United States Patent 7,560,542 (NUCLEIC ACID MOLECULE SEQ ID NO. 68811 AND OTHER MOLECULES ASSOCIATED WITH PLANTS) - sequence listing, part 6

SEQ ID NO: 31399 - DNA, 418 bp, Zea mays
  Clone ID: LIB3059-019-Q1-K1-A8
attcatagacacaccacgcgaaacacattagcaacaacctaacaacaatggctaccaagagattatccctacttgtgcttcttgcgctttatgagagcgcaacaaatgcgttcattattccacaatgctcacttgctacaagttccataattacacagtatctcccaccaattacttcaatgggcttggaacacccagatatgcacgcctataggctccaacaagcaatcgccgctagcgtctaacaacagccaatttcccaggagcaacaacaatacttggctcatataacaatacaatccatctcatcgcatcagcatctacaatttctaccagcactgagccacctagccatggtgaaccctgtcggctacttgcaacagctgatgcttgcatcaaacccacttgctatggcaaa

SEQ ID NO: 31400 - DNA, 101 bp, Zea mays
  unsure at all n locations
  Clone ID: LIB3059-019-Q1-K1-B1
cccacgcgtccgcagacgcgtgnggggtgaccaactcagttaattcctagctacttcggctgtaaacatacttgtctccgaagtttttttttttttgggct

SEQ ID NO: 31401 - DNA, 413 bp, Zea mays
  Clone ID: LIB3059-019-Q1-K1-B11
caacatacctttatcgcccttgttgtgtcaacaatcgccagccctatctttggtgcagtcattggtacaaaccatcagggcacaacagctgcagcaactcgtgctacctgtgatcaaccaagtagctctggcaaacctttctccctactctccgcaacaacaatttcttccattcaaccaactgtctacactgaaccctgctgcttatttgcagcaacaactattaccatttagccagctagctactgcctactctcaacaacaacaacttcttccatttaaccaattggccgcactgaaccccgctgcttatttgcagcagcaaatactactaccatttagccagctagctacagcaagccgtgcttccttcttgacacaacaacagttgctgccgttctaccagcagtttg

SEQ ID NO: 31402 - DNA, 399 bp, Zea mays
  Clone ID: LIB3059-019-Q1-K1-B12
cccacgcgtccggcattgctagaggtgacatgagtttcacttctactgaaccggtgctacatgtagcatctgttgatgaaccaatgctacatgtaccacgagcgggcagcgagatcaatgttgctggaccaagtgtgggcagtgagactaatgttgttggactaacgttggatcgagaggcttgtgaagttcagtcaccaccttctggtacgtcagtacatggaagcgggaaaaagaggaagaaaagtcaagttgcaagtgttttggatgactatttggagcacaagatgaaccaaacagataagactgtggaggcgttccttgagaagaagactcgtggagaggagtctatggataggtgtatccacatatttgaagctatggaggacttgacagatg

SEQ ID NO: 31403 - DNA, 404 bp, Zea mays
  Clone ID: LIB3059-019-Q1-K1-B2
cccaggaacagagcgaggcgacgccgcggcacctcttctccggcgaagggaaatggcaagcgttccaggggatctgatctggcaggttgtgaggaagaacaactccttccttgtgaagcagttcggcaacggcaatgccaaggtgcagttcaccaaggagccgaacaacctctacaacatccactccttcaaacactcgggtttggcgaacaagaagactgtgacgatccagccagctgcaaaggactcggctgtggtcctctctactaccaagaccaagaagcagaacgcacctgcgaagctcagccacaagtctgtgatgcgcaaggagttccgcaagatggccaaagctgtgaaaaacccaggttagtgacaactactacagggctgatctgaccaagcca

SEQ ID NO: 31404 - DNA, 442 bp, Zea mays
  Clone ID: LIB3059-019-Q1-K1-B3
gaggaagaagtcggtgacgaggtccgtgaaggccgggctccagttccccgtcggccgcgtcgggcgctacctcaagaagggccgctacgcgcagcgcgtcggcagcggtgcccccgtctacctcgcggccgtcctggagtacctcgccgctgaggtcctggagctcgccggcaacgctgccaaggacaacaagaagacgcgcatcgtcccgcgccacgtgctgctggcgatccgcaacgacgaggagctcgggaagctgctgaccggcgtgaccatcgcccacggcggcgtgttgcccaacatcaacccggtcctgctgcccaagaagacggcggagaaggcgtccagcggcgggagcaaggaggccaagtcgcccaagaaggccgtcaagtcccccaagaaggcatagggtttgggaggcggatcccgatgtggcatgtgt

SEQ ID NO: 31405 - DNA, 441 bp, Zea mays
  Clone ID: LIB3059-019-Q1-K1-B4
gaggaagaagtcggtgaccaggtccgtgtttgccgttctccagttccccgtcggccgcggcgggcgcgacctcatgaagggccgctacgcgcagcgcgtcggcagcggtgcccccgtctacctcgcggccgtcctggagtacctcgccgctgaggtcctggagctcgccggctacgctgccaaggacaacaagaagacgcgcatcgtcccgcgccacgtgctgctggcgatccgcaacgacgaggagctcgggaagctgctgaccggcgtgaccatcgcccacggcggcgtgttgcccaacatcaacccggtcctgctgcccaagaagacggcggagaaggcgtccagcggcgggagcaaggaggccaagtcgcccaagaaggccgccaagttccccaagaaggcatatggtttggaggcggatccgatgttgacatgtgt

SEQ ID NO: 31406 - DNA, 432 bp, Zea mays
  Clone ID: LIB3059-019-Q1-K1-A11
cgtacgcacacgcgtccggccacgcgtccgctctgtttgggcccaacatcttagcgaagaagtgaggagaaggttctacaagaactggtgcaagagcaagaagaaggctttcacaaagtatgctctcaaatatgaaaatgatgctggcaagaaggaaattcagctgcagcttgagaagatgaagaaatatgcttctgttatccgtgtcattgctcatacccagattaggaagatgaagggtttgaagcagaagaaggctcacctgatggagattcaggtcaatggtggtaccattgctgacaaggtggactatggctacaaattctttgagaaagaggtccctgttgatgctgtcttccagaaggatgagatgattgacatcattggtgtgaccaaggggaaaggttatgagggtgtggtcactcgttgggg

SEQ ID NO: 31407 - DNA, 396 bp, Zea mays
  unsure at all n locations
  Clone ID: LIB3059-018-Q1-K1-G6
attaagaccaactagcaacatataatgtacaatagtgtaccaacaatggcancgcgaggtattttgcttccttatgctccttggtctttctgcaagtgctgctaccgcgaccattttcccgcaatgctcacaagctcctatagcttcccttcttcccccatacctctcatcagcggtgtcttcagtatgtgaaaacccaattcttcaaccctacaggatccaacaggcaatcgcagcaggcatcttacctttatcacccttgttcctccaacaaccgtcatccctattacagcagttacctttggtgcatttgttggcacaaaacatcatggcacaacaactacaacaacttgtgctagcataacctgctgcctactctcagcaacagcagtttct

SEQ ID NO: 31408 - DNA, 432 bp, Zea mays
  Clone ID: LIB3059-018-Q1-K1-G7
ctctgcatctgcaggcgtcgtcgtcactcttggtggacgtagtacatcggtgcgtggagtatctgttgtttaattgcgtacgttcagttcattctgtttcttgtattctttcggttcctttcctctggtatattcatggatgatgaggtgtttctgtttaatcctctgattcacctgtaaccatgtatcatgtaacgtgcgcgtttatgtcctactgatttctgcagctgtatttattttacttgatagcttactatcgacatatgatcatgctactatcattcatatgataacaattacgtggggtgcatttgttgtcacaaatcattttttctcattatcttctttctcttttgctttctaactctttctttctacttttatcttctttcttttatttttctttctacttatttttcttttttttatttt

SEQ ID NO: 31409 - DNA, 398 bp, Zea mays
  Clone ID: LIB3059-018-Q1-K1-G8
gaataaatcggaaaagcaagatacgcctaaaattcgaagggggaagaggagaggaggggaaagaagcaaatgacggaggccccgagcaagatcgaatccatgaggaagtgggtcgtcgagcacaagctccgagccgtaggttgcctctggctaggtgggatcagcagttcgatcgcctacaactggtcgcggcccaatatgaagactagcgtcaagatcatccacgcaaggttgcatgcgcaggctctaaccctagctgcattagttggttctgcatgcgtggagtactacgaccagaagtatggttcttctgggccaaaggtggacaagtacacaagccaatatctggcccattcgcataaagattaatgttcccatgttggtttattctctttgac

SEQ ID NO: 31410 - DNA, 269 bp, Zea mays
  Clone ID: LIB3059-018-Q1-K1-G9
cccacgcgtccgcccacgcgtccgcggacgcgtgggcgcacagccttcgaggtggcttgcatctcgctcgtgggtcgatctcactgagccctcgacgctcttctctccacttcctgcgttctccatcctccttcttcgctgataggctacgccgcttgctagcctgcgcgcgccgcagcctaaccctgtgtgcaccctgttcctaaccctgcgtgtgtccaccgtcgactggcttgcgtgcgcctccacatgcgtctaacactgctagc

SEQ ID NO: 31411 - DNA, 266 bp, Zea mays
  Clone ID: LIB3059-018-Q1-K1-H1
caaaggctttggcagaatcgtaaggctactcgccagattacccctgcagagctacaaggtcgaactcatactctgaaactactcgatcatcagaatcatatacatgacctatatgatcaagtatgacactgtacactgacagtgaatataccaacatgtctaggtgattgactcatatacctttatatcctatgagaaggaccttattgagctttacagccataactctgacgatatctcatgaaaaccgacatgcgctgaatatt

SEQ ID NO: 31412 - DNA, 342 bp, Zea mays
  Clone ID: LIB3059-018-Q1-K1-H10
ccacgcgttcggggaaacgtgctgacaaacgtcacgcttagagactgccacgctgtcctccggcatttgcactgacctctccatcgcctacgacgccgcctacgaccgcacgcaccgtccttactccgctctagactacgacggtgagtacaaccgcccgtaccgcaactaggttgtgccctacatagacatcatcatcaacatgatcgccaagccgcccgcgaggtcgtctaagacggtctccaacagaggcggaggctcaggggtgggcttgacatcatgcttgagcgatacgcacttgcagaggctgagatctacggccagctcttcggcttactcaac

SEQ ID NO: 31413 - DNA, 366 bp, Zea mays
  Clone ID: LIB3059-018-Q1-K1-H11
cccacgcgtccgcccacgcgtccgcccacgcgtccgggtcagacgagtgggcgatctgcggtggaactggagtgttcgcgatggcgagaggcgtcataaggagaacgtttcttgccgacacgagcggcgggaactccgacgagcttgccgtggaggttctctgcccggtgttccgcccggcggcgtttggctcatcgtcgtcacagccagcagcaaaggacatcagctccaccgtcgtcgtcaccaaggtcggagtgtggggtggagagggagggtcggcgcaggacatcgtgacgacggatccgtcgaggcgtctgcagagcctgaccgttcgtgctgtctttgccgtggacttcattgagttta

SEQ ID NO: 31414 - DNA, 424 bp, Zea mays
  unsure at all n locations
  Clone ID: LIB3059-018-Q1-K1-H12
gaccaactagcaacatagaaagcacaatagtgtaccaacaatggcagccaaaatatttggcctccttatgctccttggtctttctgcaagtgctgctaccgcgaccattttcccgcaatgctcacaagctcctatagcttcccttcttcccccgtacctctcaccagcggtgtcttcggtatgtgaaaacccaattcttcaaccctataggatccaacaggcaatcgcagctggcatcttacctttatcacccttgttcctccaacaatcatcagccctattacagcagttacctttggtgcatttattggcacaaaacatcagggcacaacaactacaacaacttgtgctagcaaaccttgctgcctactctcagcaacagcagtttcttccattcaaccaactntctgcattgaactctgct

SEQ ID NO: 31415 - DNA, 417 bp, Zea mays
  Clone ID: LIB3059-018-Q1-K1-H4
gtttgttcgtctgacataacaatagatgacggcatgcaggaaaatgtgacaagtggtgctattgtaccatctcaagttcatatactagattcgaatccttccgctacagcacatgaagtcaacattgtcggtagcataaacgatgatgacgaaaagagtcaggatggaaaaagcagtgcagatcttgcttcatacgaggtaaaagagatggttgtcaaggataactttgaagaaaagcagcagaccgaagaggtcattgtagatcccactccacatgaagccaacaactttcccagtaccgataatcacgaggaaaatgagcagaacaaagaaattgttgcagacaccacttcacacaagataagtgctgtacaaagcatgggtagtactgaagaaaaggaacatattgaagatttc

SEQ ID NO: 31416 - DNA, 395 bp, Zea mays
  Clone ID: LIB3059-018-Q1-K1-H5
caaaattcctgagtcatttgacaaagcttttcagtattcaaaagatggaaatcagttgaccactgcaagctctgtgaaacaagccattgaacctcttaaaaaatgtggggtcagtgatggagagatatgcatgatagcaaacattgggcctgagaccgttgaagaggtttacgcactagtgccatctctcaaggctaataggtcagctatcgaaggttcagtcaccgaggttcttaccgccctcgcaaacataaaagctgctaagtgaatctccaatggaactagaccgacaataaatcggaagcagctgtcttgttgatcgaggagcgcggaatctgcaaactggcccttcagtgttttggatgtgctgcggaaacgtgttatgatgtgtatat

SEQ ID NO: 31417 - DNA, 225 bp, Zea mays
  Clone ID: LIB3059-018-Q1-K1-H6
caacaacacatcatcattggttctcctcttttaaatagccaattaattgtaatgcaatgatcaattcattctcatgcaaacaagccattaaacctcttaaaaaatgtcggcccatctatagaaacctatccatcatacccaaccttgcaccttataccgtttaaatgtttacgcactaattccatcactcaccgctaatatttcacctatcgaatgttcaatcac

SEQ ID NO: 31418 - DNA, 415 bp, Zea mays
  Clone ID: LIB3059-018-Q1-K1-H7
cgcattcgatccaactcctgagcactttctcctcgtccccgacaagccaatcgaaggggagatacggccatggactccaccggcaccggagcagggggtaaggggaagaagggagcggccgggcgcaaggtcggcgggccaaggaagaagtcggtgtcgaggtccgtgaaggccgggctccagttccccgtcggccgcatcgggcgctacttgaagaagggccgctacgcgcagcgtgtcggcaccggcgcccccgtctacctcgccgctgtcctcgaatacctcgccgctgaggttctggagctcgctggtaatgctgccagggacaacaagaagactcgcattattccgcgccacgtgcttctggcgatccggaacgacgaggagcttgggaagctgttgggcggcgtgacca

SEQ ID NO: 31419 - DNA, 441 bp, Zea mays
  Clone ID: LIB3059-019-Q1-K1-A1
cttggtctttctgcaagtgctgctaccgcaaccattttcccacaatgctcacaagctcctatagcttgctttcttcccccatacctctcaccagcggtgtcttcagtatgtgaaaacccaattcttcaaccctacaggatccaacaggcaatcgcagcaggcatcttacctttatcacccttgttcctccaacaaccgtcagccctattacagcagttacctttggtgcatttgttggcacaaaacatcaaggcacaacaactacaacaacttgtgctaggaaaccttgctgcctactctcagcaacagcagtttcttccattcaaccaactggctgcattgaactctgctgcttatttgcaacaacaactaccattcagtcagctagctgctgcctacccccagcaatttcttccattcaaccaacttgcagcattgaac

SEQ ID NO: 31420 - DNA, 419 bp, Zea mays
  unsure at all n locations
  Clone ID: LIB3059-019-Q1-K1-A10
agttcagacactaaaatcaactcaagctatgggtgatgccatgaagggcgttacaaaggcaatggctcaaatgaacaggcagctaaatctgccagggttgcagaggataatgcaagagtttgagcggcagaacgagaggatggagatggtgagcgaagtgatgggagatgccatagatgatgctttggaaggagatgaggaagaagaagaaactgaggagcttgtgaatcaagtacttgatgaaattggcattgatatcaaccaagagcttgttggagccccgtcggccgctgttgctcaacctgcttcagcgggaagggttgcccaggctgaaagtgctgggaatgctgacactggaatcgacgccgatttgcaggcaaggctggacaatctgaggagaatgtangtgctacaccagc

SEQ ID NO: 31421 - DNA, 422 bp, Zea mays
  Clone ID: LIB3059-018-Q1-K1-G5
cagaagtacatactagcttactttctgttggtcaggaatgagtacttctctggggaggcgaagaaacactcagatgtgttctgtgatatttcagaattagatttctttctatatgctacagatttggatagtgaagaacttgaactgaaggagcagaaacccattacgaaggctcaatcaggaggtgattcaagtggcaacagatcgaatgattgctacttccccggccttcatgatgatctgtctcaagactgccttgcttgggcaagcatatcatactacccttccctttcttgtctgaacaaaagattcaatttgttaattaacagtggatatttttactgactgcttaatatatattgtattgttgagctctgttttatttatctttttatttttatctctattaatctttttttttt

SEQ ID NO: 31422 - DNA, 431 bp, Zea mays
  Clone ID: LIB3059-041-Q1-K1-A4
gatgaatggacttgctctgatcctatgtgtgtgtggctatgcttgtgctcaatggtgggcacttttcagttaaagttttgtagtgctgtctgtcagttgctgcctcaaacttggaatactacttctgtttggcacctgaactgcttatcaaaaactttatgtataccagttacattccacttttaaccttcatattagtattaccatattataactgtcttttcagtatttagtacttactattcatggtgacttgcacctttctagttacatggagtgaagatatgctggctgatatgcggtcaacatgcacgtagcttactgttgaagttgatataatctgtgctgtttgcgttgctgatgatgatggctgatgagatgatggaactgcagctgactgcacaagttgctgctgtctgcacctattatgc

SEQ ID NO: 31423 - DNA, 418 bp, Zea mays
  Clone ID: LIB3059-041-Q1-K1-A5
ctcttggtccagcacttaaagcagctttcatggttatgagtcaaattggggggaagttgcttgtcttccagagtactttgccatctcttggtattggtcgtttgaggttacgaggagacgatgtccgtgcatatggaacggataaggagcatactctgagggtaccagaagattccttctacaaacagatggctgctgaattcacaaaatatcagattgcagtggacatattttctttcagcgataagtactcagatatagcgtctttaggatctttggcgaagtatactggtggtcaggtgtaccactatgcatcattccagacacctacacatggtgacaaacttaaacttgagcttagtagggaccttacacgagagactgcatgggaatctgttatgcgtatcagatgtggaaa

SEQ ID NO: 31424 - DNA, 407 bp, Zea mays
  Clone ID: LIB3059-041-Q1-K1-A7
gtgctctccgcctgcggcctctgtatcccgcaaccaaaaactacccccaaaagaagaagaaaaccccaaatcctcgagatctatcagtatcgagcgacttaccaatccgattgctagggtttagtttcgaaaaaatctgaaaaaaaattctggtcgaggggaggaggcgatgtcggcgcaagtggcggtggtgcctaatgggggcccgggcgctgtccccgcggtggtgtcgccgggagctgtcggcgtggctcagcctctcccgaccacgtcgctctacgtgggcgacctggagggggccgtctcggactcgcagctgtacgaactcttcagccaggcggggcaagtggtgtcggtgcgcgtctgcagggatgtcacctcgcgccgctcgcttcgatacgcctacg

SEQ ID NO: 31425 - DNA, 419 bp, Zea mays
  unsure at all n locations
  Clone ID: LIB3059-041-Q1-K1-A8
ggagctctgggcagcgtgcgcacgtggggtacctagctcgctctgctagcctaccatggctgatcaccaccggggcgcgacgggaggtggcgggggctacggcgacctccagcgcgggggcggcatgcacggcgaggcgcagcagcagcagaagcagggcgccatgatgacggcgctcaaggccgcgacggccgcgaccttcggcgggtcgatgctggtgctgtccgggctgatcctggccggcaccgtgatcgcgctcacggtggccacccccgtgctggtgatcttcagcccggtgcttgntcggccgccatcgcgctggcgctcatggcggccgggttcgtcacctccggcggcctcggcgtcgctgcgctgtccgtgttctcctggatgtacaagtacctgacgggcaagcaccc

SEQ ID NO: 31426 - DNA, 280 bp, Zea mays
  Clone ID: LIB3059-041-Q1-K1-A9
gcgacaacgggaccacggtgttcgactacgtgctccgtgcggagcagctggtcatcgtaccccagggctacctcgtcgccaccaaggcgcagggagaaggcttccagtacatcgccttcgagacgaaccctgacaccatggtcagccacgtcgacgggaagaactccgtcctgagcgacttgcacggccgcgtcatcgccagctcgtatgccatctccatggaagaagctgcagagctcaagaacggtaggaagcatgagctggctgtgcttactcctgc

SEQ ID NO: 31427 - DNA, 422 bp, Zea mays
  Clone ID: LIB3059-041-Q1-K1-B1
ctcggaatgacacgccaatcagccagaatgagatcagaatcactactcaggggaggatgaggaactatatcagctatgggatgtcgctgcttgaggaaaatggacatgatgagattagtatcaaggccatgggacgggccataaataagacagttatgggtgttgaattgatcaagagaagggttggaggtcttcatcagaacactgctactgaatctgttgatatcacagacacatgggaacctttggaagaaggccttctcccactagagacaactcgccatgtgtcgatgatcactgtgacactgtcaaagaaccctctggatacatcatctccaggataccagccacctatcccagctgaagaggtgaaacctgcttttgactatgatcatgaagaatcgtatcccactggtcgtgga

SEQ ID NO: 31428 - DNA, 397 bp, Zea mays
  unsure at all n locations
  Clone ID: LIB3059-041-Q1-K1-B10
cccacgcgtccgaaaaaatcagcgagaaccctggttttctttttttgtttagcggggggcgcaagagcaagctgcaagcagattacagggccacgaagctcgcccctgctctgctctctatcctattagtcctcgaattgggctttcctctgctgcggggttctggtctcgtctgggtttcagacgccagatttggagcagaggacaccggtccttggtttccttgccgccttgccggctgcaatgttatggcgcttgcggngttatgtagagcctgaattctgtgatgacggngaagttcgcgtcgttgggagattttttctgtgctttctcttttcttagctgagaaatttggtgctatttggtgctcgccgacgccgagccggagggcgtaatc

SEQ ID NO: 31429 - DNA, 407 bp, Zea mays
  Clone ID: LIB3059-041-Q1-K1-B11
cacccaaatacagatttgttgtgcgatttaccaacaaggacatcactgcccaaatcgtatctgctagtatagcgggtgatatggttcttgcttctgcctactcgcatgagttgccacgatatggtcttgaagttggtctgaccaactatgcagctgcctactgcactggccttctgttggctcgccgtgtgctcaagatccgtggtttggatcatgagtacgagggcaatgttgaggccactggtgaggacttctctgttgagccagctgatgagaggaggcctttccgtgctctcttggatgttggccttatcaggactacaacaaggaaccgtgtctttggtgccctcaagggagcattggatggaagcctggatattcctcacagcgagaaaaggtttgctgga

SEQ ID NO: 31430 - DNA, 417 bp, Zea mays
  Clone ID: LIB3059-041-Q1-K1-B12
gcaagtgacccggacagaattagattcatttgaggattatgctgctgattatgtcagagtatttgatagactctgtatcatctggaagcccaacttgcctcactaaagtccttggtctttatcagatcactgccaagaatttgagagatgggaaagagctgaagatggatgtaatggtcatggaaaacctatttttcaagagaaaggtatcaagaatatatgacctaaagggttctttgcgttcccgctacaaccctgatacttcagggaacaacaaggttctcttggatcttaatctgttagagacacttcacacaaagcccatttttcttggaagcaaagcaaaaagaaggctagaacgagctgtctggaatgatacttcttttctggcatcggtggatgtgatggactactctc

SEQ ID NO: 31431 - DNA, 430 bp, Zea mays
  Clone ID: LIB3059-041-Q1-K1-B2
cccacgcgtccgcggacgcgtggggaagcggcggcggcggagcaaacgcaggcgaaggcgagggtgtgagggaaggagcaccagccatggtgcacgtcaacttctaccgcaactatggtaagacgttcaagaaaccaaggcgtccttatgagaaggagcgtcttgatgctgaactgaagctggtcggtgagtatgggctgaggtgcaagcgtgagctttggagggtccagtatgcactgagcaggatccgtaatgctgcaaggcacttgctcacccttgacgagaagaacccccgtcgtatctttgagggtgaggcgcttcttcgccgcatgaaccgctatgggctgcttgctgagggtcagaacaagcttgattatgttcttgccctcaccgctgagaacttcctcgcaaggcggcttcaaacacttgt

SEQ ID NO: 31432 - DNA, 287 bp, Zea mays
  Clone ID: LIB3059-041-Q1-K1-B3
cccacgcgttcgaaaaaaaaaaaaaaatataataaaaaaaaaaaaaaaaaataaaaaaagaaagaatataaaaaaaaaaaaaataaaaataataaaaaaataacttatacttaaaatattataaaaaaatttaaaaaatcaatacatacttataaataatgaaaatcttgatgctaaaactaattataattcaaaaaatattaaatataagtaaattattaaactttttaaaatttcattatttaatgaatttgattcataatcctttattgcactttattatcatt

SEQ ID NO: 31433 - DNA, 437 bp, Zea mays
  unsure at all n locations
  Clone ID: LIB3059-041-Q1-K1-B4
cccacgcgntccggngcnttacctgacttggaggggccgtacccaaaattttcaagatccatgcacgtgccatgaactgtgagcgagatattcgtttcgagcttctggcacggctctgccccaactctactggagctgatataaggagcgtttgcacagaagccgggatgtacgccattcgtgcccgcaggaaaacggtgacagaaaaggattttctcgatgctgtcaacaaggtcatcaagggctaccagaagttcagtgcaacacccaagtatatggtgtacaactagtcggcgtgtcttcatgggatctgttgtttctagaaactctggatctttttcatggttgtatcatcatgagattctctatgcaaaagttgttgtttgtttagcaaattggatgcccaatggaattggttcctgtaccgcatgttttta

SEQ ID NO: 31434 - DNA, 396 bp, Zea mays
  Clone ID: LIB3059-041-Q1-K1-B5
ctgacacttccccaagttgtagcagagttggaatgtcatgaaaactttaattgatccggtcctgttccggggaacaaggttttgccaattctgccccttccggggaactgagattaatttgtccttgctgtaatgtttagccaatcctgccccgatccggggaactgagagattgtctttatcgcaacattaacagctagcggttagtatcatcttccagtcacctggaatgttactagtagtacaatccagttgtctgtttcctgccgcttacatgtaaaagtccatattcaagttttacagaaagaaacatgttctgacatttattacaaaatataccaaacaactataccagctgaaaaagtgaaaacctgcttttgactatgatcatgaaga

SEQ ID NO: 31435 - DNA, 409 bp, Zea mays
  unsure at all n locations
  Clone ID: LIB3059-041-Q1-K1-B6
cccacgcgtccgctcgagtggctaagatgttaggtgatgaatatggtactgcttcgagcatcaagagtagagttaatcgtcaatctgtgttggctgccatcacctcagctcagcagaggttgaagctctacaacaaagtgcctcctaacggattggttctgtacactggaactattgttactgaagacggaaaggaaaagaaagttactattgattttgagccattcaagcctatcaatgtatcactctacctttgtgacaacaagttccacactgaggctttaaatgagctcttggaatctgatgacaagtttgggttcattgttatgggtggtaatggtactctntttggcacactaagtggcaatacccgtgaagtgcttcacanattcactgttgacctcccaaa

SEQ ID NO: 31436 - DNA, 418 bp, Zea mays
  unsure at all n locations
  Clone ID: LIB3059-041-Q1-K1-B7
agcatttcaagctaacacattttgaggaggtatttacaacccaccattggatggtccgcatatataaactgaaaccccagaagaacagggttcgaggcaagctgaagaagttgaaggccagtgccaaaactagttccacacttgcggccgggcgaaagaacccgtggcaatagatgaagttaccaatagtgtcatttacctgatactttgttggtagatcaagtgcactaggttggtgaaccagaaaaccacagaactagattagagatctggactattgtattgcaccctcgttatatgttgtcgcaaccggccgggtgctgatgaaatttttgatagaccagaggagtttatcaatcccatgggtttggcggcgataattttctagtgacaggggttgnttaagactaccctgtac

SEQ ID NO: 31437 - DNA, 202 bp, Zea mays
  Clone ID: LIB3059-041-Q1-K1-B8
cttcagcagcaccagcatcagcaacaacatcatcagtagcagtgcagcaccagcattggcagcaccagcttctccagttcctgcacacacaacagcagattctccagaagcaccagtttctgtttgttcttctgttttttctctcccagcaccagcttgtactgcacttacagttaaaagattattactaacgttgtgtgcc

SEQ ID NO: 31438 - DNA, 439 bp, Zea mays
  Clone ID: LIB3059-041-Q1-K1-A3
ggaattcccggctcagacctacctggacggcgaggagctggactgacggatcatttcatggatctaagcccaatcccgtggggggggttgatgcagcggcggtgggtacagtggtggccgtggaggcggcggctacagcggtggcgggcgccgtgatggcggcggcggctacagcggtggcggcggctactgtggcggcggcggctactgtggtggtggcggcggctacggccgtggcaaccgtggcggcggctactgcaactccgacgggaactggaggaactgagcggtggggcccgcgcggccaagttatcctgttcgctgccgtgatgtttaccctagtccagagggtttatcttcgttcgtctcgtgtttgttgttgcccatctgtgtttttgattgcaaggtcgctctgtgtcagatgataatgctgtgttta

SEQ ID NO: 31439 - DNA, 301 bp, Zea mays
  Clone ID: LIB3059-040-Q1-K1-H1
cattgaacatgtgactatttaataaaactctgtcagaatggaggagctgaaaaacatgggggcaacatgttattaggaaaaaatttaatgaaaacaaggaccatgagcattctggtagcctagatgacaccgatcgtaacagaccaaccaataatgataatgaatacgcttcctccgcgaatgatggaggtgatggcagctggaaatctcagagaaagaaaagagagaaagaagatgatgaaactgacctcgaaaatggtgatccttcttctacatcaaagaacccaagagttgtttggtc

SEQ ID NO: 31440 - DNA, 471 bp, Zea mays
  unsure at all n locations
  Clone ID: LIB3059-040-Q1-K1-H4
tactggtctcggaattgccgcgtacccgcgactcctcggacgcgtgggcggacgcgtgggagcaatttcaacgctgtcattctcaagaggcttgtcatgagtaaaaccaaccgaccaccaatctctatgcgccgccttgtcaagtttatggaaggaaaggagaagaacattgctgtcattgttggcacagtcacagatgacaaaaggatccaggaggttccagcaatgaaggttactgccctgaggttcacggagacagcaagggccaggattgtcaatgctggtggcgagtgcctcacatttgaccagcttgctcttcgtgctccacttggcgagaacacggtcctcttgaggggccccaagaatgcccgtgaggcagtgaagcactttggcaaggctcctggagtgccgnacagccacaccaagccgtatgtgcgctccaagggaaggaagttcgagaaggctcgtggc

SEQ ID NO: 31441 - DNA, 446 bp, Zea mays
  Clone ID: LIB3059-040-Q1-K1-H6
gtcctcggacgactcgtccgcgacgccaatggaatgtcgatgccgttggcggcggggttcgggggccaggcggcggcgcgcgaggcggccgggctggcggtcgacatgatccgccagaagaagatggccggtcgcgcgctgctccttgcgggcccgcccgccacgggcaaaacggcgctagcgctcggcatagcgcaggagctcggcagcaaggtcccattctgtcctatggtaggatcagaagtgtactcctcagaggtcaagaaaactgaggtgctgatggaaaatttccgtagagctataggtttgcgtataaaggaaaacaaagaggtttatgaaggagaggttattgaactttccccagaagaggctgagagcacaactggtggatatgcgaaaagcattagccacgtaatcattggcttaaagactgtcaaagggactaa

SEQ ID NO: 31442 - DNA, 428 bp, Zea mays
  Clone ID: LIB3059-040-Q1-K1-H9
tcccgtctcgaggcacgcgtacgccaacatagaaagcacaatagtgtaccaacaatggcagccaaaatattttgcttccttgtgctggcttatctttctgcaagtgctgctaccgcaaccattttcccacaatgctcacaagctcctatagcttactttcttaccccatacctctcaccagcggtgtcttcagtatgtgaaaacccaattcttcaaccctacaggatccaacatgcaatcgcagcatgcatcttacctttatcacccttgttccttcaacaaccgtcagccctattacagcagttacctttggtgcatttgttgacacaaaacatcaatgcacaacaactacaacaacttgtgctaagaaaccttgctgcctactctcagcaacagcagtttttttcattcaaccaacttgcttgcat

SEQ ID NO: 31443 - DNA, 354 bp, Zea mays
  Clone ID: LIB3059-041-Q1-K1-A10
cccacgcgtccgcccacgcgtccgcccacgcgttcgcccacgcgtacggagccctgggaccttcttgatacaaccacagttgttgccgttctaccagcacgctgcgcctaacgctggcaccctcttacaactgcaacaattgctgccattcaaccaacttgctttgacaaacccagcagcgttctaccaacaacccatcattggtggtgccctcttttagatttcttatgagttatagttcaataataaagttgtttgtctgatgtttgtggcttcccagaaataagaacgtacatctctagattctaacaaaaaaagcccaacagtaggcacagtctcaaaaaaatattcccg

SEQ ID NO: 31444 - DNA, 429 bp, Zea mays
  Clone ID: LIB3059-041-Q1-K1-A12
cccatacctctcaccagcggtgtcttcagtatgtgaaaacccaattcttcagggcctgcaggatccaacaggcaatcgcagcaggcatcttacctttatcacccttgttcctccaacaaccgtcagccctattacagcagttacctttggtgcatttgttggcacaaaacatcaaggcacaacaactacaacaacttgtgctaggaaaccttgctgcctactctcagcaacagcagtttcttccattcaaccaactggctgcattgaactctgctgcttatttgcaacaacaactaccattcagtcagctagctgctgcctacccccagcaatttcttccattcaaccaactggcagcattgaactctgctgcttatttacaacagcaacagctaccaccattcagccagctagctgatgtgaaccctg

SEQ ID NO: 31445 - DNA, 395 bp, Zea mays
  Clone ID: LIB3059-041-Q1-K1-A2
caagcaccaagccatgtacttcccatgctcttgggtcacacttggccatcatgcttgagggcgcatagacggcattggtgatttcaggaacagagagctgctcatggtaagccttctcagcagagattacaggggcatatgaggaaagcatgaaatgtatacgtgggtatggaacaaggttggtctggaactcggtgacatccacattgatagcaccatcaaacctcagggaggtggttagagatgatatgatctgtgagatcagcctgttcaagttggtgtaggttggcctttcgatgtcaagggacctcctgcatatgtcatagatagcctcgttgtccaggaggactgcaacatcagtgtgctcaagcaaggagtgggtggagaggacactg

SEQ ID NO: 31446 - DNA, 281 bp, Zea mays
  Clone ID: LIB3059-040-Q1-K1-F4
acaatctcctatatcttacctccttctctcatacctcttaccaacaatttcttcaaaaattcaaaacccaatttctcaaccctacactatccaacatttcaatcactatcattcatcttaccattatcacccttattcctcctacatccttctatcctattacatcaattacctttcttccatttcattccacaaaacattattacacatcaactacaacaacattttctaactaaacctttcttcatactatcatcaacttcattttcattcattctacc

SEQ ID NO: 31447 - DNA, 428 bp, Zea mays
  Clone ID: LIB3059-040-Q1-K1-F5
agcgtacaacctccaacatgacctacaaggcctggcggcgtgagcctgaggagggagctataatgtactgcagccgcactatttttgaggatgctacacctgaactggttagagatttcttctgggatggtgattttcgtctaaagtgggatcccatgcttgcatactccaaatctttggatgagttccctcagaatggagcaacaattgtccactggataaaaaagttcccattcttttgcagtgaccgtgaatacatctttggaggacgcatatgggaatctgggaagacttactattgtgttacaaagggtgttccatatccatcattgcccaagaaagaaaaaccaaggcgtgtggagttgtacttctcaagttggcgtattagagctgttcaatcgcctaaacatgtgggtcagcaatctgcg

SEQ ID NO: 31448 - DNA, 240 bp, Zea mays
  unsure at all n locations
  Clone ID: LIB3059-040-Q1-K1-F6
tctagccacacatccaagcttacaacctccaacatnacctttttctcctcactacntaaccctaataaagttgttatattaaacatttttcgcgccataaaacaccatactacacattaactatctacatatttcttcttaaatcatatattctcatctaaaaccactatcccattttttcatactcaaaatctaaaaatcattatccattataatcaaacatcaattaaccactttata

SEQ ID NO: 31449 - DNA, 437 bp, Zea mays
  Clone ID: LIB3059-040-Q1-K1-G3
cccacgcgtccgcccacgcgtccgtgatcataggtattagtgaagttgatcccatagggtggcctggatcaaaatggaaatctctcctgataaagtgggatggtgctactaagtacagccaccagaatagagtatctccatgggacatcgagggagttggcagctcagttttagttactcaccgtctttcctcttctgtttcgaagcgaacaaaactgtgcttccctccaagcgatttgaacacaccaattctagatggaaatggtcgtccagactccgtggaaactgaacgtttccacagggtcttgcagggtcaaaaatggtgccaccctaatatcaatgtgcctcatggctttaatcatcaaatagccccaaaagtcaagggctctaatgcaaggagattctctgctgatgtgtggaactgcaagatgaatgat

SEQ ID NO: 31450 - DNA, 291 bp, Zea mays
  Clone ID: LIB3059-040-Q1-K1-G6
accaaaaattctatcaatatcccatctacattttaatttatgtccttttaaaatatcatcatccacctactcctcacactctcaacctccatactactctacaacctcccttctcccacccccaacacctacaccttctacattcttttactaaaccatccaaaacaactacttccctaactaccactcttactataccatccttaccttcatcatctaacctctcctactcataccatatctcaaaattatatacttcctttatctcacatacatacctttctacttact

SEQ ID NO: 31451 - DNA, 429 bp, Zea mays
  Clone ID: LIB3059-018-Q1-K1-E7
cggcacctcagatccggcctccccctcctccgcgcccacctcgcatcctccgaatccgcggccgtcgctcaggtttcgaggggcttcgcgtcgcaggccgccaagcccaccgggaaggagatcaaggttccaaaggctctgtttggcggcacaggcaactatgccagtgcactgttcctcacagcagctaaatctaatgcattggacaaagttgaatctgagattaaagctattgtagaggcttccaagaagagcccgttgttttctcaattcataaaggacttgtcagttccaaaagcgaccagggtgaaggctatagccgaaatatttgctgacgctgggttttcagatgttacaaagaatttcttggctggcctggcggacaatggcaggctgaaatatattgaacgcattgcggaaagatttgtt

SEQ ID NO: 31452 - DNA, 263 bp, Zea mays
  Clone ID: LIB3059-018-Q1-K1-E8
cccacgcgtacgcggcgtgattcacctgtccgtgggcgaccgcgtggcgctgggaccgtgcgttagctgctggcgctggcgccactgcaagggcaggcggtacaacctgtgcgaggacatgaagttcttcgacaccccgccggtgcacggctagctggctaaccaagtggtgcacccggcacgacctgtgcttcaagctcctcgacagtgtgagcctgtaagagggcaccatgtgctaaccgtttagcgtggacatgcacgct

SEQ ID NO: 31453 - DNA, 268 bp, Zea mays
  Clone ID: LIB3059-018-Q1-K1-E9
aaaaaaaaaaaaaaaaaaaaaaaaaaataaaaaaaaaaaaaaaaaaaaaaaaagaaaagaaaaaaaaaaaaaaaaaaaaaaaaaaaaaaaaaaaaaaaaaaaaaaaaaaaaaaaaaaaaaaaaaagagaatgcattaaaaaagacataaacaatacttacaacaagaataaaataaaaaggccatgaaactaagacaaaacttaaaaaaaaaaaactcttatctaaaaaaatacataacatgaaaaacataaacaatacataaataaa

SEQ ID NO: 31454 - DNA, 360 bp, Zea mays
  Clone ID: LIB3059-018-Q1-K1-F1
caaccaccatgaatacaagaaccttttgaaagacctaatcattcagggtttgctccgggtgaaagagccagcagtattgctccgttgccgcaaggatgatcaccatcatgtggaatcagtgctgcattcagcaaagcatgagtatgcatcaaaagcagatgtccatgaaccagagatatttgttgatcatgatgtatacctgccacctgccccaagccatcatgatgctcatggccagttttgctctggaggtattgtattggcttctcgagatggaaagattgtgtttgagagtacacttgacgcatgactagaaagtgttttccgcaagaaattgccagagatccggaagcttctttt

SEQ ID NO: 31455 - DNA, 399 bp, Zea mays
  Clone ID: LIB3059-018-Q1-K1-F10
cggacgcgtggggggcaatgcacctacatacctgcaacaacaattgttgcaacagagtgtaccagctctgactcaactagctgtggcaaaccctgttgcctacttgcaacagctgcttccattcaaccaactgactctgtcgaactctgctgcgtacctacaacagcgacaacagttacttaatccattggtagtggctaacccattggtcgccgccttcctacagcagcaacaattgctgccatacaaccagttctctttgatgaatcctgtcttgtcgaggcagcaacccatcgttggaggtgccatcttttagattacatatgagatgtactcgataatggtgccctcataccgacgtgtgtttcctagaaataatcaatatattgattgagattt

SEQ ID NO: 31456 - DNA, 221 bp, Zea mays
  Clone ID: LIB3059-018-Q1-K1-F12
gttcttcgccaccccgccggtgcacggctcgctggcgaaccaggtggtgcaggcggggcgacctgtgcttcaagctccccgacggtgtgagcctggaggagggcgccatgtgcgagccgctgagcgtgggcgtgcacgcgtgccgtcgcgcgggggtggggcccgagacgggcgatctcgtggtgggcgcctagctccatctacctggtgtcgattctagt

SEQ ID NO: 31457 - DNA, 300 bp, Zea mays
  Clone ID: LIB3059-018-Q1-K1-F2
cagccaccatcaatacaacaacctttttcactacctaatcattcaagctctgctcccgctgagatagccagcattattgctccgttgccccaaggatgatcaccatcatgtggaatcagtgctgcattcagcaaagcatgagtatgcatcaaaagcagatgtccatgaaccagagatatttgttgatcattatgtatacctgccacctgccccaagccatcatgattctcatggccagttttgctctggaggtattgtattgtcttttctagatggaaagattgtgttttaaagtacact

SEQ ID NO: 31458 - DNA, 435 bp, Zea mays
  unsure at all n locations
  Clone ID: LIB3059-018-Q1-K1-F3
gtgatttcgaccttgcagccacctttttttgttctgttgtgtatctagtagttggaggagagatgcagtttgcacttgcattggacacgaactcaggtcctcaccagataagatcttgtgagggtgatgggattgacaggttggaaaaattaagtattgggggcagaaagcaggagaaagctttgagaaataggtgctttggtggtagagttgctgcaactacacaatgtattcttacctcagatgcttgtcctgaaactcttcattctcaaacacagtcctctaggaaaaattatgctgatgcanaccgtgtatctgctatcattttgggcggaagcactggatctcagctctttcctctgacaagcacaagagctacgcctgctgtacctgttggaggatgttacaggcttattgatatccctatgagtaact

SEQ ID NO: 31459 - DNA, 332 bp, Zea mays
  Clone ID: LIB3059-018-Q1-K1-F4
atcaaaagcttcttgggattccttcataaaagattaatgtccatggaggagctgtgtgtctagggcatcctcttgggtgcagcggtgctcgcattttggtcacccttcttggtgtccttagggaaaagggcggcaagatcggtgttgctggtgtctgcaacggcggaggtggagcatcagctcttgttctcgaactcgcataagaagcattggcttgaagcactggatatgtaattaattcagtcgcatgcatctatgcatgatgaagtattgaaaaaaaaagaccctacgatatccatgccgggtgccactgtctgcttaattcaacagaa

SEQ ID NO: 31460 - DNA, 417 bp, Zea mays
  Clone ID: LIB3059-018-Q1-K1-F5
gttggttgaatggaagaaattgtctacattgaaccgtgctgcttatttgcagcggcagctattaccattcagccagctagctactgcctactctcagcaacaacaacttcttccatttaaccaattggccgcactgaaccccgctgcttatttgcagcagcaaatactactaccatttagccagctagctgcagcaagccgtgcttccttcttgacacagcaacagttgctgcctttctaccagcagtttgcggctaaccccgcaaccctcttacaactacaacaattgttgccctttgtccaacttgctttgacaaacccagcagcctcctaccaacaacacatcattggtggtgccctcttttagattgcttattagttgtaattcaataataaagtttttttggatgatgtatg

SEQ ID NO: 31461 - DNA, 377 bp, Zea mays
  Clone ID: LIB3059-018-Q1-K1-F8
cggacgcgtgggtagcaacatagaaagcacaatagtgtaccaacaatggcaggcaaagtatttcgcctccttatgctccttggtctttctgcaagtgctgctacggcgaccattttcccacaatgctcacaagctcctatagcttcccttcttccaccgtacctctcaccagcggtgtcttccgtatgtgaaaacccaattcttcaaccctataggatccaacaggcaatcgcagctggcatcttacctttatcacccttgttcctacaacaatcatcagccctattacagcagttacctttggtgcatttattggcacaaaacatcatggcacaacatctacaaccaactgtgctagcaaaccttgctgcctactt

SEQ ID NO: 31462 - DNA, 393 bp, Zea mays
  Clone ID: LIB3059-018-Q1-K1-F9
ggcttactagttgatgatattatggggtacaaaatctatactcatgaattacgctcgggatatgctgcaaggattgataattgtaggagctatgataccgtgagcaaagatgtaattcaaaggtggacatatcctatggtgcctgatgtagtatccagtcatgatattctaggatagtagacttcataggcagggaatatacagggcatcaaatgtaacattgtcaccttcttcacaaatctaagcatattctattgacgctagtgtgactagattagcaggtcactgcaatggaagtaattcagttattgatcatggctacataattgcgaaagatgaacatattaaatgctcatgtatatagcacaatgatatattaggctatgcatgcaa

SEQ ID NO: 31463 - DNA, 230 bp, Zea mays
  Clone ID: LIB3059-018-Q1-K1-G1
ctcgataatggtgccctcattccggcatgtgtttcctagaaataatcaatatattgatggaaatttatctcaatataaaaaaaaaaaaaaaaaaaaaaaaaaaaaaaaaaaaaattaaaaaaaaaaaaaaaaataaaaaaaaaaaaaaaaaaaaaaaatcaaaaaaaaaatacataaaaaataaaaaaaaaataaaaaaaataaaaaaaatgtttaatttttaaatattt

SEQ ID NO: 31464 - DNA, 379 bp, Zea mays
  Clone ID: LIB3059-018-Q1-K1-G10
ggatgttgctaagcagctcaaggaacaacaaatggtgatgccaggacatcgggagtgaaacttgcagaaggaactgaaccgatacatccccactgctgctgcatttggtggagtatgcatcggcgcattgactgtcctggctgatttcatgggtgcaattggttcaggaactggaatactgctggcagtgacaatcatataccaatacttcgaaaccttcgagaaggaaagggcaacggagcttggtatcttcggtttttgattagtagctgtggaaccttgaactgatagctgaattttcttgtaaggccctgtacggaagcaacccggttttttagaaaccagttcttatatttgagctaggagaggccaacttcat

SEQ ID NO: 31465 - DNA, 325 bp, Zea mays
  Clone ID: LIB3059-018-Q1-K1-G11
cccacgcgtccgcggacgcgtgggggctgcgccggcgtgctcgtgatctcaggccaggtcgtgcctccgctccggtcacccgtcgctccacgcaaccatgtcgaggaggaagaccagggagcccaaggaggagaacgtcacccttggacccactgtccgtgaaggagagtatgtctttggtgtcgctcacatctttgcatccttcaatgacaccttcattcatatcactgatttgtctgggaggtaaactctggttcggatcaccggtggcatgaacgtgaaggctgaccgtgacgagtctgtaccttacgctgttatgcatgct

SEQ ID NO: 31466 - DNA, 333 bp, Zea mays
  Clone ID: LIB3059-018-Q1-K1-G12
cccacgcgtccgcccacgcgttcgcctacgcgtccgcccacgcgtccgcaagctgatgtcggcctgtgtggatttgagggttcgttgcccgtacttttatgagctaggatgcaagattgttcctttggtgagtgacaatagcattggcctgttcttgcgatatgcattcaccagtaggtacaaagaggttctaagtaagtcccacagttcttccatgatgacagtgcccaagttcgttccacgccttacaaaagaagaaactcgggtgtttgaatctgccagagaatcgatgactggtttcaagaaatggctagcatgtgggatgagactgca

SEQ ID NO: 31467 - DNA, 133 bp, Zea mays
  Clone ID: LIB3059-018-Q1-K1-G3
acttcgaatggctcattaaatcaattatagtatgtttgattgtacattctactcttataacctttattaattctagatctaatactttcaacaaacccctacttcctttattatctcatttattatataaaat

SEQ ID NO: 31468 - DNA, 294 bp, Zea mays
  Clone ID: LIB3059-018-Q1-K1-C9
cccacgcgtccggaagggccagacgtgtccttccctcaacatcctcatcaaggttagggcgaagacaagggattcaaccgccataagcttgatgaggatgttgagggaagggccagacgtgtccttgagagcacctcctctggcgccaccaatgacaggcgccttgtagaggctcagaacgttttggtccaagggtcctggcatgcacttaaactccagtcttaatgtacttatggtccgaccatggtggcatgctcttcaaatggctctacacacgctagagactcatgataa

SEQ ID NO: 31469 - DNA, 313 bp, Zea mays
  Clone ID: LIB3059-018-Q1-K1-D1
aaggaactcctccttgtcagccacaaccaccatgaatacaagaaccttttgaaagatgtaatggttcagggcttgctccgtttgaaagagccagctgtattgctccgttgccgcaaggaagatcaccatcatgtggaatcagtactgcattcagcaaagcacgagtatgcatcaaaagcagatgtccatgaaccagagatatttgttgaccatgatgtgtacctaccacctgccccaagccatcatgaatctcacggccaggtttgctcttgaagtattggcttggcttcttcagattgaaaggatgggtttg

SEQ ID NO: 31470 - DNA, 351 bp, Zea mays
  Clone ID: LIB3059-018-Q1-K1-D10
gagaagaccatcttccacctcaacccgtccgggcgcttcgtcatcggcgggcgccagggtgacgccggcctcaccggccgcaagatcatcatcgacacgtacggcggctggggagcccacggcggtggcgccttctccggcaaggaccccaccaaggtggaccgcagcggcgcctacgtggccaggcaggccgacaagagcatcgtggccagcggcctcgcccgccgctgcctcgtgcaggtgtcgtacgccatcggcgtgccggagcccctgttcgtgttcgtcaactcgtacggcgctggcacgatgcatcacaaggagatactaaggatcgtgaaggagaactcgtac

SEQ ID NO: 31471 - DNA, 406 bp, Zea mays
  Clone ID: LIB3059-018-Q1-K1-D12
gcaccatccctagagttgtcacttttgacaagaaccctgacaaccacccatgcctcgggaaattcttccaaagctcagcccccaaggctatgctgtttttgaacttctccaccggaccttttgattctttcaagtctgcctactctgctgccgcggaggaattcaaggacaaggaaatcaagttccttattggtgacatcgaagccagccagggtgccttccagtactttggcctgaaagaggaccagacaccccttatcctcatccaggatggtgactccaagaagttcttgaaggttcacgttgaggctgaccagatcgtcgcttggttgaaggagtactttgatggctaattgacgccgttcaggaagtctgagcctattcctgaggtcaacaatgagtattt

SEQ ID NO: 31472 - DNA, 189 bp, Zea mays
  Clone ID: LIB3059-018-Q1-K1-D2
caaattcgttccgtccaggcaaggaagtaatctagcagccaaggagaggagaagatggcgcgggctaagcaaaccggccgcaagtccaccggaagcaaggccccgcgcaagcaacttggcaccaaagccgccaggaaatccgcgccgaccaccggccgcgttaaaaaaccccacaagtacaagccccgg

SEQ ID NO: 31473 - DNA, 367 bp, Zea mays
  Clone ID: LIB3059-018-Q1-K1-D3
gccacctccacgcatacaagcggcagctgcggctggcagccaacggcggccgttcatcgtccggccgccgtgcctctgccaacctccgttcacctggcaactcctgtgcatctcccaccgccggtccacctgccgccgccggtccacctgccaccgccggtccatgtgccggccgccgttcatctgccgccgccaccatgccactaccctactcaaccgccccggcctcagcctcatccccagccacacccatgcccgtgccaacagccgcatccaagcccgtgccagctgcagggaacctgcggcgttggcagcaccccgatcctgggccagtgcgtcgagttcctgaagcatcagtgcagcccga

SEQ ID NO: 31474 - DNA, 427 bp, Zea mays
  Clone ID: LIB3059-018-Q1-K1-D5
gcaacatagaaagtggaatccagtagcatacaacagagcaacaatggcgaccaggatagtttccctccttatgctccttgctctttctgcatgtgttgctaacgcgacaattttccctcaatgctcacaagctcctatagcttcccttcttcccccataccttccatcaatgatagcttcagtatgtgaaaacccagctcttcagccctataggctccaacaagcaatcgcagcaagcaacatacctttatcacccttgttgtttcaacaatcgccagccctatctttggtgcagtcattggtacaaaccatcatggcacagcatctgcagcaactcgtgctacctgtgatcaaccaagtagctctggcatacctttctccctactctcagcaacaacaatttctttcattcaaccaactgtctaca

SEQ ID NO: 31475 - DNA, 262 bp, Zea mays
  Clone ID: LIB3059-018-Q1-K1-D6
taaagttggaatcctttatctttcaacagcatcaacaatggccgaccagggaatgtttccactccttatgttcgcttgctcttatctgcatgtgattgctatactctacaatttttccctcaatgcttcacaatcctcctatatctttcccttcttctctccatacctttccatcaattatagctacatgtattacaaaacccaactcttcatccctatagtctccaacatgcaatcttatcatgcaacatacctttatcac

SEQ ID NO: 31476 - DNA, 429 bp, Zea mays
  Clone ID: LIB3059-018-Q1-K1-D7
ggcgatctattatatcgctactgatagtctccagagtgcgaagactgctcctgtctgggaaaagctggttcagaaagatattgaggtcctttacctcattgagccaattgatgaggttgccattcagaatttacagacatacaaagagaagaagttcgttgatattagcaaagaggatttggaattgggtgatgaagatgaggacaaggagaaagaaagcaagcaggagtatactcttctatgcgactggataaagcagcagcttggcgataaagtcgccaaggtccagatctcgaagcgactcagctcttctccatgtgttcttgtttctggtaaatttggctggtcagccaacatggaaaggctcatgaatgcacagacccttggtgacacatcaagccctgagttcatgataggtagacgaatttt

SEQ ID NO: 31477 - DNA, 394 bp, Zea mays
  Clone ID: LIB3059-018-Q1-K1-D8
aaacaaggcttcccaatgaagcaaggagttctgacttctggtcgtgtccgcctgctggtccacagaggcactccctgcttccgcggttatggcaggcgtaatggtgagcgcaggaggaagtctgtccgtggttgtattgtgagccaagacctatctgttatcaacttggtaattgttaagaagggtgagaacgatctgcctggtttaactgacactgagaagccaaggatgaggggtcccaaaagggcctccaagatcaggaagctgttcaatcttgcaaaggatgacgacgtgcgcaagtacgtgaacacgtaccgcaggacattcactaccaagaatggcaagaaggtgagcaaggcacctaagatccagcggcttgtgacccccttgaccc

SEQ ID NO: 31478 - DNA, 375 bp, Zea mays
  Clone ID: LIB3059-018-Q1-K1-D9
gagaccaacaagcaacatagatagtgttatacagcatcaacaattgagcaacgatgggggccaagatatcttccatcctaatgctccttgctctgtctacatgtgttgctaactcgaccatctttcctgaatactcacaaactactatatctacaattctttcagcatatattgcatcaatgtccacttcaatatgataatacatagccatacaaccatacacgctgcatcaagctttctcaacttgtacattacctatatcatgcctaacgtcataacaatcatcaaccgtatggagcttgccgtcattaacataaacgataacgacgcacaatctggaggaactcgtgctagcagtgatcatccatacagctg

SEQ ID NO: 31479 - DNA, 391 bp, Zea mays
  Clone ID: LIB3059-018-Q1-K1-E1
cccacgcgtccggaaaaaaataactcggaaaagaaggagacgccgaaaattcgaaaggggaggggaaagcaaagctgatggcggaggcccaggggaaagcaaagcaaatggcggaggccccgagcaagatcgaatccatgaggaagtgggtcgtcgagcacaagctccgagccgtaggttgcctctggctaggtgggatcagcagttcgatcgcctacaactggtcgcggcccaatatgaagcctagcgtcaagatcatccacgcaaggttgcatgctcaagctctaaccctggctgcattagttggttctgcatgcgtggagtactatgaccagaaatatggttcttctgggccaaaggtggacaaatacacaagccaatacctggccca

SEQ ID NO: 31480 - DNA, 396 bp, Zea mays
  Clone ID: LIB3059-018-Q1-K1-E12
cggacgcgtgggcggacgcgtgggggtgatgatgaacgtgacatgattgcagatgagggtcctgatttcaatgaccttgatgagaacctgcagagggaattccacaggtacctggatctgcgtggcatttcacccaggaccacaaatttcttgcacctgtacatgatcaacaaggacagccgtgagtacctgctctggctgagaaagctgaaggatttcttcaagcagtaggtgtgaagacctgaagatcagctttatctctcttttgttcctgctagggccttctcggttattccaattccatgtggattgaaatgtattaaaataaattttgacttgttatggatttaaattaacttaataccacccaatccacatggattattggtgaaacaa

SEQ ID NO: 31481 - DNA, 208 bp, Zea mays
  Clone ID: LIB3059-018-Q1-K1-E3
aagtactttaattgctgcaaagaagtgtttaatctcaaattaccatgcaacattttaagtccggatttaatagtattatcgctggtttggagaagaaaaatagggtcattagcatactgcatcgccttactgtaacttaccatgaatctttacatgcattttctgtattttactaggaacatgctgtgcctcttctaaaaattacaaa

SEQ ID NO: 31482 - DNA, 379 bp, Zea mays
  Clone ID: LIB3059-018-Q1-K1-E4
gatgacaaccaagaggactcaagcaacacaagttctggtgtatcacttggggattacgttcgtggtcctgccttagatactctcttgcagcgtttggcggagagtgacctcagtcgttctggcacaccgcctgccaagaaggaagcagtcgccgcgctaccaaccgtgaacatcaaggaagcgttgggctgttcagtctgtcttgaggatttcgagatgggaggagaagcgaagcagatgccctgtcagcataagttccactctcactgcatactcccgtggctggagctccacagctcttgcccaatctgccggtttcagttgcctactgaggagacgaagaacaacccatgcgaatcagccagcaccgcaggggcca

SEQ ID NO: 31483 - DNA, 344 bp, Zea mays
  Clone ID: LIB3059-018-Q1-K1-E5
cggacgcgtgggcggacgcgtgttcctaaggcgcgatgacggaagggtcagacgagtggtcgatctacggcggaactggagcgttcgcgatggcgagaggcgtcataaggagaacgtttcttgccgacacgagcggcgggaactccgacgaacttgccgtggaggttctctgcccggtgttccgcccggcggcgtttggctcatcgtcgtcacagtcagcatcaaaggtgagagcgagcgagcgagcgagaaaccgtttctccttcttactcatcatatcatccgatgaacaacactgggatggtctgatggatggatggatggatggatgcatgacatcatct

SEQ ID NO: 31484 - DNA, 392 bp, Zea mays
  Clone ID: LIB3059-018-Q1-K1-B11
cccacgcgtccgcccacgcgtccgcgcgaggccaagaagatcgacaagcacatgtaggacgatatgtacatgaaggtcaaaggtaactcgttcaagaacaagagggtgcttatggagagcatccacaagtccaaggctgagaaggccagggagaagacgctctccgatcagttcgaggccaggcgcgccaagagcaaggcgagtcgcgagaggaagaatgctaggagggaagagaggctggcccagggcccaagagaaataccaccaccagtctcagccacagctcccactaccggggcaccgaagaaagcaaagaagtgaagtattgcaacaaagctgcagctttctagtccagtacttcgtaattttggagcgccctgatcaattttgct

SEQ ID NO: 31485 - DNA, 385 bp, Zea mays
  Clone ID: LIB3059-018-Q1-K1-B12
cggacgcgtgggcggacgcgtgggcggacgcgtgggttttgacaggtacgacaggggccggagcggcaaaatcgactcccgtgagctgaccgaggctctccggagccttggatatgctgttccaccttctgtcatcgagcttcttatagcgaattacagcaatggtgtgcccagcaatggcgcgctagactttgacaactttgtggaatgtgggatgattgtgaagggtttaaccgagaaattcaaggagaaggatacgcgctacaccggctcggctactcttacatacgatggtttcttgtcaatggtgatccccttcatcgtcccttagctgtgctgtatgtagttcggtaacttgatagtagtcatcaaccatggttctagt

SEQ ID NO: 31486 - DNA, 328 bp, Zea mays
  Clone ID: LIB3059-018-Q1-K1-B2
aagaaaaaaaaatataaaaaaaaaaattttttttttaacaaacaaacataaaaaaaagggatagtataaaaaataagcttgggaaccaatcaatatatataaaataactatatatgcatgacagttaaaaatatacatacttcctttaaaaatattagccaatactatttgcctatggtgaactaatcaatccttaatgactgcccccatgtacaaaaccagatcaagattctagctcttccggttgaaattactccttatgtgctgtaagtttacccttgacattatattttccaacttaaatgcagcatgatttattcttttaata

SEQ ID NO: 31487 - DNA, 416 bp, Zea mays
  Clone ID: LIB3059-018-Q1-K1-B3
gacacttgatgccattatagctgggtctgggccttaactagcttctctaattgttgcgcgcgtgtatgtggttacattgcaggaaagcttactgatttgatgctggttaatttgccaggcatccttgttgtgcttggactccatgagcagctgcacaaatttcgtttcagctttcaaatatctcctttttctgcaagttttctggttgtaaaagatgatggtggcaataatatggtacttgagctcacaggatgcacatttcttgtaacctgtattccaaaactttatctacctgaaaccatagttactgtttaagaataaaatattttaatttttattattttattatttttttttttttattttatttattatttatttttttttattatatttttttatttatattttttttt

SEQ ID NO: 31488 - DNA, 411 bp, Zea mays
  Clone ID: LIB3059-018-Q1-K1-B4
ccgacgcgtccgcggacgcgtggggataaggtactgtatgttggaagagcacagaaggagtgtgaaagagagatggagttgaaggagaaatttgaaaagaatgttcaagaggtagctgagaagttccaaaacacaaacttgtatttgaagaacttagaggagaacattgatgatgagaaattgcgtgaactctttgctgagtatggcaatattacttcctgcaaggttatgcgggattcgaatggtgtcagcagaggttctggatttgttgctttcaaatctgctgaagatgctaaccgagctcttacggagatgaatggcaaaatggttggaagcaagcccctttatgtagctcttgcgcagcgtaaagaagacagaaaggcaaagctacaggcacatttttcacaaatg

SEQ ID NO: 31489 - DNA, 416 bp, Zea mays
  Clone ID: LIB3059-018-Q1-K1-B8
agcaatgcgagcgttcttcgttctgtttgtacttaataccatctattccttcgactggttttctagggacgcttgccagcctggcgtgtctgtcgtgtaactctgtctgcacgcgcttatttatatgcatccttcctttaagccgatttccactcatatctacctatagcgagctcatccgcccttattgtctgtccaccacgcactaactcacttcatgatacttcgtctttctgctgagtctactccttaccttctttttgcttaccttctactttatattttttatcttatatgagtggggttatttacatatttttctaaatttcttcttttattttcttttttttaatctttctactctttctttcttttttctatcttttttattttttttctcttattttttttctttt

SEQ ID NO: 31490 - DNA, 384 bp, Zea mays
  Clone ID: LIB3059-018-Q1-K1-C1
cccacgcgtccggctgcctactctcagcaacagcagtttcttccattcaaccaacttgctgcgttgaactctgctgcttatttgcaacaacaactaccattcagtcagctagctgctgtgagccctgttgccttcttgacacaacaacagttgttgccgttctacctgcacgctgcgcctaacgctggcaccctcttacaactgcaacaattgctgccattcaaccaacttgctttgacaaacccaacaacgttctaccaacaacccatcattggcggtgccctcttttagattgcttatgagttatagttcaataatgaagttttttggatgatgtttgtggcttcccagaaataagaaagtacatttctagattcttatgtg

SEQ ID NO: 31491 - DNA, 325 bp, Zea mays
  Clone ID: LIB3059-018-Q1-K1-C10
ggtgggctggcttctcctccccctccttttcgggttcaacttcgtcaggttctacggcgttctgatacatgtttgagcgaatctagatatcagctgtacgatgatgaataccgatgctatcgtcacaggacatccctgatccacacgactaccactccctctacaactccttaagcacctacgccaaggtaccttattccaaaatattactcaacccctatacgcaaaaatccaagctatcaacctgcgcctctgctcgcagaccggacgtaaccacgttagggcattagcgcataaacggcacgttccattgactcatccagat

SEQ ID NO: 31492 - DNA, 355 bp, Zea mays
  Clone ID: LIB3059-018-Q1-K1-C12
cggacgcgtgggcatcattggtgtgaccaaggggaaaggttacgagggtgtggtcagtcgttgtggtgtcacccggcttccccgcaagacccacaggggtctccgcaaagttgcttgtatcggtgcatggcatccggctagggtctcctatactgttgcccgtgctggtcagaatgggtaccaccaccgcactgagatgaacaagaaggtgtacaagatcggcaaggctggacaagagacccacgatgcctccacagagtttgacaggactgagaaggacatcactcctatgggtggcgtcccccattatggtatcgtgaagggtgactacctgatgatcaagggctgatgtgtt

SEQ ID NO: 31493 - DNA, 420 bp, Zea mays
  Clone ID: LIB3059-018-Q1-K1-C2
ctatttttgatcacgttattgaagccctaaattatgtcctaaaaggggaccgaactgggtggggattaccctaatggttgtccaaatcctcttcattggtattcccttctcaaagaaatctgcggtcaaatggattattcactaccccgtctcgtcgttctggtggagctctagggaagatagcacaaacattgaggtctccttcaaagtttataggccgcagtgatactctaccacatgttgatgcacggtatccagccatactattcaaacagcagcttactgcatgtgtcgaaaagatatttgggcagctcagagataatctaaaaaaggaaatatcacctcttcttaatgtttgcattcaggctccaaagtcaacacgtgggcaatctggaaaagcattcaagtcatctggagttg

SEQ ID NO: 31494 - DNA, 382 bp, Zea mays
  Clone ID: LIB3059-018-Q1-K1-C4
cccacgcgtccgaaagccggccgagccataaccgccgccgcaggccattgccgacttgcggtgaaccttgtcttgcaacggcttccaagtcaagggcccaccgccaccggttgggaagggccgccaaaggtatcccagggaagcctgtgagcgaaggctgagagaggccacgccgtccggagtctccagttccgtcgccacagcttcctgccgcgcctgtgccgaggtaaacgagagggatcgaggaagaagtatcccccggagccccttcccccgaacccgaaggctccggaatggcgcactgggttagcgacagtgatggcagtgacaactttgaatgggatagtgatggcaatggggaggaaccagcgaacttcaatgc

SEQ ID NO: 31495 - DNA, 419 bp, Zea mays
  Clone ID: LIB3059-018-Q1-K1-C5
cgaagctaaaccaggcatcgcttttgtggagttcgaggacgacggccagtccgggggggcgatgcaggctctccaaggcttcaagatcaccccggagaaccccatggctatatcctatgccaaaaaatgagaaccctaggggactctgtaccggctttgtttcggtactctagtattgatcccaaatccacgtgtgctgaggtggattgtggtgtaaattagtttaagttacaccctaatctacctcaatacatgtagattgagctcaatactagagtatccaaactagacctaagatctttccgctccgcctttagaaatcgagccacggtacccactttccagtcatgtgtttttggaaagcactcgcttgatttcgaaattaaactcttaacacttttaaatcaaggtttggccct

SEQ ID NO: 31496 - DNA, 366 bp, Zea mays
  Clone ID: LIB3059-018-Q1-K1-C6
cggacgcgtggggccactaccctacttaaccgccccggcctcagcctcatccggggccgcacccatgcccgtgccaacagccgcatccaagcccgtgccagctgcagggaacctgcggcgtaggcagcaccaagatcctgggccagtgcgtcgagtttctgaggcatctctacaatcgatccgaaatccactactgctcacctgaattccagtctaaattactgtaagttacaccgttaattacctcaatacatgtagattgatctcaatactagagtatccaaactatacctaagaggtgggcgttcctcctttataaatctagccacgtaactcactttttcagtcatgtgtttttggaaagca

SEQ ID NO: 31497 - DNA, 296 bp, Zea mays
  Clone ID: LIB3059-018-Q1-K1-B10
gcagactacaacatccaaaatgagagctccctccaccttgtgctccgtctcgggggtggtcagtaagtcatgtgtcgtttaagctgccaatgtgcctgcgtcgtctggtgccctctctccatatggaggttgtcaaagtatctgctgttcgtgtcatgagttgcgttaacattggattaattatggatcgcttgtcttgtctgtgcgtactacccaggactatcactattcatgattcaagcttatgtatgcattcataccacgtgctcaatcttctatagtgtgacctaacttta

SEQ ID NO: 31498 - DNA, 424 bp, Zea mays
  unsure at all n locations
  Clone ID: LIB3059-040-Q1-K1-E12
aacccatccaacttcccaaacgaaccacgaaccagtcctataaaaaacatatggacagggatccaaagaacacaagtcaagcacacgaatccaaagaacacgaaccggcagttcagcttcctgtccgagacctcggggaggcctgccctctcggctctcgcgttaccgatcgaggcgtggagagaaatggcggcggcagcagcaacaagagcaggagcgtggggcgtggcgtggctcctggcggccaccgtggcggcggcgctgctggcctcggcgtcggcgcagtccgggtgcacgaccacgctgatcagcctgtacccgtgcctcaactacatcagcggcaacgtgtcggcgccgncgtcctcgtgctgctcgcagctcgccagcgtcgtgcagaccaacccgcagtgcctctgcgccgcgc

SEQ ID NO: 31499 - DNA, 402 bp, Zea mays
  unsure at all n locations
  Clone ID: LIB3059-040-Q1-K1-E4
taccaagtcctcctcgggttagggttcctganggttttgtggaggggcgatggcggcggctgatgtggagtaccgttgcttcgtcggcgggcttgcctgggccaccagcaacgagtcgctggagaatgccttcgcctcctacggcgagatcctcgactccaaggtcatcaccgaccgggagacggggaggtctcgcggcttcggcttcgttaccttctcctccgagaactccatgctcgacgctatcgagaacatgaacggcaaggagctcgacggccgtaacatcaccgttaaccaggcccagtcccgtggcggtggcggtggcggcggtggctacggcggcggtcgcggcggcggcggctatggtggcgggcgccgtgactgcggttatggcggcggtgg

SEQ ID NO: 31500 - DNA, 427 bp, Zea mays
  Clone ID: LIB3059-040-Q1-K1-E8
ggcggaggttctatcagagatagaggaggaaaaacttgaatctgaagaagtagagggagaagaagagagttctgaggatgagttagatccatttgtaaagtctgatcctaagttaccaagagttgtccgaatggcaaacctctgtgttgttggtgggcattcagtaaatggtgtagctgaaattcacagtgaaattgtgaaacaggatgtgttcaacagcttctatgagatgtggccaactaaatttcagaataaaacaaatggagtgactcccaggcgttggatccggttttgtaatcctgcattaagtgcattaatttcaaagtggattggttctgatgactgggtgcttaatacagacaaactggcagaactgaagaagtttgctgataatgaagatctgcattcagagtggcgtgctgctaag

SEQ ID NO: 31501 - DNA, 52 bp, Zea mays
  unsure at all n locations
  Clone ID: LIB3059-040-Q1-K1-D10
gctgggnccaccagctttgaccgccgcctcccattcccctccgcttactgcg

SEQ ID NO: 31502 - DNA, 429 bp, Zea mays
  Clone ID: LIB3059-040-Q1-K1-D5
gatcgttgcccttgctctcctggcgctcgctgcgagcgccgcctccagtacaagcgggggctgtggctgccagacaccaccgtttcatctaccgcctccgttctatatgccgcctccgttctatctgccgccgcagcagcagccgcagccatggcaataccccactcaaccaccgcagctaagcccgtgccagcagttcggatcctgcggcgtcggcagcgtcggcagcccgttcctgggccagtgcgtcgagttcctgaggcaccagtgcagcccggcggcgacgccctacggctcgccacagtgccaggcgctgcagcagcagtgctgccaccagatcaggcaggtggagccgctgcaccggtaccaggcgacatacggtgtggtcctgcagtccttcctgcagcagcagccgcagggcgagctcgc

SEQ ID NO: 31503 - DNA, 315 bp, Zea mays
  Clone ID: LIB3059-040-Q1-K1-D7
ataaactccatctcctatcctcacaacactacacacatcatacatgaacaccacatcaagaatctcaccactttcttctatcaactaacaatcatcaataaatcttataacaaattacacaccaactgaatttcacctctacttccaacatctcatcctcttaccaaaccctacctcatatctctctactatacacaactgctcatatatgtgcctatactcatcatcatcactcaacaattcatggttcacatcacaaccacaatctttcatcttatcaacgattcactcactaatacataagcatatttattt

SEQ ID NO: 31504 - DNA, 369 bp, Zea mays
  Clone ID: LIB3059-040-Q1-K1-A4
cgcgaacgcgtccggggacgtgtacgagatgacgcacgacgagctggatttcgagttcgtgggaagccggtggggcgggcagtggcgcgtgcagaccaacgtctacggcaatggcagcactagccgcggccgggaggagcgctacctcctccccttcgaccccaccgtcgaggcccacagctactccatcctctgggctcccacccacatcatcttctacgtcgacgacacgccgatccgggaggtgatccggcacccggacatgggcggcgacttcccggcgaagccgatggcggtgtacgccaccatctgggacggctccgcgtgggccacggacgggggcaagtacaaggtcaactacaagtacgc

SEQ ID NO: 31505 - DNA, 424 bp, Zea mays
  Clone ID: LIB3059-040-Q1-K1-A5
ccacgcgtccgcgcgcctttcccgcaaggttgcttctactctaatgcccttggaggattgaagtgctgcgagaatcccaagaacaaagtgactgccgttcctgcaaacgaggaggaaatctgcggcgcaaccttccaggtggaaggggctacggtgctcacagcgctgcattaggagatgaggtgtcttcctccgtctccaggcctggactgggggcaactgtacatggtgcctggtggtgtaatgtaacataacggcaatggcatatgcagctgatcctggtctgcctgtatcatctcctcccacccgtaaagagaagttctttctgccgccatcgccatggtcagtcagagcttctctgctatagctgctggatgtgttgtgtgttgcgtctgtatcgtctctagtttgttcgacttacgtg

SEQ ID NO: 31506 - DNA, 167 bp, Zea mays
  Clone ID: LIB3059-040-Q1-K1-A6
aaaaaaaaaaaaaaaaaaaaaaaaatttaaaaaaaaaaaaaaaaaaaaaaaaaaaaatgaaaattaaaaaaattaaaaacacaaaaatacaacataatataatcaaaatattatatcaccttaacttcaataaactaacacatcattttacaacttcaaatactctt

SEQ ID NO: 31507 - DNA, 403 bp, Zea mays
  unsure at all n locations
  Clone ID: LIB3059-040-Q1-K1-A9
atttgtctacactatcaatgtagttgctgaatctgtattaacatgcctcactggcagggacatgcaattctgaaggacctcgtccgcaaggctatcaatgaaacacatgagctgaagcagtttcccacccttcgtgtggaagtaggcaatgcagcttttgagtcattggatagaatgagggatgaaagcaagaaaaatacattaaagctagttgacatggaatgcagctacttgacagtagatttcttcaggaagcttccccaggatgttgagaggggtggaaatccaagccactctatttttgatagatataatgactcttatcttagacgaattggacaaactgttctgtcatatgttaatatggtgtgttcgaccttgaggaactccatcccanaatcta

SEQ ID NO: 31508 - DNA, 432 bp, Zea mays
  Clone ID: LIB3059-040-Q1-K1-B12
gaatcccaagaatcgggtgaagacgaagctagcagcgcgatattccccaagcggtcggcaattgcctggatcggaaaatcactaccgatctcgaggattcgagtcggctattgaaacggtacgttaattaatcgcgtgatgcggaagacgagccaagtcgaccccaagcgtgggcttcttcgcaaggcgatgctgatggacaaacctgaagatggtcgtcaagtgctcatcgactaacaacactaacctagtgttactcaggttctaactttgtgctgttgttgatggtgttaagtgccggtgggctcggccttcttataagtctaagtaacccttctatacttcttattgaggatgatcccttgagctagcatatatatttcaaacttatacttttgtaatcactccgattaactaatgtaaaatttttgt

SEQ ID NO: 31509 - DNA, 332 bp, Zea mays
  Clone ID: LIB3059-040-Q1-K1-B2
gagatccatcgagaggccgtcgacaggggaattaatggcgtcgtcgtctagcagcaggcgccgtcgcctcatcctcgcagccgccgtcctgctctccgtgctcgcggctgccagcgccagcgccgggacctcctgcgtgccggggtgggccatcccgcacaacccgctcccgagctgccgctggtacgtgaccagccggacctgcggcatcgggccgcgcctcccgtggccggagctgaagaggagatgctgccgggagctggcggacatcccggcgtactgccggtgcacggcgctgagcatcctcatggacggcgcgatcccggccggcc

SEQ ID NO: 31510 - DNA, 75 bp, Zea mays
  Clone ID: LIB3059-040-Q1-K1-B3
ccaccaacctgctctccctcctctctgatgccatcaccagctccttgacctccttcctaccggggtgggccatcc

SEQ ID NO: 31511 - DNA, 417 bp, Zea mays
  Clone ID: LIB3059-040-Q1-K1-B5
agaggatcctgtggtcaaagatgctgtacaccatgctgtgaaatcgatccaagaggggtccaactccctgtttccctacgaacttctcgagatccttcgtgcccatgcacaggttgtggaagactttgcaaaatttgacattctgatgaaactgaagagaggcagcaaggaggagaagatcaaagcagaggtccataagagcctggaaggggcctttgtgctaaaccagcatcagccggcggagcatgatgagtcgagcagccagtgaactgacgtaactgtgtgagctgtagtagtaacgtacttcgtgttacgtagaagaataaggagaaaacgaccaatccggttttatctggatgtcatgtatggtcgacggtcgttgctggcttggcttccgaagacggtacctgctgtcgc

SEQ ID NO: 31512 - DNA, 268 bp, Zea mays
  unsure at all n locations
  Clone ID: LIB3059-040-Q1-K1-C1
cttctttccctttttataaactcaacaaattccttcattattccacaattctcactttctcctaataccatttttccacanttcctcccaacaattacttcaatnnncttcnaacacctanctnttcaatccaacattcaacaacaatctctatctactaacttcttacaacaaccaattacccaatttcaacaacaatccttaccacatctaacaatacaatccatcacaactcaacatcaacaacaattcctaccatcactttacc

SEQ ID NO: 31513 - DNA, 324 bp, Zea mays
  Clone ID: LIB3059-017-Q1-K1-H3
cccacgcgtccggtcaaaggagaggaagatcatgtacactagtgaactggagaagaaggtccagactctgcaaacggaggccactacgctgtcagcacagctgaccctgctccagagggatacaactggtttaactgccgaaaacagagagctcaagcttcggttgcagtccatggaagagcaagctaaactgcgggacgctttgaatgaagccctgcgagaagaagtccagcgacttaagattgccgcaggacaagtcttgtacatgaatgggaaccccttcaatggtggactccatcatcagagggcatcctatttcgtgca

SEQ ID NO: 31514 - DNA, 427 bp, Zea mays
  Clone ID: LIB3059-017-Q1-K1-H4
cccacgcgtccgccggaaggaagagatgccagagtcacatggccatatgtggaggacgaatcgtatatgtggacatggcttttttttgttccactagctgcttacaccctgtggcaacttatgtatttcctcatagttaatgtcctgcgccggcagaggttgttaagggatcctgaactcatcacatcctacagagagctctcaaagaaagcacagaaagcaaacaacatctggtggaggctgagcggactgctgggtgaccggaaccggcaggtcatgtacatactgctccaggcgctgttcacagtggcaacaatggccctgacggtccctatattcctgtcctaccggatgcacgtggtgttcctgatacttaaggtgtgcgcctcgacatggaaacggtggcagctttatcttggaggtgatg

SEQ ID NO: 31515 - DNA, 297 bp, Zea mays
  Clone ID: LIB3059-017-Q1-K1-H5
ggagctgcctggaggcgggctcctcgtgtaccagagcttctgtgctgctgaaggcgcgggtgctacctcgcccaaatctgttttccactgctttgacggcgagaacgtggagagtgctcctcctcctatgaagaaggactacaagctggctaatcttctctgctgggaggaggaagcggatgccatggaggagaaggcgggagtgcttgatgagtaagacgggcttctggggtcgatttgcttctgagttgtttattttatatcgtcgcaatttcgtggttgtcgtttggttattct

SEQ ID NO: 31516 - DNA, 429 bp, Zea mays
  Clone ID: LIB3059-017-Q1-K1-H6
gcttgagtcagagatccctaagtttcgatccactgtcccagtggatttgggactgcgagggaggagcagttcatcctccgcgtgccgccatccgtcgcagagcggatcgagcgcctcatgaatgaatccgccgcctcctcctccaaccccgacgaggcctacctggacctctccttctcagaggatggaagaaatggcacatttatgatcggtaatgagagctttcctgcatctctcttggatctacctgctgtggtggagtcatacaaaacatatgatgattctgtactaattaaaactgctgatgttggtcagatgattatggtaagagaagaaaatgatcctgctccagaaggagtcgagtacaagcatgggcttactcctccaatgagggatgcacgcaggcgacgtttccgcagagaaccagac

SEQ ID NO: 31517 - DNA, 253 bp, Zea mays
  Clone ID: LIB3059-017-Q1-K1-H7
cggacgcgtgggaaaaaaaaaaaaaaaaaaaaaaaaaaaaaaaaaaaaaaaaaaaaaaagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaataaattaaaaaaatatataaaaaattatattaattaaaaaaatattattaattaaataaattaaaataataaaaaaaaaatatttaatataataatata

SEQ ID NO: 31518 - DNA, 203 bp, Zea mays
  Clone ID: LIB3059-017-Q1-K1-H8
cagtcatccacactaacgaacgaactcttgctccgatcacgagctagctgagggcgacgattgccgctgtgcttaacagcaaggagaccccgcaagttgttgccgttctgggtggtggtggcgctgctggcttcgtccgcttcggcggcaatcacttgcgggcaggtggggtcgtcgttggcgccgcgtatcggtgcgcgacg

SEQ ID NO: 31519 - DNA, 255 bp, Zea mays
  unsure at all n locations
  Clone ID: LIB3059-017-Q1-K1-H9
gatcagcaaagcggcagtgcgtagagaggatcgtcgaacagaacacatgaaatgggatcgntctcgtcgtgtgcctggctctgtcagctgccagcgcctctgcaatgcagatgccctgcccctgcgcggggctgcagggcttgtacggcgctggcgccggcctgacgacgatgatgggcgccggcgggctgtacccttacgcggagtgcctgaagcacgctcagttcatccagacagcggcggctacttactact

SEQ ID NO: 31520 - DNA, 307 bp, Zea mays
  Clone ID: LIB3059-018-Q1-K1-A1
cagccacccacccactcgcttcagccgtttccgccgcgcgtaccaagcaggtggagacgggatgcctgctggccacggcctgcgctcgcggacgcgcgacctcttcgcgcgccccttccgcaagaagggctacatcccgctcaccacctacctccgcacctacaagatcggcgattacgtcgatgtcaaggtgaacggcgccgtccacaaggggatgccgcacaagttctaccacggccgcaccggtcgcgtctggaacgtcaccaaacgcgccatcggcgtttaggtcaacaagcatgtcaatggg

SEQ ID NO: 31521 - DNA, 396 bp, Zea mays
  Clone ID: LIB3059-018-Q1-K1-A11
caaaaaaaaaaataaaaaaaactaaaattaaaaaacaaaaacaaaaaaaaatagaaaagctacattttcaaaattaaaacaatctccaactgcttataccaataccattttcccacaatgctcacaaactcctataacttcccttcttcccccatacctctcaccatctgtatcttctatatgttaaaacccaattcttaaaccctatacgatccaacatgcaatctcatctttcatcttacctttatcaccctttttccttcaacaatcatcaaccctattacaacatttacctttggttcatttattgtcacaaaacatcatatcacaacaactacaacatactgttctatcaaacctttctttataatcttaacatcaatattttctttctat

SEQ ID NO: 31522 - DNA, 307 bp, Zea mays
  Clone ID: LIB3059-018-Q1-K1-A12
gctgcttatttgcagcagcaaatactactaccatttagccagctagctgcaggaaaggggacttccttcttgacacagcatcagctgctgactttctaccagcagtttgcggctaaccctgcaaccctattacaactacaacaatcgtagccctttgtccaacttgctttgacagacccagcggcctcctaccaacaacacatcattggtggtgccctcttttagatagcttattagttgtaattcaataataaagttttttggatgatgtatgtggccaaccagaaataggaagttacatttccaa

SEQ ID NO: 31523 - DNA, 423 bp, Zea mays
  Clone ID: LIB3059-018-Q1-K1-A2
aagtgttttcgtgttcaccttgttaagaatggcaagaggattgctgccttcgtgccaaatgacggttgtttgaactacattgaggaaaatgatgaggtcttgattgctggatttggtcgtaaggagcacgctgtgggagatattcctggtgtccggttcaaggtcgtcaaggtttccggtgtgtctctgcttgcccttttcaaggagaagaaagagaagccaaggtcttagattgctcttgctaccaaaatcagcaagcgtggagttgaaacgggagggcgttagatgattaataagaatggttgcttgctatgtttgcagtgcattcgtgcaattgttaacctaagattttgttggtgaaaacgatttcttttcagacttgcttctgttgagtgctatcattccatatcaatgtacttcctc

SEQ ID NO: 31524 - DNA, 205 bp, Zea mays
  Clone ID: LIB3059-018-Q1-K1-A3
atgcagataattgagcaaaatttgtccaagcaacctcagctgagccaaccagacactggggatcaaatacgaattgatctggaaagcactaccaatcacttgcaaccaaactacgatgaaaattctatgctgcaatctggtttctcttgggctcctgaacagaacagaagagcccctactacagatttctggaaaaatgttgaaa

SEQ ID NO: 31525 - DNA, 369 bp, Zea mays
  Clone ID: LIB3059-018-Q1-K1-A5
gcaaaccagatcacttggtttactttgttgaggggtgatggcggtgtcttgcgcaaacctcagctccgaggcagggcttaaaaagcttgatgagtaccttctcactcgcagctacatcactggctaccaagcttccaaggatgacttggctgtctacacttcgttttcgtctgctccctcgtccaagtatatcaacgtagcaaggtggtttaatcacattgatgcgctcgtgaggctgagcggaattactgcaaagggccaaggtgtgaaggttgaatcgtcagcagttccgtcagccccaactccagatgttgctgaatcacatgccccagttgctgaagaggacgaccactatgattttgacctttt

SEQ ID NO: 31526 - DNA, 230 bp, Zea mays
  Clone ID: LIB3059-018-Q1-K1-A6
cccctgctgacaccacaccacttcctatatactctcccgcccgctgctgccctcggtccgcgtacatatcccgtcaccaaccgatcctacaccctccagcatggccgttgcgactgccaacgccgcgacagccctggctcttgcgctcgatctctcgctcgcggacaccaactctgagggcgacgcgctctccacgcttctccacatcctaaggtaccccatctacattc

SEQ ID NO: 31527 - DNA, 432 bp, Zea mays
  Clone ID: LIB3059-018-Q1-K1-A8
gggtcttcagaccattagctttatctactccagagcgcagaagaacccgatcggcacgatgagggtgttgctcgttgccctcgctctcctggctctcgctgcgagcgccacctccacgcatacaagcggcagctgcggctgccagccaccgccgccggttcatctaccgccgccggtgcatctgccacctccggttcacctgccacctcctgtgcatctcccaccgccggtccacctgccgccgccggtccacctgccaccgccggtccatgtgccgccgccggttcatctgccgccgccaccatgccactaccctactcaaccgccccggcctcagcctcatccccagccacacccatgcccgtgccaacagccgcatccaagcccgtgccagctgcaaggaacctgccgcgttggcagcaccccgatcct

SEQ ID NO: 31528 - DNA, 249 bp, Zea mays
  Clone ID: LIB3059-018-Q1-K1-B1
cgaaaagtctgatctgaagccagcagacgtgaaaccgacagcacgtacgtacgtacgtgtgagggctgctcggcggccatgggagaatggtgcttcaagaaacgcgcagctctggtgattattgtggccattattagctcgctgcagctgctcctgataactgctcaagaagctggaggagaccacgaggtgtggtcgtcgtcatcctcgccggccggtggtcgtggtggcggcgccgtcgtcgtcccg

SEQ ID NO: 31529 - DNA, 436 bp, Zea mays
  Clone ID: LIB3059-017-Q1-K1-F9
caatcgccagccctatctttggtgcagtcattggtacaaaccatcagggcacagcagctgcagcaactcgtgctacctgtgatcaaccaagtagctctggcaaacctttctccctactctcagcaacaacaatttcttccattcaaccaactgtctacattgaaccgtgctgcttatttgcagcaacaactattaccattcagccagctagctactgcctactctcagcaacaacaacttcttccatttaaccaattggccgcactgaaccccgctgcttatttgcagcagcaaatactactaccatttatccagctagctgcagcaagccgtgctttcttcttgacacagcaacagttgctgcctttctaccagcagtttgcggctaaccccgcaaccctcttacatctacaacaattgttgccctttgtccaac

SEQ ID NO: 31530 - DNA, 400 bp, Zea mays
  Clone ID: LIB3059-017-Q1-K1-G1
atttgagcattcagaaacacaccaagctaagcgcactagcaacaacctaacaacaatggctgccaagatattatccctccttgcgcttcttgcgctttttgcgagcgcaacaaatgcgtccattattccacaatgctcacttgctcctagttccattattccacagttcctcccaccagttacttcaatggccttcgaacacccagctgtgcaagcctataggctacaacaagcgattgctgcgagcgtcttacaacaaccaattgcccaattgcaacaacaatccttggcacatctaacaatacaaaccatcgcaacgcaacagctacaacagtttctaccatcactgatccacctatccatggtgaactctgtattcttattgcaacaactgtttttt

SEQ ID NO: 31531 - DNA, 396 bp, Zea mays
  Clone ID: LIB3059-017-Q1-K1-G10
cggacgcgtgggttcaacatggaagatatagaggagggatttgaaggttacgaggatgggaggtcactgcttatgtctcagaagagcttggagaaacgctttggccagtctccaatttttattgcatccacctttatgactcaaggtggcatacccccttcaacaaacccaggttccctgctaaaggaagctatacatgtcattagttgtggatatgaggataaaacagattggggtaaagagatcgtatggatatatggctctgttactgaagatattttaactggtttcaagatgcatgcaggaggttggatatccatctactgcatgccacttcggccttgcttcaagggttctgctccaatttacctttctgatcgtcttaaccaagtgtta

SEQ ID NO: 31532 - DNA, 429 bp, Zea mays
  Clone ID: LIB3059-017-Q1-K1-G11
cccacgcgtccgggggatacagcttggcagaatttgatggagcgtagaacctccgacgggacatacaatgcctggcggcgtgagcctgaggagggacctataatgtactgcagccgcactatttttgaggatgctactcctgaactggttagagatttcttctgggatggtgattttcgtctaaagtgggatcccatgcttgcatattgcaaatctttggatgagttccctcagaatggagcaacaattgtccactggataaaaaagttcccgttcttttgcagtgaccgtgaatacatctttggaggacgcatatggtaatctgggaagacttactattgtgttactaagggtgttccatatccatcattgcccatgaaagaaaaaccgaggcgtgtggagctgtacttatcaaggtggcgtattaga

SEQ ID NO: 31533 - DNA, 444 bp, Zea mays
  Clone ID: LIB3059-017-Q1-K1-G12
accttcccctacaccagaaaaatccccagttctttggtccgcgtcagagaggcggcggggatgtctgggcgcggcaagggcggcaagggtctgggcaagggcggcgcgaagcgccaccggaaggtgctccgcgacaacatccagggcatcaccaagccggcgatccggaggctggctaggaggggtggcgtgaagcgcatctcggggctcatctacgaggagacccgcggcgtgctcaagatctttctcgagaacgtcatccgcgacgccgtcacctacaccgagcacgcgcgccgcaagaccgtgaccgccatggacgtcgtctacgcgctcaagcgccagggccgcaccctctacagcttcagaagctaggctaggcgcctgttcgtagtcggtgactggttaggggacatgtctctgggtgatgctttttgaggtagtatt

SEQ ID NO: 31534 - DNA, 411 bp, Zea mays
  Clone ID: LIB3059-017-Q1-K1-G2
cagagtgtgagaatagtttgtagggttgtcatcaaccaccaaaaagggcgagattgagggcatgtatgcccgtggttggttttagtaattaatgacaacgtaatattatatgtgactaacgtgtgttctgcagagcaaatggtaagttagattgtattacaggaagttgtactacaacggtgaatacaatcactgagatgagaacttgaagcaacagctgaaacgacgaatcaaaagatgaatgtcttcatattccaagtgtcatgagttgcggacactttgtatagaattatgtcttctattgtattttatccatactattaagaggagttgtggatgagttattttgaccaagataatgctagtgtattgttgtatcatattgcacactctattactagtttaactcta

SEQ ID NO: 31535 - DNA, 405 bp, Zea mays
  Clone ID: LIB3059-017-Q1-K1-G7
gccgccgccaccgaagcggcctcccaggtaagcaggatcgtccagcccgccgccgccaggaagcgcaatccccgcgtcacgagctcccgccggaagtgccgcaaggcgcactttacggccccgtcctccgtccgccgtgttctcatgtccgccgggctgtcgacggagctccgccacaagtacaacgtgcgctccatcccgatccgcaaggacgactaggtgcaggtcgtgcgcggcacctacatgggccgtgaggggaaggtggtgcaggtgtatcttcgtcgctttgttatacatgacgagcgggtcacttttgttattttttatcttttcatttttatcttttattttttctacttcttttttattttttatttctttttttttttttatgtttttttattt

SEQ ID NO: 31536 - DNA, 420 bp, Zea mays
  Clone ID: LIB3059-017-Q1-K1-G9
attttgagcattcagaaacacaccaagcgaagcacattagcaacaacctaacagcaagggctaccaagatattatccctccttgcgcttcttgcgctttttgcgagcgcaacaaatgcgttcattattccacaatgctcacttgctccaagttccattattacacagttcctcccaccagttacttcaatgggcttcgaacacccagctgtgcaagcctataggctacaacaagcaattgcggcgagcgtcttacaacaaccaatttcccagttgcaacaacaattcttgtcacatctaacagtacagaccatcgtaactcatcagcatcaacaattcctaccagcactgagccacctagccatggtgaaccctgtcgcctacttgcatcagcagttgcttgcatcaaacccacttgctc

SEQ ID NO: 31537 - DNA, 374 bp, Zea mays
  Clone ID: LIB3059-017-Q1-K1-H1
atcacgcgtacctggaatcgccatctacagacccgcatccagggcatttccatactacagcgagcgagctttacatatcatatccaaaatcacctacgcgttcaagatacattggttctacatcatcaccacccctaaccccgtgttcagccacctggctgggaatacttccgtctggaacgccatatttcctgatgtgctgcaggcattcttcaacaccactcctgagatggataaactgttccgcttcaagatgctcgactcgtagatctttttcgcgcctttcagcttcaactgaaacaccagctcttcaatactttttatatgagatcgttcttgattgttgtcaatgtcattgatattaataattaaat

SEQ ID NO: 31538 - DNA, 405 bp, Zea mays
  unsure at all n locations
  Clone ID: LIB3059-017-Q1-K1-H10
gcgcgacgtcgacaggcacaacgtctgcgccatggaggtgaggcacagcgtcgaacgggtggaccaggccgacgtctacagccctggggctgggaggatcacacgcctcaccagccacaagttccccgtcctcaacctcgtacagatgagcgcggtgcgggtagacctgtaccaggacgccatcatgtcgccgttctggaacttcaacgcccacagcgccatgtacggcatcaggggcagtgcaagggtccaggtcgccagcgacaacgggaccacggtgttcgacgacgtgctccgtgcggggcagctgctcatcgtaccccagggctacctcgtcgccaccaaggcgcatggagaaggcttncagtacatcgccttcgagacgaaccctgacaccatggtcag

SEQ ID NO: 31539 - DNA, 442 bp, Zea mays
  Clone ID: LIB3059-017-Q1-K1-H11
cggactcgtggtcggactcgtgggaaaaaaaaaaaaaaaaaaaaaaaaaaaaaaggaagagaaaaaaaaaaaaaaaaaaaaaaaaaaaaaaaaaaaaaaaaaaaaaaagggctcggccgttttaaaggtcccaaccttccttccccttccttccaacttcataccttttttatagtgccccctaatttcatttcactgcccttcttttaacaccttcttacctggaaaacccctgcctttcccaattttattccctttgcatcacttccccttttcccctgttgccttattaccaaatagccccgtacctatcgctcttccaatcattttcccacccttattgtctattgtaccccccctttttcctgcccttatatccctctttttttggttttaactctcattttaccctttttattttcttttctttatttcttttttt

SEQ ID NO: 31540 - DNA, 244 bp, Zea mays
  Clone ID: LIB3059-017-Q1-K1-F8
cgaattgcaatttcgacctagacctacgcatgcgcataagcatacttccaatcgttttcataaacctccaaaaagtcaaatatagagagcagttaagacactgggtagggccagtcattaataaaatcatcatattatatatgactaactattatatttcaaatcatattgaaaattagattgtatacagaaagtattacaacaactcttaaaacaatctcttatatgataactttaatctatt

SEQ ID NO: 31541 - DNA, 415 bp, Zea mays
  Clone ID: LIB3059-017-Q1-K1-E2
aattgactgttagcttacaagattctagttcaccattgaagaaattgcgtcaaaatgtggaagctttatccagctcaagtgcagtttggtcaagaagtgctggagctccattatattgggctgaggtatactgtggtgggcaagcatcaacaggaagatgggtacatgttgatgttgtgaataatctcattgatgctgaacagaatgtagaagcttcttctgccgtttgcaagaagcctttaagatatgttattgcttttgctggaaatggagccaaggatgtaaccagaaggtattgcttgcagtggcacagaattgcacaaggcagagtgaattcagagtggtgggataatgttttggcgccactaatacagatggaactggcagcaacaaacaactatgaagacatggaact

SEQ ID NO: 31542 - DNA, 387 bp, Zea mays
  Clone ID: LIB3059-017-Q1-K1-E3
ctggaattctatgacaagggtgttgcgcctcgtaaaaacctcgatgtgatgaaagccggtattgacagcatggtcaatggcacctcaatggatgatgatgatatcgagaagaccgatgcatctcccaagaaaagcaagaaaaagaagaccaaaaccaaggctgatggtgatgcaatggacgtggataaaccctccaacgttgctggtggagaagctgagcctggaactgagaagaagaagaagaaaaagaagcataagctggaggaggaggcacaggaggagaacggtgcagcagatactacccctaagaaaaagaaaaagaagagccgtgaagcttccgaagaagctgaacctaagaccgtcaccgatggtaagaagaagaaaaag

SEQ ID NO: 31543 - DNA, 401 bp, Zea mays
  Clone ID: LIB3059-017-Q1-K1-E4
cccacgcgtccgcggacgcgtggggacctttcttccaggacacaagtgggacatcatggtagagcttttcttctacagagacccagaggaagcgaagcagctggaggaagaagaggctctggttgcacctgactatggcgcggttgcagaatacactgcaccaggcgctgacaactggggcggtgaatggggtgctggcgaagctgcagctccagctgctagcattccagctgctggcgcagactgggctgctgctccagctcctcctgctgacggtgtctgggacgcagctgttgctccagctgcagcagcagcccccggatgggaacaaggcgcggcccccgttgcggcgtcgacccctacctgggagtaattaataaagagttaatgatcatggtgga

SEQ ID NO: 31544 - DNA, 376 bp, Zea mays
  Clone ID: LIB3059-017-Q1-K1-E5
cccacgcgtccggttggccaatcaattatacagaaattttgggcaagagtcctgggtgggggccctgctcttcgtgctgttgcttcaatgagcagggctgattgggcagcaaaacttaagcattggaaggatgaattcgtttgtacactgcagcattactggttagggacaaaactactctgggcagatgttaggatctcatcaagattgctggtgaaacttgctggggggaagagcctttcaagaagagagaggcaacagctgacacgcacaacatcatatatcttcaggcttgatccgggggctgtgttcatcattgttccattcatggaattcttactgccagtcttttttaagttatttcctaacatgcttt

SEQ ID NO: 31545 - DNA, 363 bp, Zea mays
  Clone ID: LIB3059-017-Q1-K1-E6
cgagatatggcggacggcaagcgtggggaggattcggccgtggcgttgaagacggcggcgtcgtcggcggtgatggctgggggtttacgcggcgtgagcaaccctctggaggagtggagcgggcgcgtgaaggcgattgaggccgggttccgcgcgtggatggcgaagcaacccatccaaatcgaggccgcggtgaccacggccgtgggggcggtgcagggcggggctctgggtgggctcatgggctcgctcacagctgacggcgggtcgccgttccccatcccgcagccgtcgtccaacgggacccataggccatggcgtcgttcaagcaggcccaggctttagctggtggacctttggtgc

SEQ ID NO: 31546 - DNA, 198 bp, Zea mays
  Clone ID: LIB3059-017-Q1-K1-E8
ggccaccttggtatgtcatcatttaggtcataggataggagagcataagagggtacggttctgatattgggggcctggactcacctgtacaaatgagttggaaacaaccagccagcatgtttttttatctatttgattggatggacataagcgctcaccttggaagaaactacccagattttaccgaatgattttgct

SEQ ID NO: 31547 - DNA, 353 bp, Zea mays
  Clone ID: LIB3059-017-Q1-K1-F1
gcagctaccaaattgttcaaccaggcatatgaaatccttggatatgacttgctggatctgggcaccaatggaccaaaagaaaagcttgactcaacaatgatcagtcagccagctatatatgtcaccagccttgcagcagtagaggtactacgtgcacgcgatggaagccaagatgtgattaactctgtagatgttacatgtggtctcagtttgggagagtataccgctcttgcatttgccggtgcttttagctttgaggatggactgaagcttgtcaagctaagaggagaagctatgcaggatgcttcagatgctgccaatagtgcgatggttagtgtgattggtctggattc

SEQ ID NO: 31548 - DNA, 384 bp, Zea mays
  Clone ID: LIB3059-017-Q1-K1-F10
cattttccttgcaaccgattgcctatccccctcccaaccaaagaccgatggcgcccaaggccgagaagaagcccgcggcgaagaagccggcggaggaggagcccgcggccgagaagacgaccgccgggaagaagcccaaggcggagaagcgggtccccgcgggcaagtccgccggcaaggagggcggcgagggcaagcgtggcaagaagaagggcaagaagagcgtggagacgtacaagatctacatcttcaaggtgctgaagcaggtgcacccggacatcggcatctcctccaaggccatgtgcatcatgaactccttcatcaacgacatcttcgagaagctggccggcgaggcctgcaagctcgcgcgctacaacaagaagc

SEQ ID NO: 31549 - DNA, 372 bp, Zea mays
  Clone ID: LIB3059-017-Q1-K1-F11
cccacgcgtccgggcaaaccccccaagttcgcctgggggcacagcacctgcgtggttggcggcactagggtcctcgtcctcggaggccacaccggggaggagtggatactgaacgagctacatgagctctgcctggcaagcaggcccgacgacgacgacgatgaccgctactgactagtttcgttgcacatggttcatctgttttatatgctatatgctattgttcgtaactacttccagtatgttgttgggtaatcggtatgagaaaaaatagtggaaaattaattaaaaaagttagactagaagattttagtgtattttgttttcatcggagaagttttcttttatcggtctagatagattctatggtct

SEQ ID NO: 31550 - DNA, 432 bp, Zea mays
  Clone ID: LIB3059-017-Q1-K1-F12
tcttccttggggagacgtttccaattccagtatatctttctcttcttccaatggttgggggttgtgctctagctgctgtcacagagctgaactttaatatggttggatttatgggtgccatgatatccaaccttgcatttgttttccgcaacatcttctcgaagaggggcatgaaggggaagtccgtcagtggcatgaattactacgcttgcctgtcaattatgtccctggtcatactgactccatttgctatagctatggaaggccctcaaatgtgggctgctggttggcaaaaggctcttgcagaagttggacccaatgttgtctggtggattgctgcacagagcgtgttctaccacttatataaccaggtgtcctacatgtctctcgatcagatttctccattgacattcagcattggcaatacaatga

SEQ ID NO: 31551 - DNA, 410 bp, Zea mays
  Clone ID: LIB3059-017-Q1-K1-F3
gagagatggaaattcagatgcttatgattatacagaggctgctggacaaattcatggagtggaggactatagaggactgccaagtgcttctggatttctggtgcaagactgaggctacatgaggctcatgctggttcttctgagtctgtggtggagatccagggcacactggaccaagcaaaagctgcgcagagcctcctggagggctttatcagcgcgaacagcaggcagcagcaatcccattcttctcgcatgccactttacccaagatggggatagcttctggttgtggcaggggaaaaccgagtcagcaaggttggctggagttatcttagactgcagattagattcatcgatgatgttaatggtagctgtttaaattgaccgtgcaagcctgataacttatatta

SEQ ID NO: 31552 - DNA, 403 bp, Zea mays
  Clone ID: LIB3059-017-Q1-K1-F5
accttctccacggaggaggcgattcggaacgccatcgagggcatgaacggcaaggggcgggacggccgcaacatcaccgtcaacgaggcccagtcccgcggcggccgtggaggcggcggcggtgggtacggtggtggccgtggaggcggcggctacggcggtggcgggcgccgtgatggcggtggcggctacggcggtggcggcggctacggtggcggcggcggctacggtggtggtggcggcggctactgcggtggcaaccgtggcggctgcttctgcaactcctactggaactggaggagctgagcggttgtgcccgctcggtcaagttatcctgttcgctaccgtgatgtttaccctagtccagatggtttatctttcttcgtgtcgtgtttgttgttgc

SEQ ID NO: 31553 - DNA, 393 bp, Zea mays
  Clone ID: LIB3059-017-Q1-K1-F6
gggtactggaagtggtttgctggaaatctggcttctggtggagctgctggtgcgtgcgctctattctttggctatgtctctggactacgcccgtacgcgtttggccaatgatgccaaggctgcaaagaagggtggtgagaggcagttcaatggactcgttgatgtttaccgcaagacccttgccagtgatggtattcgtggcctctaccgtggattcaatatctcttgtgtggggatcattgtgtaccgaggtctttactttggtatgtatgattccctgaagccagtgcttcttgttggtaccctgcatgataacttcttggccagcttcttgctcgggtggggtataaccattggtgctggccttgccttctaccccattgacactgttct

SEQ ID NO: 31554 - DNA, 426 bp, Zea mays
  Clone ID: LIB3059-017-Q1-K1-F7
gatcacccttgaggtggagtcctcagacaccattgacaacgtcaaggccaagatccatgacaaggagggcattccaccggaccagcagcggctgatcttcgccggcaagcagctggaggatggtcgcaccttggctgactacaacatccagaaggagagcaccctccacctggtgctccgcctcaggggtggtatgcagatttttgtgaagacattgactggcaagaccatcaccttggaggtggagtcgtctgacacaatcgataatgtcaaagccaagatccaggacaaggaaggcattccaccggaccagcagcgcctgatctttgctggcaagcagctggaggatggccgtaccctcgccgactacaacatccaaaaggagagcaccctccacctggtgcttcgcttgcgaggtggtatgca

SEQ ID NO: 31555 - DNA, 436 bp, Zea mays
  Clone ID: LIB3059-017-Q1-K1-E11
cccacgcgtccgcacaagcaacatagaaagtggaatccagtagcaacaacagagcaagaatggcgaccaagatattttccctccttatgctccttgctctttctgcatgtgttgctaacgcgacaattttccctcaatgctcacaagctcctatagcttcccttcttcccccataccttccatcaatgatagcttcagtatgtgaaaacccagctcttcagccctataggctccaacaagcaatcgcagcaagcaacatacctttatcacccttgttgtttcaacaatcgccagccctatctttggtgcagtcattggtacaaaccatcagggcacagcagctgcagcaactcgtgctacctgtgatcaaccaagtagctctggcaaacctttctccctactctcagcaacaacaatttcttccattcaaccaact

SEQ ID NO: 31556 - DNA, 525 bp, Zea mays
  unsure at all n locations
  Clone ID: LIB3059-039-Q1-K1-G5
accggtttcggaattacccgggctcgacgccacgtcgtctcgccgcacgtcgtctcgtcccacgtcgtctctgtactaatcagtaaccaagggtcaaaacttcaacatggtcccgcgaagggctccatcatgatnnctctatgagaagttactacaatcagtaacaatgtcaataccttcaagttgtatgttagggagaagttttcatctctttgacgaatttgatgatcnttcttcccaagtaccctgagctttttgaagggtattngttgactcggacaacgcntgcccctgaaccgtgtcacgaagaatatgcttcaacaacatagcagtctcaaagaccattcaagaagaatgctgattccgcaaaagccctttgacattgaatcaggatacttttgctgaagaagacccctgatgaagtaccagcacccaaggataagacaggatgaaagaggaaaagcgaagatggaggaagaagaaaggccagttcgccaaagttctggaatgagtttggcaaatcaa

SEQ ID NO: 31557 - DNA, 429 bp, Zea mays
  Clone ID: LIB3059-039-Q1-K1-G7
cccacgcgtccgcccacgcgtccgcccacgcgtccgcttcaaccctacaggatccaacgggcaatcgcagctggcatcttacctttatcacccttgttcctccaacaatcatcagccctattacagcagttacctttggtgcatttattggcacaaaacatcagggcacaacaactacaacaacttgtgctagcaaaccttgctgcctactctcagcaacagcagtttcttccattcaaccaactagctgcattgaactctgcttcttatttgcaacaacaacaactaccattcagccagctacctgttgcctacccccagcaatttcttccattcaaccaactggcagcattgaactctcctgcttatttacagcagcaacaactactaccattcagccagctagctggtgtgagccctgctaccttc

SEQ ID NO: 31558 - DNA, 411 bp, Zea mays
  Clone ID: LIB3059-039-Q1-K1-G8
ctgcactgaaccctgctgcttatttgcagcaacaactattaccattcagccagctagctactgcctactctcagcaacaacaacttcttccatttaaccaattggccgcactgaaccccgctgcttatttgcagcagcaaatactactaccatttagccagctagctgcagcaaaccgtgcttccttcttgacacagcaacagttgctgcctttctaccagcagtttgcggctaaccccgcaaccctcttacaactacaacaattgttgccctttgtccaacttgctttgacagacccagcggccttctaccaacaacacatcattggtggtgccctcttttagattgcttattagttgtaattcaataataaagttttttggatgatgtatgtggccaaccagaaataag

SEQ ID NO: 31559 - DNA, 386 bp, Zea mays
  Clone ID: LIB3059-039-Q1-K1-H1
gggttggcttctcctacccctccggttcgggttcgggttcgtgaggttctacggggtgcggttgcgtgggtgagcggatcgagatggcggcgtctgatgttgagtaccgctgcttcgtctgcggcctcgactgggccacggacgaccactccctccacaacgccttcagcacctacagcgaggtcctcgagtccaagatcatcctggatcgggagacgcagaggtcccgcggcttcagcttcgtcaccttctccacggaggaggcgatgcggaacgccatcgagggcatgaacggcatggagctggacggccgcaacatcaccgtgaacgaggcccagtcccgagtcggccgttgaagctgctgcggtgggtacagtggtggccgt

SEQ ID NO: 31560 - DNA, 118 bp, Zea mays
  Clone ID: LIB3059-039-Q1-K1-H10
gaggtacaaagccgttgttagcttgtttagaagagtatcggctatgtccaaagcatggcgatatggtgatgcagcaaaacttatgtcaatgcttgaagatgcttcaaatgggttttct

SEQ ID NO: 31561 - DNA, 368 bp, Zea mays
  Clone ID: LIB3059-039-Q1-K1-H11
gtctcaacatgcagcgtgttatgcaaaataatgctgctgtattccgtacacaggaaacacttgaagaaggttgtgagctgattagcaaaacatgggaaagtttccatgatgtgaagctcagtgaccggagtctcatttggaactctgacctgatagagacccttgagctggaaaatcttttgataaatgcatgcataaccatgtattcggcagaggctcggaaggaaagcagaggagctcatgctcgtgaggatttcacgacaagagatgacgagaagtggatgaagcactcactggagtactgggaaaacgagaaagttcgattggcatacaagccattgcacatgaacacattagacgatgaagta

SEQ ID NO: 31562 - DNA, 349 bp, Zea mays
  Clone ID: LIB3059-039-Q1-K1-H12
aacaccaggctccagattatggtcaacccgtcgtgcggaaagggcaggggctcctgcccggtcccgccgaggccgccagcggaggacaagaagccctgcaacaggaccagcatcaacaggggctccctcgtgaagcggatgcccttcttccgccgcagcaggtcgcgtcctcgctcaagggcggcgtcatccaaagatgggctcatcgtcgtcggtgacgggaaagagagcgacggcgacagcgcgttggcggatccagcgccgacgacgccgacgatgggcctagtccagatgaagcggttcaccagcgggcgctccgcgtttaaggacttcgactggcggaaggagg

SEQ ID NO: 31563 - DNA, 359 bp, Zea mays
  Clone ID: LIB3059-039-Q1-K1-H3
cccacgcgtccggttcccttctgacccatgggacagggtttctgattccgccaaggagctcgtgaccgggatgctgcggcgcgaccctaggctgcggctcacggccaagcaggttctagagcatccgtggatgcaggaacacgcggacccacaagactcgtgcgggcagtgccacgagaccggccttcaacgggagggcgccggctcgtgctccttctacacgccgttggcgtcgcggagcatggacgtgagctttgacacgcgtggccccatcgcgtggaggggtgggggcgaggacgaggcgacctgctgctcgcccacgttcgccgtcgtctgcaggtcgtcgttctcggcgttca

SEQ ID NO: 31564 - DNA, 383 bp, Zea mays
  Clone ID: LIB3059-039-Q1-K1-H4
aaacctcattgattggataatcagagcacagcatgtgccaactgacaactactaattgcaccgtatgctcctgatgtaaatcggagctactctatcctactatcacaaggtctttcggtgacttcagcatgtcctgcatcatcactgctatttcgcatacctcaagtacctactcgtaagtgctctccctccccctgaatctggtctattctccatacaatcgcaaatcacgcggtgctagcaagtaagaattgctcactgtctcacatgtttgatattcttctgtactatttcaacctttagttgcattcatatgcttaagtctgattcttcttctgtataatcctatctttgacagtactagaaaattattctcatgatat

SEQ ID NO: 31565 - DNA, 417 bp, Zea mays
  Clone ID: LIB3059-039-Q1-K1-H5
gagcattcagaaacacaccaagcgaatcacattagcaacaacctaacaacaatggctagcaagatattatccctccttgcgcttcttgcgctttttgcgagcgcaacaaatgcgttcattattccacaatgctcacttgctccaagttccattattacacagttcctcccaccagttacttcaatgggcttcgaacacccagctgtgcaagcctataggctacaacaagcaattgcggcgagcgtcttacaacaaccaatttcccagttgcaacaacaatccttggcacatctaacaatacaaaccatcgcaacgcaacagcaacaacaattcctaccagcactgagccacctagccatggtgaaccctgccgcctacttgcaacagcagttgcttgcatcaaacccacttgctctg

SEQ ID NO: 31566 - DNA, 407 bp, Zea mays
  Clone ID: LIB3059-039-Q1-K1-H6
gctccaacaagcaatcgcagcaagcatcatacctttatcacccttgcttcaacaatcgccagccctatctttggtgcagtcattggtacaaaccatcagggcacagcagctgcagcaactcgtgctacctgtgatcaaccaagtagctctggcaaacctttctccctactctcagcaacaacaatttcttccattcaaccaactgtctacattgaaccgtgctgcttatttgcagcaacaactattaccattcagccagctagctactgcctactctcagcaacaacaacttcttccatttaaccaattggccgcactgaaccccgctgcttatttgcagcagcaaatactactaccatttagccagctagctgcagcaagccgtgcttccttcttgacacagcaac

SEQ ID NO: 31567 - DNA, 408 bp, Zea mays
  Clone ID: LIB3059-039-Q1-K1-H7
ctgctcctcgcctcctctccctagccttcacgacgcatgggagagtgacggaaagcgacgcggcgcgagcgaggagggccaaggggaagaggggaagcaccgcaccaggacccttgttcgccgccgtcgcctctgatctccgcgaggttgtcaggattcaatatgtcgaccagcacattcgctacttcctgcacgctgttgggcaatgttagaacaacgcaggccttccagacagcggtgaagagcccttcgtctctaagcttcttcagccaagttacgaaggttccaagcctgaagacctccaagaaactggatgtctacgccatggctgtatacaaggtgaagcttgtcgggcctgaaagtgaagagcacgagtttgatgctccagatgacgcctacattcttgac

SEQ ID NO: 31568 - DNA, 385 bp, Zea mays
  Clone ID: LIB3059-039-Q1-K1-H9
ggggccgtcaagctcaaccacggtcattacatcgcatcaactggtcggggggcctgcgccacgccaagaagtgcgaggcgtcgggcttctgctacgtcaatgacatcgtgctcgccatactcgagctgctcaagcatcacgagagagttctgtatgtcgatatcgatatccaccatggtgatggagtggaggaggctttctacacaacagatagggttatgactgtctcgttccacaagtttggtgattatttcccaggaacaggggatatccgtgacattgggcactcaaaagggaagtactactccctgaatgtccctctagatgatgggattgatgatgaaagctaccagtccctttttaagccaatcatgggcaaagttat

SEQ ID NO: 31569 - DNA, 395 bp, Zea mays
  Clone ID: LIB3059-040-Q1-K1-A1
gttggattgtgttcaaagttgggcttttggacagctgtggggggcacggcagctctgtgacttgtgaagaggaagggaggaagaaagcggatccatggcgtcgaagcggatcctcaaggagctcaaggacctgcagaaggatccttccacctcttgcagcgcaagccctgttgccgaaaatatgttctactggcaagcgacgattatggggccatcagatagcccatacgctggtggcgtatttttggtcactattcactttccaacggactacccattcaaaccaccgaaggttgcattcaagacgaaggtttaccacccgaatatcaacagcaacgggagcatctgtcttgatatcttgaaggagcaatggagccctgcactgacagtttcta

SEQ ID NO: 31570 - DNA, 218 bp, Zea mays
  unsure at all n locations
  Clone ID: LIB3059-039-Q1-K1-E7
ccggtttcgtgaattacccggggctcgacgccacgtcgtctcgtcccacgtcgtctcgggctcgtccctttttttgttttttttttacaagaatgtcaaaagtcgctgcgtaatgtgtaacgtgaaactatttgtgggcatcggaggaatcgtttactagtactatatngcagttggaacactatctcaaacgtcagggaagattatagtctgtccca

SEQ ID NO: 31571 - DNA, 416 bp, Zea mays
  Clone ID: LIB3059-039-Q1-K1-E9
gggacttctaagtaccagctctctgtatctatcaaggatgttagtggccaaaggattggtgaatatgctagtgcctcgggaagtgttgattttgattctgtgctgtgtagaaactgtaagcgccatatagccagccagtctgctcatcttcatgaggcatactgcatgagacacaatgtagcctgctcacatgatgggtgtggagttgtccttcggaaggaagaagcagcagatcatgtgcactgcaacaagtgcggacgagcttaccagcagagagaaatggaaaagcatatgaaagtcttccatgaaccgttgcagtgcccctgtggggtggtcctggagaaggaagatatggttcagcaccagtccttgacttgccccttgcgattaattgtgtgccgcttctgtggtgacac

SEQ ID NO: 31572 - DNA, 418 bp, Zea mays
  Clone ID: LIB3059-039-Q1-K1-F11
gcgcttcttgccctttttgtgagtgcatcaaatgcgttcattattccacaatgctcactggctccgagtgccattattccacagttcctccctccagttacttcaatgggcttcgaacacccagctgtgcaagcctataggctacaacaagcgcttgcggcgagcgtcttagaacaaccaattgcccaattacaacaacaatccttagcacatctaaccatacaaaccatcgcaacgcagcagcaacaagcactgagccacctagccgtggtgaaccctatcgcctacttgcaacaacagctgcttgcatccaacccacttgctttggcaaacgtagctgcataccatcaacaacaacagttgcaacagtttctgccagcgctcagtcaactagccatggtgaaccctatcgtctacc

SEQ ID NO: 31573 - DNA, 417 bp, Zea mays
  Clone ID: LIB3059-039-Q1-K1-F12
aggcacgcgggggcgcaaggcgcgacggctcagcgcggtctcgactgcccgtgtacggggcagccaccccgtggcgggcggctcccgacctcaacggctcgggcgcgggtccggctgctcggccatggcggcacaagtgcgcggccccctgagcgggcgagcgcgcagtcccgcggctctggcagtgcgggcgctaaccaggcgcagccagtgtgggttcgtcccggcgggcgcatggtaccggccatggtgccccgttgaggcgcgtgcgcgcacatggtattctcacggaggcaaccagacggtcgaacggatcatcatggtacagaacactccatgcataggagtgggcagaaaggtaaatctggttgttgaaacaaattaacatacgatctttgaaaacctgttgctgagtaa

SEQ ID NO: 31574 - DNA, 437 bp, Zea mays
  Clone ID: LIB3059-039-Q1-K1-F2
cattcaaccaactagctgcattgaactctgcttcttatttgcaacaacatcaactacgattcagccagctacctgctgcctacccccagcaatttcttccattcaaccaactggcagcattgaactctcctgcttatttacagcagcaacaactactaccattcagccagctagctggtgtgagccctgctaccttcttgatacaaccacagttgttgccgttctaccagcacgctgcgcctaacgctggcaccctcttacaactgcaacaattgctgccattcaaccaacttgctttgacaaacccagcagcgttctaccaacaacccatcattggtggtgccctcttttagatttcttatgagttatagttcaataataaagttttttgtctgatgtttgtggcttcccagaaataagaaagtacatttctaaaa

SEQ ID NO: 31575 - DNA, 393 bp, Zea mays
  Clone ID: LIB3059-039-Q1-K1-F3
gtgcactgaagaagcctggaggagatgaaatgctgataggcatttctcataagccatcatcccatacatctcatctagcatttcctggccaaacctctgcaacaaattctgatgtccgagttcacactaaagctgttacttttgaagacgacatatatgtagttagttcgtcaaagtctgctaccttgctactggattctatacagtctgatcctgtgctcaagaattcttcagaccccgctctatctcgtgacagaaagataatatcaagtggactaaaggcctttacaggatctatcattgagcacgacgactatgtttccaccattgaaccttctgtggctagttcgttggcaaaacctggtactagtgcttcttcaaggcccgtgtcaa

SEQ ID NO: 31576 - DNA, 102 bp, Zea mays
  Clone ID: LIB3059-039-Q1-K1-F4
gcagtggctgggctgcttttttagctgggagcttacataccttgtctgggccagaccatctgggtgccctggcgccactgtcaatggccagatccagacttg

SEQ ID NO: 31577 - DNA, 421 bp, Zea mays
  Clone ID: LIB3059-039-Q1-K1-F5
caactagcaacatataaagcacaatagtgtaccaacaatggccgccaaaatatgttgcgtccttatgctccttggtctctctgcaagtgttgctaccgcaaccattttcccacaatgctcacaagctcctatagcttcccttcttcccccatacctctcaccagctgtgtcttcagtgtgtgaaaacccaattgttcaaccctacaggatccaactggcaatcgcaacacgcatgttaccattatcacccttgttcctacaacaaccgtcagccctattacaagagttaccttaggtccatttggtggcacaaaacatcatggcacaacaactacaacaacttgtgctagcaaaccttgctgcatactctcagcaacatcagtttattccattcaaccaactggctgcattgaactctgct

SEQ ID NO: 31578 - DNA, 395 bp, Zea mays
  unsure at all n locations
  Clone ID: LIB3059-039-Q1-K1-F6
ctctgcgctgagcacaatgttcacctggtcactgttcctgccgcgaagactcttggcgagtgggccgggctttgcaagattgactctgagggcaaggcaaggaaggttgtaggctgctcctgtgtcgtcgtcaaggactacggtgaagaatctgagggccttaacatagtgcaggagtatgtcaagtcgcactagatgtgtgacatgtttcagtgatactcttgatttggacctgggcttaaaattatgcttttgcatctggggcttgcctaagagattagaacattttactagaagagccgaagaggatatgtatgaacaatttggacatctgaattttttttgtttatggtgctgtcgtctggttntaatgcaaatcatgaagagccgagttt

SEQ ID NO: 31579 - DNA, 420 bp, Zea mays
  Clone ID: LIB3059-039-Q1-K1-F7
cgttctggtcgtgtgcctggctatgtcatctgtcagcgcgtctgcaatgcagatgccgtgcccctgctcgttgctgcaagtcttgttctgcgctagcgccggcctgacgacgattatgggcgcctgctggctgtacacttacgcggagtacctgaggcagtcgaaatacagcacgatggcggcgactccatactactccgtgtgagggcagactaacgctatgtaccaggcgctgcggtaacagtgctgccatcagcagatgaggatgatggacgtacaatacgtttcgcatcagctagagatgaagattcagcttgagcgtgccgctgacgtcagcatcagcctgtactagccactgttgatgcatcatcagcagcatctgatggcagctcatgctcttaaccccatggccatgatgat

SEQ ID NO: 31580 - DNA, 294 bp, Zea mays
  Clone ID: LIB3059-039-Q1-K1-G11
atttgtgtttcctcatgatgtttgggaatgggatagggggttggcagctggtgagtttaggctgttttttcccagcctgttttgacactgattactgtatacttgaactgcggtttggaaatgctccagctgttaggttcaaaaaaaaaaaaaaaaaaaaaaaaaaaaaaaaaaaaaaaaaaaaaaaaaaaaaaaaaaaacaaaatataaaaaaaaacaaaataaatttgcaataaaaacaacattataaaaaataaataaaaaaaaaaaaggggcgccctttttaaaggttcc

SEQ ID NO: 31581 - DNA, 307 bp, Zea mays
  Clone ID: LIB3059-039-Q1-K1-G2
tatgatcttaagcagattgagttacaattcattcaccaagcaatctacaacagggttcggtccataatccaagaggagcaacaacaacaaccatgtgagttatgtggatctcaacaagctactcaaagtgcggtggcaatcttgacagcagcacaatacctaccatcaatgtgcggcttgtaccactcatactaccaaaataatccatgcaccatcaatgacattagtcgtgtttgcaattgaagaattgtgtctacctaaccgttatacttctataacggtgttaagcaataaagtaccatacatt

SEQ ID NO: 31582 - DNA, 418 bp, Zea mays
  Clone ID: LIB3059-039-Q1-K1-G3
cggacgcgtgggcggacgcgtgggcggtcgcgtgggcaactagcaacatagaaagcacgatagtgtaccaacaatggcagccaaaatattttgcttccttatgctccttggtctttctgcaagtgttgctaccgcaaccattttcccacaatgctcacaagctcctatagcttcccttcttcccccatacctctcaccagcggtgtcttcaatgtgtgaaaacccaattgttcaaccctacaggatccaacaggcaatcgcaacaggcatcttaccattatcacccttgttcctccaacaaccgtcagccctattacagcagttacctttggtccatttggtggcacaaaacatcagggcacaacatcttcaacaacttgtgctagcaaaccttgctgcatactctcagcaacatcag

SEQ ID NO: 31583 - DNA, 424 bp, Zea mays
  Clone ID: LIB3059-039-Q1-K1-E6
caatagtgtaccaacaatggcagccaaaatattttgcctccttatgctccttggtctgtctgcaagtgctgctaccgcgaccattttcccgcaatgctcacaagctcctatagcttcccttcttcccccgtacctctcaccagcggtgtcttcggtatgtgaaaacccaattcttcaaccctataggatccaacaggcaatcgcagctggcatcttacctttatcacccttgttcctccaacaatcatcagccctattacagcagttacctttggtgcatttattggcacaaaacatcagggcacaacaactacaacaacttgtgctagcaaaccttgctgcctactctcagcaacagcagtttcttccattcaaccaactagctgcattgaactctgctgcttatttgcaacaacaactacca

SEQ ID NO: 31584 - DNA, 243 bp, Zea mays
  Clone ID: LIB3059-039-Q1-K1-D10
cggacgcgtgtgctgacgccttggcggtacgcttggtgaagaaacagacactgcaactagggccaaataactaccacccggtttagccggctccgctgacaccgacgaaactgccctctgtctacaggatgcacaattacaaggccatgaaggcccacgagctggtctgccatgagtgctgaagtggaaggaagtggacgtcgttgaacaccgtgaaggcgagatacacattaggaccaccga

SEQ ID NO: 31585 - DNA, 87 bp, Zea mays
  Clone ID: LIB3059-039-Q1-K1-D3
gggctggaaagctgccttttgttgtttcactaagatgaaggttgtatgatctctgtcggttcgtagtggaagttgttacaccagatg

SEQ ID NO: 31586 - DNA, 405 bp, Zea mays
  Clone ID: LIB3059-039-Q1-K1-D4
cccacgcgtccgcggacgcgtgggttttgaagagaatccaacggaccttgatttgctgaaacacgataagttgctatgcaacatggaaattcctgcatacctgcgtgatgtccctgactacctaattgatccgaaaacaaaagaagccaacaatgctgtcaagctttccaaggctgctatgcatatcgacaagccccaaaagcggaaaaagcaagggtttaagggaagatcaaggaaaagcagagaccctctcaagacattctctgctgaaggcaaactaaggaaacggaagaaagaaagggaaggagaaccaaatagaagaaagaagagtaagagggcggaagttgatttttcaagcagtttgctatcaagctcgcccaatttgtaggctttcttgtttgaagc

SEQ ID NO: 31587 - DNA, 310 bp, Zea mays
  Clone ID: LIB3059-039-Q1-K1-D5
tcccgctcgacccactctctctcccatcgtcctcttacgcttttcttctcgtgtgctgcattattacacatgtacagcgtacatggattgatagaggagtcagactacacacattatcatgtacattcttaccaataatatatgcatgatcataataaacttttagttttaatgaatcaatataaacaactaatatcttcactcttaaaattaataacaatcttcactataattcttatttatatatataactattttaaagcaaataatttttttaacaattatattataaatactttcactttaatat

SEQ ID NO: 31588 - DNA, 376 bp, Zea mays
  unsure at all n locations
  Clone ID: LIB3059-039-Q1-K1-D6
cccacgcgtccgggggttcggttggtgctgaatatgttgttgagtctactggtgtttgcactgaccaggagaaggctgcagctcacttgaagggtggtgccaagaaggttgtcatctctgctcctagcaaggatgcccccatgtttgtcgttggtgtcaacgagaaggagtacaagtctgacattaacattgtctccaatgctagctgcacaaccaactgccttgctcctcttgctaaagtcatcaatgacaagttcggtatcgttgagggtctgatgaccactgtccatgccatcactgctacccagaagactgttgatgggccctcatctaaggactggangggtggaagggctgctagtttcaacatcattcc

SEQ ID NO: 31589 - DNA, 138 bp, Zea mays
  Clone ID: LIB3059-039-Q1-K1-D7
gcaatacgtctaatcagtcatcattatacgatggtttatacggtatatatacgactgcgttggtagcaagctgaaagattactttgtatcgtactattttaattatattttgtggagataaagaaattattatgagct

SEQ ID NO: 31590 - DNA, 429 bp, Zea mays
  unsure at all n locations
  Clone ID: LIB3059-039-Q1-K1-D8
agcgaagcacattagcaacaacctaacaacaatggctaccaagatattatccctccttgcgcttcttgcgctttttgcgagcgcaacaaatgcgttcattattccacaatgctcacttgctccaagttccattattacacagttcctcccaccagttacttcaatgggcttcgaacacccagctgtgcaagcctataggctacaacaagcaattgcggcgagcgtcttacaacaaccaatttcccagttgcaacaacaatccttggcacatctaacaatacaaaccatcgcaacgcaacagcaacaacaattcctaccagcactgagccacctagccatggtgaaccctgccgnctacttgcaacagcagttgcttgcatcaaacccacttgctctggcaaacgtagttgcaaaccagccacaacaaca

SEQ ID NO: 31591 - DNA, 372 bp, Zea mays
  Clone ID: LIB3059-039-Q1-K1-E10
cacgatatggtcttgaagttggtctgaccaactatgcagctgcctactgcactggccttctgttggctcgccgtgtgctcaagacccgtggtttagataaggaatatgagggcaatgttgaggccactggtgaggatttctctgttgagccagctgatgagaggaggcctttccgtgctctcttggatgttggccttattaggactacgactgggaaccgtgtctttggtgccctcaagggagctttggatggtggcctggatattcctcacagcgagaagaggtttgctggtttcaagaaggatgacaagcagctggatgctgatatccatcgcaagtacatctatggtggccatgttgctgactacatga

SEQ ID NO: 31592 - DNA, 232 bp, Zea mays
  Clone ID: LIB3059-039-Q1-K1-E12
gcaaggaggacctgcggtggtgcaagcaggcgtgcgagtggcagtacggaaaggacacgccgcggaagagggaatgcgagagcgagtgccgcgagcggcaccagcaagctgacgcgggcgaggacggcgacagcggcgtggacgcctacgtctcccgctccgggaggggcgagtgccggcgccagtgcctgcgccgtcacgagggccagccgtgggagacccaggagtgcat

SEQ ID NO: 31593 - DNA, 433 bp, Zea mays
  Clone ID: LIB3059-039-Q1-K1-E2
gttcacgcgttcaaagatgcgtggggaaaacaacatagtcctccttctcctcctcctgtgtgctgtaatttctccgaaccaagtaattggtagtgcttgtactccggaacagaaggctgccatcctaaatcaatgcgaagagtacatcaagcctggatacccccttatactgccatcgtacgccagtgtgtgttgcgacaaggtgagagatgtgccaaatagggacatgaactgcatcgtcgatctgctcacgcctccaaaaaaagcgaaacacggtgtcgacaagataaaacgtctgaaagatctctgcgacaacttcgctcatcatcagacagacagcaactgtcattgctaatggaagttcgaggcaagatatatggtctagtaaataaagtcgtcgatcaaagcatgacaactgtcaaatgtatctttg

SEQ ID NO: 31594 - DNA, 373 bp, Zea mays
  Clone ID: LIB3059-039-Q1-K1-E3
cccacgcgtccggaggacgacgctgcggcggctgcgctcagggtcagcaaggcgaccgtcaacgttgacaccggcgacagcgccgacgaggccgtcgccgaagctgctgctgaggagaaagagaaggaggaagtccagccgaagcccgctgacggttccggctccggctccggctccggcggcggcgcagccaagccggtgtgctacgagacgagccgtcgttccgacacctgcgaggcggctggcgacgtgcgcgtccttgggagcacccagacggtgtacgtggactcgctggaccgggagtggaagaccaagccgtactgtcggaagcacgacaacttcgcgctcgcccacgtcaaggagtggtccctga

SEQ ID NO: 31595 - DNA, 276 bp, Zea mays
  Clone ID: LIB3059-039-Q1-K1-C9
aacaaatgcattcattattccacaatgctcacttgctcctagtaccattattccacatatcctacctccagatactccaatgcgcttctaacactcatatatgcaatcctataagctacaacaatctctcacttctatcgtcttacaacaaccaattttccatttacaacaacaatcctatatacatctaaccatacaaaccatagtatctaactatcttaacaactcattcaacaaaacatgataaaccctatatcctactttcaacaacagatt

SEQ ID NO: 31596 - DNA, 373 bp, Zea mays
  Clone ID: LIB3059-039-Q1-K1-E5
aaagcattgtgaagcccgggtgctcgcaggatgtccttaaagcagcggtaagcgccatggcttctgtgacggagatgttgaccatcatgtcttccctttcatttagtggacaggcgaccatctgaaggccaagctgaagatgtcatatgctgttgcgctgtcatgtcccgaacatatttgtgtttttttgggaaagaaacatacaattttttgttctcattctagtatcgtctacctatgtcaaactacaatatgataggacccttgctaaataattgtttcgtttgctggtatttctcatctttgatgctaggcatgttggaaagttaaaaaaaaaaaaaaaaaaaaaaaaaaaaaaaaaataaaaataaaa

SEQ ID NO: 31597 - DNA, 430 bp, Zea mays
  Clone ID: LIB3059-017-Q1-K1-C8
cccacgcgtccggttttgataaataggtactcagggaaaatacagtgtgaaccatagcgagaatgccttgagttctcttaacacaaaaatcctaatccaaagtgcaaataaagtgtagccatctcaacaatcaaacatgacatcatagaaaccaaatatgagattgctcaagcttcaacagcaacccttccagccacctggtccagatcacgccttccctgggaggtgatgcgccgtccacccttgggatcgacatcaatgatgcccatctcctgcagctgctggaggatgttgcgtgaaatggcaccactgctcttgcagaagtgaggtgggcgtgagccattcctctggcggccaccataaatcttctggaagccaccaacaccaatgccttgtctcaagtagatcttccttgctacagatgcagccc

SEQ ID NO: 31598 - DNA, 345 bp, Zea mays
  Clone ID: LIB3059-017-Q1-K1-C9
ggctggcaagagcatggcgcttgtcggcatgagcggctccggcaagagtaccgtgctggcgctcatcctccgcttctacgacccgatcgccggaagagtcttgatcgatgggaaggacatcaagaagcttaagctcaagtgtctcatgaaacacatcggcctggtccagcaagagccggcgctgttcgcgacgacgatctacgacaacatcctgtatggcaaggacagggccacggaggccgaggtcgttgaggcagccaagctggctaacgctcactcgttcatgagctcgtttccgggggggtacatgaccatggtatgtggagcgcggcttgcatctgtcgg

SEQ ID NO: 31599 - DNA, 414 bp, Zea mays
  unsure at all n locations
  Clone ID: LIB3059-017-Q1-K1-D1
gccagggacgccattgccaaggctaatccggtggtgaaggcagacaagctcgacaagagctagggngggttccctacggttgggtatcaggaagattgtaaaccgcggtaactcgtcatgcggaactgctgccttgccccccgcgcctttctcttccatgtttgctgctacaatcttgttgttgggcattgcagtgcacggtgcacacttgtgtagcccgcctcgagaattcctgcctctgcatctggtcagttctaaaatgatttgcatgttggctatgttgtgtaagctctatttatggtggtctcgctgagacgggtatttggcttcgcagttatctagctatgtgatgtactgttgtcttgtccctgggtattatatggtacactgcagccagtaatagtataaaatata

SEQ ID NO: 31600 - DNA, 432 bp, Zea mays
  Clone ID: LIB3059-017-Q1-K1-D10
ctgctttcatctagccctctcgttgtgggtaatgcacctacatacctgcaacaacaatgtctgcaacagattgtaccagctctgactcagctagctgtggcaaaccctgctgcctacttgcaacagctgcttccattcaaccaactgactgtgtcgaactctgctgcgtacctacaacagcgacaacagttacttaatccactagcagtgcctaacccattggtcactgccttcctacagcagcaacaattgctaccatacagccagttctctttgatgaaccctgccttgtcgtggcaacaacccatcgttggaggtgccatcttttagattacatatgagatgtaatcgataatggtgcccttataccggcatgtgtttcctagaaataatcaatatattgattgacatttatcctcgataaaaaattta

SEQ ID NO: 31601 - DNA, 419 bp, Zea mays
  Clone ID: LIB3059-017-Q1-K1-D12
cggacgcgtgggcaccatctgccgactggtagcagagagaagagatagaccgagagagagagagagaatctgagactgagactggtagcagctgaagcatcggtgctagctagcttgggcagcaacatcacgatgtcgtccaactgcggcgaggatgagaaggagctggtgtgcgtgaccggcgccggcggcttcatcggctcgtgggtggtgaatgagctgctccagcggggttaccgcgtcaggggaacggcgagggaccctgctgacagcaagaacgcgcacctgctggctctggagggagccaaggagcgcctcaccctgtgccgcgcctacgttctcgaccgcgcctccctgctcgccgacttcgccggatgtcacggcgtatgccacgtcgtctctccggtgtccaacgaccc

SEQ ID NO: 31602 - DNA, 246 bp, Zea mays
  Clone ID: LIB3059-017-Q1-K1-D2
agcgccggccagccggtctccaatcctgcaatccctccaatatccaataggggatgaggtgcagcgagcaagtccaataacctacagtgcttggaatttgtggaaggagagatgctggcgaatctttgataacagactttgctttgtactggatgagaaggcagagcacctgccaggctccaatcctgcgtcagcgttcctgcctccctggctccctgccgtctactcgtctccaagaatcatgct

SEQ ID NO: 31603 - DNA, 426 bp, Zea mays
  Clone ID: LIB3059-017-Q1-K1-D3
agggcacaacaactacaacaacttgtgctagcaaaccttgctgcctactctcagcaacagcaggttcttccattcaaccaactagctgcattgaactctgctgcttatttgcaacaacaactaccattcagccagctagctgctgcctacccccaacaatttcttccattcaaccaactggcatcattgaactctcctgcttatttacagcagcaacaactactaccattcagccagctagctggtgtgagccctgctgccttcttgacacaacaacagttattgccgttctacctgcacgctgcgcctaacgctggcaccctcttacaactgcaacaattgctgccattcaaccaacttgctttgacaaacccagcaacgttctaccaacaacccatcattggtggtgccctcttttagatttct

SEQ ID NO: 31604 - DNA, 353 bp, Zea mays
  Clone ID: LIB3059-017-Q1-K1-D5
cccacgcgtccgggaaaccctagccgccatatctcacgatccactcgagcaccgagcggagggaaggtgaggagcgatggcgcgcggcgtggtgtcggcgaagggcggcgcggtcgcgggcaagaagaaggggtcggtttccttcacgatcgactgcaccaagccagtggaggacaagatcatggaggtcgcctcgctcgagaagttcctgcaggagcgcatcaaggtcgccggcggcaaggctggcaacctcggcgactccgtcaccatctttcgcgagaagaccaaggtcaccgtcacgggggacggacccttctccaagaggtacctgaagtacttgtccaataagtact

SEQ ID NO: 31605 - DNA, 423 bp, Zea mays
  Clone ID: LIB3059-017-Q1-K1-D6
cccacgcgtccgcccacgcgtccgggaatatgatgctctgagggttattttcaagaaggtccaatctgtcatatcgtttaagcccacaatggtaacaatactttcccccgaggttgcagaaaaagaatcagaagctggtgggaagatgggtgacctagattcttatgagattgaaggcggcgagacaaaatcagagattttgcagaatctagctgagttccagttttcttgtgtcctgtacaatggtgccctagagaatgcatgcagtgagcttggagcccgtatgtctgccatggacagctctagcagaaatgctggcgatatgcttgatcgtctcactctcacttacaacaggacacgccaagcatccatcaccacagagcttactgagattatatctggtgcatcggcccttgaggggta

SEQ ID NO: 31606 - DNA, 419 bp, Zea mays
  Clone ID: LIB3059-017-Q1-K1-D7
cccacgcgtccgtgctaacatggagctgcaacgtgagctgtttattttctgtcagactgtatgtaccgaccgaggtaggagggaaatgttgtggccttttgtaagcaggtcattggatgtttattttagattattttttggcgttttacccacactacccttgaaacttattgagttcttatccagcaaataagattatgtaatcctggattatataggttcaaagcttgggacagcaatttgtttagagtcctgtataatctagctgtcacgtctcatgactcacgttgagaaagatgaggggatttgcatcgtttatggtttagtaagtggcttattattatatttttatttagtttggccgttttttagtatccaatctttatttacgcttgcattctactttatatctattttta

SEQ ID NO: 31607 - DNA, 427 bp, Zea mays
  Clone ID: LIB3059-017-Q1-K1-D8
cgagctcgctccctccttccacgtcgaggtccgagtcctgctttgatggcgacggacggggctgagactcccgcgccgttggtggatgcggccccagaggcgcccgccgacgccccggcggcgcctgctgccgacgcgaagccggccaaggccaagaaggccaccgcgccgaagaagcgcgccagcccgacccacccgccgtacgccgagatggtctcggaggcgatcacgtcgctcaaggagaggacggggtccagcagctatgcgattgccaagttcgtggaggacaagcacaaggacgggctcccgcccaacttccgcaagcttctgaacgttcagctcaagaagctcgtcgcctgcggcaagctgaccaaggtgaagaactcgtacaagctggcgttcgccgtcaccaagccgaattccaagc

SEQ ID NO: 31608 - DNA, 290 bp, Zea mays
  Clone ID: LIB3059-017-Q1-K1-D9
cgtccgattcccggtcgcccacgcgtcgcccacgcgtcgccacgcgtcgccacgcgtcgggacctgggtgagcgggggaaacacactagcgaagcgcatacacgacctaacaacaatggcttacaagacattatccctcttgccttttgccttttggagtgcaacaaatgcgttattattccaaagctcactgctcagtgccattattccacagtctcctccagttcttaatgggcttcgaacacccactgtgcaagcctataggctacaacagcgcttgctgcagcgtt

SEQ ID NO: 31609 - DNA, 429 bp, Zea mays
  Clone ID: LIB3059-017-Q1-K1-E1
ataccttccatcaatgatagcttcagtatgtgaaaacccagctcttcaaccctatagggtccaacaagcaatcgcagcaagcaacatacctttatcacccttgtttcaacaatcgccagccctatctttggtgcagtcattggtacaaaccatcagggcacagcagctgcagcaactcgtgctacctgtgatcaaccaagtagctctggcaaacctttctccctactctcagcaacaacaatttcttccattcaaccaactgtctacattgaaccgtgctgcttatttgcagcaacaactattaccattcagccagctagctactgcctactctcagcaacaacaacttcttccatttaaccaattggccgcactgaaccccgctgcttatttgcagcagcaaatactactaccatttagccagctagc

SEQ ID NO: 31610 - DNA, 366 bp, Zea mays
  Clone ID: LIB3059-017-Q1-K1-E10
caccgctaaaggtgctgaattcgtggtattcagaccctccgagattgctgccagggttgcacttgctgctatcggcgaatgcaggagttctgtaattgagagagctgctagtagctgcaaatatttggacaaggagagggttttaagatgccatgaaatgattcaagagaagattactgcgggaagcattgtcctaaagtctgctggatcatcaatctgctctgtgccacaaagcccaatatgtgtactggacgctgcatcctgtctgagtcaacaaagcgatgactctactgtcgggtgtgctgcagtatgttaccatagttcttccacaagcaataggagaaagatcactatacgtctactcta

SEQ ID NO: 31611 - DNA, 405 bp, Zea mays
  Clone ID: LIB3059-017-Q1-K1-C7
cgccgttgtagcgacttcgcaggctaaaggccagctttcaaaggctgctaaaacgcaggagtcgaactcttgtctgatatgcttgttgctcgttattttcggagtggtcctgctcatagtgataatagtacttgcagcctaaaagcttggaaggcagctggggttccgaaatctgatcgagagcttattgcgacaaattccttcataagttatttttgctgtgctgctaggaatgattcctggtacccatgcggtgattggcgctctgcttgtggtgtggcggtatatgtggtgatgatggggtctgatgcataaaagtactctttcttgcaagtgtattgcctcatgcacggttttgtttatatattgtgatgtattgatgcttgatgtataacaaggttggat

SEQ ID NO: 31612 - DNA, 199 bp, Zea mays
  Clone ID: LIB3059-017-Q1-K1-B11
aactacaacaattgttgccctttgtccaacttgctttgacagacccagcggcctgctagcaacaacacatcattggtggtgccctcttttagattgcttattagttgtaattcaataataaagttttttggatgatgtatgttgccaaccagaaatatgaagttacatttccagatgttaatgtgaaaaaaaaaattga

SEQ ID NO: 31613 - DNA, 356 bp, Zea mays
  Clone ID: LIB3059-017-Q1-K1-B12
gatcgtcgaacagaacagcatgaagatggtcatcgttctcgtcgtgtgcctggcgctggcagctgccagcgcctctgcaatgcagatgccctgcccctgcgcggggctgcagggcttgtacggcgctggcgccggcctgacgacgatgatgggcgccggcgggctgtacccctacgcggagtacctgaggcagccgcagtgcagcccgctggcggcggcgccctactacgccgggtgtgggcagccgagcgccatgttccagccgctccggcaacagtgctgccagcagcagatgaggatgatggacgtgcagttcgtcgcgcatcagctgcagatgatgatgcaacttgagcgtg

SEQ ID NO: 31614 - DNA, 426 bp, Zea mays
  Clone ID: LIB3059-017-Q1-K1-B2
cccacgcgtccgccctggtgatctgaatgactggtaccgccacacatctaaaggtgcatggccgttctcaactgctgatcatggttggcctatatctgattgcactgctgaaggactaaaggcttcattattgttatcaaggatctctcccaaaattgttggtgaaccgatggaagctaatagattttatgatgctgtcagttgtctgatgtcttatatgaatgataatggcggtttcgcgacatatgaactcacaagatcttatccctggttggagctgatcaatcccgctgagacctttggggatattgtgattgattacccgtatgttgaatgtacatcagcagcaattcaggccctgacatcattcaaaaaactataccctgggcaccgcaggaaagaggtggataactgtatcagcaaagc

SEQ ID NO: 31615 - DNA, 353 bp, Zea mays
  Clone ID: LIB3059-017-Q1-K1-B5
ctggttattatgaagatggggcctttggtataagattggagaatgtacttattggcaaggacgccaatgctaagtttaattttggagataaaggttatttggcatttgaacatataacatgggctccataccagaccaagctgatagacaccgggcttctgacccctgttgagatcgactgggtgaacacgtaccactcagactgccggaagatcttggagcctcatctgaacgagcaggagaagcaatggctgatgaaagctactgagcccgtagctgcaagaggctgagccttttcgtgaacgttgcatgccaccgagcgccatgctcatcttctgcgtggcatacatata

SEQ ID NO: 31616 - DNA, 423 bp, Zea mays
  Clone ID: LIB3059-017-Q1-K1-B6
cttcttcgtcgacaagcaggggagttaggtctcacatgcatgcttcatcacattgttgggtgcataacgaaacacatcgtcgtcggatcggagatgatgagttccgtcgtcgtggatgctgctgctaccagcagcagcgagaagaagacgtcgtggccggaggtggtgggcatgtccatcaaggaggcgacggagactattctcaaggacatgcccaacgcgtacatccaggtgctgcctgttgggtcgcccgtgacgctggaccttcgccccgaccgcgtccgtatcttcgttgacaccgtcgccatgactccgacagttgggtgatacataccaaatgcaataaacaaaccctactttttattttatgtttccagttaataataaaccaggccttagcttcttggttgtccttccttggtt

SEQ ID NO: 31617 - DNA, 460 bp, Zea mays
  Clone ID: LIB3059-017-Q1-K1-B7
ttccctggtctacccactcttcctccaactcatatgaaacaaccatttctactcaataaatacatcactaatcaattcgcctgctcaactatcaatttcccaatcctctacacttaattttattccttccaccattaatctctactacctccttcaattcttcctgtcccatcctatttatgtctttttcctcttctttctttcttttcttttttacctttttttttctttttactttcctttatatattatttttttttcctctttcattcttttctttttttttctctttttttttttttttttttttttttttttcttccttttcttgtttctttttatatttctatttttttttttattttttttttttttttttttttattttattattttttttttttttttttttattttttttttttttttttttttattttttttttatattttttttatt

SEQ ID NO: 31618 - DNA, 429 bp, Zea mays
  Clone ID: LIB3059-017-Q1-K1-B8
agatctcattgcctcctaagtcctatcgcccaccccgatcaccgcgcgggtatcggagcatggcgtctgcggcggcggtggacgccggcgacgcgccggagcccacggtgcggaacctcctagaccaggagtccctcaagtgggtcttcgtcggcggcaagggcggcgtaggcaagaccacctgcagctccatcctttccgtcctcctcgcgggggtccgccagtccgtgctagtcatctccaccgaccccgcgcacaacctcagcgatgccttccagcagcggttcaccaagtttcccaccctcgtccgcggattcaccaacctctacgccatggaaattgacccgaaggtagaaaatgatgatttagccaatgaaggaatggagggattcctttcagaactgacaaatgcgattccaggagtagatg

SEQ ID NO: 31619 - DNA, 415 bp, Zea mays
  Clone ID: LIB3059-017-Q1-K1-B9
ggtatcctgctgaagcctagcatggtcacccctggagctgagcacaaggagaaggctggtccagaagccattgcaaagtacacgctaacaatgctcagaaggagagtacctcccgctgttcctggaatcatgttcctttctggtggacagtccgaggtggaggcaactctgaacctgaatgcaatgaaccagtctctgaacccatggcatgtgtcgttctcctatgcccgggctctgcagaactcggtgctgaagacatggcaagggcgccctgagaacgtggaggcagcgcagaaggccctgctggtgcgcgcaaaggccaactcgctggcccagctcggtcgctacactggtgagggcgagagcgatgatgccaagaaaggcatgttccagaagggctacacctactaatgtg

SEQ ID NO: 31620 - DNA, 429 bp, Zea mays
  Clone ID: LIB3059-017-Q1-K1-C1
cccacgcgtccgcggacgcgtgggcaactagcaacatagaaagcacaatagtgtaccagcaatggcagccaaaatattttgcttccttatgctccttggtctttctgcaagtgttgctaccgcaaccattttcccacaatgctcacaagctcctatagcttcccttcttcccccatacctctcaccagcggtgtcttcagtgtgtgaaaacccaattgttcaaccctacaggatccaacaggcaatcgcaacaggcatcttaccattatcacccttgttcctccaacaaccgtcagccctattacaagagttacctttggtccatttggtggcacaaaacatcagggcacaacaactacaacaacttgtgctagcaaaccttgctgcatactctcagcaacatcagtttcttccattcaaccaactggc

SEQ ID NO: 31621 - DNA, 435 bp, Zea mays
  unsure at all n locations
  Clone ID: LIB3059-017-Q1-K1-C10
cccacgcgtccgcccacgcgtccgcttatgctgaaagtcatgatcaagcattagtcggcgacaagactattgcgttttggttgatggacaaggatatgtatgatttcatggccctcgatagaccttcaactcctaccattgatcgtgggatagcattacataagatgattagacttatcacaatgggtttaggaggagagggctatcttaatttcatgggaaatgagtttggacatcctgaatggatagattttccaagaggtccgcaaagacttccaagtggtaagtttattccagggaataacaacagttatgacaaatgtcgtcgaagatttgacctgngtgatgcatactatcttaggtatcatggtatgcaagagtttgatcaggcaatgcaacatcttgagcaaaaatatgaattcatgacatctgatc

SEQ ID NO: 31622 - DNA, 363 bp, Zea mays
  Clone ID: LIB3059-017-Q1-K1-C11
cccgagggctgcggctaccagttccagatgcagtacggctccatcgggtggtcggtcggcgcgacgctcgggtacgcccaggcggccaaggacaagcgtgtcatcgcgtgcatcggcgacggaagcttccaggtgacggcgcaggacgtgtccacgatgctccggtgcgggcagaagagcatcatcttcctcatcaacaacggcggctacaccatcgaggtggagatccacgatggcccgtacaacgtgatcaagaactgggactacacgggcctggtcaacgccatccataactccgagggcaactgctggaccatgaaggttcggacggaagagcagctcaaggaagccatcgccatggcg

SEQ ID NO: 31623 - DNA, 440 bp, Zea mays
  Clone ID: LIB3059-017-Q1-K1-C12
cgttcttcggcttcattgtcacaaggttcgagttcgtcaccgtctagtacgactgtgcgagggaggaagaggcgaggagaagatgcagatcttcgtgaagaccctgacggggaagaccatcaccctcgaggtggagagcagcgacaccgtcgacaacgtcaaggccaaaatccaggacaaggaagggattcccccagatcaacagcgactgatattcgctggcaagcagctggaggatggacgcacgctggctgactacaacatccaaaaggagtcaactcttcatttggtccttaggctgaggggtggaaccatgatcaaggtcaaaactcttactgttatagagatcgattatgacttttatcttacttgatttatttactgatcattggattctttttaatataatgtttgttatttttcttatttttatatttttt

SEQ ID NO: 31624 - DNA, 371 bp, Zea mays
  Clone ID: LIB3059-016-Q1-K1-H2
cggacgcgtgggccggattctcgtccccttgaggatggagatatcatcaatattgatgttactgtctacctcaatggctaccatggtgatacatctgctacatttctttgcggtgatgttgatgacgaagctaagaaattagttaaggtgacaagagaatgtctcgacaaggctatatcgatttgttcacctggggtggagatcatacaaagtggtagaactatacaggatcatgcagacaagtttaagtttggtgtagttagacagtttgttggccatggggttggcaaagttattcatgctgaacctgttgagcattatttcagaaacaatgaagggggacgtatgatgttgaatcaaacatttactat

SEQ ID NO: 31625 - DNA, 439 bp, Zea mays
  Clone ID: LIB3059-016-Q1-K1-H3
gcaacatagaaagcacaatagtgtaccaacaatggcagccaaaatattttgcttccttatgctccttggtctttctgcaagtgctgctaccgcaaccattttcccacaatgctcacaagctcctatagcttcctttcttcccccatacctctcaccagcggtgtcttcagtatgtgaaaacccaattcttcaaccctacaggatccaacaggcaatcgcagcaggcatcttacctttatcacccttgttcctccaacaaccgtcagccctattacagcagttacctttggtgcatttgttggcacaaaacatcaaggcacaacaactacaacaacttgtgctaggaaaccttgctgcctactctcagcaacagcagtttcttccattcaaccaactggctgcattggactctgctgcttatttgcaacaacaactacca

SEQ ID NO: 31626 - DNA, 93 bp, Zea mays
  Clone ID: LIB3059-016-Q1-K1-H4
ctacgacccactcgtccgaaaaaaaaaacacatacaaaataaaaatataaaaaaaaaaaaaaaaaaaaaaaggaaaagatactaaaatacaat

SEQ ID NO: 31627 - DNA, 425 bp, Zea mays
  Clone ID: LIB3059-016-Q1-K1-H5
ccaaccttgactggtacaaaggcccaactcctgcttgaggctcttgaccagatgaccgagcccaagaggccttcagacaagcccctgcgtctgcccctccaggatgtgtacaagattggtggtattggaactgtaccggttggtcgtgtggagactggtgtcatcaagcctggtatggttgtcacctttggtccaactggcctgactacctaagtgaagtctgtttagatgcaccacgaggcgcttcacgaggctcttccgggtgacaatgttggcttcaactggaagaacgtgtctgtcaatgatctcaagcgtgggtttgaggccttcaactgcaaggatgaccctgacaaggatgctgtcagctataccttccaggtcataatcatgaaccaacctgggtcatattggcaactgctatgccc

SEQ ID NO: 31628 - DNA, 263 bp, Zea mays
  Clone ID: LIB3059-017-Q1-K1-A11
aaaaaaaaaacataaaaagcacaataatatataacaagaaaaacaaacaaaatattgggaggtcacatactcattgatatgtctgcaaatgctgctactgcgaccattttaccgcaatgctcacaagctcctataacttcatttcttccccaaaaccccttaccagccctatcttaataatgtgaaaacccatttctacaaccctacatgatccaatatgcaatctgaccttacatcttacctttatcaacctttgttcttca

SEQ ID NO: 31629 - DNA, 397 bp, Zea mays
  Clone ID: LIB3059-017-Q1-K1-A12
cccacgcgtccggcgagatcttcctcaactcaacccaaccttctcgagctcgagcgccggtaggatctgcggtgacatccatggtcaatacagtgatcttctaaggctttttgaatatggaggctttcctcctgaagccaattatctattcttaggtgattatgttgatcgaggcaaacaaagtttggagactatatgccttcttcttgcttacaaaatcaagtaccctgagaacttttttcttctgaggggcaatcatgaatgcgcctcaataaacagaatatatggattctatgatgaatgcaagcgtcgatttaatgtgcggctatggaaggtcttcacagaatgttttaacactttacctgtggctgctcttatcgatgattaaatattatgt

SEQ ID NO: 31630 - DNA, 350 bp, Zea mays
  Clone ID: LIB3059-017-Q1-K1-A3
cttgatcctcctgcacaccagagtaccatacaccactgcgcatcagtgcaaagaggtagctacgctatctgccatggctcaagagctccacgaaacgtcctcttgctctgccaccaccacctcgtcgtgcaccacatcctgctgctcgtccactgtcacagactcgtcctcttcgcccccgtcaccggcggcggccaatgccgcgcccgcgacacggaagcggcaggcgttggaggccgaggccgaggccgaggcgggcggtgaggaggaggaggaggaggaggaaggctgtgctggtaataaggcggcgcctgccaagaagcgaccgcggtgcagcgaggggaagcacc

SEQ ID NO: 31631 - DNA, 426 bp, Zea mays
  Clone ID: LIB3059-017-Q1-K1-A4
cccagcgtccgcagaaacacaccaagctaagcgcactagcaacaacctaacaacaatggctagcaagatattatccctccttgcgcttcttgcgctttttgcgagcgcaacaaatgcgtccattattccacaatgctcacttgctcctagttccattattccacagttcctcccaccagttacttcaatggccttcgaacacccagctgtgcaagcctataggctacaacaagcgattgcggcgagcgtcttacaacaaccaattgcccaattgcaacaacaatccttggcacatctaacaatacaaaccatcgcaacgcaacagcaacaacagttcctaccagcactgagccacctagccatggtgaaccctgtcgcctacttgcaacagcagctgcttgcattcaacccacttgctctagcaaa

SEQ ID NO: 31632 - DNA, 362 bp, Zea mays
  Clone ID: LIB3059-017-Q1-K1-A6
cggacgcgtgggggcaagtcgctcaggacggagttcttcccggcgacgtggctgaccatggtgtcagggttcgtctcgaaggcgatgtactggaagccttctccctgcgccttggtggcgacgaggtagccctggggtacgatgagcagctgccccgcacggagcacgtcgtcgaacaccgtggtcccgttgtcgctggcgacctggacccttgcactgcccctgatgccgtacatggcgctgtgggcgttgaagttccagaacggcgacatgatggcgtcctggtacaggtctacccgcaccgcgctcatctgtacgaggttgaggacggtgaacttgtggctggtgaggcatgtgatcct

SEQ ID NO: 31633 - DNA, 427 bp, Zea mays
  Clone ID: LIB3059-017-Q1-K1-A7
caacaatccttggcacatctaaccctacaaaccattgcaacgcaacaacaacaagaacggtttctgccatcactgagccacctagccgtggtgaaccctgtcacctacttgcaacagcagctgcttgcatccaacccacttgctctggcgaacgtagctgcataccagcaacaacaacagctgcaacagtttatgccagtgctcagtcaactagccatggtgaaccctgccgtctacctacaactactttcatctagcccgctcgcggtgggcaatgcacctacgtacctacaacaacagttgctgcaacaaattgtaccagctctgactcagctagctgtggcaaaccctgctgcctacttacaacagttgcttccattcaaccaactggctgtgtcaaactttgctgcgtacctacaacagcgac

SEQ ID NO: 31634 - DNA, 419 bp, Zea mays
  Clone ID: LIB3059-017-Q1-K1-A9
cccacgcgtccggcagcagatgccttcacaagcgccacagttgctgcttcaacagcaggcagctttgcagtctagttatcagtcttcacagcaggcgatttatcagcttcagcaacagctacaactaatgcagcagcagtctaacctaaatcagcaaccctctgcgcaggttggttcatctgcagtttcttcaacatgtaactggacagagcatacctcccctgaaggttttaagtactactacaatagcattactcgtgagagtaagtgggagaagcctgaagagtatgtgctgtatgagcaacagcagcagaaactgcttttgcttcaacagcaccaacagaatatcgctgtacagcaactgcagtcaccgccacagggtcaatcacttccatccatgcaaccgattcaacagcttc

SEQ ID NO: 31635 - DNA, 396 bp, Zea mays
  Clone ID: LIB3059-016-Q1-K1-H11
cccacgcgtccgcccacgcgtccgcccacgcgtccgcccacgcgtccgccgctcggctcggggaacgcgatctgttccccaacctccgcagccgctccaccgtcctccactccggctgccgaatcgacccgccccgatccagatcaggagctgagggatggacgcgaacaggcgccagagtgggatccagcagttgctggctgcggagcaggaggctcagcaaattgtgaatgccgctagagctgccaagtcagcgaggctcaggcaagcaaaagaggaggctgagcgggaaatagccgaataccgtgcccagatggaggctgagtttcagaggaaggttgcagagagcagcggcgactccggtgcaaacgtcaagcgtctcgaggaagaaacggc

SEQ ID NO: 31636 - DNA, 264 bp, Zea mays
  Clone ID: LIB3059-039-Q1-K1-B4
gtgtctctgaccattgggacatgatgggctcagatcctttggaggccggctcccagggtgctcagctggtgctggatatccgcaagaggaagggtctcaaggaacagatgacccctctttctgagtttgaggacaagctctaaaatttttggctgttggtgatactgtttcatctgccggtttaatcatcaattcgtctactgtaatagcagcgacttcaatattttattttgttttagttgtcaaatgcacctgtttttgaac

SEQ ID NO: 31637 - DNA, 396 bp, Zea mays
  Clone ID: LIB3059-039-Q1-K1-B5
cgcaaattgcaccaagaaatccatcgagaggccgtcgacaggggaattaatggcgtcgtggtctagcagcagccaccgccgcctcatcctcgcagccgccgtcctgctctccgtgctcgcggctgccagcgccagcgccgggacctcctgcgtgccggggtgggccatcccgcacaacccgctcccgagctgccgctggtacgtgaccagccggacctgcggcatcgggccgcgcctcccgtggccggagctgaagaggagatgctgccgggagctggcggacatcccggcgtactgccggtgcacggcgctgagcatcctcatggacggcgcgatcccgccgggcccggacgcgcagctggagggccgtctagaggacctgccgggctgcccgcg

SEQ ID NO: 31638 - DNA, 380 bp, Zea mays
  Clone ID: LIB3059-039-Q1-K1-B6
cggacgcgtgggtttttttttttttttttttttgaaataactgtgagttgtggattatgtaaaaaaaatatcttgtcgcgtcttgttttaagaagacaaccaaatgtgaaccatacatgtgtgtcaggataaatttctctctctctctctctctcataagccctgtcatgttctgtattgcaactttgtgccatcaatgacgatgcagggagtagatttaacatcagagatgggataacatgttgtcatactctagtctgcaaacatcaagtctataccgtttgattcctgaaagtggctgcacccattttcctcgagtacatcgcaggcattttcttttcgcattttccgctcttcaaccactgcttcaaccgagtctg

SEQ ID NO: 31639 - DNA, 433 bp, Zea mays
  Clone ID: LIB3059-039-Q1-K1-B7
cagttgttcaaccctacaggatccaactggcaatcgcaacaggcatcttacgattatgacccttgttcctccaacaaccgtcagccctattacagcagttacctttggtccatttggtggcacaaaacatcagggcacaacaactacaacaacttgtgctagcaaaccttgctgcatactctcagcaacatcagtttcttccattcaaccaactggctgcattgaactctgctgcttatttgcaacaacaattaccattcagccagctagttgctgcctacccccagcaatttcttccattcaaccaactagcagcattgaactctgctgcttatttacagcagcaacaactactaccattcagccagctagctgatgtgagccctgctgccttcttgacacaacaacagttgttgccgttctacctgcacgc

SEQ ID NO: 31640 - DNA, 419 bp, Zea mays
  unsure at all n locations
  Clone ID: LIB3059-039-Q1-K1-B9
gaaggattcctcgccaaggtaccgattctgaatggccatgtctactccataaatgacaatgccacagtggaggatgcagcaacagactatgaattcatgatcaggcagctggttaaggtccgcacaataggagtctcagagagaaacgactgtcccaagttcgatctcatccttctcaccatgggctccgatgggcatgtggcctcgcttttcccgaaccaccctgccatggagctgaaagacgactgggtcacctacatcaccgactctccgcagcctcctcctgagaggatcaccttcactctcccagtgatcaactcagcatccaacatagcaatagtgtccactggtgatgacaaagcaaaggctgttcacatagcagtttctgacatggcncgaagtcttgatgctcctacatc

SEQ ID NO: 31641 - DNA, 409 bp, Zea mays
  Clone ID: LIB3059-039-Q1-K1-C10
cccacgcgtccgagaagacatcggctttcaggcggcctccaatcttgatcgtcatcggggacccaacctgtgatcccaagtctctacagcatgctctgggaaagggagccatagagtatgaagagtttctgaaaaccggtgacccggagttcagttggaagccaccgaaggacgagtggcagagcatcgccctaggctacacttctgggactacttccagcccaaagggcgtcgtgttgcatcaccgcggtgcttatctcatggcactcagcgttgccatcgtgtgggggatgcctgaaggggctgtctacttgtggactctgcccatgttccattgcaatggttggtgctacactagggcgctggcagcgttctgcggaacaagcatatgtcttcgccaggtgagcac

SEQ ID NO: 31642 - DNA, 395 bp, Zea mays
  Clone ID: LIB3059-039-Q1-K1-C11
gtaacatttacggggaacttcaatgagtattttggctttgccaccgatgtagatgcaggggtttacttgatgctggtaaatgatctaattcatggactttatcctgaggctgtaaccattggtgaagatgttagtggaatgcctacatttgcccttcctgttcacgatggtggggtaggttttgactatcggatgcatatggctgtggctgacaaatggattgaccttctcaagcaaagtgatgaaacttggaagatgggtgatattgtgcacacacttacaaataagatgtggttagagaagtgtgtaacttatgcctaaaggcatgatccagcattaatcggccaccagacttatgccgtttgggtgattgaccaggatatgtatgatttcat

SEQ ID NO: 31643 - DNA, 393 bp, Zea mays
  Clone ID: LIB3059-039-Q1-K1-C12
gagaccaactagcaacatagaaagcacaatagtgtaccaacaatggcagccaaaatatggggcttccttatgctccttggtctttctgcaagtgttgctaccgcaaccattttcccacaatgctcacaagctcctatagcttcccttcttcccccatacctctcaccagcggtgtcttcagtgtgtgaaaacccaattgttcaaccctacaggatccaacaggcaatcgcaacaggcatcttaccattatcacccttgttcctccaacaaccgtcagccctattacaagagttacctttggtccatttggtggcacaaaacatcagggcacaacaactacaacaacttgtgctagcaaaccttgcttgatactctcaagcacatcagtttctt

SEQ ID NO: 31644 - DNA, 345 bp, Zea mays
  Clone ID: LIB3059-039-Q1-K1-C2
gcatggtcccagtcaaccctcaggcaacccggtgttaagggacgcgctggctcctggagctcctgcgtccatgagaggtcactctgcagtccgacatgaccgtggcctactcgcaggacacaccctagatcgagctactcaccctagacgagcagactcacaacatgtaccagtgtgagactatctgcctcaccaatcacttacatcagacctgtgccaagcaccgtcccaagttcacactgatgcacgcactgctcctggatcatcagccggagctcgttgatgaagaccctcttatggacctctagaacatggacgtgcacaacgatgactaagcaatttcag

SEQ ID NO: 31645 - DNA, 331 bp, Zea mays
  unsure at all n locations
  Clone ID: LIB3059-039-Q1-K1-C3
ctctcgcatccaggacacagggtaccatgattgcttctgagggtctgaagcacagagggtttgaggtttgcctagctgatcttcagggcgacgaggatcaagcttacaggaaaatcaggctccgtgctgaagatgtgcagggcaggaatgtgctcacaaacttttggggcatggattntaccactgataaactcagatccctagtgaagaagtggcagacattaatcgaagcccatgttgatgtcaagacaaccgacaactacatgttgcgtctgatctgcatcggcttcaccaagaggcgcccaaaccaagtcaagagaacctgctatgc

SEQ ID NO: 31646 - DNA, 185 bp, Zea mays
  Clone ID: LIB3059-039-Q1-K1-C5
tctgactcgtgggcggacgcttttgtgctctccttgctttcacacttggtgtggagcagatgatttgctgctgcaacaagatggatgctactacacccaagtattcaaaggcccgttatgatgagattgtgaaggaagtctcttcctacctgaataatgctggatacaaccctgatcagatctac

SEQ ID NO: 31647 - DNA, 367 bp, Zea mays
  Clone ID: LIB3059-039-Q1-K1-C6
gacgagtccattgttaactgaaaacattatcaactttctctaagcgtcacaagccctgccatggaaagaaacggtcaagcttttcctcacttgtccacctttcttcctgtgaccacacaatcaaacagctctcctgaaccatgatgttcgaacagcttgccggatgtggcgctcgttcttctgcaacagttcatcgaccttgtgcgactgggacaacaaaaggcccgagtactcgaccttctcttcttgaccatgaccggccttgaagccattcttcgatgaaaaaatacccccaaagaacatggcgttcgaaaagttatgggaatggtaagtgtcgcaagaatcgaacgaatctgggcgctctaac

SEQ ID NO: 31648 - DNA, 317 bp, Zea mays
  Clone ID: LIB3059-039-Q1-K1-C7
cggattcccggtcgaccacgcgttcgccagcgtccggtcggttcactttccaggtaaggaagggttcgtctggtggcgccgccgcagccaaagtcgggcctcttcgttggcatcaacaagggtcatgtcgtcaccaagcgcgagctgcctacccgcccgtgccaccgcaaggggaaatcaacgaagagggtgtctatggtcaggggcctgatcagagaggttgctgggtttgctccttatgagaagcgtatcactgagcttctgaaggttggcaaggacaagcgtgccctgaagcttgctaagagaaagcttggaac

SEQ ID NO: 31649 - DNA, 422 bp, Zea mays
  Clone ID: LIB3059-039-Q1-K1-C8
cagaaacacacctagcgaagcgcactatcaacgacctaacaacaatggcttggaagagattatccctccttgcgcttcttgccctttttgtgagtgcaacaaatgcgttcattattccacaatgctcacttgctccgagtgccattattccacagttcctccctccagttacttcaatgggcttcgaacacccagctgtgcaagcctataggctacaacaagcgcttgcggcgagcgtcttagaacaaccaattgcccaattacaacaacaatccttggcacatctaaccatacaaaccatcgcaacgcagcagcaacaagcactgagccacctagccgtggtgaaccctatcgcctacttgcaacaacagctgcttgcatccaacccacttgctttggcaaacgtagctgcttaccaacaa

SEQ ID NO: 31650 - DNA, 349 bp, Zea mays
  Clone ID: LIB3059-039-Q1-K1-B3
gcgagacacatcctggtagttgggagaccccgtctgaagggaccgagtgaagagcaggggcccgtgtgcatctgagaagccgcagatgatctcttagttcagatgctgttatcatgaacccaagattcatggaacgctcccaatcccatgcatgtcagcgcccaacacacagggaagaggccaggctaccaggtttatcagaagctgtttcaataaccggagaattttttttccatgccaatgcacactgtacagaggtgatgctggacgaatcgagctggagccttgtgtccggtgccgagaagcccgagacgatgtcgctttgagcttactctaacgtgttcggact

SEQ ID NO: 31651 - DNA, 395 bp, Zea mays
  Clone ID: LIB3059-038-Q1-K1-H8
tggaagaggataaacttgagctcgcaacttctcttattgagaaggcgaaggcaaagggggtttctcttttgcttcccactgatattgtagtagcggacaagtttgcagctgatgctgagagcaagattgtccctgccactgctatccctgatgactggatgggtcttgatgttggccctgatgccaccaaaacattcaacgaagcattggacaccaccaagactgttatttggaacggccccatgggagtgtttgagttcgagaagtttgcagctggcactgaggcgattgccaagaagctagctgagcttacaaccacgaagggtgtcactaccatcatcggcggcggcgattctgtcgctgctgtcgagaaggctgggctggccgacaagatg

SEQ ID NO: 31652 - DNA, 422 bp, Zea mays
  Clone ID: LIB3059-038-Q1-K1-H9
cccacgcgttcggctggtggtggccagctgggttttggaggtcgctgccctgatgaagtgtattgatgctagcaccatccctagagttgtcacttttgacaagaaccctgacaaccacccatacctcatgaaattcttccaaagctcagcccccaaggctatgctgttcttgaacttctccaccggaccttttgattctttcaagtctgcctactctgctgccgcggaggaattcaaggacacggaaatcaagttccttattggtgacatcgaagccagccatggtgccttccagtactttggcctgaaagaggaccagacaccccttatactcatccaggatggtgactccaagaagctcttgaaggttcacgttgaggctgaccagatcgtcgctaggttgaaggagtactttgatggca

SEQ ID NO: 31653 - DNA, 409 bp, Zea mays
  Clone ID: LIB3059-039-Q1-K1-A10
cggacgcgtgggtctcgagacgagaaggctgcagctgtcggtatcctgagcaacctccgcacgacagacaagaaggcaactgagattctgatgcgggcaaacttgctccctattctgatcaccttgtttgaggcaaacatggccgctgccgtgacacctcaaagaatgtggttgcttgagggcatcgctggtgtctttatccggttcacagtcacctgggacaggaagctgcagagttcagcagttggacacggtgtggttccttgccttgagaagttgctttcacaaggatcggtggacgccaagtctaaagcggcaacatccttggcccaactgtcacagagcacgatggcgctgcgcaagtcagaaacgccaaggtggtctgcgttcttcatcggccgaatctact

SEQ ID NO: 31654 - DNA, 419 bp, Zea mays
  Clone ID: LIB3059-039-Q1-K1-A12
cccacgcgtccgcccacgcgtccgagctgcgcaggcccatctcgctgggcgacccgtcgctgacggcgtcggcgcaggtgacgctggcctcccgcaaccccaacgaccgcgtgggcatcttctacaagcgcctggacgtgttcgtcacctaccgcgacgaggccgtgacggtgcccgtgtctctgccgccgcagtaccagggccaccgcgacttcaccgtctggtcccccgtgctgtcggccgagtccgtgcccgttgccgcctacgtcgccgacgccatgaagcaggacgtcgccgcgggcttcgtcgcgctgcaggtcaaggtggacggccgcgtcaagtggaaagtcggcagctgggtctccggcagctaccacctcttcgtcagctgccccgccgtgctctccgcgggctacccc

SEQ ID NO: 31655 - DNA, 397 bp, Zea mays
  Clone ID: LIB3059-039-Q1-K1-A6
gccccgtgatgcttttcaaaggatggaaacgactgatccaggacatgattgggagagaagggccctttctggagactgcttgtgtgccatttgctggtcttgctattcttctttggccatttgctgtagtaggagccgttctggcatccatactctccagtgcccctttaggtgcttatgctgcagttgtagcttatcaggaatcctcccttatcctgggaattgcctatgtgttctcgtcagtgtctatatttgatgaatacacaaatgatgttcttgacatggcgcctggttcttgttttccaagatttaaatatcggaagggcaaagatgagtcttcacacgggcacagtgttccattatccagaccagcctcattcaacagggagaagcaaga

SEQ ID NO: 31656 - DNA, 409 bp, Zea mays
  Clone ID: LIB3059-039-Q1-K1-A8
ccggctctagccactcgtccttcgacatataaagcacaatattttaccttcaatggcagccaaaatattttgcgtccttgtgctccggggactgtctgcaaccgctgctaccgtgaccattttaccacaatgctcacaagcttctatagcttaccttcttcccccatacctctcatcatcggtgtcttcagtatgtgaaaacccaattcttcaaccctacaggatccaacacgcaatctcatcattcattatacctttatcacccttgatccttcaacaaccttcatccctattacagcacttacctttgatgcatttgatggcacaaaacatcaagacacaacaactacaacaacttgtgctatcaaaccttactgcctactctcataacaatcaaataattcaatta

SEQ ID NO: 31657 - DNA, 400 bp, Zea mays
  unsure at all n locations
  Clone ID: LIB3059-039-Q1-K1-A9
cggacgcgtgggccggctacgaccagctgctccgcgcgctccaggacaagtggttctcgcacttcaccatcaggaagttcgccgacgacgagaggaagctggtggacgcggtgaacgggacggagtacgtacccacgtacgaggacaaggatggcgactggatgctcgtcggcgacgtcccctggaagatgttcgtggaaacctgccagcgccttcgtctgatgaaaggttcagaggccgtgaacttggcaccaagagccgnccgatgaggcacactccgttgggcgttggcacgcacgcacgcactggcgtcttgaaggaaagggggactctgctggcttgatgaggatcttcacgtgagataggaacgtgtgtacagttgtcgccttatggtattgag

SEQ ID NO: 31658 - DNA, 373 bp, Zea mays
  unsure at all n locations
  Clone ID: LIB3059-039-Q1-K1-B1
ccgactcgtccgcacgtctcccagatctaactgccccccgactcacgaatcccaaagggtccatggcgacgcaccgccactgcctcccactcctcctcctcgtggccgccgccctcgccgccgtccctgctcgcgcggcgctgggcggcgggcgcggcccgctgctgggcgggtggaacccgatccctgacgtgagcgactcgcacatccaggagctaggcgggtgggcgctggggcaggcgaagcaccagaagctggccgacgacgggctgcggttccgccgcgtggtgcgcggcgagcagcaggtcgtgtccgggatgaactaccgnctctacgtcgacgccgtcgaccccggcggccgtaccgtgcccta

SEQ ID NO: 31659 - DNA, 382 bp, Zea mays
  Clone ID: LIB3059-039-Q1-K1-B10
cccgacgcgtccgggctgcggctgccagccaccggcgccggttcatctaccgccggcggggcatctgccacctgcggctcacctgccacctgcggtgcatatcccaccgccggtccacctgccgacgccggtccacctgccaccgacggtccatgtgccgtcgccggttcatctgccgacgacaccatgccactaccctactcaaccgctccggcctcagcctcatgcccagccacacccatgcccgtgccaacagccgcatacaagctcgtgccagctgcatggaacctgcgagcgttggcagtactcccgatcctgagccagtgcgtcgagtttctgatgcatcacagcagtcagaccgcgacgccctactgctagactc

SEQ ID NO: 31660 - DNA, 196 bp, Zea mays
  Clone ID: LIB3059-039-Q1-K1-B11
cccacgcgtccggaaggatgtgttattaaaaactgcaagataaaccattctgtagttggactccgatcttgcatatctgaaggtgctatcatagaggacagtttactaatgggtgcggactactatgagacagaagctgataaaaaactccttgccgaaaaaagtggcattcctatgggtattgggaaaaatcatg

SEQ ID NO: 31661 - DNA, 416 bp, Zea mays
  Clone ID: LIB3059-039-Q1-K1-B12
gcggcacttccggaaggatgtgttattttaaactgcaagataaaccattctgtagttgggctccgatcttgcatatctgaaggtgctatcatagaggacagtttactaatgggtgcggactactatgagacagaagctgataaaaaactccttgccgaaaaaggtggcattcctattggtattgggaaaaattcatgcatcaggagagcaatcattgacaagaatgctcgaattggagacaatgttaagatactcaatgctgacaatgttcaagaagctgcaatggagacagacgggtacttcatcaaaggtggaattgtcacagtgatcaaggatgctttactccctagtggaacagttatatgaagtgaacgtgcgacatgcaactgtgtgtctcgacattcgacaatgatcag

SEQ ID NO: 31662 - DNA, 391 bp, Zea mays
  Clone ID: LIB3059-039-Q1-K1-B2
ccgacgagtagagctctccactcaaaccatcctaagcctctactgtctcagttggggcgtcgagcacaaggcccttggtgggctttgccagcaggtcggtgtactgctggaacggggccattgagaacttggtctgactccagaattcaggagtgaggaagccgtaggtcttcatcaggcagtcgaaggttgccttgacgaagttgccaagggtcttagtggagccacgggacgaggtgaagacatcctcaatgccagcgaactgcagcaccttcttgggcacgcgcgcggcgacgatgccagaacccctgggcgcgggtaccatgcgcacggtgacggagccacacttgccagtgaccttgcaaggcacggtgtgcggctgtccgatctt

SEQ ID NO: 31663 - DNA, 441 bp, Zea mays
  unsure at all n locations
  Clone ID: LIB3059-038-Q1-K1-H7
cccacgcgtccggtccaggaccaggataaaggaaaaggaagcccagctctctctagcctggagccgagaagccgagggggcgaaggagcagcaaggcatggaggagcccgttccggctgatccccccaggattttctggaagtcaaggagttcaggttcaggaccgtgagatcaatgggctgaacgagcagctagaggaagactcccgcgtgctggagcttctgcagaagcagctggctgacgagcgcaggaagcggacagagatcgagaaggagaactccatgctccatgagcaggtcaccatgctgatgaacatgctcgacgagaacgagggtttcgacgaggacggagaggccccgccgcccgattccttcgattaagcgttgttacagtactatantccgtttctttttcccgtcagtgtgaaatcatacgtctcta

SEQ ID NO: 31664 - DNA, 312 bp, Zea mays
  Clone ID: LIB3059-038-Q1-K1-F8
agaacacttacgtcaccgcgtaacggttgacattgccttcatggctagaactgttgtgggcatcacactccttaacgacttgtgctagccatctacttgctagtcgcaatgaatgttatcgattgtgcacacagcgtgagaccaatccagctgctttgtgtaactataggagaccaagtgatcattccacctaccgtgtaatccagataatgcgtacatcgtatcatgactttgagatggtgccctagatatgatgatatactgcgatgtcagcgactgcacaacttatgtaatcaatatagcaaggattag

SEQ ID NO: 31665 - DNA, 408 bp, Zea mays
  Clone ID: LIB3059-038-Q1-K1-G1
ctccgattattcgaaatttctcagagaacaagaaatattcttaatgaatggactgaagactgtcaacataactggaaatggctatctagagcagagattgcagcctggattgagtggtttacagtctatgggttattcatctcagatacctattcaacctggtggtaccactgcaaacctgatgcataatcatgtcaaaattactggagagactgtcccctctacacttgattcagttgtaccttcaatagcaccatcaggtggcatgccaatcaaacttacagaagcaccactaactgcttcgaagaagaaccctgttagtcgtccatcaaagcctgttggaccaccttcaggatttaatcatgtaaccccaaagcgtcaagatgattctattccggttgaaaaact

SEQ ID NO: 31666 - DNA, 417 bp, Zea mays
  Clone ID: LIB3059-038-Q1-K1-G10
cagacagagtgaaagaagagactgaaagactcgatagtctttattaggaagatttagagatggacgatgatgagcggtataaccgaaaactcgaagctgggctttacacactgcagttaattgcgcttattctgggacacatatggcactctgggaattcccagatgagagcaagagtagaattacttcttaagcagaacatacttacaaagcaagatgtgaagagcatacttgaggagtaccatgacaacattggagatttggatggacctgaagagaaggatagagcacaagtgctgaccatggaaattattgacgcgtcgtgatgtgcatgggcctagggtagttggttgtggagcaagacagaggctggtagatattttgagtatgttgagtgaatttatatgcacagtcagc

SEQ ID NO: 31667 - DNA, 180 bp, Zea mays
  Clone ID: LIB3059-038-Q1-K1-G12
gtgggacctgagcgtaattggaacccgtagcccttttcggcctccttcccggccgaacagcctcgacagcccgaaaccttggccgccgatcggtttcggagaagagaaccaaatcaggatgtttctcggttcgttcccgcggggcccgaccaaggaggctgcttacaagcagctgcggtc

SEQ ID NO: 31668 - DNA, 357 bp, Zea mays
  Clone ID: LIB3059-038-Q1-K1-G3
cacgcgtacgcgggcacgtttctagatctagaacgctatcgtttgatctcatagatccaagcctgcgtgctcgggccagcgatgtcataggtcttctatagcgtcaactgcattcaatatagtggccgtcacagtacatcgtcgatactgctaaaacacttatactacccaactgaaccaccttgcaccacatgcatatttatgcagctggcactatagcgactaggccctctccactcgatcttcccaacacttgaacagcctcaatagctaatgtgacgcgcactcttacagaaccttcagcaactgcttcgaagaagatccctgcaacgtgaccattacactctgcagcaccat

SEQ ID NO: 31669 - DNA, 429 bp, Zea mays
  Clone ID: LIB3059-038-Q1-K1-G6
ctgagatcctcgttgatggccctcatgacattgatcgctgcgcttacgtcactgagaccgtccttgctgcctgctacaaggcgctcaacgagcaccatgtcctcctggagggtaccctcctgaagcccaacatggtgactccaggctccgactccaagaaggtgactcctgaggtgattgctgagtacaccgtccgtaccctccagaggaccgtccctgctgctgtgcctgctgttgtcttcctctctggtggacagagcgaggaggaggccacccgcaacctcaatgccatgaacaagctcagcaccaagaagccgtggtccctgtctttctccttcagccgtgccctccaagcgagcaccctcaaggcctgggctggcaaggtggagaacttggagaaggctagagctggcttcctcgccaggtgca

SEQ ID NO: 31670 - DNA, 438 bp, Zea mays
  Clone ID: LIB3059-038-Q1-K1-G7
gattactaccacaaagaagggttctattacatctgttcaagctatttatgtgcctgctgatgacttgacagatcctgctcctgctaccacctttgcccatcttgatgctactactgtgttgtcacgtcagatttctgagcttggtatttaccctgccgtggatcctctggattccacatccagaatgttgtccccccatgttctgggtgaggaccactacaacactgctcgtggtgttcagaaggttcttcagaattacaagaatctccaagatattattgccattctgggaatggatgagctcagtgaagatgacaagttgacagttgctcgtgctaggaagattcagcggttccttagccagcctttccatgttgctgaagttttcacgggtgcacctggaaagtacgttgagctgaacgagagcgttaaaagttt

SEQ ID NO: 31671 - DNA, 439 bp, Zea mays
  Clone ID: LIB3059-038-Q1-K1-G8
cccacgcgtccgcccacgcgtccgcgtctgtgctaccgccgccgccgccgcaagactgcgtcgggcactttgccggcgacgatttcccaccagctatttctactcggatccgatctatttacaagcccaacaggatcagaggaggtgatggcgaggagtgacagctgcctggcgcgcgtgggtgccggaattgctatcggtggcgcggtcggcggagccgtcggtgcttgctatggaacttttgaggcgttcagatacaagatccctggattgctaaagatcagatacattgggcaaaccaccgttggcagcgctgcgatttttgggcttttcttgggggctgggagcttgattcactgtggaaaatcctactagtttgtttccctttttttttctgaagtctgaacacacctttgtcgatgggcttcagtgaaaacta

SEQ ID NO: 31672 - DNA, 433 bp, Zea mays
  Clone ID: LIB3059-038-Q1-K1-G9
cggattcccggtcgacccagcgtcgcgacctgggtagctttggcaccgcataggctaccatatccaggcacgtgtcaccactactgatgccattggctaccatgaacccatggatgcagtactgcatgaagcaacagggggttgccaacttgttagcgtggccgaccctgatgctgcagcaactgttggcctcaccgcttcagcagtgccagatgccaatgatgatgccgggtatgatgccaccgatgacgatgatgccgatgccgagtatgatgccatcgatgatggtgccgactatgatgtcaccaatgacgatggctagtatgatgccgccgatgatgatgccaagcatgatttcaccaatgacgatgccgagtatgatgccttcgatgataatgccgaccatgatgtcaccaatgattatgccgagtat

SEQ ID NO: 31673 - DNA, 429 bp, Zea mays
  Clone ID: LIB3059-038-Q1-K1-H1
cgatatgataaagtttgcgaagaagatgtatccggaggtggatttgatcggtggtaatgtggtgacaattgcacaggcccagaatttgattcaagctggtgtggatggattgcgtgttggaatgggatcgggctcaatttgtaccacccaagaggtttgtgctgttggaagaggacaggcaacagcagtgtataaggtttcatcttatgccaaggatcacaatgtaccggttattgctgatggtggaatttcaaactctgggcatattgtgaaagctctgtcgctgggggcatccactgttatgatgggcagctttttagctggtagtcatgaagctcctggtacttatgagtataaagacggccgccgagtcaaaaaatacagaggcatgggctctcttgaagccatgacaaaagggagtgatgcaag

SEQ ID NO: 31674 - DNA, 198 bp, Zea mays
  unsure at all n locations
  Clone ID: LIB3059-038-Q1-K1-H11
gggcccaccagccaccttgaaagggggattcaattgccaccattgaaccaccattggggaccaggattttttccctcctaatgctcctggctctttcggcatgtgtggctaacgcgacaattttccctcaatgctcacaagctcctatagcttcctttcttcccccataccttncatcaatgatagcttcagtatgtg

SEQ ID NO: 31675 - DNA, 430 bp, Zea mays
  unsure at all n locations
  Clone ID: LIB3059-038-Q1-K1-H2
agagccgcaaggccatgctgaagcttggcatgaagcccatcactggtgtcagccgcgtgactgtaaagaaaagcaagaatatactctttgtcatctccaaaccagatgtgttcaagagcccgaattccgacacgtatgtcatattcggcgaggctaagatcgaggacctcagctcccagctgcagacccaggcagcagagcagttcaaggctcctgacttgagccagatgatctcgaatccagagacgtctggcccgggacaggaggacaatgatgaagaggtcgacgaaactggtgttgaggccaaggacattgagctggtgatgacccaggcatctgtttcaaggcccaaggctgtcaaggccctcaaggcttctaatggggacattgtcactgccatcatggatctgacaacctnaggtgatatttc

SEQ ID NO: 31676 - DNA, 444 bp, Zea mays
  Clone ID: LIB3059-038-Q1-K1-H4
cggttcggaattccgaggctacgacgctcacgcgtaagccgacgcagagggagcgatatggggttcgtcagagacacgatggagtcgatccgctgcatgcagatccgccaagtgctcatgcagatcatcagcctcggtatgattgttacctctgcattaatcatatggaagggtttgatagttttcacggggagcgagtcaccagttgtagtggtgctctcgggtagcatggagcctggatttaaaaggggtgatatcctgtttttgcatatgagcaaagatcctattcgcacaggagaaatagttgttttcaatgtcgatggtcgtgagattccaattgttcaccgagtgattaaggtccatgaacgtcaggacactgcagaagtggacatcctcaccaaaggtgacaataattttggggatgaccgactattatatgcacat

SEQ ID NO: 31677 - DNA, 432 bp, Zea mays
  unsure at all n locations
  Clone ID: LIB3059-038-Q1-K1-H5
acctgaagaaactccgaccggccggtgggcggtggcggcacggcaggatctgtgccgcgatggcgacgtcgaacacggcgcggatggaggacggcggcggcgacctgcggagcaccatcaagaagtggaatatcatctaccctgtctacctcaactccaagaagacggtcgccgagggccgccgcatcgccgctgccaaggcctgcccggaccccacctgcatcgagatcgctgactgctgttcgcacctcaagatcccccacgccatcgagttggataaggcgtaccctcgggatttcttccaggtggggagggtcagggtgcagcttaagaaagatgacggctcccccgtcaatcctgctattaaaacgaagaagcagctgatgatccaagtagcagagctagttcccaagcatcacgngaggacaaaga

SEQ ID NO: 31678 - DNA, 413 bp, Zea mays
  Clone ID: LIB3059-038-Q1-K1-H6
atatcttttagtaacctttcaataggcgtcccccaagaactagtaaacatggcaaaactgttgagcctgttcttagccctctcctttgtagcagctatgtttgccataggctctcatgctgatggagactgtgagaatgacctccaaagcctgataagtgactgcaagacatacgtgatgttcccagctaatccaaaggtccctccttcggatgcttgctgtggtgtcatcaagaaggcaaacgtttcttgcttgtgctccaaggtcaccaaagaaactgagaaggttgtgtgcatggagaaggttgtgtatgttgctgagcagtgtaagaggccatttgagcatggcttccagtgcggaagctacaaggttccagcaaactgatgatatcgcaagagggaagcgcttgacgt

SEQ ID NO: 31679 - DNA, 423 bp, Zea mays
  Clone ID: LIB3059-038-Q1-K1-F7
cccacgcgtccggtggcgcataacaaatacacttgtccaatatgctctaaaacagctgttgatttgacacatcattgggaaatgttggatcaagagatcgaagccacgatcatgcctcttgtgtatcgctacaagatttgggtgctttgcaacgattgcaacaaggtctcagaggtgaactttcacgtgattggccacaagtgcagccactgcagatcgtacaacacccgaacgacatcgcgccctgcagatttatcgggaagcagctcaccttcaacagactcatccgacaacaacatatagagaagaaaccattgacagagccaatatgattgaagaaccgaaggaggaaatattgtttcggggcgtgcgtgcttgccaaacttgaagactcccagccgtttattggccctcatcttggct

SEQ ID NO: 31680 - DNA, 303 bp, Zea mays
  Clone ID: LIB3059-016-Q1-K1-F12
cacaccgttgtcacacaagtgactgtacctttgcacacattcggctcaccgtttgcacactgttggtgcaccggactgtccggtgtgttaaaactagccgttggctgcacagcattgtcacactgatgactcaccgtttgctcactgttggctcactgtttgcacacaatttgctcaccgtttgctgacaagactttcctgtgtgtcagaactagccattgtcttcacatcgttggctcacttttttttcaccattttcgcaccgttatctcacatttttctcacctttgtttgacattactt

SEQ ID NO: 31681 - DNA, 186 bp, Zea mays
  Clone ID: LIB3059-016-Q1-K1-F6
gtgacttactctctcgtatcttgaactcctcaaactcacctactggctctgaggctgggtccatccctagcgtcgtcccagtgccaaggcgcagccggccatcgactcaatcgcacttgatgacccatgaatgaacattacaagtaccttctcaatctactgcttatacgcgctcctgatgtagct

SEQ ID NO: 31682 - DNA, 382 bp, Zea mays
  Clone ID: LIB3059-016-Q1-K1-F9
gtgggttggcttctcctccccctccggttcgggttcgggttcgtgaggttctccggggttcgggttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgaaggcatgaacggcaaggagctggacggccgcaacatcaccgtcaacgaggcccagtcccgcggcggccgtggaagcggcggcggtgggtacggtggt

SEQ ID NO: 31683 - DNA, 436 bp, Zea mays
  Clone ID: LIB3059-016-Q1-K1-G1
cggacgcgtgggattaagcagaacctttacctttttatgtttatcatgtagcaacaatgagtatttttatccatttattaggttgataacctgagaaatcgctgtgagcttcaagaacttgagcttcaaaaatcagcaaaaaaagtactagaggccatgacactggttgccgaagaatctgcaaaatccaaagctgcaaaagaagttataaaatctttaaccgctcagctcaaggatatggctgagagattaccaccagaccacggggcctataatgtcaatgagacaaagcaatcacataatccgaatggcattgactcacatgctgctagctactctagcatgaatggaattcaccagacacggaatgagttgctcaatgcttcaattgcacatagtctgaactctggacgaccatcgtcgcattgcaatggaa

SEQ ID NO: 31684 - DNA, 425 bp, Zea mays
  Clone ID: LIB3059-016-Q1-K1-G10
cggacgcgtgggtagcaacatagaaagcacaatagtgtaccaacaatggcagccaaagtatggtgcctccttatgctccttggtctttctgcaagtgctgctacggcgaccattttcccgcaatgctcgcaagctcctatagcttcccttcttcccccgtacctctcaccagcggtgtcttcggtatgtgaaaacccaattcttcaaccctacaggatccaacaggcaatcgcagctggcatcttacctttatcacccttgttcctccaacaatcatcagccctattacaacagttacctttggtgcatttattggcacaaaacatcagggcacaacaactacaacaacttgtgctagcaaaccttgctgactactctcagcaacagcagtttcttccattcaacccaacaagttcattgaactc

SEQ ID NO: 31685 - DNA, 358 bp, Zea mays
  Clone ID: LIB3059-016-Q1-K1-G11
cggaccctggtgggttggcttctcctccctctccggttcgggttcgggttcgtgaggttgtcccgagttcggcttcgtgggtgagcggatcgagatggcggcgtcagatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgaaggcatgaacggcaaggaactggacggccgcaacatcaccgtcaacgaggcccagtcccgctgc

SEQ ID NO: 31686 - DNA, 332 bp, Zea mays
  unsure at all n locations
  Clone ID: LIB3059-016-Q1-K1-G12
cggacgcgtgggcggacgcgtgggctgacgcgtgggaaaaaaaaaaaaaaaaaaaaagaaaagaaaaaaaaaaaaaaaaaaaaaaaaaaaaaaaaaaaaaaaaaaaaaaaaaaaaaaaaaaaaaaaaaaaattaaaaaaaaaaaaattaanaaaaaaattaataaaaattaaaaaatttaaaataaataaaaaaaaaaaaaataaaataaaaaaatataaaaaaaaaanaaaattaaaaaaaaattaaattaaaaaaaaaaaaaaaatttaaaaaaaattaaaattataaaaaatttaaaaaaaaaaaaaaaaataaaaaaaataatttatt

SEQ ID NO: 31687 - DNA, 420 bp, Zea mays
  Clone ID: LIB3059-016-Q1-K1-G3
cggacgcgtgggtccggataggatttgtctcccctccactgcgcctctccgtttccggggtggctccggccgccgccttcctgtctgcgtgcgccgctggttccattccccgtgcgcccttcctgatcccgaggcctcttcttctcccaattccgctctcccctgcgcgctgggaccgctcccgcagctgcagcctctttggcgtatgcgccaacactcgccgtgcgccaacccttcgacggaacgccttcacggagacggtggttccctacgtgccgggctctggcaagtacatagcgccggactacctcgtgaagaaggtgtcagccgaagatgtgcaagatctggtgagggggcagaggaaggtgccgctcatcgttgacttctacgcgacctggtgccggccctgtgttcagatgg

SEQ ID NO: 31688 - DNA, 351 bp, Zea mays
  Clone ID: LIB3059-016-Q1-K1-H1
gaggacaacatgttcttcatctgacacaagttttttttttttttttgccggtgtcgtggcgcaagttcgggtcgattttgctgtgtggcaacgtcgcattgtttttatgctgttgcctttttttgcttgctggtcgtagtgccactgtgtgttgttgaagtcgctggtttgaaactgcagtcagttaactgtacgcgtcctgctttgtttttgtttgcgcgcgtgtgaaacagacaaacagtctgatgatttggtgtgttcagggttgtaaacaaactttattagattctcactggattatactgcatgactgtagttgaaggaaaagaagcaggtttgagttgtgaagat

SEQ ID NO: 31689 - DNA, 425 bp, Zea mays
  unsure at all n locations
  Clone ID: LIB3059-016-Q1-K1-F11
aaagatgcaactgagcttgtagcaaagcttatggcatatcatcatactgctcaaacggaggcgcgcaagcaacattattcaagtatgggccttgacctctctaagggtatcattcgcaacaaccttgagtatggcgtgatagagccatcgatgagcaaagtaaagatcattcagtttgccacggaggctgccattactatcctgaggattgacgacatgatcaagcttaccaaggaagaagagggtaacgaagagtaagcagcccaccagtagtgggctagtggactcccatgggatggttgccatagcatgtagcacttgttttttcacttatcgtttacttttgcttgctgtgagcattcgtttgtaggaaaagtgagaacggatgtgtatcaatccgtgttgngtgacgatgactcacggat

SEQ ID NO: 31690 - DNA, 275 bp, Zea mays
  Clone ID: LIB3059-016-Q1-K1-C9
ggctctgttagcctaccatggctgatcaccaccggggtgcgacgggaggtggcgggggctacggcgacctacagcgcgggggcggcatgcacggcgaggcgcagcatcagcagaagcagggcgccatgatgacggcgctcaaggccgagacggtcgcgaccttctgcgggtcgatgctggtgctgtccgggctgatcctggccggcaccgtgatcgcgctcacggtggccactcccatgctggtgatcttcagcccggtgctggtgccggccggc

SEQ ID NO: 31691 - DNA, 430 bp, Zea mays
  unsure at all n locations
  Clone ID: LIB3059-016-Q1-K1-D10
cgttcgactgctcatccttaccgacccaaggactgaccatcacccaattaaggagtctgggtctggggaacatccccaccattgccttctgtgatactgactctcccatgcggtatgtcgatatcggcatcccagcgaacaacaaggggaggaacagcattggatgcctgttctggcttttggccaggatggttctgcagatgaggggcactatcctccctgggcacaagtgggaggtcatggtggatttgttcttctacagggacccagaggaagcaaaggagcaggaggaggaagctgctgttgcccctgagtttgccgcaatcactgattaccaaggagctgatcagtggggtggtgaccagtggacctctgatgtgactgcgccgcctgttgctcctactgtgnctgattggggtgctgctccaac

SEQ ID NO: 31692 - DNA, 280 bp, Zea mays
  Clone ID: LIB3059-016-Q1-K1-D11
cccagcgatcgactgacaaaaaaggtacccttctaaagtcacgacaaagaaatagaggttgataatcaagctggtgatatagtgatagcataccgactcactgatccaatctagttaagatcgaattatgatagggattagcgcaatggttacatgcactgtcattatccattgaactgtgatctgtttttcatgcagaatactgactcatttatgcttatgctcaacatactacaataaagcgagtcttgctatatcattgttaaatgcacgttcatat

SEQ ID NO: 31693 - DNA, 261 bp, Zea mays
  Clone ID: LIB3059-016-Q1-K1-D2
ggtggatatattgttgtttcatgaccttgtagctgtcggacaataagagtggaaatagtgccgcaaaatagctttgttgtttctaaaagcgaagaatacattgccggttatgtcaacggcttttactcgaggaccaccttgtcagttatacaagtctaatgcagtcttttcactatgttggtcttgatttatctacgacgtcgatactgattacagattgttttgtattgtattttacgacaattggattttatttgtttc

SEQ ID NO: 31694 - DNA, 406 bp, Zea mays
  Clone ID: LIB3059-016-Q1-K1-D3
ccgctcctccgcgagggtgtcgttgtcccgcaagaccctgtgttgttgtcatcaactgagagagaaacaactcgatcgatcgatcaagaagaccggcgaggctctagctccagaccgacaatgccgtacgcagccacaaggacgtcgccgcagcagcacagccgcgtggccagcaacgggagggccgtggcggcgtgcgcaggccacgcgggcgtgccggacgaggtggcgcggcaccacgaagcacgcggtggccgcggggcagtgctgctctgtgatggtgcagtccatcgcggcgccggcggacgcggtgtggtcgctggtgcgccgcttcgaccagccgcaggggtacaagcgcttcatcaggagctgccacctggtggacggcgacggcgtcgaggtgggg

SEQ ID NO: 31695 - DNA, 405 bp, Zea mays
  Clone ID: LIB3059-016-Q1-K1-D4
ccctgttccaagtcctaccacctctgtccgtaagaggcaaaagacatctcaatctgtgcctgctttacctgcacctcctgcaatgcattcacaacagctggctacaccaacacagccatcgtcttcaactgctaggaaagcagtacccccagtccctaaaggcaaaaagacgaaaccaggtcagaaggtaccaggtggctctgcagccaagcctatgccatcttcagcaggtcctagtggaagaggaccacacatgaataggaattttccaggtggttctgctcctgaagctcaagctcagaatgtcgatccattggttggtcgtaaagtgatgagccggtggcctgaagataatagtttttatgaagcaaatatatctgattataatgctggaacgggccttta

SEQ ID NO: 31696 - DNA, 446 bp, Zea mays
  Clone ID: LIB3059-016-Q1-K1-E1
ctgggccgtccaccgccacctcttctaccaggacgcgtcggatctccgggacaagttggaggccaaccgacacgtggataacctggacgtggtcgataggctcattgacgatgcggaggctcagtacaggaacttccagcaccccgatccctacattgttccatgggcaccaggcggcactaaattcacaagaaacccccctccacctcaagggatcgagatcatctacaattatggcaaggaggaccagtaaacaagagtcctgcaagcggggggcagaacttccacagttccaaatcacttcctgtttaatcgagttgttgtacgagaaataagaatggaaattactggactccatccatgcttctcatttgcttgttctgataatcatgtgctcttcatctagtgcatattgaagtcatgtttcctggcataaaaatggaact

SEQ ID NO: 31697 - DNA, 336 bp, Zea mays
  Clone ID: LIB3059-016-Q1-K1-E10
aggaggaacagcaaaaccaaaagttcgcgcaatatcgttgaccgcaaccatgaccagaaggaagagcagttagtacaatccttgagggagttacttcttgcaagcaaacagctcccagataagtttgatgactactatgtccttctacggtatgcccattttatttattttctggaaaatttatgttatatattgtccttagactgacataatccacccaagtaacaggggaagagatgttttattcttcagtacttctaggatgcctgtttccttccagttttgcactgaagagatcatgacctcattgttctctggtcttgcagctatcttaaa

SEQ ID NO: 31698 - DNA, 421 bp, Zea mays
  Clone ID: LIB3059-016-Q1-K1-E11
gcttgattgttccaggtattagcagtcgaccggttcctcggagcacgatgaagtttggtgcggcctacctgcttgctgtcctcgctgggaacgccagcccctccgctgacgatttgactgccattctggagtcagttggctgtgaagttgacaatgaaaagatggaactcctgctgtcccaactgagcggtaaggacatcaccgagctcattgccgcgggcagggagaagtttgcttcagtcccatgtggtggcggcggtgtcgctgttgcggcagctgcacctgctgctggcggagctgctcctgcagctgaagcaaagaaagaagagaaggtggaagagaaggaagaaagcgatgatgatatgggcttcagcctcttcgactaggctgcacagtcatcacagtattgttttgggcattg

SEQ ID NO: 31699 - DNA, 318 bp, Zea mays
  Clone ID: LIB3059-016-Q1-K1-E2
gagagcgcgatacagtcgcatcaactacccagccgcggagaccatgagatacacgttgcaggccctccgagacgtggatactgtgtcgctaacgcgacgctcattgaccatggctcacacgctcccatgacctcccagcaccccgcatacctacacatgaacaagagcaccaggctgcgctaacccaacacgacaaccatatacgcctcaacgagccgtcaccatatgcaacaatcgcaaagcggaccagttgacacaacaactgccagccctatgcataacgcacacagtggcacataacatcatggcacatcaact

SEQ ID NO: 31700 - DNA, 175 bp, Zea mays
  unsure at all n locations
  Clone ID: LIB3059-016-Q1-K1-E5
ggctgttccgctcgggtgctgctgttttttcgggtctcgctgtcttctctgggcctgggccgcggcgcgcggntcgcgtgcggctcggcgttggtgccttgcgggtggcggtggtctgcggcggcgcgctcctcctggtgccccgcctcggtgtgcctgtggctcgcgctcgccg

SEQ ID NO: 31701 - DNA, 395 bp, Zea mays
  Clone ID: LIB3059-016-Q1-K1-E9
gggagacgcagaggtcccgcggcttctgcttcgtcaccttctccacggaggaggcgaggcggaacgccatcgagggcatgaacggcaaggagctggacggccgcaacatcaccgtcaacgaggcccagtcccgcggcggccgtggaggcggcggcggtgggtacggtggtggccgtggaggcggcggctacggcggtggcgggcgccgtgatggcggtggcggctacggcggtggcggcggctacggtggcggcggcggctactgtggtggtggcggcggctacagcggtggcaaccgtggcggcggctactgcaactccgacgggaactggaggaactgatcggtggggcccgcgcggccaaattatcctgttcgctaccgtgatgtttaccct

SEQ ID NO: 31702 - DNA, 458 bp, Zea mays
  Clone ID: LIB3059-016-Q1-K1-F1
gattcccggtcgacccagcgttcgacacacctagcgaagcgcactagcaacgacctaacaacaatggcttccaagacattatccctccttgcgcttcttgccctttttgtgagtgcaacaaatgcgttcattattccacaatgctcacttgctccgagtgccattattccacagttcctccctccagttacttcaatgggcttcgaacacccagctgtgcaagcctataggctacaacaagcgcttgcggcgagcgtcttagaacaaccaattgcccaattacaacaacaatccttggcacatctaaccatacaaaccatcgcaacgcagcagcaacaagcactgagccacctagccgtggtgaaccctatcgcctacttgcaacaacagctgcttgcatccaacccacttgctttggcaaacgtagctgcataccaacaacaacaacagttgcaaca

SEQ ID NO: 31703 - DNA, 332 bp, Zea mays
  Clone ID: LIB3059-016-Q1-K1-F10
cggcgcgtggcaggttgatcggtcacgcatgccatgcagcagggccgcagcgtgcgcgtgcttacgcgcgccgatgccgatgccgcttcgtcgtcgtcgtcgtatttttcctcctcccgtgcccctgctagtaatgctgctgtggccacggcgccgggcgacgacgaggatatcgacatcgtcgccattgtcaccggctgctgcctcgcctccgaggaagaatctaaggctgccggcggcggcgactacccgcacttggacctcaacctcatcatggacatcgtgaggatgaactagatagctacaaattaaagatatacctgccagtgcat

SEQ ID NO: 31704 - DNA, 215 bp, Zea mays
  Clone ID: LIB3059-016-Q1-K1-C6
tccgggctagacgtacgcgtacgcactctcttacgatggcatgtgtaatgtcgagaaggatattttgttgcaatgcgtgcgggaaaaagggagtgcgtagaggctcagctgaacctgaatcagatattgtgcaggcttgcagaagctttctagatcaacagcagtgcattaatgtgtggcgatttatctaaactatcaacgagagaaaagacttg

SEQ ID NO: 31705 - DNA, 390 bp, Zea mays
  Clone ID: LIB3059-016-Q1-K1-A9
gccgggccggatccagcgccggcccctacctcgcgtctccgctccaccatcgcgggcgacgacgcgccgcgtaggaccaagggccgcggcttccgcgaggaccccaactcctctgcgccccgcgattcgcgctttggcgcggggggacgcgccgacctcgactcgctcggcggcccgggacccatccaatcaattgaaggatggattgtgttggtcactggagttcatgaagaagctcaagaagatgacctccaaaatgctttccaagaatttgggcaggtcaaaaacctgcatttgaatttggaccgtcgtaccggatttgtcaaggggtacgctttgattgaatatgaaaaagttgaagaaactcatgctgcaataaaagaactggat

SEQ ID NO: 31706 - DNA, 421 bp, Zea mays
  Clone ID: LIB3059-016-Q1-K1-B10
gtccgcagaaggatgatgatgacttctggtgaggctgtcaagtacaagagctcattgtacgcgattccagcagatccttaagaaggaaggccccaagtccctgttcaagggtgctggtgctaacattcttcgtgccattgctggcgctggtgtgctttctggctacgaccagctccagatcctcttcttcggaaagaagtacggctccggcggtgcttaaatggagaaaaatgatgacgaacaagagcagttcgctcccggtccagcccagtcaggatctggtcaagtttttgcctttcatatcgaagaaattaataatttatgtaggagaatttttccaacattcgttttgggcggagacattgatctcaaaacactcgtaactgtcctactaggtggtggcatgggtccccaaaacatg

SEQ ID NO: 31707 - DNA, 395 bp, Zea mays
  Clone ID: LIB3059-016-Q1-K1-B11
agctttgtgcaagcgccactagtgctacgcatattccaggcacttgccaccaggattgcattgtgtaccatgaacccatgcatgcagtactgcatgatgcaacaggggcttgccagcttgatggcgtgtccgtccctgatgctgcagcaactgttggccttaccgcttcagacgatgccagtgatgatgccacagatgatgacgcctaacatgatgtcaccattgatgatgccgagcatgatgtcaccaatggtcttgccgagcatgatgtcgcaaatgatgatgccacaatgtcactgcgacgccgtctcgcagattatgctgcaacagcagttaccattcatgttcaacccaatggccatgacgattccacccatgttcttacagcaaccctt

SEQ ID NO: 31708 - DNA, 405 bp, Zea mays
  Clone ID: LIB3059-016-Q1-K1-B12
cggacgcgtgggttgccgtctcccttttgcgtgagcaaagaaagagagcgagaagagcagtcgccatgtctggcatcatccacaagatcgaggagaagctccacatggggggcgaccacaagaataaggaggaggagcaccacaagaaggccgaggagcaccacaagaaggaggagggggagcaccacaagaaggacggcggggagcacaaggaaggcatcgtggagaagatcaaggacaagatcaccggcgagcacggcgacaagtccggcgaccacaaggaaaagaaggacaagaaaaagaagaagcacggcgagggccacgaccacgacggcggccacagtagcagcagcagcgacagcgactgagatctggtgtcgcagcacaggtgcaacacatgtatgc

SEQ ID NO: 31709 - DNA, 437 bp, Zea mays
  Clone ID: LIB3059-016-Q1-K1-B2
ctcaagcatcagcggcaggagctctgggcagcgtgcgcacgtggggtacctagctcgctctgctagcctaccatggctgatcaccaccggggtgcgacgggaggtggcgggggctacggcgacctccagcgcgggggcggcatgcacggcgaggcgcagcagcagcagaagcagggcgccatgatgacggcgctcaaggccgcgacggccgcgaccttcggcgggtcgatgctggtgctgtccgggctgatcctggccggcaccgtgatcgcgctcacggtggccacccccgtgctggtgatcttcagcccggtgctggtgccggccgccatcgcgctggcgctcatggcggccgggttcgtcaccttcggcggcctcggcgtcgctgcgctgtccgtgttctcctggatgtacaagtacctgacgggcaagcaccc

SEQ ID NO: 31710 - DNA, 432 bp, Zea mays
  Clone ID: LIB3059-016-Q1-K1-B7
cccacgcgtccgcggacgcgtgggtttgcatttaaggactacttcaagaggtggttgagcttcaagaaggatagggatggctattggaagtggtttgctggcaacctggcctctggtggtgctgctggtgcttcctctttgttttttgtgtactccctggactacgcgagaacaaggttggctaatgacgctaaggctgccaagggatgaggtgaaaggcagttcaatgggcttggcgatgtctaccgcaagacactcaagtctgatggtattgctgggctataccgtggatttaacatctgctgtgttgaaatcattgattatcgtggtcagtactttgggctctatgattccatcaagccagttgtacttactggcaacctccaggacaatttctttgccagtttcgctctgggttggctgatcactaat

SEQ ID NO: 31711 - DNA, 392 bp, Zea mays
  Clone ID: LIB3059-016-Q1-K1-B9
cgcacgcgtccggcaacatagaaagcacaatattgtaccaacaatggcagccaaaatgtttggcctccttatgctccttggtctttctgcaagtgctgctaccgcgaccattttcccgcaatgctcacaagctcctatagcttcccttcttcccccgtacctctcaccagcggtgtcttcggtatgtgaaaacccaattcttcaaccctataggatccaacaggcaatcgcagctggcatcttacctttatcacccttgttcctccaacaatcatcagccctattacagcagttacctttggtgcatttattggcacaaaacatcagggcacaacaactacaacaacttgtgctagcaaaccttgctgcctactctcagcaacagcagtttc

SEQ ID NO: 31712 - DNA, 415 bp, Zea mays
  Clone ID: LIB3059-016-Q1-K1-C1
cggacgcgtgggcggacgcgtgggctttctccctactctcagcaacaacaatttctggcattcaaccaactgtctacactgaaccctgctgcttatttgcagcaacaactattaccattcagccagctagctactgcctactctcagcaacaacaacttcttccatttaaccaattggccgcactgaaccccgctgcttatttgcagcagcaaatactactaccatttagccagctagctgcagcaaaccgtgcttccttcttgacacagcaacagttgctgcctttctaccagcagtttgcggctaaccccgcaaccctcttacaactacaacaattgttgccctttgtccaacttgctttgacagacccagcggccttctaccaacaacacatcattggtggtgccctctttt

SEQ ID NO: 31713 - DNA, 420 bp, Zea mays
  unsure at all n locations
  Clone ID: LIB3059-016-Q1-K1-C11
gccagttaacttccaattactggggtttccacgtttaaggttgctcctatgaaggctgcaagtaacttcaataagatccaatgtttctgctttgaggagcaaacacttcttcctggagaacagattgacatgccagtattcttctatatcgatcctgagtttgagacagaccccaaaatggacggngtgaacaatatcgttctttcgtatacattcttcaaggtgaacgatagttaggaaacgtgccaacagcattgttgtattaggaaaacaacacttgaacaatccatatgcagatatgctgcggaatagcatctcatgtaacaccaagagttttttttggtagttagctcacgttagtctgtggagaattttgcaaaaaaaaaaaaaaaaaaaaaaaaaactagaaaaaaagggcgg

SEQ ID NO: 31714 - DNA, 431 bp, Zea mays
  Clone ID: LIB3059-016-Q1-K1-C12
ggctgacagcgttcacccagtggacgctccacgtcttggggttcttccctgtaggctagaacgtacgtcccaagctgtccggcatggaccaggttcaagccggcagtccctacggcgccagcacattcgacgccgacagcttcgaggtggccgaacgaggtggagctggagcacgcctttcaccaggggaagtacttctcaggcatcgccatacagctcaagggttcaacctgatctacacatatacccttgacggatatcatataagacacttattacagattcgtcttacccatcaatagatcggtctgatctctcgtggtgtctggatgttgtgtggctcagtggaactttcatgctacggtgactttgaatgtaactggaatttggaatattcgttgtttaatgcaatttcgatgatttgctcaaat

SEQ ID NO: 31715 - DNA, 415 bp, Zea mays
  Clone ID: LIB3059-016-Q1-K1-C2
cccacgcgtccggagccacctagccatggtgaaccctgccgcctacttgcaacagcaggtgcttgcatcaaacccacttgctctggcaaacgtagttgcaaaccagccacaacaacagctgcaacagtttctgccagcgctcagtcaactagccatggtgaaccctgccgcctacctacaacagcaacaactgctttcatctagcccgctcgctgtggccaatgcacctacatacctgcaacaacaattgttgcaacagattgtaccagctctgactcagctagttgtggcaaaccctgctgcctacttgcaacagctgcttccattcaaccaactgactatgtcgaactctgctgcgtacctacaacagcgacaacagttacttaatccactagcagtggctaacccattggtc

SEQ ID NO: 31716 - DNA, 440 bp, Zea mays
  Clone ID: LIB3059-016-Q1-K1-C4
caaatttactgtattattatggcatgtgtaatgtcgtgaaggatattttgttgcaatgctactttagaaagggagtacgtggaggctcagctgaacctgaatcagatattgtgcaggcttgcagaagctttctagatcaacagcagtgcattaatgtgtggcgatttatctaaactatcaacgagagaaaagacttgacagagaacctgaagcagctacagtgcaggacactaatttttgttggtgagaattcccagttccatgctgaagttgtgcacatgactgcaaagcttgataggcgatatagcgctcttgtggaggtacaagcttgtggctcggttgtgacagaaaagcaaccacacgcaatgctgataccaatggagtactttctcatgggatatggactgtataggccaagacagataaactatagccctcgt

SEQ ID NO: 31717 - DNA, 361 bp, Zea mays
  Clone ID: LIB3059-016-Q1-K1-A8
cccacgcgttcgcccacgcgtccgcccacgcgtccgcccacgcgttcgcccaggcgtgggcccacgcgtccgcggacgcgtgggaagaagatagacggatcctcccggtgaacgaacatgtcgccaagagagtggatccacgacggagactacaccccggtaatcgtggtcatgattttcattgtgctgctcacagtcgcgttcgtgcttttctcccattattgctttgggtaccgtatcgttcatgctcactggatatgactttgaatgctatgtgatgctcaagtatctcatttgcgttgacagtgtcctttccaagcgggcacatcatgatataaagaattcaaacccttatgaggtt

SEQ ID NO: 31718 - DNA, 417 bp, Zea mays
  Clone ID: LIB3059-038-Q1-K1-E1
cagctgcaacagtttctgccagcgctcagtcaactagccatggtgaaccctgccgccggcctacaacagcaacaactgctttcatctagcccgctcgctgtggccaatgcacctacatacctgcaacaacaattgttgcaacagattgtaccagctctgactcagctagttgtggcaaaccctgctgcctacttgcaacagctgcttccattcaaccaactgactatgtcgaactctgctgcgtacctacaacagcgacaacagttacttaatccactagcagtggctaacccattggtcgctgccttcctacagcagcaacaattgctgccatacaaccagttctctttgataaaccctgtcttgtcgaggcagcaacccatcgttggaagtgccaatcttttagatacatatgag

SEQ ID NO: 31719 - DNA, 402 bp, Zea mays
  Clone ID: LIB3059-038-Q1-K1-E10
aattgttcaaccctacaggatccaacaggtaatcgcaacaggcattttaccattattacccttggttcttcaacaaccggcaggcctattacagcaggtacctttgggccatttgggggcacaaaacatcaaggcacaacaactacaacaacttgtgctagcaaaccttgctgcatactctcagcaacatcagtttcttccattcaaccaactggctgcattgaactctgctgcttatttgcaacaacaattaccattcagccagctagttgctgcctacccccagcaatttcttccattcaaccaactagcagcattgaactctgctgcttatttacagcagcaacaactactaccattcagccagctagctgatgtgagccctgctgccttcttgacaca

SEQ ID NO: 31720 - DNA, 356 bp, Zea mays
  Clone ID: LIB3059-038-Q1-K1-E12
agtgttaacgcatccagcggaacgcttttgcttcggcctttgaacaattggttccaaagtttgagaccctcttggcgcttatggacttttcggggaacccaaaactagggttcataattgcccaaggcgaacttgctcgtactgccatatttacacagattgtccaaccaatccctaaaatgggcttcgaacacctacctgtgcaagccaacatgcgtcaacaagcgcttgcggcgagcgtcttacaacaaccaattgcccaattgcaacaacaatccttgccacatctaacaatacaagccatcacaacgcagcagcaacaacagttgctaccagcactgagccacctagccatg

SEQ ID NO: 31721 - DNA, 419 bp, Zea mays
  unsure at all n locations
  Clone ID: LIB3059-038-Q1-K1-E5
gctgctgagcacgttcctccgggacttcgaggccggcgcgctggaagcccgcgggtggccgacggagttcgccgcgtacaaggtggccaaggccgccctgaactcctactcgagggtcctggcgaggcggcaccccgagctgcgcgtcaactgcgcgcacccgggctacgtgaagaccgacatgaccaggcagacgggcctgctgaagcccgcgcagggcgcggccaacgtcgtcaaggtggcgctgctcccggaaggcggccccaccggagctttcttcgcgctaggcaaggaggcgccgttcgtgtgacgctgccgtactgggctggcggtggtggggacttcacggtccggcgctagtgcgccgnctctccgacttgcctggcgcctgctatctactacctctctgctctctgtgc

SEQ ID NO: 31722 - DNA, 320 bp, Zea mays
  Clone ID: LIB3059-038-Q1-K1-E6
caaagaatttgaatatctgaacaattgaatatctcacttgaacgttatatggcttatgtgttaggcattctttcttttcgtatggatttggtttcaaatcataaatacttgttgtaatcttattagcctctgagggcacaccttgcttcaacatatttgtatacggaatcgatgacaagtatccatgcttcaacatattaacttacaaaatgacacacgacatcaaactatcaatctaccagcagatagccggtgaccctgcaactactatgacaacgtactacaattgctgccatatgtgcatctagctgtgacaaacc

SEQ ID NO: 31723 - DNA, 346 bp, Zea mays
  Clone ID: LIB3059-038-Q1-K1-E7
cagccagctagctgctgcctacccccagcaatttcttccattcaaccaactagcagcattgaactctgctgcttatttacagcagcaacaactactaccattcagccagctagctgatgtgagccctgctgccttcttgacacaacaacagttgttgccgttctacctacacgctatgcctaacgctggcaccctcttacaactgcaacaattgctgccattcaaccaacttgctttgacaaacccagcagtgttctaccaacaacccatcattggtggtgccctcttttagattgcttatgagttatagttcaataatgaagttttttggatgatgtttgtggct

SEQ ID NO: 31724 - DNA, 397 bp, Zea mays
  unsure at all n locations
  Clone ID: LIB3059-038-Q1-K1-E8
aagttcccctcgattagctacactgatcttcagcaacgagtctcttaggaaactgctgttccacaggaaaaaatcgagcaagaaacaggtgcacgggtatcaatcagtgatggtacagtcactattgttgctaaaactcaagaaattatggataaagctattgagaaggttgagttcctcgtgggacgtgaaattgaagttggtcgtacatacaaaggaattgtttcttcgattaaggagtatggcgcttttgtggagttcaatggtggacaacaaggcttacttcatatttcggagttgtcacatcaaccggttacgaaagtctcggatgttgtaactcttgggcaatctctctctctgagatgcattggacaggacatgcggngtaacattaaac

SEQ ID NO: 31725 - DNA, 416 bp, Zea mays
  unsure at all n locations
  Clone ID: LIB3059-038-Q1-K1-E9
cggacgcgtgggcggagccctactaccgtactcctctcgcctncactatcgctgcaacggtttgctctcgctcctgctgctgctgggactctcggcgttcggtgtctacatggggtggatgtctcccacggttgtagctgacatgggactcgaacttctgtcggtgacctttatttttagcgtcattgtctattttgcactctacattgccggcatcaagtccggccacaaaagttcttctttgagaccacatgttagtgggagcttcatgcaagattggtggtttggagtgcaacttaatcctgattctatggaagttgacctcaaatgcttctttgtgagggcacgaatgatggcatggttatctattaacctctctatgtttgcaaagagccactgtgctggatcagccaatc

SEQ ID NO: 31726 - DNA, 401 bp, Zea mays
  Clone ID: LIB3059-038-Q1-K1-F1
cccacgcgtccgcccacgcgtccgcggacgcgtgggttcagaaacacacctagcgaagcgcacgagcaacgacctaacaacaatggctaccaagatattatccctctttgcgcttcttgccctttttgtgagcgcaacaaatgcgttcattattccccaatgctcacttgctcctagtgccattattccacagttcctccctccagttacttcaatgggcttcgaacacccagctgtgcaagcctacaggctacaacaagcgcttgcggcgagcgtcttacaacaaccaattgcccaattacaacaacaatccttggcacatctaaccatacaaaccatcgcaacgcaacagcaacaacaatttctaccagcactaagccaactagctgtggtgaaccctg

SEQ ID NO: 31727 - DNA, 178 bp, Zea mays
  Clone ID: LIB3059-038-Q1-K1-F11
gcgcttgcggcgaacgtcttagaacaaccaattgcccaattactacaacaatccttggcacatctaaccatacaaaccatggcatcgcagcagcaacaagcactgagccacctaaccgtggtgaaccctatcgcctacttgcaacaacagctgcttgcatccaacccattgcttggca

SEQ ID NO: 31728 - DNA, 394 bp, Zea mays
  Clone ID: LIB3059-038-Q1-K1-F2
ctctcaggaacaacaattccttccattcaacctactgtctacactgaaccctgctgcttattggcagcaacaactattaccatttagccagctagctactgcctactctgaacaacaacaacttcttgcatttaaccaattggccgtactgaaccccgctgcttatttgcagcatcaaatactactaccatttagccagctagctacaacaagccgtgctttcttcttgacacaacaacaagtgctgacgctctaacaagagcttgcggctaaccccgcaaccctcttacaactacaacaattgctgccctttgtgcaacatgctttgacaaaaacaatagcctcctaccaacaacaccttattggaggtgccctattttagattgcttattag

SEQ ID NO: 31729 - DNA, 417 bp, Zea mays
  Clone ID: LIB3059-038-Q1-K1-F5
ctctcagcaacagcagtttcttccattcaaccaactggctgcattgaactctgctgcgtatttgcaacaacaactaccattcagtcagctagctgctgcctacccccagcaatttcttccattcaaccaactggcagcattgaactctgctgcttatttacaacagcaacagctaccaccattcagtcagctagctgatgtgagccctgttgccttcttgacacaacaacagttgttgccgttctacctgcacgctgcgcctaacgctggcaccctactacaactgcaacaattgctgccattcaaccaacttgctttgacaaacccaacaacgttctaccaacaacccatcattggcggtgccctcttttagattgcttatgagttatagttcaataatgaagttatttggatgat

SEQ ID NO: 31730 - DNA, 441 bp, Zea mays
  Clone ID: LIB3059-038-Q1-K1-F6
caactagcaacatagaaagcacaattgtgtaccaacaatggccgccaaaatatttagcgctacttatgctccttggactttctgcaagtgctgctactgcgaccatcttgccgcaatgctcacaagctcctatagctccccttctttccacgtacctctcaccagcggtgtcttacgtatgtgaaaacccaattattcaaccctacaggatccaacaggcaatcacagctggcatcttacctttatcacccttgttcctgcaacaatcatcagccctattacatcagttacctttggtgcatttattggcacaaaacatcagggcacaacaactacaacaactagtgctagcaaaccttgctgcctactctcagcaacagcagtttcttccattcaaccaactagctgcattgaactctgcttcttatttgcaacaacaac

SEQ ID NO: 31731 - DNA, 420 bp, Zea mays
  Clone ID: LIB3059-038-Q1-K1-D9
gcaacacagagtaccaacaatggcagccatacaatttagcgtggttatgcatcttgggctgcgtgcgagtgctgctatcgcaaccgttgttccacaatgcttacatgctcctatagctttccttcttcctccatacctatcaccagcgcggcttcatgcgtgaagacccaatggatgcaccctacctgatacaacaggcactcgcaacaagcatctgagcagtatcaccactgttgcatcaacaaccgtcatccctattacaagagttaccttaggtcgatgcggtggcgcaacacattctggcacaacaactacaacaacttgtgctagcaaaccttgatgcatactcgcagcaacatcagtttctgccattctaccaactggctgcatcgaactatgccgcctatttgcaacaacaac

SEQ ID NO: 31732 - DNA, 443 bp, Zea mays
  Clone ID: LIB3059-038-Q1-K1-C4
cccaagttgaacccgctgaagcagcacaaaatccttctgatctagctgccacttgcgggcctgcataccaagaagttggtggtgctagtgcctcgcaaagtgccattgaggcccagaaagctactgctgcggcatctcagctcactcgcagtggttcatcaagggcaatggaaaatgcacaggacggcggggagaggaagtaacgagatagagctcgtttttttttatcgtctatgctacatcttatggatgcatatgatcctgcctgacgattctcaggtctcagctctccgtggctccgtgtgcaaatctctgccacgggcgtgttttaacgcctgattggatggttgcccgctggcgcgcccggccagcctcgtacggccacttcggacgcatctgcatcttcggaggtacccgcagatgtagatgaatggccgtaaaat

SEQ ID NO: 31733 - DNA, 344 bp, Zea mays
  Clone ID: LIB3059-038-Q1-K1-C6
cccacgcgtccgtctacatctccggcttcccctcttaataaatattttttatggttggtgtttatttaaaaaggtttgccgttttatatgatccaaacttacataaacatgcattcgaggtaataattattctataatgacacctaaatttaattcactgaccatttaattacaatgccataactgaaaaaactctcaccttaccaatgttaatcgcattccatcacatgcccctttctaaatctgcagtaatactctaaaggatggtaccaattatccttaccaatagttccccaacctgaatcctaaatgggactcgcattgtataagaacattaacaactt

SEQ ID NO: 31734 - DNA, 437 bp, Zea mays
  Clone ID: LIB3059-038-Q1-K1-C7
cggacgcgtggggatctggctctgaaggagctgatagctccttgcaggagcagtacagcaaggagctggcccttgaggaggcggagaccatagccctttctattctgaagcaggttatggaggagaaggtgaccccaaacaacgtcgatattgccaaggttgctcccaagtaccacctctacacccctgccgaggtcgaagccgtgatcgcgaggctgtgaaacgctttcggagctcgtgttattcatgtcatcaatcggtaatagacgatccttgtacgaagcgtggacatcttttgttcttgattatggctgtcatcgtactctgttgttaactccacaaggacagtcgatggtactatgattcacacctcagcccgattccgttgtctgattgcctagtgcctacacttgtttttttattttaccgtttcggct

SEQ ID NO: 31735 - DNA, 389 bp, Zea mays
  Clone ID: LIB3059-038-Q1-K1-C9
accactgctgcccaagaggtcgaccagtcagacgaacacaccgctgtgtcaggcacggaagaactgctggcgcagcagctcaaggacaacctccacagcagcggcgactgcactggccatggcaccctctcttcggaagaagacgacggtggcgtggtcagtgacgagggctgcagcttcgctctcccggatgccatgttcgctgccgggttcacccaccatggcgccgaggaggtgcagctggccaactggacatccatgttctggaactgatcagcggatggatgcatccaagtgcaaagatcggatcctctcctagtctcgacccttttctgcagcatataattaccgtgttaattatgtgccgtccgatgtttgtaagtgctcat

SEQ ID NO: 31736 - DNA, 330 bp, Zea mays
  Clone ID: LIB3059-038-Q1-K1-D1
aaaggaccgcggcgccctcgtcgagttctacgccccctggtgtggtcactgcaagaagcttgctcctgagtatgaaagacttggtgcaagttttaagaaagctaaatctgtcttgattgctaaggttgattgtgatgagcacaagagtttgtgcagcaagtatggagtttccgggtatccaacaatccaatggttcccgaaaggatccttggagcccaaaaagtatgaaggacaacgcactgcagaagcccttgctgaatttctcaatactgaaggaggcacaaatgtaaagctggcaaccattccttcaagtgttgtggttctcacccc

SEQ ID NO: 31737 - DNA, 422 bp, Zea mays
  Clone ID: LIB3059-038-Q1-K1-D10
gcaacaaccatccctagtggatctatattttcaaataatcgtagcacaacaacttccacgaccaggggtttcaacaatcaaaccagtaattgcagcgaaccttgattcttaacttcagcaacaacaatttctttcattcaatcaactagctggggtgaaccctgctgcttacttgcaggcacaacagctactaccattcaaccaacttgtcaggagccctgctgccttcttactgcagcaacagttgttgccattccatctacaagttgtggcaaacattgctgctttcttgcaacaacaacaattgctgccattttacccacaggttgtgggaaacattaacgccttcttgcaacagcaacagttgctgccattctacccacaggatgtggcaaacaatgtcgccttcttacaacaacaac

SEQ ID NO: 31738 - DNA, 303 bp, Zea mays
  Clone ID: LIB3059-038-Q1-K1-D11
agcaacaacaatttcttccattcaatcaactagctggggtgaaccctgctgcttacttgcaggcacaacagctactaccattcaaccaacttgtcaggagccctgctgccttcttactgcagcaacagttgttgccattccatctacaagttgtggcaaacattgctgctttcttgcaacaacaacaattgctgccattttacccacaggttgtgggaaacattaacgccttcttgcaacagcaacagttgctgccattctacccacaggatgtggcaaacaatgtcgccttcttacaacaac

SEQ ID NO: 31739 - DNA, 380 bp, Zea mays
  Clone ID: LIB3059-038-Q1-K1-D2
gataagaaggcgggcgccgtggcagagaagaatgcggcggcggcggatcagagcaaggaggtggccgctggtgatgtgagcctgaaggagctgtccaagaggctcaacgacttcgccaaggagagggactgggagcagtaccatagcccccggaacctgctgctcgccatgatcgctgacgtcggtgagctgtcagagctgttcatgtggaaaggggaggtgcgcaagggcctcgcggactgggacgaagcggataaagagcaccttggcgaggagctctccgacgtgctgctctacctggtccgcctatgcgacatgtgcggcgtcgacctcagcgacgccgccctcaggaagatcgtcaagaacgccgtcaagtaccc

SEQ ID NO: 31740 - DNA, 403 bp, Zea mays
  unsure at all n locations
  Clone ID: LIB3059-038-Q1-K1-D3
ctctgctcctccatctccatggctgtcgccggcttgccgtgcttnccgctctctgccggcggcgccgccccagctgtgcggctggccgcgaggccaaaccggcagcgaccaccccgacgatggacgggtgccgcaccgtcagcagaccgtggggagatgggcaacgacgacagtggtggtgaggcgttgccgccaggtcggtccgtcgtcgtgacgactacaaagcccgccgcagcagaactttctgtgaaggaggatgtcagattgtcagtattctagtttgaggatatgatgatattcccaagtgagcatggtggggtgtttcctcatcaacaagcactccaaggtataattgatgttgctccaataccgggtgtgagaagagccacaactgatgttacta

SEQ ID NO: 31741 - DNA, 421 bp, Zea mays
  Clone ID: LIB3059-038-Q1-K1-D5
cagcaaagcggcagtgcgtatagaggatcgtcgaacagaacagcatgaagatggtcatcgttctcgtcgtgtgcctggctctgtcagctgccagcgcctctgcaatgcagatgccctgcccctgcgcggtgctgcagggcttgtacggcgctggcgccggcctgacgacgatgatgggcgccggcgggctgtacccctacacggagtacctgaggcagccgtagtgcagcccgctggctgctgcgccctactacgccggttgtgggcagccgagcgccatgtgccagccgttccggcaacagtgctgccagcagcagatgacgatgatggacgtgcaatccgtcatgcatcagctgcagatgatgatgcatcttgagcgtgccgctgccggcagcagcagcctgtacgagccagctctgat

SEQ ID NO: 31742 - DNA, 283 bp, Zea mays
  Clone ID: LIB3059-038-Q1-K1-D7
cgtttatgtgatatggacaagtgtgtgtagctgcttgcttgtgctagtgtaatgtagtgtagtggtggccagtggcacaacctaataagcgcatgaactaattgcttgcgtgtgtagttaagtaccgatcggtaattttatattgcgagtaaataaatggacctgtagtggtggagtaaataaaaaaaaaaacaaaaaaaaaaaaaaaaaaaaagaaaaaaaaaacaaaggcaacaagctgcaaaggatcaaaagctcaagtactataaagagcaacgatata

SEQ ID NO: 31743 - DNA, 385 bp, Zea mays
  Clone ID: LIB3059-038-Q1-K1-D8
ccgacacatagtgaggctactcctaggcatctaatctatcgagattgtacatggcgagggacgtatggaagctgatatagctgatagtgatcaagaacaacttcttgctggtgtatcactcaggcaacatcgatgccaacgacaatcaataccaacgagcgtataaactgtacagtgtacactcgtactgatactatgcataagcacacaaagaagctgtaacgaatcatctaggttgatgcaaggaatggcattgggagcactatactaacaatacctagatgcacagcaggcgatcaatgtagaaccacaagtataatatggacaagtagtaaatcatgatggacactgggagcaacaaccaaatctgctacaactattacag

SEQ ID NO: 31744 - DNA, 347 bp, Zea mays
  Clone ID: LIB3059-038-Q1-K1-C3
cccacgcgtccgatctgaatgacaaagtaaacgttgaggctagcaaaataagtgtgggtgtcaggtccatattctgtattgtagaaaaagctgaggccaaatggtggaagaaacttgttcgagatgatcaaagggcacctcactttgtgaaagttgattgggacaaatgggttgacgaagatgatgatggtgctgatgtcaacttggatgggatggacttctcgaattttggcggtatgggtggtatgggtggcatgggtgatatggctggcttgggtggtcttggtggcatgggtggaatgggcggtatgggtggtatgggaaatggatgatttgaggatgatagt

SEQ ID NO: 31745 - DNA, 437 bp, Zea mays
  Clone ID: LIB3059-038-Q1-K1-A6
acacacctagcgaagcgcactagcaacgacctaacaacaatggcttccaagacattaggcctccttgcgcttcttgccctttttgtgagtgcaacaaatgcgttcattattccacaatgctcacttgctccgagtgccattattccacagttcctccctccagttacttcaatgggcttcgaacacccagctgtgcaagcctataggctacaacaagcgcttgcggcgagcgtcttagaacaaccaattgcccaattacaacaacaatccttggcacatctaaccatacaaaccatcgcaacgcagcagcaacaagcactgagccacctagccgtggtgaaccctatcgcctacttgcaacaacagctgcttgcatccaacccacttgctttggcaaacgtagctgcataccaacaacaacaacagttgcaacagtt

SEQ ID NO: 31746 - DNA, 404 bp, Zea mays
  unsure at all n locations
  Clone ID: LIB3059-038-Q1-K1-A9
gcatcttcgtggtgaaattgacaagctcgttaccgctcggaaagaactatctgcagaggctgcatctctcgtggaagagctgaacagggagcaatctgttaaacagcagctacctgtgctgaaaacagaaattgatggtctgcaacaggaacttgttcacgtgaggactgcttgcgggttagagcagaaggggaatttggaattgctggaacaaaggaaggcaatggagaagaatatgctttctatggcacangagatcgagcagatgcgaggcgaattagctaattttgaagttagaccaaggggcccaggtggagcatatgggatgcagattgggagttcggaagtgaccttcactaagaacccatatgaagatggttataatgcttatgtgggggttcctg

SEQ ID NO: 31747 - DNA, 397 bp, Zea mays
  Clone ID: LIB3059-038-Q1-K1-B3
cggacgcgtggggcagtttctttcattcaaccaactagctgcattgaactctgctgagtattggcaacaacagcaactaccattcaagcagctacctgctgcctaccaggagcaatgcctttcattcaaccaactggcagcattgaactctgctgcttatttacagtagtaacaactactaccattcagccagctagctggtgtgagccctgctaccttcttgatacaaccacagttgttgacgttctaccagcacgctgcgcctaacgctggcacactgttacaactgcaacagttggtgccattcaaccaacttgctttgacaaacccagcagcgttctaccaacaacccatcattggtggtgccctattgtagatgtcttatgagttatagttc

SEQ ID NO: 31748 - DNA, 410 bp, Zea mays
  Clone ID: LIB3059-038-Q1-K1-B6
gagaaagtactaccagggaacatcattgtccgccaaagagggacccgcttccatcctggaaactatgttggcatgggcaaggatcatacacttttctgcctgaaagaaggcaatgtacgctttgagcgcaacaaactctcaggcaggaaatgggttcatgttgatccagttgctggtcatgatcttcaccccatttacgcagatggttttgctactacatccgacactgagccaatgcaataaatgtgcttggggatttgggctgtcattttgttccaactcattcagctgccattttacagtttcatgtgtaaactttagcaggcttgaacgtagctggatcttttctttgtaatcataactactttgaataatataagttatacactgtaagctttgttctcatggtt

SEQ ID NO: 31749 - DNA, 316 bp, Zea mays
  Clone ID: LIB3059-038-Q1-K1-B7
aggaaacccagccgacggcgcatcggtcttccaggtaagcagtagcgttcacgtcaggggccgtcatgaagcgcaacccccgcgtcacgagctttcgccggaagtgccggaaggcgcacttcacggcccagtactctgtccggcgcgtgctcatgtccatggcgctatcgacggagctatgacacatgtacaaatgtgcgttccatcccgatcctgcatagacgacaaggtgcaagtcgtgcgcggtacctacaagggacttgaggtcaaattggtgcacgtgtaacgacgttgctatgttatacacgtatagcgg

SEQ ID NO: 31750 - DNA, 363 bp, Zea mays
  Clone ID: LIB3059-038-Q1-K1-C1
ctttgaggcaactctggcatcagaagcacttctaaatgaagaggcggtagtagcagcggcagccgcagaggctgttgctcttgccagagcagctgccgaagctgcccaagaagttgttcagatagtacaaagaaacaaccatcagccggtaattagaccaaaaaagtgtgtggacaactacttggcaaatgaaatccttcgcacagagatgcgatcgagcagtcctgacatgtatgctaataatcctttgatggagtatctggactcttatggtatcatggatgctgaagatgaattagatgcttatgcacagtatactgagaacatagctgggaaatctgctcgtcaatctgagagaaaagc

SEQ ID NO: 31751 - DNA, 351 bp, Zea mays
  Clone ID: LIB3059-038-Q1-K1-C10
gctcgtgcggctcgtcaaggagaacaaggtcaaccaagatcgaggagatctacctccacgtgatgggccgtcaaggagcaccaaatcatcgagaccctagtgccggggctcaaggacgacgtgatgaagatcacgcccgttcagaagcagacccgcgccggacagcgcacccgcttcaaggcctttgtcgtcatgggcgactgctacggccacgtcggcctgtgagtcaagtgcgccaacgaggtggccaccgtcattccgcggcgccatcattctcgacaagctctacgctgttcccgtcaggaaaggctactggggaaacaagattgggcagtcacacaccgtgccctg

SEQ ID NO: 31752 - DNA, 203 bp, Zea mays
  Clone ID: LIB3059-038-Q1-K1-C11
aaagaaacaactaaaaagagaaaacagttttacctaaaaacgaagagatctacctaccgggatcgtgctaaacgagcaccagatgatcaaagaccatcgatccggagactaaagtcgaggtgatgaacatcactcccgttcagaagccgacccgctccgcacagcgcacccgcttcaaggcctttgtcatcataagctactgc

SEQ ID NO: 31753 - DNA, 392 bp, Zea mays
  Clone ID: LIB3059-038-Q1-K1-C2
cgcggccaggctcttcaccaagcttatcgttgtctttctgctgctcgtttgttacaccggggcacgggtgcgaccggtgactatggtgtcagcgaggaagtgcgagtcgcagagcttccgcttcaagggaccttgctcgagggacgccaactgcgcaaacgtctgcctgaccgaaggtttcaccggcggcgtgtgcaagggcctacgccaccgctgcttctgcaccagggactgctagtactgcctcgcctcgtgtcctgcgtgtgcatatatagccgcagcggatcaattaaacatgcatgcatgcgttaccaaatatttggcagtaccagcaagttaatgaattaaaatattaaataatatgtcatggaaaaaactaaagcagaaaaagg

SEQ ID NO: 31754 - DNA, 443 bp, Zea mays
  Clone ID: LIB3059-038-Q1-K1-A4
cgagaagcaaattgtgacggccaatcctgatatcaatgtcgtggagctctgcgatgatgacgactttgttgttgtagcatgtgatggcatttgggactgcatgtcaagccaacagctggtggattttatccacgagcgtataaacacggagagcagcctgtctgccgtgtgcgagagagtgctggacagatgcctggctccatcaacgatcgctggagacgggtgcgacaacatgaccatgatcctggtgcagttcaaaaaacctgtcgatcggaacaagaaggccgaagcagcagggcaatctgccagcaatgtggacgaagccaagagtcgtgttgctgaggagtgaagcatggctggcactcaccagggcgcaaccatttgctttcataaggcatgtgaaaaaaaggaacgaaaaaacctgcagtgtacgtatcttaact

SEQ ID NO: 31755 - DNA, 424 bp, Zea mays
  Clone ID: LIB3059-015-Q1-K1-H2
cggacgcgtgggttttagcaaccggttcctgaagtctggtgttcaaaaggctggtaggaaaacgagatacgagagagctggaaatgagcaatttgtgacagagacaagcaaatgggtcttccatgagagggggcaccttaaggctgttaatgttaagcaccacaaggttggggagaccaatgaaccaggcatgtaccgcattaacgatgacctggaatactctgttgagatctatgaatggtctggaacaagctggaagccatatgttgctgatgatgtgcaactccagtttttcatgatgagtccttatgttctgaaaactatgtcgaatgacaacaagggtttatactcaacatccttcaaagttcctgatgtctacggagttttccagttcaaagttgagtaccagaggctgggatatact

SEQ ID NO: 31756 - DNA, 381 bp, Zea mays
  Clone ID: LIB3059-015-Q1-K1-H3
gcacgagctgcgggggaagagcaaggcggatctgcaagcgcagcttaaggagtttaaggcggggctctccctgctacgcgtaaccaaggtcaccggcggggctcccaacaagctctccaagatcaaggttgtgcgcacctccatcgcgcgcgtgctgaccgtcatctcgcagaagcagaagtcggcgctgcgtgaggcgtacaagaagaagaagctgctcccgctcgacctccgccccaagaagacccgcgccatccgcaagcgcctcaccaagcaccagctcttcttgaagaccgagaaggaaaagaagcgcgagaaagtatttcccatgaagaagtacgctatcaaggcctagatcagtgaaagaacatttatcctgtc

SEQ ID NO: 31757 - DNA, 442 bp, Zea mays
  Clone ID: LIB3059-015-Q1-K1-H4
ccgacgcgtccgcggacgcgtggccgtacgcttgcgtggccgccgcattcgccctagggaggtggagttcttaagctcgaactctttttacctgaggaatatccaatggctgccccaaaggttaggtttctgacaaagatttatcatcccaacatcgacaagcttggtaggatatgcctcgacattctcaaggacaaatggagcccagcacttcagattcgaacagttcttttgagtatacaggctctactgagtgcgccaaatccagacgaccctctttcggataacattgcaaagcactggaaagccaatgaagtagaagctgtcgaaacagctaaggagtggactcgcctgtatgcgagcggtgcatgagaacgcagtgatgttcttgatgtaataacccatcatacttcagtcctcatctattgccatttgcttgata

SEQ ID NO: 31758 - DNA, 439 bp, Zea mays
  Clone ID: LIB3059-015-Q1-K1-H5
gcagttggaagccaattctggcccggctgaagtttctgagttgactggcccggatgtgatggaagagaagtgcgcttctgctgccatttgttttgtatcattccttccagacatccttgattcaaaggcagaaggaagaaacaagtaccttgagctcctgctctctgtagctgagaagtttaaaaagagtccatacagttttgtctggacagctgctggcaagcaagctaatctcgagaaccaggttggtgtgggcggctacggctatcccgccatggtagctctcaacgtgaagaaaggtgcatacgctccactccgtagtgccttccagcgcgacgaaatcatcgagttcgtgaaggaggcaaggcgtggtggaaagggaaaccttcctctgaacgatgcacctacagtagtcgcgtccgaaccgtgggacggcaaa

SEQ ID NO: 31759 - DNA, 443 bp, Zea mays
  Clone ID: LIB3059-015-Q1-K1-H7
cccacgcgtccgcccacgcgtccgtttgagcattcagaaacacaccaagcgaagcgcagtagcaacaacctaacaacaatggctaccaagatattatccctccttgcgcttcttgcgctttttgcgagcgcaacaaatgcgtccattattccacaatgctcacttgctcctagttccattattccacagttcctcccaccagttacttcaatggccttcgaacacccagctgtgcaagcctataggctacaacaagcgattgcggcgagcgtcttacaacaaccaattgcccaattgcaacaacaatccttggcacatctaacaatacaaaccatcgcaacgcaacagcaacaacagttcctaccagcactgagccacctagccatggtgaaccctgtcgcctacttgcaacagcagctgcttgcatccaacccacttgctct

SEQ ID NO: 31760 - DNA, 433 bp, Zea mays
  Clone ID: LIB3059-015-Q1-K1-H8
cccacgcgtccgcccacgcgtccgcccacgcgtccggaccaactagcaacatagaaagcacaatagtgtaccaacaatggcagccaaaatattttgcttccttatgctccttggtctttctgcaagtgctgctaccgcaaccattttcccacaatgctcacaagctcctatagcttcctttcttcccccatacctctcaccagcggtgtcttcagtatgtgaaaacccaattcttcaaccctacaggatccaacaggcaatcgcagcaggcatcttacctttatcacccttgttcctccaacaaccgtcagccctattacagcagttacctttggtgcatttgttggcacaaaacatcaaggcacaacaactacaacaacttgtgctaggaaaccttgctgcctactctcagcaacagcagtttcttccattc

SEQ ID NO: 31761 - DNA, 430 bp, Zea mays
  unsure at all n locations
  Clone ID: LIB3059-015-Q1-K1-H9
cccacgcgtccgcccacgcgtccgcgcacctcccagtgcccgtggcgacgacgggcgatggcgagccaccgccctcgtgaagcacctcgggcacggcgactgccgactgacccggtcagcttgattaggcaatatggttatccctccaccagctagggctcctgcaatcaccaagttcctcaagccgtatattttgaagatgcatttcacaaacagtttcgtgagcgctcaggtcatccacacaccgacagccacggtcgcatgctctgcaagctctcaggagaaactcctgaggccaagcatggagtcgacacgggatgttgctgcggctgcaaagattgggaagttgcttggagagcgctngctgttcaagggtatccctgcagtatctgtctccatgtcaagagaccagaagtaccatggcaaggtc

SEQ ID NO: 31762 - DNA, 366 bp, Zea mays
  Clone ID: LIB3059-016-Q1-K1-A1
cccacgcgtccgggttggcttctccttcccctccggttcgggttcgggttcgtgaggttctccggggttcgggttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgctgcggccgtgg

SEQ ID NO: 31763 - DNA, 406 bp, Zea mays
  Clone ID: LIB3059-016-Q1-K1-A10
gcgtggattcggtcgtggtgaaaccgtatcacctcgcgcagaaaaaagcgccctggagttacgtctagggaggagggatatgatccatagtttccttttggattgttctactaccagatgtgcgttttgtttacagaagtgcggttttttacatttgcacttatacgcgtattttgcagtcatgtaatgtaattgaaggggtaagtgatttttttagttcctcttgtcccccctaggaacatgttggacctctgtaaattgttcgtttgaactttgaaatgtacatcggctgtgttctgccaaaaaaaataaaaaatataaataatataattataatataatttataaataatttaatttaatattatatttttttttattttatatttttatattttatgatatt

SEQ ID NO: 31764 - DNA, 395 bp, Zea mays
  Clone ID: LIB3059-016-Q1-K1-A12
cccacgcgtccgcccacgcgtccgcgctactgcatctgcggctcatcaatccgtgcagtccgagagcaccccgtcttcccgctactcccgcaagggcgctcgtcgcttccttctccggggcgtggcaggcaccttctggtagagcgagagcgagagcagcgccgccggcagttcgcgctatggcgtcccagcaggtgttccgggctcagcagcagcagcagcagcagttcccggctcagcagcaggagtcccagccggggaaggagcacgcgatggacccccggcccgaggccatcgtccaggactacaaggccgccaacaagctcaaggacaaggtggcgctcgtgaccggcggcgactccggcatcgggcgcgccgtgtgcctgtgcttcgcg

SEQ ID NO: 31765 - DNA, 394 bp, Zea mays
  Clone ID: LIB3059-016-Q1-K1-A2
cccacgcgtccgagaacgtttccgcacgattactactgcttactacaggggagcaatgggcatcttgcttgtgtacgatgtcacagacgagtcatctttcaataacataagaaattggatcagaaacattgagcaacatgcttcggataacgtgaacaaaattctggtggggaataaagctgatatggatgaaagcaaacgggctgagcccacttcgaaggggcaagctctcgctgacgaatacgggataaagttttttgaaacgagtgcaaaaacaaacctgaatgtcgagcaggttttcttttccatagcaagggacatcaaacagagactgtcggagaccgattccaagcctgaagatcgaactatcaagatcaaggctgaaggggaagct

SEQ ID NO: 31766 - DNA, 357 bp, Zea mays
  Clone ID: LIB3059-016-Q1-K1-A3
atagaatgctaatgcaagcaattcttgaatcactgaaagactatgaacagtcgaatagaaaggatgtgcaatccactgcatctgatcctgcatctaaagccaatggtactgtaaaagactgcaatggtgttgctgcagcagcattggagcaagatgcatcctcatttgatgctcctgacaagcatacgaatgtccccaacagtggagaaaaagtcagcgaagggcaaagtacagattgcaacgccggaaagagcagtgcttcggtctctgcttctggttcctcagagccccttgcaccaacacagatggtgaatggacaacctgcttcggtagactcccagaaagtgacccagaatg

SEQ ID NO: 31767 - DNA, 216 bp, Zea mays
  Clone ID: LIB3059-016-Q1-K1-A4
ctgtgacgaccgatctgtccaactccatccttcggggctgcagcagcttattcttgagatgcacttcattgtcgagattgctgtgtgtgtaacgtttccatatagaccagttcagcagcttgtgtccacaatcataaccagagcagttgcagctttctcagcaaggggtgttgatccacaaagtgttcttcctgaggacagttggtttgtctacac

SEQ ID NO: 31768 - DNA, 302 bp, Zea mays
  Clone ID: LIB3059-016-Q1-K1-A6
aatcaatcaaaccgccgccctccggcctggcggctgccgcagtcggcctgcggtgtagtgttagtctgctgctgatttccgttgttatactgctggtacatgtgtcgtgtgatagatgtgtcaactatatatcaatctcgtcgccggcagctctggcatgtttgagtatgtgttgcttctctgtggtgccggcgacgatggctgctagtactgttaatgtgatcgggtctccttgaacaatggcataaatatgttgcttgtttactttttcctctaatggcaagtaaagttcatgatttgcg

SEQ ID NO: 31769 - DNA, 420 bp, Zea mays
  Clone ID: LIB3059-016-Q1-K1-A7
agctcctatagcttcctttcttcccccatacctctcaccagcggtgtcttcagtatgggaaaacccaattcttcaaccctacaggatccaacaggcaatcgcagcaggcatcttacctttatcacccttgttcctccaacaaccgtcagccctattacagcagttacctttggtgcatttgttggcacaaaacatcaaggcacaacaactacaacaacttgtgctaggaaaccttgctgcctactctcagcaacagcagtttcttccattcaaccaactggctgcattgaactctgctgcttatttgcaacaacaactaccattcagtcagctagctgctgcctacccccagcaatttcttccattcaaccaactggcagcattgaactctgctgcttatttacaacagcatcaactacc

SEQ ID NO: 31770 - DNA, 456 bp, Zea mays
  unsure at all n locations
  Clone ID: LIB3059-015-Q1-K1-H12
cgtccgcacccaactcgccgccgccgctgccaacgccgcctgctgccgcagccgccatgggggcgtacaagtatgtgtcggaactatggaggaggaagcagtcggacgtgatgcgcttcgtgcagcgcgtgcgctgctgggagtacaggcagcagccgtccatcgtccgcctcaccaggcccacccgccccgacaaggcccgtcgtctcggctacaaggccaagcagggatatgttgtctaccgtgtccgtgtgaagcgtggtggcaggaagaggcctgtgcccaagggtattgtctatggcaagcccaagcaccagggtatcacccaactcaagttccagaggaacaagaggtctgtcgctgaggagagagctggacgtaagcttggtggactgagggttcttaactcctactgggtgaatgaggatagtacctacaagtatttngagatcatcc

SEQ ID NO: 31771 - DNA, 295 bp, Zea mays
  Clone ID: LIB3059-015-Q1-K1-F8
cacacgcgtacgaagttgcttattgcctccacatacataaacttatctggtcagtcatgcctcaactttgagtatctggtctcacgcaagaagtatgtgatttcaatagatgacaattgcctaccagctaacgacactgatgtgtcgactgttgatgtatctgcacagcacatgtccaatctgaaatcacgtgctacacatttctttttcaacacactctatgatccatacaggaaaggtgctgactttgtccgttgttacacattcagcctgtgcgaggtggttgagtgcatgc

SEQ ID NO: 31772 - DNA, 439 bp, Zea mays
  Clone ID: LIB3059-015-Q1-K1-G10
caaggttcttccttggggagacgtttccaattccagtatatctttctcttcttccaatgcattggtggttgtgctctagctgctgtcacagagctgaactttaatatggttggatttatgggtgccatgatatccaaccttgcatttgttttccgcaacatcttctcgaagaggggcatgaaggggaagtccgtcagtggcatgaattactacgcttgcctgtcaattatgtccctggtcatactgactccatttgctatagctatggaaggccctcaaatgtgggctgctggttggcaaaaggctcttgcagaagttggacccaatgttgtctggtggattgctgcacagagcgtgttctaccacttatataaccaggtgtcctacatgtctctcgatcagatttctccattgacattcagcattggcaatacaatga

SEQ ID NO: 31773 - DNA, 437 bp, Zea mays
  Clone ID: LIB3059-015-Q1-K1-G11
gtttatcgtggcctgtatttcggactttacgattctatcaagccagttgtcctcactggcagcctccaggacaacttctttgccagttttgctctgggttggctgatcaccaacggtgctggtcttgcatcttaccccattgatactgtccgcagaaggatgatgatgacttctggtgaggctgtcaagtacaagagctcattggacgcattccagcagatccttaagaaggaaggccccaagtccctgttcaagggtgctggtgctaacattcttcgtgccattgctggcgctggtgtgctttctggctacgaccagctccagatcctcttcttcggaaagaagtacggctccggcggtgcttaaatggagaaaaatgatgacgaacaagagcagttcgctcccggtccagcccagtcaggatctggtcaagtttt

SEQ ID NO: 31774 - DNA, 377 bp, Zea mays
  Clone ID: LIB3059-015-Q1-K1-G12
atttctgggacgccacaaacatcatccaaaaaaaaaaaaaaaaaaaaaaaaaaaaaaagaaaggaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaatgacgaaacctaataaaaaaaaaataatattaaaaacaattataaaaaaataaatatatataaaaatacaccaaaaaaaaaaaatatatccaatagttaaaaaatcactaattttaaaaaaaactattaatttaaaaaaaaataataatctaaataataatt

SEQ ID NO: 31775 - DNA, 444 bp, Zea mays
  Clone ID: LIB3059-015-Q1-K1-G3
ctcctctctcgcattccgaaccttttgagcctttaattcatccccttgaacttcaaacgggaccaccaccaatcaggcggccttggcccccaccgcaccaggaaccggcgggaaggcgaaaaaagggcgcgggcgggcgcaagggccgcgggccgaggaagaaagtcgtgacgaggtccgtcaaagccgggctgcagttccccgtcggccgcatcgggcggtatctgaagaagggccggtacgcgcaacgcgtccgcacgggcgcccccgtctacctggcgcgcgtcctcgagtacctggcccgcgaggtgctggagcctggccgcaacgctgccaaggacaacaagaagacccgcatcatcccgcgccacgtgctcctggccatccgcaacgacgaggagctcggcaagctgctgtccggcgtcaccatcgcccacggcggcg

SEQ ID NO: 31776 - DNA, 438 bp, Zea mays
  Clone ID: LIB3059-015-Q1-K1-G4
cccacgcgtccgaggaaaaatatccccaaaccctagctcccgatctcgatggcgaacgctcgcgtcttcttcgacatgaccgtcggcggcgccccggcgggccggatcgtgatggagctgtatgccaacgaggtgcccaagaccgcggagaacttccgcgcgctgtgcacgggcgagaagggcgtgggcaagtccgggaagccgctccactacaagggctccaccttccaccgcgtcatccccgagttcatgtgccagggcggcgacttcacccgcggcaacggcaccggcggcgagtccatctacggcgagaagttccccgacgagaagttcgtgcgcaagcacaccgtccccggtgtgctctccatggccaacgccgggcccaacaccaacggctcctagttctgcatctgcaccgtctcgacctcttggctcgac

SEQ ID NO: 31777 - DNA, 443 bp, Zea mays
  Clone ID: LIB3059-015-Q1-K1-G6
cccacgcgtccgatttaatctgtgccaaactattggtggtgcaggatataacatgaaaggaaaaaaaaaaaaaaaaaaaaaaaaaaaaaaaaaaaaaaaaaaaaaaaaaaaaaaggaaaaaaaaaaaggaggatcaaggtaaaggaaccaaaaaaaggaacgaaaaaaataaaagaaaaaagtcaccaaaatgaaatccataggaccaatgattaaaaacgtagttgaagggaaaaacaatgggaaaacccaagtaaaaccccatgtaaaacaggcaaatttaaacagctggtaaaatagcgaagaggccagaaaaaaggcctttaccaaacaggggaaaaaccaaaagggcaaatggaacgggcattggaaaggcctttaaagcgcggaataagaaggggaaacgcccagggtaaccgcaacagtggccagtgctttagcgc

SEQ ID NO: 31778 - DNA, 436 bp, Zea mays
  Clone ID: LIB3059-015-Q1-K1-G7
cccacgcgtccgggagagcaccctccacctggtgctccgtctcaggggtggcatgcagatctttgtgaagacactcactggcaagacaatcacccttgaggtggagtcttcggataccattgacaatgtcaaggccaagatccaggacaaggagggcatcccaccggaccagcagcgcctcatcttcgccggcaagcagctggaggatggccgcaccctggcggattacaacatccagaaggagagcactctccacctggtgctccgtctcaggggtggcatgcagatttttgtgaagacattgactggcaagactatcaccttggaggtggagagctctgacaccattgacaatgtgaaggccaagatccaggacaaggagggcattcccccagaccaacagcgtctgatctttgcgggcaagcagctggaggat

SEQ ID NO: 31779 - DNA, 411 bp, Zea mays
  Clone ID: LIB3059-015-Q1-K1-G8
cccacgcgtccgcccacgcgtccgcccacgcgtccgcggacgcgtgggcgagggcaagttgcacccgcaacaaccgggttaacaagcctaaccggaccctggccattctggttccttggcggcggcggcggcggcggcggccggccggtggcggttggctttgggacccggcaagccagggcccggcttccggggacccggcggccgaagaggggagaggaccatatgaacgcggagaggaagaacgtggggggcgcgcgaaaagagggccccggcgacactctcgccgggggagagcgtattgcgcgggctcacactctgcgggtcctacagcgtatcgaggtgaacgacggcgtgggcatgaggttcgtgtcgttgttcgccgagatgttccagaagatctggtggatc

SEQ ID NO: 31780 - DNA, 417 bp, Zea mays
  Clone ID: LIB3059-015-Q1-K1-G9
cggacgcgtggggaagaacccgatcgacaccatgagggtgttgctcgttgccctcgctgtccgggctctcgctgcgagcgccacctccacgcatacaagcggcagctgcggctgccagccaccgccgccggttcatctaccgccgccggtgcatctgccacctccggttcacctgccacctcctgtgcatctcccaccgccggtccacctgccgccgccggtccacctgccaccgccggtccatgtgccgccgccggttcatctgccgccgccaccatgccactaccctactcaaccgccccggcctcagcctcatccccagccacacccatgcccgtgccaacagccgcatccaagcccgtgccagctgcagggaacctgcggcgttggcagcaccccgatcctgggccagtgcgt

SEQ ID NO: 31781 - DNA, 442 bp, Zea mays
  Clone ID: LIB3059-015-Q1-K1-H10
cggacgcgtgggttaatgatgttattaagatgggttttgacaagaatcagctaattgagtctgtgcaaaacagattgcagaatgaggcaacagttgcttattatttactattggacaataggcttcgtacaaccagtggttatcttggatctgagtttcaagaatctatggactcatctttgtctcaagtaatcgctgaaacaccaacttcagcaactgaacttcgtcagcatgggttttcagaatctccaggttctggcttgaggcagcattttgcagctgaaaggaaatgggcccttggtcttcagtctcgagcacattcacgagaaataataagtgaagtgcttaaagctctgcaagaactgaatgtttactggaaaaagattggacactacaacatgaaatgcagatggagtccttgctgccttgagagtatgatgca

SEQ ID NO: 31782 - DNA, 398 bp, Zea mays
  Clone ID: LIB3059-015-Q1-K1-F7
cccactcgtccgctgacactcgttgctttcactgactactatgataaatgattgtgcggcaatatctgaaggtatcgagactttcaagctacacgttcaagatcctaaatttcctgatatataccatattaatatgtagtattatttcctcatggtaccatgacactattcatgcgaacaaccaccaatcaaactttcaattcatcacttacacaggataaaccttctactgatctatctaattctttttcttacagtttcagactataactcgatcttatacacaaattataaacacagagctatgacgatcactaactcatcaatcctttattctcaaatcattataaccctgtaataccaacatgtctcatatgatcatactataatacttactt

SEQ ID NO: 31783 - DNA, 433 bp, Zea mays
  unsure at all n locations
  Clone ID: LIB3059-015-Q1-K1-E11
cgtatccctccatcagtccgtcgggccatccctagcttcatcccaattcttgttcgtgcagctgctggtggcagcctgagaccaggcgcgaggatgctggcggtgttcagcggcgaggtggtggaggtgccggcggagctggtggcggcggggagccggacgccgtcgcccaagacgaaggcgtccgagctcgtcgcgcgcttcctggggaccagctgccccgccgccgtgtccgtgcgcctcgccgacctcggccacctcgcctactcccacgccaaccaggccctcctccgcccaaggtcgttcgcggcgaaggacgaggtgttctgcctgttcgagggggtgctggacaacctgnggcggctgagccagcagtacgggctgtccaagggcgccaacgaggtgctcctggtcatcgaggcctacaaggcgc

SEQ ID NO: 31784 - DNA, 423 bp, Zea mays
  unsure at all n locations
  Clone ID: LIB3059-015-Q1-K1-E12
ctgttattgtgaggcagcgcaagccatggcgccgaaaggatggtgtctacatgtactgggaagacaatgctggagtgattgtgaacccaaagggagagatgaaaggttctgccatcactggacccatcggaaaggagtgcgcggatctctggcccaggattgctagcgcggcaaatgcgattgtctaaaggaagcagtttgtcaaagttccatttaaaatggggacttgagaagggagttcttagttaggcgagctttcgattgccctgaatatgtttccccggctaatgcttgtgctgctggaccgtttcctgatagctttgctttgatgacatcctccccgttatcgataaagttgcgtagcctgacattttgcagagtttaagtaggctggttttggtgggagaaattngagtgatccat

SEQ ID NO: 31785 - DNA, 439 bp, Zea mays
  Clone ID: LIB3059-015-Q1-K1-E8
gggtcttcagaccattagctttatctactccagagcgcagaagaacccgatcgacaccatgagggtgttgctcgttgccctcgctctcctggctctcgctgcgagcgccacctccacgcatacaagcggcagctgcggctgccagccaccgccgccggttcatctaccgccgccggtgcatctgccacctccggttcacctgccacctcctgtgcatctcccaccgccggtccacctgccgccgccggtccacctgccaccgccggtccatgtgccgccgccggttcatctgccgccgccaccatgccactaccctactcaaccgccccggcctcagcctcatccccagccacacccatgcccgtgccaacagccgcatccaagcccgtgccagctgcagggaacctgcggcgttggcagcaccccgatcctgggccag

SEQ ID NO: 31786 - DNA, 420 bp, Zea mays
  Clone ID: LIB3059-015-Q1-K1-E9
gggtccggaagcgccggcagccagcaccagcgagcgtcgtcgtccctgctgatcaccgggggcgttcgagggaaagcgaagctgacaccgcccctcccgcgcgggttctacggcaacggcttcgtcttcgtggaggcggagctgtgcggggcgacgcgctcgctcggtggcacggtcgagctcgtgcagaaggccaagcgcggcatgacggaggagtacgtgaagtcgatggtggatctgttctcgctcggcggggcgccgccgtacgcgcaggggtggacgttcgtggtgtccgacataacgcggatcggggaggacgagttggacctggggtgggcggagcgggtggccggcggcgtgcccattgtcggaaacgacgacgcgaccaagatggttagctaccagatgaggtgcaagaac

SEQ ID NO: 31787 - DNA, 441 bp, Zea mays
  unsure at all n locations
  Clone ID: LIB3059-015-Q1-K1-F10
cgctcgctgtgggcaatgcacctacatacctgcaacaacaattgttgcaacagattgtgccagctctgactcaactagctgtggcaaaccctgttgcctacttgcaacaatttcttccattcaaccaactgtctacactgaaccctgctgcttatttgcagcaacaacaactactaccattcagccagctagctactgcctactctcagcagcaacaatttcttccatttaaccaattcgccgcactgaacccctctgcttatttccagcagcaaatactactaccatttggccagctagctacaacaagccccgcttccttcttgacacaacaacaattgcttccgttctaccagcagtttgtggctaaccncgcaacccttttacaactgcaacagttgctgccctttgtccaacttgctttgacaaacccagcagcct

SEQ ID NO: 31788 - DNA, 395 bp, Zea mays
  unsure at all n locations
  Clone ID: LIB3059-015-Q1-K1-F11
gctatagatcactcactcacatacattccaatatgaataatatgagtgatagagccttggtggtacttatgttgcttctatctgtattattcgttgcgcaatgcggtcgtcctcatgatgatgaagttgttggaaccgcaaggggccgccgagctgcttttagcctcaccgagaatggatattgtgacacggagcaccaaaactgtaaagtggtctactgctgctcgcatccacagccaaagcattgctatgccacttttatgcagtgtcgggccaattgctacgttcataaacgcaagtgatccatatctgatgctgtggttctaaaaacatcatcattgttagcttaaacaatgtactttacaatggttggtaatataataatatggngaagt

SEQ ID NO: 31789 - DNA, 431 bp, Zea mays
  unsure at all n locations
  Clone ID: LIB3059-015-Q1-K1-F12
cactgctcagctagcgtccacctccacttcctatcgccatctctccccctttcgtcatgcttctctctcctctgccatcgcgtccgccgccccaccgccatccgcgccgaagctgaagtgcggcctccgctacctgtctccgcggcggagtcagagccccctgacgccggcgctgtggaagccgaaggtcagggacccgtggagctccgcgctccgacgctcttctcgactgatgacaatcccaccccgctccagactgccaccagtctcctcctcaccggcgccatctcggtcttcctcttccgcgccctccgccgccgcgcccgccgcgccaaggagctcagagtgcggtcgagcgggttgaagaagcccaacaatctcaccgaggaggccctggagaggctgagattgatgagcgcctnaccgatcga

SEQ ID NO: 31790 - DNA, 429 bp, Zea mays
  Clone ID: LIB3059-015-Q1-K1-F2
cccacgcgtccgcggacgcgtgggcggcggcggcgatggggggcgaccaggagacggagaagaagaagaccccggtggcactaatgcccatcgcgaagcccctcgcaggaaagaagctctgcaagcggaccctcaagctcgtgcgacgagcctctgaggccaagtgcctcaagcgcggagtcaaagaggtagtcaagagcattcgccgcgggaacaaagggttgtgtgtgattgctggaaatatttctcctattgatgtgattacacacgttccaatactatgtgaggaatctaatgttccttacatatatgttccatcaaaagaggatcttgcgaccgcgggaaccactaagaggccaacttgttgcgtcctggttctgaccaaaccaaacaaggtggagctcagtgacgaggtgaaagataaactga

SEQ ID NO: 31791 - DNA, 439 bp, Zea mays
  Clone ID: LIB3059-015-Q1-K1-F4
cccacgcgtccgcccacgcgtccgcgcaaattgcaccaagaaatccatcgagaggccggcggcaggggaattaatggcgtcgtcgtctagcagcagccaccgccgcctcatcctcgcagccgccgtcctgctctccgtgctcgcggctgccagcgccagcgccgggacctcctgcgtgccggggtgggccatcccgcacaacccgctcccgagctgccgctggtacgtgaccagccggacctgcggcatcgggccgcgcctcccgtggccggagctgaagaggagatgctgccgggagctggcggacatcccggcgtactgccggtgcacggcgctgagcatcctcatggacggcgcgatcccgccgggcccggacgcgcagctggagggccgcctagaggacctgccgggctgcccgcgggaggtgcagaggggattc

SEQ ID NO: 31792 - DNA, 440 bp, Zea mays
  Clone ID: LIB3059-015-Q1-K1-F5
cccacgcgtccgctactatactatactctaggaagcaaggacaccaccgccatggcaggcaagatgcttgcattgttcgctctcctagctctttgtgcaagcgccactagtgcgacgcatattccagggcacttgccaccagtcatgccattgggtaccatgaacccatgcatgcagtactgcatgatgcaacaggggcttgccagcttgatggcgtgtccgtccctgatgctgcagcaactgttggccttaccgcttcagacgatgccagtgatgatgccacagatgatgacgcctaacatgatgtcaccattgatgatgccgagcatgatgtcaccaatggtcttgccgagcatgatgtcgcaaatgatgatgccacaatgtcactgcgacgccgtctcgcagattatgctgcaacagcagttaccattcatgttcaa

SEQ ID NO: 31793 - DNA, 439 bp, Zea mays
  Clone ID: LIB3059-015-Q1-K1-F6
cccacgcgtccgcggacgcgtggggtcaacactgactgctatgataaatgatgaggctgcaatatctgaagtgattgagactgtcaagcagcaagttaaggatgctaaatttcctgatttagaggttattcgcatgttgtgggatgtgctcatggaggctgttcagtggtctgggaagaaccagcagcaaaattccaatgcagcacttaggcaggtgaaagcttggactgagcttttgaatgctttttgcacgagtggcagactcgaactggaacttatacacaaagttcagacacagtgctatgaggatgctaagctgatgaagctgtttccggaaatcataagaacactgtatgaccaagatgtcctagctgaagatactatagtcctttggttccgtaaaggttcaaacccgaagggcaggcaatcttttgtgaaa

SEQ ID NO: 31794 - DNA, 428 bp, Zea mays
  Clone ID: LIB3059-015-Q1-K1-E10
aggtggttgaggttaatgttaaagtggaaagtgcaggcacacataatgtgcataatagtgctttctatgctgaagagaagttgctgaaatctgagttgcaagcaatgcgtgattgcgacccttcatctgcccgccactggattgtacgcaacacacgaactgtgaatcggacggggcagccaactggctacaggctcgtacctggttcgaactgcctgcctttggctctgcctgaggcgaaatttctgaggagggctgggttcttgaagcacaacctctgggtcactcaatacaagcgtggcgagatgttccctggaggggagtttcccaaccagaatcctcgcatccatgagggtctgccaacatgggtcaagaatgataggcctctggaggaaaccgacattgttctctggtacgtgttcgggctc

SEQ ID NO: 31795 - DNA, 445 bp, Zea mays
  Clone ID: LIB3059-037-Q1-K1-H1
gcgagagggtttcctcttccctccacggctccaacgagcccccggcccctccgcctcagagcccacgcgcccggttggccgccgcccccgccatggatgtggatctgtggatctccaaagtcaaggaaggccagcacctcgccgagcacgagcttcagtcgctctgcgaatacgtgaaggagatcctcatcgaagagtcgaacgttcaaccggtgaatagccctgtgacggtttgcggtgacatccatgggcagttccatgacctgatgaagctcttcgcgacggggggccacgtcccagagacgaactatattttcatgggtgattttgtggaccgtggcttcaacagtctggaggttttcaccatcctgttgctactaaaagcgaggtatcctgcacacataacccttctgcgtggaaatcatgaaagtaggcagttgacaca

SEQ ID NO: 31796 - DNA, 429 bp, Zea mays
  Clone ID: LIB3059-037-Q1-K1-H11
attgagaccaacaagcaacatagaaagtggaatccagtagcaacaatagagcaacaatggcgaccaagatattttccctccttatgctccttgctctttctacatgtgttgctaacgcgacaattttccctcaatgctcacaagctcctatagcttcccttcttcccccataccttccatcaattatagcttcaatatgtgaaaacccagctcttcaaccatataggcttcaacaagcaatcgcagcaagcaacatacctttatcgcccttgttgtttcaacaatcgccagccctatctttggtgcagtcattggtacaaaccatcagggcacaacagctgcagcaactcgtgctacctctgatcaaccaagtagctctggcaaacctttctccctactctcagcaacaacaatttcttccattcaacc

SEQ ID NO: 31797 - DNA, 426 bp, Zea mays
  Clone ID: LIB3059-037-Q1-K1-H12
cccacgcgtccgcccacgcgtccgagaactgccaataatgcggtattggatatcgagagccttcctcaaccgcctgataaatgctgctctgggagtccgaagatgatcagggccttgtcgcgtaagggttcgaaccggatggagaggaggggcggcggcggcggcgagcaggagcaagaggatttggcgaaaaaacttgtcatcaaagttgtgccgtctcaactggagcagcagcccctgggtcagaacaaggcgctggtcgctccacattgcacacctgttcttgttgattctggggaagggaggagcaaaagattcattagccggttcacgtccatcaacccttcgaagattctcctcttgttcggcacgctgtcgagcgtggggacaacgattctgatctactttacgctggcgatcaacagc

SEQ ID NO: 31798 - DNA, 358 bp, Zea mays
  Clone ID: LIB3059-037-Q1-K1-H3
agaaagcacaatagtgtaccaacaatggcagccaaaatatttcgcctacttatgctccgtggtctttctgcaagtgctgctaccgcgaccatgttcccgcaatgctcacaagctcctatagcttcccttcttcccgcgtacctctcaccagcggtgtcttcggtatgtgaaaacccaattcttcaaccctataggatccaacaggcaatcgcagctggcatcttacctttatcacccttgttcctccaacaatcatcagccctattacagcagttacctttggtgcatttattggcacataacatcagggcacaacaactacgacaacttgtgctagcaaaccttgcttgctactctc

SEQ ID NO: 31799 - DNA, 119 bp, Zea mays
  Clone ID: LIB3059-037-Q1-K1-H4
attttactactgttttgacactcgttgtatttctgtatatcgcgtcagactgttaaatggaagcactacactgtgtttcttgcaaacaaaacacaacaaacaaaaacataacactacaa

SEQ ID NO: 31800 - DNA, 444 bp, Zea mays
  Clone ID: LIB3059-037-Q1-K1-H6
cgaccctccctccttcgctccttccccgccgcctcccggccgtcgccgccatggtgaagtactcgcaggagccgggcaaccctaccaagtcggctaaggccatgggcagggatctgagggtccacttcaagaacacaagggagacagcctttgcgcttcgcaagttgtctttgaccaaggctaagcgataccttgaggatgttattgctcacaagcaggcaattcccttccggagatactgtgggggtgttggtcgcaccgcgcaagctaagtctcgccactccaatgggcagggccgctggccggttaaatcagccgggttcatcctggatttgctgaagaatgctgagagtaacgctgatgtgaaaggcttggatgtggacaacctctatatttcacacatccaggtgaaccaagcccagaagcagaggcgccgcacctacc

SEQ ID NO: 31801 - DNA, 444 bp, Zea mays
  unsure at all n locations
  Clone ID: LIB3059-037-Q1-K1-H7
gccacatggagacgccacagcagcaattcgccgccgccgccgccgccgccgcccacgggcaggacgacggcgggtcgccgccgatgtcgccggcctccgccgcggcggcggcgctggcgaacgcgcggtggaacccgaccaaggagcaggtggccgtgctggaggggctgtacgagcacggcctgcgcacccccagcgcggagcagatacagcagatcacgggcaggctgcgggagcacggcgccatcgagggcaagaacgtcttctactggttccagaaccacaaggcccgccagcgccagaggcagaagcaggacagcttcgcctacttcagcaggctcctccgccggcccccgccgctgcccgtgctctccatgccccccgcgccaccgtaccatcacggccgcgtcccggcgccgnccgcgatgccgatgccgatgccgc

SEQ ID NO: 31802 - DNA, 203 bp, Zea mays
  Clone ID: LIB3059-037-Q1-K1-H9
gtttcgaaaggtcctagggagatcagtgcagtgaaggagaaagttcttagcgagaacgaacaggtttacattttttgaggagttctatgtttttggatcatggatatttgtctcgaagatatgcctctggtttcctttaaacttaatgcctttgtaatcatttcgttcttagtatggttggacctttcttgtctgtttatcta

SEQ ID NO: 31803 - DNA, 323 bp, Zea mays
  Clone ID: LIB3059-038-Q1-K1-A1
ccacgcgtccgcggacgcgtgggctgacacgtgttcggacgcatggggcgagctgcgcgcccgggccgcatctctccccgacgagtacttcctcgtgctcgtgggcgacatggtcacggaagacgcgctgcccacataccataccatgatcaacacgctcgacggcctccgcgactagactcacgccagcaactgcccctggccagtctgtacgcgcgcctggaccgacgaagagaaccgccacggtgacatcctctgcaagtacatgtacctatccggccgcgtcgacatgcgcatggtcgagaagacccgtcagtacctca

SEQ ID NO: 31804 - DNA, 343 bp, Zea mays
  Clone ID: LIB3059-038-Q1-K1-A11
catggacacaacaacagttggccgtccttagaagggatcttcttaacaggaagtaatggattcaactcaatggttgttcatccagactcagtacagcgtgggaactatacatttccacccactcatattagccattcatggatgtcccatgctacaaatggtattgctgatggagttccccagtgggaatatgccaatgcaactgctaatattcaaggcagatttgcccattcaggagccacagaaatcgcaaatgttggttttcatgaatatcagaatggcccttcaactatttgtcggggaccagtaccttatttccaccagcatgcgatgcatggcatgc

SEQ ID NO: 31805 - DNA, 320 bp, Zea mays
  unsure at all n locations
  Clone ID: LIB3059-038-Q1-K1-A2
gccagaactaactggcccccggcttacgaatcccaaagccttcatggggacccaacggcactggcttccaattcttcctcttctggccgnncgcctcgccgncgtccctgctcgcgcggcgctgggcggcgggcgcggcccgctgctgggcgggtggaacccgatccctgacgtgagcgactcgcacatccaggagctaggcgggtgggcgctggggcaagcgaagcaccagaagctggccgncgacgggctgcggttccgccgcgtggtgcgcggcgagcagcaggtcgtgtccgggatgaactaccgnctctacgtcg

SEQ ID NO: 31806 - DNA, 438 bp, Zea mays
  Clone ID: LIB3059-037-Q1-K1-F4
gattgagcagtccttccaggttcatcgtagttatggaagtatgcttgaaggcgaggctgatgaactcaagagggttttccttgaaggaaatccttatcttcttggattgaccatgattgtttctctattacactctctgtttgatttcctggccttcaaaaatgatattcagttctggaacaagaacaagtccatggaaggtctatcggcaaaatctgtggttctgaattttgtgtgtcaactaattgttttcctgtaccttcttgacaatgacacttcatggatgatccttgctagctctggaattggtgtttgcattgagttttggaagatcggaaaggcgatgcatattgaagtcgatagaagtggaaaaattcccatgttgaggttccgagatcgtgaatcatatgcacagaataagaccaaagagtacgatgc

SEQ ID NO: 31807 - DNA, 435 bp, Zea mays
  Clone ID: LIB3059-037-Q1-K1-F6
ccatgatggaggcatttgtacatgacccgttaatcaattggcgtctgttcaatttcagtgaggttcctcaagtgtcgaactatggtaatgttcatgctcacacggttgtcagtagtgaagaagcagtggctaaccgagagctcatgcaacctcagcgaggagcacgtgagagggaactgctacaggctgtcaatcaactcggtgatgccaatgaggttttgaatgagcgtgctgtagctgtgatggcacggatgagtgacaaactaacagggcgtgacttctcttctgggtcagctttggctggagcaggtagctctatccaacatggcagtgagcatttggcttcaggagatgcccgggatgcccaacctggtctctcagtgaaggttcaggttcagaagctcatactccaagcgacttcacacgaaaatttgt

SEQ ID NO: 31808 - DNA, 433 bp, Zea mays
  Clone ID: LIB3059-037-Q1-K1-F8
gtccctctctgatttttggacgagcagaacatacctgagacgacaggtagaagacgacggactgcctcgagcagcagagatcagggaggccgagggcgggatgacgatccggttcgtgctgttcgtcaacaagcagggccagacgcggctggcgcagtactacgagcacctctccctcgacgagcgacgggccctcgagggcgagatcgtccgcaagtgcctcgcccgcactgaccagcagtgttcgtttgtggagcaccggaactacaaggtcgtttacaggcgctacgcctcccttttcttcctcgtcggcgtcgacagcgatgagaatgagttagctatccttgaattcatacatcttctggtggaaactatggatcgccacttcggcaatgtgtgcgagctcgatatcatgttccatctggagaaagtg

SEQ ID NO: 31809 - DNA, 430 bp, Zea mays
  Clone ID: LIB3059-037-Q1-K1-F9
acaggatccaacaggcaatcgcagcatgtcatcttacctttatcacccttgttcctccagcaccgtcatccctattacagcagttacctttggtgcatttgttggcacaaaacatcagggcacaacaactacaacaacttgtgctagcaaaccttgctgcctactctcagcaacagcagtttcttccattcaaccaactggctgcattgaactctgctgcttatttgcaacaacaactaccattcagccagctagctgctgcctacccccagcaattacttccattcaaccaactggcagcattgaactctgctgcttatttacaacaacagcagctaccaccattcagccagctagctgatgtgagccctgctgccttcttgacacagcaacagttgttgtcgttctactcgcacgctgcgcctaacgc

SEQ ID NO: 31810 - DNA, 173 bp, Zea mays
  Clone ID: LIB3059-037-Q1-K1-G1
aaaaaaaaaaaaaaaaaaaaaaaaaaaatttaaaaaaaaaaaaaaaaaaaaaaaaaaaaaaaaaaaaaacaaaaataaacatacatacaaaactaaaaaataaaatataaaatccccctacttcaaattactccacccttttttaccaccccttcaattttaaaacccttctt

SEQ ID NO: 31811 - DNA, 439 bp, Zea mays
  Clone ID: LIB3059-037-Q1-K1-G2
cgcatcacctattcacctccgtcgccatctcgctcccgtgacccacccaccccgtcgcgtctcggcctggcttcctcctcctcgaggaccgccgtgcaagagcggagctccccgccgcttctctctccgccttccgagaggcccgacccctgataccacgctgagggcggtggtattaggagattagcgatggcaaggtggcggccggcggcgctgctggtagtggctctggcggcggttctatcgacggcgtggcgggcggatgcgctatcggttacggtgaccgacaccgagtgcatccacgagttcgtgccctatgagggcgacaccgtgtccgggaacttcgtcgtcgtcgaccacgacatcttctggagctccgaccacccaggaatcgacctcacggtaacgtcaccaggtggcaacactgtgtacacattga

SEQ ID NO: 31812 - DNA, 390 bp, Zea mays
  Clone ID: LIB3059-037-Q1-K1-G3
gaagatatttccacgaccaactgctggtctctctcgtgccattgatcaatgccagactgtgaagtacaacatgaattcaagggctgggagaggctttacccttgaagatttgaaagctttgtgtattccaaaaaggcttggtccaaccattgacattactgtggaataactgctcatgaacaaatacctagaggagcttcacgccaatgtccagaggcttaagacatatctagccaagctggttatattgccaaggcgtgctcataaggtctaggctgctgactctactctggaggagcttaacaatgctacgcagtatcagggtgactacatgccaattactttcggtgagaagcgctatgtcaaggtcgtgaacgtcacagatgaaat

SEQ ID NO: 31813 - DNA, 411 bp, Zea mays
  Clone ID: LIB3059-037-Q1-K1-G4
gacgccgccgccgcaagccgtccgccttgctcttcacgaaggcttggtcctcctcctggtgtctccactccccccttcacagatccgttcctccagctagggttagcgttcctctgcagcgatggcgatcaagcggactaaggcggagaagaagatcgcgtacgacaagaagctgtgcagcctgctcgatgagtacaccaaggtgctcatcgccctggccgacaacgtcggttccaagcagctccaggacatccgccggggcctcaggggcgactcggtggtgctcatggggaagaacacgctcatcaggcgttgcatcaaggtgtacgccgagaagaccggtaaccacacctttgacccgctcatggacctcctggtcggcaacgtaggcctcatcttcaccaaaggaga

SEQ ID NO: 31814 - DNA, 437 bp, Zea mays
  unsure at all n locations
  Clone ID: LIB3059-037-Q1-K1-G6
cttcattgagatgtactttgtgttcacatcattctggaactataaggtgtattatgtgtatggcttcatgttgctggtctttgtcatccttcttatagtcaccatctgcgtcactattgtgggtacttatttcttgctgaacgccgagaactaccattggcaatggacgtcgttttcttctgcagcctcaaccgctctgtacgtgtatctgtactccatctactactaccatgtgaagacaaagatgtcaggcttcttccagacaagtttctatttcggctacacgctgatgttctgccttggcctaggcatactttgtggagctattggctatctagggtcaaccctttttgtaaggagaatctacaggaatatcaaatgtgattaaatccctgctgcttaagctagcaacaganaaatcatatgtattgtcagga

SEQ ID NO: 31815 - DNA, 434 bp, Zea mays
  Clone ID: LIB3059-037-Q1-K1-G7
acgggatccaacaggcaatcgcagctattatcttaccttcatcacccttgatcctgcagcaaccttcatccctattacagcagttacctttggtacatttgctgacacaaaacatcagggcacaacaactacaacaacttgtgctagcaaaccttgctgcctactctcagcaacagcagtttcttccattcaaccaactggctgcattgaactctgctgcttatttgcaacatcaactaccattcatccagctatctgctgactaccctcagcaattactttcattcaaccaactggcagtattgaactctgctgcttatttacaacaacagcatctaccaccattcagtcagctagctgatgtgagccctgctgacttcttgacacagcaacagtggttgtcaatctactcgcacgctgatcctaacgctggc

SEQ ID NO: 31816 - DNA, 427 bp, Zea mays
  Clone ID: LIB3059-037-Q1-K1-F3
aaaagatgctatgggttcttaactgctgtcatatcataacttatcatttatgatgcgggggagtagagacctccacatgtctattcttgaaggacgatttccagaattcgtgccaggattcttgaaggtgccattttcaaccggagaacgttcccagtggttcgcacgcgatgagtcgctgcattgcatatcgatgctgggctgcaccatgtctgacataacgtcaggggccacctttaactgtaccggttgactgcaaatggagttgtgccgagttaaggctcttcgcctctccggcaagcaaaagacgacgacaggctttcacaaagaagttttttttccgtcatacatgtagggtctcactcacaccgattcagcataggattttccaatagtatgctgaagcttggcgacaggttttgttagt

SEQ ID NO: 31817 - DNA, 437 bp, Zea mays
  unsure at all n locations
  Clone ID: LIB3059-037-Q1-K1-E1
cccacgcgttcgaaataacatagagcgattgacactagctgtcctttcttatctacctagcgctgtcctgtatgtgcatgatctatccgaagactgtgggacctcagtggccgatcagtacattacgtacaagcatattaaggacagattccgtgaccggctattgcttgaaggtaatttccaatgccaactttgggaaagaagagccataagtttcacgatgctgatgaagatgtagcacggtacagaagattgnngccagaatgcgcccttcaagtatctgtgcagaccgaaatcggcgtcaaacagcttaaggaaagagtgcatgagctgctgacctctcagatggctcggatccaatctagcaaggcggagcatgaaacacatgaagtagcgactagtgttgtttactgaagtttgacaataataaggattcg

SEQ ID NO: 31818 - DNA, 373 bp, Zea mays
  Clone ID: LIB3059-037-Q1-K1-E11
aaaaaaaaaaaaaaaaaaaaaaaaaaattaaaaaaaaaaaaaaaaaaaaaaaaaaagagaaaaaaaaaaaaaaaaaaaaaggccaacagcctgctcctccggttgaagagcgactggcctgctttctcgcaactagtcgcccgccttgaccccaacgtctttcgtgtccataaagtccggttcccgccatttggtcccaaaggggctcctaaaacccccagtgaactaaaggatgcctcatccttgtgacggcttaaaaaccccgtcgttctacgtgctttgtcagctttacctttcaaagactaccgtgtctgctggtctctttcagattcaaaattttctgaaacagctatgtttataaagaaaatgtttg

SEQ ID NO: 31819 - DNA, 428 bp, Zea mays
  Clone ID: LIB3059-037-Q1-K1-E12
ggcgtttaaaaaatgggcaccatcagagtaagaatctggttacacttccaggatattgggtttctggaaccattggtcataagttgatgtgtgggaaacctacaagggttgattacgaggacactcatattgatgtcagatgtcagatccatcagctagcattcagtcctcatacagactccaaagggattatggatctgacagaattcctgtcacccaaacatgtaattctcgttcatggtgaaaagcctcagatggcttttcttaaggagaggatcgaatctgaattggggatgccttgctactacccagggaataatgaatccgtctccattccgacaacccagaaccttaaaatgagtgctacagaaaggttcattacaagctgtgctgtggagcaaggtaaacgtagcctgcacaagcggaac

SEQ ID NO: 31820 - DNA, 334 bp, Zea mays
  Clone ID: LIB3059-037-Q1-K1-E4
ggcttctcctccccctccggttcgggttcgggttcgcgaggttctccggggttcgctggggtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatgctggatcgggagacgcagaggtcccgcggcttcggcttcgtcaccttctccacggacgacgcgatgcggaacgctctcgagggcatgaacggcaaggagctggacggacagcacatcacgcgtaacgaggcccagt

SEQ ID NO: 31821 - DNA, 440 bp, Zea mays
  Clone ID: LIB3059-037-Q1-K1-E5
cccgatcgacaccatgagggtgttgctcgttgccctcgctctcctggctctcgctgggagcgccacctccacgcatacaagcggcagctgcggctgccagccaccgccgccggttcatctaccgccgccggtgcatctgccacctccggttcacctgccacctcctgtgcatctcccaccgccggtccacctgccgccgccggtccacctgccaccgccggtccatgtgccgccgccggttcatctgccgccgccaccatgccactaccctactcaaccgccccggcctcagcctcatccccagccacacccatgcccgtgccaacagccgcatccaagcccgtgccagctgcagggaacctgcggcgttggcagcaccccgatcctgggccagtgcgtcgagttcctgaggcatcagtgcagcccgacggcgacgccct

SEQ ID NO: 31822 - DNA, 442 bp, Zea mays
  Clone ID: LIB3059-037-Q1-K1-E6
cccacgcgtccgagctggcatcttacctttatcacccttgttcctccaacaatcatgaggcctattacatcagttacctttggtgcatttattggcacaaaacatcagggcacaacaactacaacaacttgtgctagcaaaccttgctgcctactctcagcaacagcagtttcttccattcaaccaactagctgcattgaactctgcttcttatttgcaacaacaacaactaccattcagccagctacctgctgcctacccccagcaatttcttccattcaaccaactggcagcattgaactctcctgcttatttacagcagcaacaactactaccattcagccagctagctggtgtgagccctgctaccttcttgatacaaccacagttgttgccgttctaccagcacgctgcgcctaacgctggcaccctcttacaactg

SEQ ID NO: 31823 - DNA, 438 bp, Zea mays
  Clone ID: LIB3059-037-Q1-K1-E8
cggacgcgtggggtcttcacccaatcagggatgaggatgccaagttcaagctctgcggggtgaggtctgttcagtttggccagaagggcatcccctacctgaacacctacgacggccgcaccatccgctaccccgacccgctcatcaaggccaacgacaccatcaagatcgatctggagaccaacaagatcatggacttcatcaagtttgacgtcggcaacgtggtcatggtgaccggcgggaggaacaccgggcgtgtaggtgtgatcaagaacagggagaagcacaagggcggcttcgataccatccacgtcgaggactccatgggccaccagttcgccacccgcatgggcaacgtgttcaccatcggcaagggcaacaagccgtgggtgagcctgcccaagggcaagggtatcaagctcagcatcatcgaggagc

SEQ ID NO: 31824 - DNA, 430 bp, Zea mays
  Clone ID: LIB3059-037-Q1-K1-E9
ggatctgcaggctctgcagtcacttttatacatgaaagacaatgatgaagtgttcattgagctgggttatgacaaggataagaagaaggaaaatgctgagcgtgatgagcgtgccaagaagtctgtgagcattaacgagttactgaaacctgctgaaggataaaggtactacggcgagacgtggtcgaggaaggcgccgtgatgatcgcggtgattttagaggcgtatactagagggggatacagtcatggtccatctgctgctgctccatccattgaagatcaagctcagtttccaagccttgatggcgaagtgaacgtgcgcccagctgctgatgtcaccgagcgttgagttgtctgctgctgtcatatttaaattgatgccgacgttaaatatctgtgccacatgttaaacggaacagataatgatg

SEQ ID NO: 31825 - DNA, 442 bp, Zea mays
  Clone ID: LIB3059-037-Q1-K1-F1
caaatggttggagagcatcttctgcaccacgcacctactggcctcccccaccaactgaggctgagagcaatggctacttgcgcgttcggtgcaatggtggcttgaaccaacaacgtaatgcaatatgtaatgcttgtggtgctgcacggatcatgaatgctacactggtgctgccagaattagacacaaattcattctggcatgatgaaagtggctttgtaggtatttatgatgttccccacttcatcaagacactgaaatatgacgtccgaattgttatgagcattcctgaaatcactacaaatggaaagaccaagaagctcaaaggccagcagcttcggccaccaagagatgcaccggtatcttggtatgcaactgatgctttggagacgatgaagaagtatggagctatatatttaagtccattttcacaccgtttggc

SEQ ID NO: 31826 - DNA, 426 bp, Zea mays
  Clone ID: LIB3059-037-Q1-K1-F11
cccacgcgtccgcgcaagcacggcctatgccatatcaagaaaagagtctcagtaaaatggttgggaacggacgagcaaggtctggaattattgtgctaccttgtggtgctggcaagtccttggttggtgtatctgcagcctgtcgtattaagaagagctgtttatgtttggccacaaatgctgtctccgtagatcaatgggcatttcagttcaagctttggtcgaccataaaagatgagaacattagtcgttttacatctgataacaaggagaagtttacagggatggctggtgtggttgttactacatataacatggttgcattcggtggtaaaaggtctgaagattcggagaagatcattgaagaaatccgaaacagagagtggggcttgcttctaatggatgaggtccatgttgtccctgcac

SEQ ID NO: 31827 - DNA, 366 bp, Zea mays
  Clone ID: LIB3059-037-Q1-K1-F12
gacccactcattcgaagactctttcgcgcaagcacagcctataccatatcaagaaaagagtctcaataaaaggtttattatacaagactatcaaggtctgtaattattgtgctaccttgtggtgctggcaagtccttggttggtgtatctgcatcctgtcgtattaataagagctgtttatgtttgtccacaaatgctgtcttcgtagatcaatgggcatttcagttcaagctttgatccaccataaaatatgacaacattattcgttttacatctgataacaagcagaaatttacatgcatctctgatctatttattactacatataacatggttgcattctgtgttaaaaggtcttaatattca

SEQ ID NO: 31828 - DNA, 419 bp, Zea mays
  Clone ID: LIB3059-037-Q1-K1-D8
gcattcattggcacacaccatcagggcacacaactacaacaactagtgctagcggccttgctgcctactctcagcaacagcagtttcttccattcaaccaactagctgcattgaactctgctgcttatttgcaacaacaactaccattcagccagctagctgctgcctacccccaacaatttcttccattcaaccaactggcatcattgaactctcctgcttatttacagcagcaacaactactaccattcagccagctagctggtgtgagccctgctgccttcttgacacaacaacagttattgccgttctacctgcacgctgcgcctaacgctggcaccctcttacaactgcaacaattgctgccattcaaccaacttgctatgacaaacccagcagcgttctaccaacaacccatc

SEQ ID NO: 31829 - DNA, 440 bp, Zea mays
  Clone ID: LIB3059-015-Q1-K1-C6
cgaccgtcggcctcgtcttctggtgaaagggcaagctgcaatagctcttgtcatgttgttcagggagttttcagttctactccagaatggttggttcccaaaaatcttcattgttcttctcagtggagtggtggcagcattttacttctatcgcattgcaactggtaaccccaaagatctgagcagcaagaatgattcagcgaactaatgcactgggacgagtcagatggtcagtgggacgtagacccagaagattatggtctgttcctttccattttcttcatcggccttcaattgaggcaaagctcggtcctagcgtctaagatgtctgcgtgatgatacatggattcaaaagaattgtttgcttatctggcccacttcccgcactcctttgttcctttactcgtgtaatatactaagatgtcaggcccgcttaaaca

SEQ ID NO: 31830 - DNA, 441 bp, Zea mays
  Clone ID: LIB3059-015-Q1-K1-C7
cctgtatcggcgctctccaccgccccggccccttcctccaccagcgcgccgccggctgggtccacttcctcgcgccgcacaggaagacccgaccgccccccgcgatgagctggcttgggaagctgggcctgagcgggcttggaggcagcccgcgcgcgtcggaggcgtcggcagcgctggcgcaggggcccgacgaggaccagcccgcgccggggaacgagttcgcgcaattcggcgccggctgcttctggggcgtggagctcgcgttccagcgcgtgccgggagtcacccgcacggaggtcggctacagccagggcaacatccacgatccgacctacgaggacgtctgcaccggcaccacataccacaacgaggtcgtccgcgtgcagtacgacccggccgcctgcaagtacgacgacctactcgacaccttctgggcgc

SEQ ID NO: 31831 - DNA, 440 bp, Zea mays
  Clone ID: LIB3059-015-Q1-K1-C8
caaacttctcaagactgtcactgtccactccaccacctcacttgcgatgcgaacaagagcaaagccctgaaatccttctccccctgcacgcacctgcagacctgctctctcgcgcgcatctcccgtgcccctcactgtttagtggcgacgactgggcgacagtcgccgccgccgcccgctaggggccgtgcccctggtctccatcttcgggcgcttcgcccaccagatatgagcagctggcaattcgattttgaggccattatttgataacccgggacaagtgcactgttacctgaccattttagcttgttcagatggctacacagttgccatgcttcacacagctcagtccaccgtcttgtagttggataaaagatgtcgggaactgcaaggctacgcctgatagggtagccagaagtgcccgagctttgggccactgt

SEQ ID NO: 31832 - DNA, 443 bp, Zea mays
  Clone ID: LIB3059-015-Q1-K1-D1
cccacgcgtccggcttgaagtccaaggatgatgtccgtggattagttttagaggtagcgggggaatatgattctgaaggtagcatcactgatgatgatattgatactgaggaacatgaagataaaactgttcgtggagcagaaaatggtgctgctgatggtgataatgctagtaatggagctgaagttgaaagccagagttctttgccggataacaaagttcgagtgttatggcttgatgatagtgaaaaaacagaagacattgatgaggtagttgttgttgatagaagtttccttcatggtgatttagttgcctctgcctcagatccaactggtcagatggggcttgttttggatgtcaatcttgtggttgatttgcaaggtgtgaatggcgatatgataaagggtgtttcttccaaggatttgagacgaatcaaggaattc

SEQ ID NO: 31833 - DNA, 396 bp, Zea mays
  unsure at all n locations
  Clone ID: LIB3059-015-Q1-K1-D2
ctcagctgaggctgccgctcgtagaaggatttccctggaataacaaggtcctactggagttcaatcaaagccaggtcctttgcagacagtttttgaactacctncagatgaggttgttgaccacagttattcatgtgcacttgagaggtcatttctgtatcatggacgcatgtatgtctcttcatggcatatttgctttcattcaaatgtcttctcaaagcaaatcaaggttgtgattcctttgagagatattgacgagataaggagaagtcagcatgcagttattaatccagctattacaatatttcttcgaatgggagctggaggatttggtgttcctccattaggatgtccagatggaagagtcaggtacatgtttgcatcattttggacaga

SEQ ID NO: 31834 - DNA, 441 bp, Zea mays
  Clone ID: LIB3059-015-Q1-K1-D4
gtcactcaacacagcacaggcagctcgagagagagagagagagaaagatgtcgtggtgggggcaccaccaccacaaccagccggctcccccggcgtcgggccccaaccaggtgttcaagatcttctgccgcgccaacgagaactactgcctggccgtccgcgacggcgccgtcgtgctggccccggtcaaccccaaggacgaccaccagcactggtacaaggacatgcgcttcagcacccgggtcaaggacgaggaaggcatgccggcgttcgcgctcgtcaacaaggccacggggctcgcaatcaagcactccctcggccagtcccacccggtcaagctcgcgcctttcagcccggaccaggaggacgcgtcggtgctgtggacggagagcaaggacgtgggcaagggcttccgctgcatccgcatggtcaacaacaccc

SEQ ID NO: 31835 - DNA, 289 bp, Zea mays
  Clone ID: LIB3059-015-Q1-K1-D5
cccacgcgtccgatgatgccgagcatgatgtcaccaatggtcttgccgagcatgatggggcaaatgatgatgccacaatgtcactgcgacgccgtctcgcagattatgctgcaacagcagttaccattcatgttcaacccaatggccatgacgattccacccatgttcttacagcaaccctttgttggtgctgcattctagatagaaatatttgtgttgtaccgaataatgagttgacatgccatcgcgtgtgactcattattaacaataaaacaagtttcctcttatt

SEQ ID NO: 31836 - DNA, 427 bp, Zea mays
  unsure at all n locations
  Clone ID: LIB3059-015-Q1-K1-D6
cccacgcgtccgcccacgcgtccgcaattagtaaacaacctaaagctcgcatgactggtcatcagaagcttgtaaaccatgtttacttttcccctgatggacaatggttggcaagtgcatcctttgataaatctgtcaagttgtggaatggtatcacaggtaaatttgttgcagcattcagagggcacgttgcagatgtctaccagatcagctggtctgccgacagtaggcttctactaagtggaagcaaggattccactctaaagatctgggatattcgaacacacaagttgaaaatggacttgccgggccacgcggatgaggtgtacaccgtggattggagccctgacggtgaaaaggtggcgtctggtggcaaggatcgggtcctcaagctatggatgaactgatngattattatatatctatg

SEQ ID NO: 31837 - DNA, 96 bp, Zea mays
  Clone ID: LIB3059-015-Q1-K1-D8
cccacgcgtccgcccacgcgtccgcaaaggatgtttgtttttaactagtcgtgcgcacgtgattaattcagttcatgttgttatggttgtcttccc

SEQ ID NO: 31838 - DNA, 436 bp, Zea mays
  Clone ID: LIB3059-015-Q1-K1-C5
cagcaagccagagatggtggacgcgcgttgatgtcctgctcgcgagtagagctggacggcggatcacatcggtgatttcgtcaccccgcgtccaccatctctggcttgctgtcctcatcccgtcatatacatccttagctcgataattacattgtagcatttaaccgaacacatgtacctatcaccattgcataagataaggctcctccttaccgaaataggaaatgatcattttcacacaacgtgattttcccatgtgaagtgaatgtatccataaatagatgggcttacagagtgttaagtggacgcttctcatgaagcggacatggataccgaagctgacatgacactatatcgcataaagtttacttgtgactttcatgttttagcatgtttatactactgacatactttctactactccatttctatacta

SEQ ID NO: 31839 - DNA, 440 bp, Zea mays
  Clone ID: LIB3059-015-Q1-K1-B1
cccacgcgtccggccacgcgtccggccacgcgttcggaaaaacagattgtaaatgacaggggcgtatattctttagaatgaactgggcctaaaggtgaatttattccgatgaccaaactaaaccaaaatatcaaggatatgaaatctatcctttacggcaatggtgaatcagagcctgtaactgaagcatgtgtacaattgacccaagaattcttcagggagaacactttacggctattaatcatacatcttccaaaactaaatttggaggtatgtaatttgacctgtttttgcatgtagattgacagtactactggagtagcttttattacatacataatacatacccctcttgttatcgtttttacacaaaaaaactgatacattcgtatggatgtatctctacttctgattgttgcagactaggaaagatgctactc

SEQ ID NO: 31840 - DNA, 442 bp, Zea mays
  Clone ID: LIB3059-015-Q1-K1-B10
cccacgcgtccggcgagatcttcctcaaccaacccaaccttctcgagctcgaggcgccgatcaagatctgcggtgacatccatggtcaatacagtgatcttctaaggctttttgaatatggaggctttcctcctgaagccaattatctattcttaggtgattatgttgatcgaggcaaacaaagtttggagactatatgccttcttcttgcttacaaaatcaagtaccctgagaacttttttcttctgaggggcaatcatgaatgcgcctcaataaacagaatatatggattctatgatgaatgcaagcgtcgatttaatgtgcggctatggaaggtcttcacagaatgttttaacactctacctgtggctgctcttatcgatgataaaatattatgtatgcacggtggactctctcctgatctagcacacttggatgagat

SEQ ID NO: 31841 - DNA, 395 bp, Zea mays
  unsure at all n locations
  Clone ID: LIB3059-015-Q1-K1-B11
gtggtagggcggcgccggcatcctgtttagggcgcctgcggtggcggcggcgtgtacggattcatctgcggcgggtagccgccctgcggaggcggcggtgcgtacggcctgtaagacgccatcgcgcggcggctagggttcctcggaacccgagccccagcacacagacaccgcgccggcggacactgctcgctcccccttctcctccgtcgccgccaccgcagaagcctctaccactgcacgtncgaggccaccgacacatattctaccaaatctatgggagcgcgaggtagtcggcgtctcggcgatttggcgaggagctggaaggaaggaaggaaggggcgatgagaatttcacgacagcttgtgaatcctcgccctagatgccgacgggca

SEQ ID NO: 31842 - DNA, 436 bp, Zea mays
  Clone ID: LIB3059-015-Q1-K1-B12
gtgctcgtgactttgaggacaaggagaagggcgtcaagatcaagaaagaggactgggacaagttgcatgttcacatagcctcgtacaacaacttccccactgctgctggtttggcctcttcggctgctggccttgcctgtttcgttttcacccttggaaagctgatgaatgtgaaagaagattatggagaactttcttcaatagcaaggcagggatctgggagtgcatgccgcagtatatatggtggttttgtgaaatggtgcatgggagaaaaagatgatggaagtgacagtattgccgtgcagcttgctgacgaaacacactggaatgatcttgtaattattattgcagtggtcagttcaaagcagaaggaaaccagtagcaccagtgggatgcgagataatgttgaaacaagtcctctcttgcagtacagggc

SEQ ID NO: 31843 - DNA, 444 bp, Zea mays
  unsure at all n locations
  Clone ID: LIB3059-015-Q1-K1-B3
ccgacgcgtncgcgcaaaattgacccaggaaatccatcgagaggccgtcgacaggggaagtaagggcgtcgtcgtctagcagcagccaccgccgcctcatcctcgcagccgccgtcctgctctccgtgctcgcggctgccagcgccagcgccgggacctcctgcgtgccggggtgggccatcccgcacaacccgctcccgagctgccgctggtacgtgaccagccggacctgcggcatcgggccgcgcctcccgtggccggagctgaagaggagatgctgccgggagctggcggacatcccggcgtactgccggtgcacggcgctgagcatcctcatggacggcgcgatcccgccgggcccggacgcgcagctggagggccgcctagaggacctgccgggctgcccgcgggaggtgcagaggggattcgccgccaccctcgtca

SEQ ID NO: 31844 - DNA, 441 bp, Zea mays
  Clone ID: LIB3059-015-Q1-K1-B5
ctctccgcttcccgctccgatcgacctgctccctccccaccaccgagcccatggcggagcagctcaccgacgaccagatcgccgagttcaaggaggccttcagcctcttcgacaaggacggggatggttgcatcacgaccaaggagctgggcactgtcatgcgctcgctggggcaaaatcctacagaggctgagctccaggacatgatcaacgaggtcgatgctgatggcaacggcaccatcgatttcccagagtttctcaaccttatggctcgcaagatgaaggacaccgactctgaggaagagctcaaggaggccttccgtgtgtttgacaaggaccagaacggcttcatctcggccgccgagctccgccatgtcatgacaaatcttggtgagaagctaactgatgaggaggtggacgagatgatccgtgaggctgatg

SEQ ID NO: 31845 - DNA, 424 bp, Zea mays
  Clone ID: LIB3059-015-Q1-K1-B6
ctttgttgtggcaatcctcttagtgctgatataatcttctaaaaaaaaaaaaaagaaagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaataaaaaaagggataacacattaaagattacaaacttacataagctaacctaaaaaacatgatttaactgtaaatgaaactcaaaacaatatcaccatcaatataacaaaaaaactgagatttacaaaacgcacagataaatcacactgaatgtcaaaaagaactaatcctattatttcacattatacacaataacaaaaacgcctacatatatcccgacaaaaaaaattgctaaattacaaatggaaattacaatctatcttatcactaaattt

SEQ ID NO: 31846 - DNA, 412 bp, Zea mays
  Clone ID: LIB3059-015-Q1-K1-C4
agcaacatccccagttttcgcagccaccacctccgaacatgccccaactgcacgcacgagctcacatgctttcacattcacaaggatctcggcctactcttccgcagcttccaccaatgggtggaccatcagtgccatcacaagtgaacccaccgcttccgcctatgcctcacccaacggcaatgcatggttcacagagtcagatgatgccccaaatgccacagcacatgatgggcctaaatcagatgcatgctggttctgtgcctactggtactgtacccccaatgggtgggttcccaagtgggatgggaaacatccaaggagcatcaggttcgtctggcgtacaaaattttcctatgggtggcatgtataatcggcctcagggacaaatggctccacaagggccaatgac

SEQ ID NO: 31847 - DNA, 441 bp, Zea mays
  Clone ID: LIB3059-015-Q1-K1-A6
cggcggcggccacgtgcgcgccgtcgtccaagctgcccgacggcgccggctccggcggagtgccggggctagcgccctgctgcagcaggcagcagtcgatgacggcgcaggtggcgcgcacgcagaaggtagcggacaaggtcgcgctgagcctgccgagcgacggcaggtacacgtcgggcgacagcgtcggcgtgaccatcttcagcggagggccgctgttattggtaccgacagaccgcagagacttcaccacgatgctggccgggacggcgccgctccacgccggagccggagccggtgcccacgggtactacgattactacatcggcattgacgtggagcatgcacaagttggcggccccggcggggcgctcgtcgcggcgctgcactacacggtccattacacggcgctacagcccgacgtgtacgcgtcgttcg

SEQ ID NO: 31848 - DNA, 431 bp, Zea mays
  Clone ID: LIB3059-014-Q1-K1-H11
cttcggcggcgacgagcacccaccagcagttctgtagaaatggctgatggtgaggacatccagcctcttgtctgcgacaatggcaccggaatggtcaaggctggttttgctggggacgatgcaccaagggcggttttccctagcattgttggccgtcctcgccacactggtgtcatggtagggatgggacagaaggatgcatatgttggcgatgaggcacagtccaagagaggtattctcacgctcaagtacccgattgagcacggtattgtgagcaactgggatgacatggagaaaatctggcatcatactttctacaacgagcttcgtgttgcaccagaggagcaccctgtgttgctcactgaggctcctttgaacccaaaggccaacagggagaagatgacccaaattatgtttgagactttcaatgt

SEQ ID NO: 31849 - DNA, 398 bp, Zea mays
  Clone ID: LIB3059-014-Q1-K1-H2
cttggccgaccccttggccaaaagtaaattccgggaaaaaaggaaaccagaaagaatgtataaaggccgaggattaaaagaaaaggaaaaggaaaaagaaaaaaagattcaaaaaagaaaaaaccaaaaagggaaaaaggaagaaagaagatacataaataaaagggaaaaaaaaaaggaaggcatgaaaaaaaagatgaacaaagttaaagagaaaagagagaaggacaagaaaaaggagaagaaaaaagcaaaagagcagaaaaaaaaagaaggaacaaaaaaaagcaaaaaaaaaaaaaaaaagaaggacaaaaaaaaaaaaaaaaaaaaaaccaaagaccaaaaaaaaaaaccaaaagagaaaaaaaggaagggaataagggaaggagaacctt

SEQ ID NO: 31850 - DNA, 423 bp, Zea mays
  unsure at all n locations
  Clone ID: LIB3059-014-Q1-K1-H4
agccttgccgaacctgcggcgttggcagaaccccgatcctgggccagtgcgtcgagtgcctgangcatcagtgcagcccgacggcgacgccctactgctcgcctcagtgccagtcgttgcggcagcagtgttgccagcagctcaggcaggtggagccgcagcaccggtaccaggcgatcttcggcttggtcctccagtccatcctgcagcagcagccgcaaagcggccaggtcgcggggctgttggcggcgcagatagcgcagcaactgacggcgatgtgcggcctgcagcagccgactccatgcccctacgctgctgccggcggtgtcccccactgaagaaactatgtgctgtagtatagccgctggctagctagctagttgagtcatttagcggcgatgattgagtaataatgtgtcacgc

SEQ ID NO: 31851 - DNA, 451 bp, Zea mays
  unsure at all n locations
  Clone ID: LIB3059-014-Q1-K1-H8
cactcgttcgagccttgcctcgcgcagcggtctggttcggttgggtgccctcttcgccggtggctctgatgcttttgggaagccggaggacgcttagggcngtcttattccttntttttttattttttttttttttttttttttttttttttttttttttttttttttttttttattttttttttttttttttttttttttttttttattttttttttttttttatttttttttttttttttttttttattattttttatttattatttttttttttttttttatattttttttttttttttttttattttttattttttttttatttattttttttattgttttttttttttttatttttattttattttttttttttttttttgtttttgtttttttttttttttattattttttttttgtttttttttttgtattttttttttttttt

SEQ ID NO: 31852 - DNA, 420 bp, Zea mays
  Clone ID: LIB3059-014-Q1-K1-H9
cgcaagtaccagaagagcacggagctgctgatccgcaagctgccgttccagcgcctggggcgtgagatcgcccaggacttcaagaccgacctccgcttccagagctccgccgtcgccgcgctgcaggaggcgtccgaggcctacctcgtcgggctcttcgaggacaccaacctctgcgccattcacgccaagcgcgtcaccatcatgcccaaggacatccagctcgcccgccgtatccgtggggagagggcctaggcgtcgtcccggtggaggtggaagtagtagtggccgtttctgtcatcactgtctggctagaaggtgtagagatgtgccgggttctgtagtttgggttatcggtcaaatcatgatgtagttgggtctaccctgctgtaatttaactatgactatgcaatggcaatg

SEQ ID NO: 31853 - DNA, 433 bp, Zea mays
  Clone ID: LIB3059-015-Q1-K1-A1
accaattacccaaccgatttcttccaaccaaccttcccaacttccacttcaggaccgatctgcatcacattgtcctccctatctccatgagtcacggcatcagcatgccttgaaaagggccaggggagctggaggtcggtttctcaattcgaagtcagatgacaaggaagagaactccgactcaagtcaaaaagagattcagaacggagttgcgccccaaaagggtggccaaccgtcaacccctccgtctcccaacggtgcgtcgtcagcttatcaggcgcctagtcgtgaatgatgattcggaactcacaactgaagagattttagtccctgacgctagttgtggcagcagctttgtacagtaagtgctagcgggcagcagcgaaatggtgtcatagaaaaacgttgacgagtcagacaggttttggagtct

SEQ ID NO: 31854 - DNA, 243 bp, Zea mays
  Clone ID: LIB3059-015-Q1-K1-A10
gtgtgtccgtgtgtgttctgcagttctgctggtaagactcgtagcccaagaataagaaccaggacatgggccttaataatcaccttgaactgccaaagggaacgcctgtgtgggtgtgtgcaagcgtgctaaaggccacttagaaaagtctcattagtatctgagttgagttccagttccactcttatgttttcaacagtagacaatgttcctgttcgtgagttgtctgtgtgattttcttct

SEQ ID NO: 31855 - DNA, 268 bp, Zea mays
  Clone ID: LIB3059-015-Q1-K1-A11
aaaaaaaaaaaacagaaaaaaaaaaaaattaaataaaaaaaaaaaaaaaaaaaaaaaaaagaaaggataaaaaaaaaggggcggccgttttaaagatcccaatttaacttccccttccttccaacttaataccttttttatagggccccctaatttaaattcattgcccgttttttaaaaacttcttaactgaaaaaaccttggctttcccaaattaaatccctttgaaaaaaatccctttttccccagttggcttaataccaaaaag

SEQ ID NO: 31856 - DNA, 407 bp, Zea mays
  Clone ID: LIB3059-015-Q1-K1-A12
gcggaccgtgggtggtgaaccctgcctctactacaacagcaacaactgatttatgtaggcttcgctgtggtaatgcacctacatacctgcacaacagttgctgcaacagattgtaccagctctgactcagctagctgtggcaaaccctgctgcctacttgcaacagctgcttccattcaaccaactgactgtgtcgaactctgctgcgtacctacaacagcgacaacagttacttaatccactagcggtggctaacccattggtcgttgccttcctacagcaacaacaattgctgccatacaaccagttctctttgatgaaccctgccttgttgtggcagcaacccatcgttggaggtgccatcttttagattacatatgaaatgtactcgataatggtgccctcat

SEQ ID NO: 31857 - DNA, 446 bp, Zea mays
  unsure at all n locations
  Clone ID: LIB3059-015-Q1-K1-A2
cccacgcgtcccgccaggtctggattccgtccccggtcgggcccggccgaccccggctgttggtcccggcgtcaagcgtcgcgggctccactgagcgtgcgtgtcaccggcgggaggcaagggcaggcggtggtggcgatggcgtccgctgacgcgcgcttggcggggatcgcctnctccatccgcgtcatctccgacttccccaagccagggatcatgttccaggacatcacgacgttgctgctcgatcccaaggcgttccgtgacaccatcgacctctttgtcgagcggtacaaggaccaagggatcaccgtggttgctggtgttgaagctagagggttcatttttggtcctcctatcgctttagccattggcgcaaaatttgtgcctttgaagaagccgaagaagttgccaagcgaggtgatctncgaagagtattctttgga

SEQ ID NO: 31858 - DNA, 441 bp, Zea mays
  Clone ID: LIB3059-015-Q1-K1-A3
ctcggcataactgcgctgctcgtgatctactggatgtacaagtacctgacgtgcaagggccagcctggcgccaaccagctggaccacgccaatgcgaggctgacgtccaaggcccgcgacatcgaggatgcagcacagcaccgcatcgaccagccgcaggggtcttgacagaagaaccacactagatcggaccgctcgcgcgacctacttgtaccactgccggagcggcggcatatggcccttaaaggcggtggctgctgctacgtacgctgccgtagagtctcggtcgccgcgatagctctagctagtcgtttatgtgttgtgctctgtgtgtgcatgctcgtgtctggtggcatgcagtgcaccgcagtactatatgctgtatgcgtctatatttgatcggagaggctgatgtacagcatgctcgatatgtctagtttg

SEQ ID NO: 31859 - DNA, 442 bp, Zea mays
  unsure at all n locations
  Clone ID: LIB3059-015-Q1-K1-A4
atcccgcagcagccaaaacctacctagccgccgccgcaggcggccccccatcgccgccgagatgcagatctttgtgaagactctgacggggaagaccatcactttggaggtggagtcctcggacaccattgacaatgtgaaggccaagatccaggacaaggagggcatccccccggaccagcagcggctcatcttcgccggcaagcagctcgaggacggtcgcaccctcgccgactacaacattcagaaggagtccaccctccacctggtgctccgcctccgcggtggcgccaagaagcgtaagaagaagacgtacaccaagcccaagaagatcaagcacaagcacaagaaggtgaagctctccgtgctgcagttctataaggtggacgacgccacaggcaaggtgacccgnctncgcaaggagtgccccaacacagagtgc

SEQ ID NO: 31860 - DNA, 442 bp, Zea mays
  unsure at all n locations
  Clone ID: LIB3059-037-Q1-K1-C3
caactagcaacatacatagtgaagtacactagccacatcttagcaccaatggccgcccgggtttttgcccttcttgcccttcttgctctttcaacaaacgttgctaccgcgactattattccacaatgctcacaacaattcctctctccggtgacagccgcgagatttgaatacccaactatacaatcctacaggctacaagaggccatcgcagcaagcatcttacggtcgttagcattgactgtccaacaaccatatgccctattgcaacaaccatccttagtgaatctatatctccaaagaatcgtagcacaacaactacaacaacaattgcttccaacaatcaatcaagtagttgcagcgaaccttgatgcttacctncagcaacaacaatttcttccattcaatcaactagctggggtgaaccctgctgcttacttgc

SEQ ID NO: 31861 - DNA, 429 bp, Zea mays
  Clone ID: LIB3059-037-Q1-K1-C4
agacaacactaagggttgatacttcaaggggagaaacacttcgcataaattttgatgtggacctttccagcccttcaatgttctataattagcctggatgcaatggacatcagtggacaggagcacctagatgtgaaacatgatgtattcaagcagcgaattgatgcccatggcaatgttattgcgactaggcaagatgtagttggtgggatgaagatggaggcacctctacaacatcatggtggaaggcttgaacacaatgaaacctattgtggctcttgttatggtgcacaagaatctgatgatcaatgttgtaacacatgtgaagatgttcgtgaagcctacaggaaaaaagggtggggtgtatcgaatccagatttgcttgaccagtgcaaaagggagggctttcttcaaagtataaaggacgaa

SEQ ID NO: 31862 - DNA, 443 bp, Zea mays
  unsure at all n locations
  Clone ID: LIB3059-037-Q1-K1-C6
aagacggacctgtaggtgataaaactcatgtttctactcgagtaatgggaacctatggatatgcagcaccagaatatgtcatgactggtcatctgacatcaaagagtgatgtctacagcttcggggtggtgcttcttgagatgatgtcagggcgcaggtcgatggacaagaaccgcccgaacggggagcacaacctggtggaatgggcgcgccccctcctaggcgagaggcagcggttctacaagctaatcgaccctcgcctggagggcaacttctcggtgaagggcgcgcagaaggcggcgcagctagcgcgcgtgtgcctgagccgggaccccaaggcgcggcccctgatgagccaggtggtggaggtcctgaagccgctgcagaacctcaaggacatggcgagcgcctnctacttcttccagacgatgcaggccgagcgg

SEQ ID NO: 31863 - DNA, 438 bp, Zea mays
  Clone ID: LIB3059-037-Q1-K1-C7
caaagataaggctaccgggaaggagcagaacatcaccatacgatcctcgggtgggctggcagaggctgacatccagaagatggtgcaagaagctgagctgcatgcccagaaggaccaggagcggaaagccctcattgacatcaggaacaatgccgacaccactatctacagcatcgagaagagtcttggagagtacagggacaagatcccggcagaggttgcatctgagatcgaggcagccatcgctgacctccgccaggagatggcctcggatgacattgagaagatcaaggccaagcttgaggctgccaacaaggctgtctcgaagattggacagcacatgtctggtggtggctctggcggctcgcagtcaggatctggacctcagggtggcggcgaccaggcgccggaggcagagtatgaggaggttaagaagtg

SEQ ID NO: 31864 - DNA, 439 bp, Zea mays
  Clone ID: LIB3059-037-Q1-K1-C8
caccactggtggttttgaggctggtatctccaaggatggccagacccgtgaacatgcggtccttgcgttcacccttggagtgaagcagatgatttgctgctgcaacaagatggatgcaaccactcccaaatactccaaggcacgttatgaagagattgtgaaggaagtctcatcctacctcaagaaagttgggtacaaccctgataagattgcctttgttcccatttctggttttgagggtgacaacatgattgagaggtccaccaaccttgactggtacaaaggcccaaccctgcttgaggctcttgaccagatcaccgagcccaagaggccttcagacaagcccctgcgtctgcccctccaggatgtgtacaagattggtggtattggaactgtaccggttggtcgtgtggagactggtgtcatcaagcctggtatg

SEQ ID NO: 31865 - DNA, 430 bp, Zea mays
  Clone ID: LIB3059-037-Q1-K1-C9
cccggttccgcgtgcctttccccacctactctcgcggctctcgccagccagtctaggggttcggtcccggcgtgcttatccgcccccgccggccatgtcgaagcaaggagggaaggccaagccgctgaaggcgcccaaggccgacaagaaggagtacgacgagacggatcttgcatatctgcagaagaagaaagatgaggaaaaagcactgaaggagcttaaggccaaggcacagaagggcgcgattgggggctcgggtctgaagaaaagtggaaagaaatgagactggtcacccgtctccaatacctagaggatgataaggcagctgtctatctgtgttgcgcttcactaagtgtgattgtaacagtggtacctcttgtgttctgtgttccgcgatgttgcagttggttgcttgatcgaaagatgtttc

SEQ ID NO: 31866 - DNA, 427 bp, Zea mays
  Clone ID: LIB3059-037-Q1-K1-D1
agagcaactatcatcatagaaagcacattattgtaccaacactggcacccaaaatatttggcctccttatgcttcttggtctttatgcaagtcctgataccgcgaccattttcccacaatgctcacatgctcctataactacccttactaccccgtacctctcaccaacattgtattcggtatgtgaaaacccacttcttcaacactatacgatccaacaggcaatatgcactggcatcatacctttatcacccttactacttcaacactcatcacacctattacagcagttacctttgctgcatacatttgcacaaaacatcactgcacaacatctacaacaactcgtgctagcaaaccttgctgtctactctcagcaacagcaagttcttccattcaaccaactacctgcatagaactatgctgc

SEQ ID NO: 31867 - DNA, 425 bp, Zea mays
  Clone ID: LIB3059-037-Q1-K1-D12
cggacgcgtgggctgtgtccggtcctccaggagccaatgccactgcaaccagatctgggcagaaagcagatggaaacgccgatggacctgaagacatggccgtcgatcacaaggtgacaacatcctctcccgtcaagaaccatattgacctgaacatccaacctgaacgggacgatgagcagtcaccgaaatctggtgcggctggtttgttgagccgagacaatgcaacttagagagtggatagcgttgtttgattgatcataccaatgagtggacatagataaccgatcgaacatatccttccgaatgtctatacccttgttttttttaagatagatgtggcgtgaggcgtggggtcttgtagtgtagctgttaccttcccataccatagagccggtttccttttaccctgagactccagtggt

SEQ ID NO: 31868 - DNA, 442 bp, Zea mays
  Clone ID: LIB3059-037-Q1-K1-D2
cttatcacaatgggtttaggatgagaggtctatcttaatttcatgggaaatgagtttggacatccttaatggatagatttttcaagaagtccgcaaagacttccaaagtggtaggttattccaaggaataacaacagctatgacaaatgtcgtcgaagatttgacctgggggatgcagactatcttaagtatcaattgtatcaagaattttgatcaggcattgcaacatcttgagcaaaaatatgaattcatgacatctgatcaccagtatatttcccggaaacatgaggaggataaggtgattgcgttcgaaaagggagatttggtatttgtgttcaacttccactgcaacaacagctattttgactaccgtattggttgtcgaaagcctgcggtgtataaggtggtcttggactccgacgctggactatttggtggattt

SEQ ID NO: 31869 - DNA, 259 bp, Zea mays
  Clone ID: LIB3059-037-Q1-K1-D5
acccaccactcacccctctccacaaccttacatcaactactaactacccacacacccacacaacaacacatggtcacattcaaacattttatgccctctctaaaacctcttaccaccaccatatttccaaaccattaccacaaacccatactaaccatcattaacaacacatacaacctgaacattaacaatactactaacaatattactcaccttctctcatcaataccaataacaaaccaaacaaaaaattctatca

SEQ ID NO: 31870 - DNA, 350 bp, Zea mays
  Clone ID: LIB3059-037-Q1-K1-D6
cctgggtcgtcctagggtggctgctcatattgccactggaactccatccagatagggggcacatgcaaattgttagggcactactctaaaatcagtcaccgaacactaaatctgaaagccatcgtgatgctctcctagctatattctgccagcacctgtacctggacatcatgattaccaatgtgggacataccgtacaactagcttcttaactgccgatagttcatgaccagacgtacttgaagcattgcgactcaccacccgagtgcgtagcctaagagaacatactgaccatagctggcggacattctcgcgtactgctcgttccacggatctgtgcatcctcatgt

SEQ ID NO: 31871 - DNA, 440 bp, Zea mays
  unsure at all n locations
  Clone ID: LIB3059-037-Q1-K1-D7
cccacgcgtccgcccacgcgtccgcgcaaattgcaccaagaaatccatcgagaggccggggacaggggaattaatggcgtcgtcgtctagcagcagccaccgccgcctcatcctcgcagccgccgtcctgctctccgtgctcgcggctgccagcgccagcgccgggacctcctgcgtgccggggtgggccatcccgcacaacccgctcccgagctgccgctggtacgtgaccagccggacctgcggcatcgggccgcgcctcccgtggccggagctgaagaggagatgctgccgggagctggcggacatcccggcgtactgccggtgcacggcgctgagcatcctcatggacggcgcgatcccgccgggcccggacgcgcagctggagggccgnctagaggacctgccgggctgcccgcgggaggtgcagaggggattcg

SEQ ID NO: 31872 - DNA, 443 bp, Zea mays
  Clone ID: LIB3059-037-Q1-K1-C2
gaccaactagcaacatagaaagcacaatagtgtaccaacaatggcagccaaaatatttggcttccttatgctccttggtctttctgcaagtgctgctaccgcaaccattttcccacaatgctcacaagctcctatagcttcctttcttcccccatacctctcaccagcggtgtcttcaatatgtgaaaacccaattcttcaaccctacaggatccaacaggcaatcgcagcacgcatcttacctttatcacccttgttcctgcaacaaccgtcagccctattacagcagttacctttggtgcattcggtggcacaaaacatcaaggcacaacaactacaacaacttgtgctaggaaaccttgcttgctactctcagcaacagcagtttcttccattcaaccaactggctgcattgaactctgctgcttatttgcaacaacaac

SEQ ID NO: 31873 - DNA, 430 bp, Zea mays
  Clone ID: LIB3059-037-Q1-K1-B10
ctcttcttcacctcactaacaccgagctagcagctcgctctgtcctgcaacaatggccgctcgctcctcctcccagcagctggtcgcggcggcggtcctggcagcggcgctgctgctgctggcggcgggggccgggacggcgtcggcggcggtgagctgcggcgaggtgacgtcgtcggtggcgccgtgcctcgggtacgcgatgggcagcgcggcgtcgccctccgcggcgtgctgcagcggggtgcgctcgctcaacagccgcgcgtcgtcgacggcggaccggcaggccacctgcaactgcctcaagagcatgacgggccggctcggcggcggcgtcagcatggccaacgccgccaacatccccggcaagtgcggcgtctccgtcggcgtgcccatcagccccaccgtcgactgcaccaagatcaac

SEQ ID NO: 31874 - DNA, 419 bp, Zea mays
  Clone ID: LIB3059-037-Q1-K1-B11
cacactgacaccgcaaacacgccaaccggcctaccgccttcttctcttgtctcgtccggctcgcgactatggccgccgccgccgaggtagaccccagccccaacccgccgccaactacagcctccggcctctccaagaccaagacgcgggaggccgaccgccgccgacgccgccgcagcaaggccaagaagaacaagtccgtcactgaggctgatgcccaggacgctgacgggggagcttccagctccgacgccaaggagaacgccgatcccaaccccgagccacaggttgaggtggagatagagtacgtgccggagaaggccgagcttgacgaccctctcctggatgatttcaaggccatcttcgagaagttcaccttcaaggacgctgctgcagcggcggccgaggatgataataaa

SEQ ID NO: 31875 - DNA, 429 bp, Zea mays
  Clone ID: LIB3059-037-Q1-K1-B12
gccattcctgattcctccatcttccgttccgccgcaccgccgccggagatatgtcgaggctcgctgctgccgccctccgctgcgtcgtcactgcatcgagagatacctcctcatctcgcttcgccgtgtctgcgccggtgtctgctcggctcttctccgcggatgcatccggtgaagccgccgccacggccgcagagtcgcaggatgactctttcttcaaggcatcccgcgaaggattagcctatggaaggttttacagtgtcattggtggaggcagtcgtcttgagaagaacatattgaaaactgatattatccatcaccttgacagatgtggattgtcattggatgatgtgaagattgaatacaacaagggatatgctccattggccgctttgttgaggttttcttcgaaggcaatgtttaccaccg

SEQ ID NO: 31876 - DNA, 427 bp, Zea mays
  Clone ID: LIB3059-037-Q1-K1-B2
gaaactgcaccacagagcatgccacacgcaacgccttgatcctgtgcgagaaggcaagccatctagaggtcccagtagctgagggcagccatgagcctctcaagggaggaaagccgcacgttgctgacttcgttcatggacctgatggcctcgggaacgtagatcttcctgatcccactatcaagaaagtggaggaaagtgctaccgacttcttggttgataaggtctcgcgatttcctggagaggtctctgtgctcgccttgggtcctctgacaaacatagcattggccatcaagaaggatccctcattcgtgaaaaacgttaagaagatcgttgtgctgggtggagcgttctttgcggctggaaatgccactccttccgctgaagcaaatatccacagtgatccggaggcagccgacatggtttt

SEQ ID NO: 31877 - DNA, 439 bp, Zea mays
  Clone ID: LIB3059-037-Q1-K1-B4
cccacgcgtccggatttccctcatgtcgagaggtatttctggaccatggttaaccagcctgacttcaagaaggtcattggtgaggtcaagcaggcagagtctgcacctcctattccgaaaaaggctgctccttctaaggagccaaaggcaaaggatgtcaagaaggaggctccaaaggaagcccccaagccaaaggtggttgaggcaccagcagaagaggaagcaccaaagccaaagccaaagaatcctcttgacttgctgccaccaagcaagatggtccttgatgactggaagaggctatactcaaacacaaagactaacttccgggaggttgccatcaaaagtttctgggacatgtacgacccagagggctactctttgtggttctgtgactacaagtacaatgatgagaacaccgtctcctttgtgaccctgaaca

SEQ ID NO: 31878 - DNA, 430 bp, Zea mays
  Clone ID: LIB3059-037-Q1-K1-B6
cggacgcgtggggcgtaccataacggattcgtagatatatgtatctacatcaacgagaggcaaccattactatttctggaggcatactcactggcctcagacgacattcacatactacaattcatagtgctcaggacctgcttgatcacgattgacgaatgagatatcgaatgctgcatatcgtacattatttttgactgatgcatgtactcataatgctacaacctttgattgtactgctgaacattctacagatagatcgcatgatactaacgctaacgctccttgtcaattctttgacatgctatcccgaggatctgccagactctatctatatagagatgccactgcattgcgaatcctacttgatcatggacacctgatatcatgatcactgtcatactccgtgaacatgtgactttatggacaa

SEQ ID NO: 31879 - DNA, 439 bp, Zea mays
  Clone ID: LIB3059-037-Q1-K1-B7
cggacgcgtgggatctataaatggctatctcccacatatgaactagtctctatcatgagccaatccagatcagcaaagcggcagtgcgtagagaggatcgtcgaacagaacagcatgaagatggtcatcgttctcgtcgtgtgcctggctctgtcagctgccagcgcctctgcaatgcagatgccctgcccctgcgcggggctgcagggcttgtacggcgctggcgccggcctgacgacgatgatgggcgccggcgggctgtacccctacgcggagtacctgaggcagccgcagtgcagcccgctggcggcggcgccctactacgccgggtgtgggcagacgagcgccatgtaccagccgctccggcaacagtgctgccagcagcagatgaggatgatggacgtgcagtccgtcgcgcagcagctgcagatgatgatgc

SEQ ID NO: 31880 - DNA, 442 bp, Zea mays
  Clone ID: LIB3059-037-Q1-K1-B8
agaccaactagcaacatagaaagcacaatagtgtaccaacaatggcagccaaaatatgggggcctccttatgctccttggtctttctgcaagtgctgctaccgcgaccattttcccgcaatgctcacaagctcctatagcttcccttcttcccccgtacctctcaccagcggcgtcttcggtatgtgaaaacccaattcttcaaccctataggatccaacaggcaatcgcagctggcatcttacctttatcacccttgttcctccaacaatcatcagccctattacagcagttacctttggtgcatttattggcacaaaacatcagggcacaacaactacaacaacttgtgctagcaaaccttgctgcctactctcagcaacagcagtttcttccattcaaccaactagctgcattgaactctgctgcttatttgcaacaac

SEQ ID NO: 31881 - DNA, 390 bp, Zea mays
  Clone ID: LIB3059-037-Q1-K1-B9
cgcgtgtcttgctgtagttaggtgctgctgtgtctggtctcctccggtagcaactgtggtctgatggaacagtaacaatgcttattgaatccagctagttgcttatttgtggatcctctctctttgttgttggccacctttatctcgtgatgtttgtgtgcatgtgaatactctgaatgtgcatttcgaagtttgagaagttacgacgcgttaaaaaaaaagcgtgcaccacagcccgtcccgagcgctgcacgacctcacggggatcaagaagcactactgccagaagcacagccagaagaaggtcaagtgctacaggtgcaacatgcgctacgacgtttagtacgacttgaatgcgcacgtcaagacctgcagcgaccgcaagtatct

SEQ ID NO: 31882 - DNA, 442 bp, Zea mays
  unsure at all n locations
  Clone ID: LIB3059-037-Q1-K1-C1
cggacgcgtgggtgatgatgtcgacaagaccatggatgaaattaatgaacagactgaagagatgaaacaaattcaagatgctttgtcaacttcttttggaacttctgctgattntgacgaggatgaactggaagcggaacttgaagaactggaaggagcagagttggaatctcagcttctggagcctgttgcagctcttcctgtgcatccagtgcatgtcccaggcaacaagcaaccagctcgccctgctccacagaaagctacagctgaagatgatgagcttgctgcactgcaagctgaaatggcactgtgatcaggtttccactgaagaggtgaaatgtgtatatgaattgcgttatgctgaaagctgagtcaggctttattgtatttgccatgtgtgtataatcttggtggatatttggcaaccgtcaaccgaagcagc

SEQ ID NO: 31883 - DNA, 430 bp, Zea mays
  Clone ID: LIB3059-037-Q1-K1-C10
acttactccatatggtggtggcataaatgatacggcaatgttctggggtgtaaaattgtgacaatgatctgctgatgcaagccggcaaacttgggaatgtgcaatcagagctgcttctccgcaaggactcccggactttcactttcgaaaagggatgggccttcccacgccgagtttacttcaatggtgataattgtgtcatgccatctcctgaaaattatccatggctgccgaatgcaagccctctaacaaaaccattggcactcccattcttggtattctgggttgccttggctgctctgctggcttatgcatgattagtgggatcaagaggtttagcaagtttcaagttgatgtcagattccatgaggtgcactgcaacaagtcatttgttcattcaattccatggttgcacagaaaagatgaggcg

SEQ ID NO: 31884 - DNA, 429 bp, Zea mays
  Clone ID: LIB3059-037-Q1-K1-C11
gcagtacgaggagcctgagcaaccgatgcagagcatggatgagatcatgcagatcctggctgaggcgaccattccagcagctggtccccatggactcaatcagttcctgaacgacggccttgacctcgacgatgacatggacgacctggactcagataccgatcttgacctggaaagcagtggggaaatcgtgtatgctatttgacagcagcgaggcaatgcgtatcatcagtcgtgctcagatcgtttgttgcgccgcaggttaccgagataattagagagacaggggggaggtatctgctggagatgctgctcgtgtctgatgccgtgatgcccccctttttttcatcctgttatgtttggctgttgtttggttgtggtgcacctccagtgttttacaacagtttggcccttcggaattggttgtgc

SEQ ID NO: 31885 - DNA, 427 bp, Zea mays
  Clone ID: LIB3059-037-Q1-K1-C12
agccgctccatcagcgagcacgtcgagcaggggcagacggtggccgcgtacggcggcggcgggatggtcctgatgaacaaggcggcggaggggtacaccaccttcgccgacgcgcacgtgctggccgcgtcgcacgtgagccacgccgcggggtcgaggatcgcggcgtacgccaggtcggcgcccaggcccacggcgtccatcgcgttccggggcacggtgatggggtcgtccccggcgccgtccgtggccttcttctcgtcgcgcgggcccaacagggcgagcccgggcatcctgaagccggacatcacggggcccggcatgaacatcctggcggcgtgggcgcccagcgagatgcacccggagttcgcggacgacgtgagcctgcccttcttcgtggagtccgggacgtccatgtcgacgccgc

SEQ ID NO: 31886 - DNA, 238 bp, Zea mays
  unsure at all n locations
  Clone ID: LIB3059-037-Q1-K1-B1
cccacgcgtccgcggtgagccgtgcgtccctcgaccagaagctcgccctcgccaagcgtggctcccgagaggcgaccctcgccggagccaaggcggcagcggtggcgactatcgcctccgcgatccccaccctggccagcgtgcggatgctgccatgggccaaggccaacatcaaccccaccggccaggcgctcatcgtctccacggtggctgggatggcctacttcatcgncgccga

SEQ ID NO: 31887 - DNA, 443 bp, Zea mays
  Clone ID: LIB3059-036-Q1-K1-H7
ccgatcgacaccatgagggtgttgctcgttgccctcgctctcctggctctcgctgcgagcgccacctccacgcatacaagcggcagctgcggctgccagccaccgccgccggttcatctaccgccgccggtgcatctgccacctccggttcacctgccacctcctgtgcatctcccaccgccggtccacctgccgccgccggtccacctgccaccgccggtccatgtgccgccgccggttcatctgccgccgccaccatgccactaccctactcaaccgccccggcctcagcctcatccccagccacacccatgcccgtgccaacagccgcatccaagcccgtgccagctgcagggaacctgcggcgttggcagcaccccgatcctgggccagtgcgtcgagttcctgaggcatcagtgcagcccgacggcgacgccctactg

SEQ ID NO: 31888 - DNA, 432 bp, Zea mays
  Clone ID: LIB3059-036-Q1-K1-H8
cccacgcgtccgcaggttcgcacgctcaatggaaagatagagaatagaaatgaggtggatgagggctctgaaggctccagctctgctgagtctgatgaactgaagcctaacaagagaggtgcctatggtaagcctgggcttgcagcaccaatgcctgtgcacatggaatcgaggccggttgctggtgaaaggagatgacttgtcatcggcatcatgccatgccatttcaggtttataatcttgtggtttgtcatcttgctgctacatttccactgatgtttcatgatggaagtttttttcccctcaaattgtagaagatgtacaactgtggactctagaactagggcagttgtatattcagacgacctctcgggtaattgcactttgttgcagaattgtactactggactagtaccatcttttaaaactgag

SEQ ID NO: 31889 - DNA, 426 bp, Zea mays
  Clone ID: LIB3059-036-Q1-K1-H9
gctgctcctggcgtcaccgccagcccgcctacgcgggtagaggtgcgagcggcagcgggggggaaccgcggctctctctgcgtagcgcgcgccgacggacaggcggagacgggcgcgctcaggggatgcgcctggctgccaccgaagccgctgggagcgggccagccgtaccggagcaggggggccgccgccgtgtgtcactacgtagcgcacctcagcgcgcgcaccatacaggggatctacgccggagccagcgcagtgctattagttgctaaaggcactgccatacacaaatctttccttgtgccattacttgctcttcaggcacattgcagcataatctcatggatcaagggtgactatggtcagtggactgctgatcacgctgtgttggtgcatctatacttcttcattccaggggaactg

SEQ ID NO: 31890 - DNA, 317 bp, Zea mays
  unsure at all n locations
  Clone ID: LIB3059-037-Q1-K1-A1
ggtgcagcgcggcggtcgccccgagtcgtccactttggccccgacaggctgtccaccgtggcgcgaactggccctcgcccgtttcggcccggccggccgtagcagctcaacagagaactagcctctcgtcggcctttcccaggtctgcgcgtggcgcggcgccgcagcaaagctccacgcgtgcgtgtccgccacccgncgtaccggcccggcccgtcgtcagtgcttcggtcggtgaacgacgtctcgcttgggtatcagcgcgttcttcgaagcgcacgaacgacaaacgggagaaggaagagaactcgtgggga

SEQ ID NO: 31891 - DNA, 421 bp, Zea mays
  Clone ID: LIB3059-037-Q1-K1-A11
cccacgcgtccgcccacgcgtccgcccacgcgtccgcccgcccccaattccaaatccggagtgcccgcggccacagaccgacccccatcacacacgcgcatcgcgccaccccatccgtcaccgtcgacccgcgagcacccatggcgaagggaggaggtggaggccagcgcgagggtagcgccctgaagagggcggcgatcgtcgcaggggggctcgcgctggcctgggtcaccgtggagaccgctttcaggcccttaatgggccgcctccgcgctgccatctgcagctccaccgagaccgcccgcgaccccgaccaggaggagcctcccgcgcctgcctctgcggcggaggcggagaaggcgtccgcaccagaggagcctgccgcggtggatgagaaagtcgaggagaaggtggtcgagtt

SEQ ID NO: 31892 - DNA, 421 bp, Zea mays
  unsure at all n locations
  Clone ID: LIB3059-037-Q1-K1-A12
gcaaagcggcagtgcgtacagaggatcgtcgaacagaacagcatgaagatggtcatcggtctcgtcgtgtgcctggctctgtcagctgccagcgcctctgcaatgcagatgccctgcccctgcgcggggctgcagggcttgtacggcgctggcgccggcctgacgacgatgatgggcgccggcgggctgtacccctacgcggagtacctgaggcagccgcagtgcagcccgctggcggcggcgccctactacgccgggtgtgggcagccgagcgccatgttccagccgctccggcaacagtgctgccagcagcagatgaggatgatggacgtgcagtccgtcgcgcagcagctgcagatgatgatgcagcttgagcgtgccgctgccgncagcagcagcctgtacgagccagctctgatgc

SEQ ID NO: 31893 - DNA, 445 bp, Zea mays
  Clone ID: LIB3059-037-Q1-K1-A2
caacttgtgctaggaaaccttgctgcctactctcagcaacagcagtttcttccattcaggcaactggctgcattgaactctgctgcttatttgcaacaacaactaccattcagtcagctagctgctgcctacccccagcaatttcttccattcaaccaactggcagcattgaactctgctgcttatttacaacagcaacaactaccaccattcagccagctagctgatgtgagccctattgccttcttgacacagcaacagttgttgccgttctacctgcacgctgcgcctaacgctggcaccctcttacaactgcaacaattgctgccattcaaccaacttgctttgacaaacccaacagcgttctaccaacaacccatcattggtggtgccctcttttagattgcttatgagttatagttcaataatgaagttttttggatga

SEQ ID NO: 31894 - DNA, 442 bp, Zea mays
  Clone ID: LIB3059-037-Q1-K1-A5
gcaaggactccgccaagaagactgcgaagaagtcgcgcgtcaagtgcttcatcaagcgggtcaacttcactcacctcatgcccacccgctacaccctcgacgtcgatttcaaggatgtcgccaccggtgggcccgacgcactctctacccacgacaagaaggtcgccgcctgcaagacggccaaagcgcgccttgaggagaggttcaagaccggcaagaacaggtggttctttaccaagctccgcttctagatgctcggcctcccgaatagtcctgctttagctgtcgatttgttgtatcggacacactccatctctgttttcgtattaccatgaatatttcgtgtttagtcctggggctctcagagataaatttgctaagatatgccgttgttgtgttacatgttttcgtgataggtctggttaaaattttgttctgttta

SEQ ID NO: 31895 - DNA, 329 bp, Zea mays
  Clone ID: LIB3059-037-Q1-K1-A6
caaaaacacaccaagcgaagcgcactagcaacgacctaacaccaatggctaccaagatattagccctccttgcgcttcttgcccttttagtgagcgcaacaaatgcgttcattattccacagtgctcacttgctcctagtgccattattccacagttgctcccaccagttacttcaatgggcttcgaacatccagccgtgcaagcctacaggctacaactagcgcttgcggcgagcgccttacaacaaccaattgcccaattgcaacaacaatccttggcacatctaaccctacaaaccattgcaacgcaacaacaacaacaacagttt

SEQ ID NO: 31896 - DNA, 437 bp, Zea mays
  Clone ID: LIB3059-037-Q1-K1-A7
ctgtttttttttttttttttttttcttttttctatttattttttttttttattatgagcttatgtcctttccggtggacatccttgtaaatatcgtgggggcccccaattaggccaccccggatctctgatttatcgggaaggaatccgacaaaggcccggaggagcaaattggattggctcttaatatcgggccgggcattgacggagcgtaaatttaacaagggaacggagcggtttaaaacctccaaccggctgagtgtgtcaacacaccttggcccttgtaacgttacttactattagcgcgatgctccaacccggaccctttgttgcacctgtaagccccctacccgttgtttacatggggacatactcgcaacagctggtggtgctaccttacctagttcctaaagcaaacttgattggataaaattaact

SEQ ID NO: 31897 - DNA, 441 bp, Zea mays
  Clone ID: LIB3059-037-Q1-K1-A8
cccacgcgtccgcggacgcgtgggctagccatcaagtacaacaaggcagtgcaggagggggacgaactgcctcctgagaaacttgcgatagcaaatgtgggtcggcaagatgcaaaaaaagcatttggaagagcatgtgtcgaatttgatgtcatcaaacatagttcagaccctaggaaccatgctcgacacggttgtcttttagtctactaatagtattgttgtcccaaactgaaacatagccacactatcgaagcacacgtgcgatgagcttgacgccgggtacattttggttctaaggtttgtttttgaatggatttgtctacatttcattgttgttaaacttcctgccttttctatcaaagcttcagtgcgttctagttatgtttaagccaaggtggctccagatgtcagttgggatgtcattgccctgggagaact

SEQ ID NO: 31898 - DNA, 432 bp, Zea mays
  Clone ID: LIB3059-037-Q1-K1-A9
cccacgcgtccgggcgtgtacagcgactacgacgtgcgcaacgacaaagctgcaggcggcagcagcagcagcaggaggccggagatggcgtggtacgagcggcgccggccacggctcgggatcgtgtcgcgcaaggggaggcgcgtggtcgagaaccaggcggccgtggcgcagctggcggcgtcggtcgggttcgacgtggacatcatggagacggccaacggcgcgccgctctcggccgtgtacgcgtccgtgagctcgtacgatgcgctggtgggcgtgcacggcgccgacctgaccacgttcctgttcctgcgccccggccgcgcggcgctggcgcagatcgcgccgctcggcatcaccatgctctcgcgcaacctcttcggcgtgccggcggccaggatggggctgcactacgtgcagtacgacgtg

SEQ ID NO: 31899 - DNA, 438 bp, Zea mays
  Clone ID: LIB3059-036-Q1-K1-H5
gcatcgccgccgccaacccggagggaacccgctgggaggggacctgctggtacgtccagaacctccgccgctatgagttccctctccagttcgacatgcccgtcgcctacccccaggtcgcccccgagatcgagctccccaccctcgacggcaagactcacaagatgtaccgcggtgggaagatctgcctcaccgtgcacttcaagccgctgtgggccaagaactgcccgaggttcggcctggcgcacgcgctgtgcctcggcctcgcgccgtggctcgcggcggaagtcccgattctggtcgactcgggcatggtgaagcacaaggatgacgaggcggctccggctgaggcatctgcctctgctgctcctccttcgtagttgccacttgcaacaactgagtgtccggtgagctaagggcgatatcggaaatcaactc

SEQ ID NO: 31900 - DNA, 346 bp, Zea mays
  Clone ID: LIB3059-014-Q1-K1-F4
gcagatttgggtggttttgatggggattcttattacgacaacaatgtggaactagatagtaagctatatcctgttaatgggacctactatctctggtaaaactttacttgcaaagacattatctcgttttgtgaatgtaccatttgtaattgctgatgcaactacattaacccatgcaggttatgtattataggatttataatctatattatacaatttactcactttttcatattttaatgtacaagcatttcatcattttatattttacatatactatttttataatatcataatataagtttgaatatttaactttattataaacttatctttttaatttttt

SEQ ID NO: 31901 - DNA, 291 bp, Zea mays
  unsure at all n locations
  Clone ID: LIB3059-014-Q1-K1-F5
agcagctcaggcaggtggagccgcagctccggtaccaggcgatcttcggcttgntcgtccagtccatcctgcagcagcagccgcaaagcggccaggtcgcggggctgttggcggcgcagatagcgcagcaactgacggcgatgtgcggcctgcagcagccgactccatgcccctacgctgctgccggcggtgtcccccactgaagaaactatgtgctgtagtatagccgctggctagctagctagttgagtcatttagcggcgatgattgagtaataatgtgtcacgcatc

SEQ ID NO: 31902 - DNA, 406 bp, Zea mays
  Clone ID: LIB3059-014-Q1-K1-F6
ggcggcggctgatgtggagtaccgttgcttcgtcggcgggcttgcctgggccacgagcaacgagtcgctggagaatgccttcgcctcctacggcgagatcctcgactccaaggtcatcaccgaccgggagacggggaggtcccgcggcttcggcttcgttaccttctcctccgagaactccatgctcgacgctatcgagaacatgaacggcaaggagctcgacggccgtaacatcaccgttaaccaggcccagtcccgtggcggtggcggtggcggcggtggctacggcggcggtcgcggcggcggcggcggttatggtggcgggcgccgtgacggcggttatggcggcggtggcggctacggcggtcggcgcgaaggtggcggcggcggctacggaggcggtggc

SEQ ID NO: 31903 - DNA, 421 bp, Zea mays
  Clone ID: LIB3059-014-Q1-K1-F7
cccacgcgtccggaccaactagcaacatagaaagcacaatagtgtaccaacaatggcagccaaaatattttgcttgcttatgctccttggtctttctgcaagtgttgctaccgcaaccattttcccacaatgctcacaagctcctatagcttcccttcttcccccatacctctcaccagcggtgtcttcaatgtgtgaaaacccaattgttcaaccctacaggatccaacaggcaatcgcaacaggcatcttaccattatcacccttgttcctccaacaaccgtcagccctattacagcagttacctttggtccatttggtggcacaaaacatcagggcacaacaactacaacaacttgtgctagcaaaccttgctgcatactctcagcaacatcagtttcttccattcaaccaactggct

SEQ ID NO: 31904 - DNA, 302 bp, Zea mays
  Clone ID: LIB3059-014-Q1-K1-F8
ctcgttcctgccctcggccctccccaactccagcaggcagatcagatacatccatgtcgggaccggaagtaatcatcaggaaaggaaagggttgaaccatgagcgccgtggctgtttcgtcgtcgcttaacccggacgcgccgctcttcatacccgcggcgctgtttcacgtggaggacttttctccgcagaggtgggacctcatcaccaccactgtctgggtccgcgaccactgttcccgcgagcgcgcccacatgtacacgatagcccagcacatatacacgggcgggctctccgacgac

SEQ ID NO: 31905 - DNA, 272 bp, Zea mays
  Clone ID: LIB3059-014-Q1-K1-G10
gaggaggaagaagaagctgagtgtgataagacagttagggaggttcgcgagagcgtgtagctggatatgacctcactgcacatctaaatgctgcctgtgaggctgtgacgtgtctgtagataattggctttattgtctgctgaatttggtagaacttatgcaattctggcgtcagatatagtggtctatataagccttttccatcctgtaatatatttgttttgttgaactgtatgtgtggtactccgtatatgggtttgttctaagggagc

SEQ ID NO: 31906 - DNA, 399 bp, Zea mays
  Clone ID: LIB3059-014-Q1-K1-G11
ctactatactatactctaggaagcatggacaccaccgccatggcagccaagatgcgggcattgttcgctctcctagctctttgtgcaagcgccactagtgcgacgcatattccagggcacttgccaccagtcatgccattgggtaccatgaacccatgcatgcagtactgcatgatgcaacaggggcttgccagcttgatggcgtgtccgtccctgatgctgcagcaactgttggccttaccgcttcagacgatgccagtgatgatgccacagatgatgacgcctaacatgatgtcaccattgatgatgccgagcatgatgtcaccaatggtcttgccgagcatgatgtcgcaaatgatgatgccacaatgtcactgcgacgccgtctcgcagattatg

SEQ ID NO: 31907 - DNA, 417 bp, Zea mays
  Clone ID: LIB3059-014-Q1-K1-G12
cacgcgtccgaagagttcttcagcgccttcgaggaggagatggaggtcaagcggcggctcgagcaggggcaggcggcgctcgagggcgccactgaagacatggacctcatgggccggctcctcgatgagctcgacctgctgcagcgccgctcccaggacgtggacctcgacatggtggacgtcaaggtgcagaagctcatgccagagctcgggttcatgcctgaggacgccgaccgcctcgtcgcctccttcagcggtgggtggaaaatgaggatgtctctaggcaagatacttcttcaggaccctgatttgcttttgcttgatgagcctacgaaccatgtcgatttagataccattgagtggctggagatgtatctcaagacgcaggatgtgccgatggtcattatatctcatgac

SEQ ID NO: 31908 - DNA, 426 bp, Zea mays
  unsure at all n locations
  Clone ID: LIB3059-014-Q1-K1-G4
tcccggtggacgccacgcgtccggggccttctcccgtcaccgtccacgttaccggattcaagaggttccatggagtnccctgggaccctacggagaggatcgtgcgcggtctccagccattcatggagacgagagggttgcccaagggccttgttctcgggagctgcaccgtccttgaggccgccgggcagggcgcgcttggcccgctgtatgaactgctggagtcgaccgtctccggccgggaacgtcaggagcgagtaattctgctccattttggcgccaacagtggttcacataggtttgctcttgagaatcaagctgttaatgaagctactttccgttgccctgatgagctaggatggaaaccacagaggacacctatcatatcttcagatggaagcatcttacactcaagacatacttcac

SEQ ID NO: 31909 - DNA, 357 bp, Zea mays
  Clone ID: LIB3059-014-Q1-K1-G5
cccacgcgtccgcccacgcgtccgcccacgcgtccgcgagattctgaatgtaatatagtagaatcatctataagctgtcggatatcatgtatctcttacaaaaaaaaaaaaaaaaaaaaaaaaaaaaaaaaaaaaaaaaaaaaaaacaaaaaaaacaaaaacaccaaacaaaaaaaaaacaaaaatacaacataacaaatcatatatagatccaccatgacgcaaaccgcccgcctccctacaacaacgtccgcatctaaaacaaccctgtcgctacccaacatacccttacagcacaacaccctggtttcaccagatgatgtaacaaccaatagtcccgcacataccgatcttacc

SEQ ID NO: 31910 - DNA, 417 bp, Zea mays
  Clone ID: LIB3059-014-Q1-K1-G6
gttggcttctcctcccccaccggttcgtgttcaggttctggttcgtgggcgagaggggggagatggcggcgtcggacgttgagtaccgttgcttcgttggcggcctcgcctgggccaccgacgaccactccctcaacaacgccttcagcacctacggcgaggtcctcgagtcgaagatcatcctggatcgggagacgcagaggtcccgcggcttcggcttcgtcaccttctccacggaggacgcgatgcgcagcgccatcgagggcatgaacggcaaggagctcgacggccgcaacatcaccgttaacgaggcccagtcccgcggcggccgtggaggcggcggtggcggatacggtggcgggcgccgtgatggaggcggctacggcggtggcggtggaggctacggcggtggtcgtg

SEQ ID NO: 31911 - DNA, 371 bp, Zea mays
  unsure at all n locations
  Clone ID: LIB3059-014-Q1-K1-G7
gtggggcagataccacagaactcaactctcatcttcgatgtggagctggtgaacgtagaatgaagtgagaagatccacgagaaactgcggcagtttcacaaattttgctacgcatcattttccttgggcaatgctgtttcgtaggcataggggcatgttaagtggattcatctctgtcgctatcatactttcgaactgagtttcagaaggaaaaaaactgtggactgttgccatctgggataattcctgggctgcagcattcgccatccttctcccggttccttcagggtcattttgacattcttgtgataccctcagaaccttttgaactgatgaaatggttaaggtggagtaaaaaaaannnaannnaa

SEQ ID NO: 31912 - DNA, 419 bp, Zea mays
  Clone ID: LIB3059-014-Q1-K1-G8
aattacagtcatgtcattcttcctgttggccccggtaaccttacttacagaaggtgggaaagttagtccagcaggtttgcagtctgctggtttgaacttgaaacagatatacacaaggtcattgattgctgcatgctgcttccatgcataccaacaggtgtcatacatgatcctcgccagggtatccccagtcacacattcagtgggcaattgcgtcaagcgtgtggtggtcattgtgacctcggttctgttcttcaggacccctgtttctcccatcaactcactcggtaccgggatcgctcttgctggagttttcctatactcgcaattgaagaggcttaagcccaagcccaaggctgcttgatcatagacctttgcaggtccatccaatagaacttttgaagttatgctatgccatt

SEQ ID NO: 31913 - DNA, 123 bp, Zea mays
  Clone ID: LIB3059-014-Q1-K1-G9
cccacgcgtccgcaatgatgggttgttggtagaacactgctgggtttcttatgaggtgtagttcaataataaagtgttttatctgatgtttgtggcttcccagaaataagaaattacatttct

SEQ ID NO: 31914 - DNA, 389 bp, Zea mays
  Clone ID: LIB3059-014-Q1-K1-H1
cggacgcgtgggcggacgcgtgggattgagaccaacaagcaacatagaaagcggaatggaggagcaacaatagagcaacaatggcgaccaagatattttccctccttatgctccttgctctttctacatgtgttgctaacgcgacaattttccctcaatgctcacaagctcctatagcttcccttattgccccataccttccatcaattatagcttcaatatgtgaaaacccagctcttcaaccatataggcttcaacaagcaatcgcagcatgcaacatacctttatcgcccttgttgtttcaacaatcgccagccctatctttggtgcagtcattggtacaaaccatcatggcacaacagctgcagcaactcgtgctacctctgatc

SEQ ID NO: 31915 - DNA, 274 bp, Zea mays
  Clone ID: LIB3059-014-Q1-K1-D6
cccacgcgttcgacctcactaacaccgagctagcagctcgctctgtcctgcaacaaggcccgctcgctcctgctcccagcagctggtcaaggcggccgtactggcaggcgcgctgctgatgctggcggcgggggccggaacggcttcagctgcggagagctgcatgccaggtgaccacttctgacgagacgtgccttagatacgcaatacacagaacggcattctccaacatgacgagctgcacctgggtgcgctagattaacagacgtgcgtc

SEQ ID NO: 31916 - DNA, 416 bp, Zea mays
  Clone ID: LIB3059-014-Q1-K1-D8
cccaggaacagagcgaggcgacgccgctgcacctcttctccggcgaagggaaatgcgaccgttccaggggatctgatctggcaggttgtgaggaagaacaactccttccttgtgaagcagttcggcaacggcaatgccaaggtgcagttcaccaaggagccgaacaacctctacaacatccactccttcaaacactcgggtttggcgaacaagaagactgtgacgatccagccagctgcaaaggactcggctgtggtcctctctactaccaagaccaagaagcagaacgcacctgcgaagctcagccacaagtctgtgatgcgcaaggagttccgcaagatggccaaggctgtgaaaaaccaggttagtgacaactactacaggcctgatctgaccaagccagctcttgctaggct

SEQ ID NO: 31917 - DNA, 423 bp, Zea mays
  Clone ID: LIB3059-014-Q1-K1-E1
gaaagtggaatccagtagcaacaatagagcaacaatggcgaccaagatattttccctgctgatgctccttgctctttctacatgtgttgctaacgcgacaattttccctcaatgctcacaagctcctatagcttcccttcttcccccataccttccatcaattatagcttcaatatgtgaaaacccagctcttcaaccatataggcttcaacaagcaatcgcagcaagcaacatacctttatcgcccttgttgtttcaacaatcgccagccctatctttggtgcagtcattggtacaaaccatcagggcacaacagctgcagcaactcgtgctacctctgatcaaccaagtagctctggcaaacctttctccctactctcagcaacaacaatttcttccattcaaccaactgtctacactgaa

SEQ ID NO: 31918 - DNA, 183 bp, Zea mays
  Clone ID: LIB3059-014-Q1-K1-E11
cccactcaacacacccatcctccactactaccacactttttccaacctactaaccactcatcatccaatgatactattataacttctgtaaacatccccacctcactctccatcaactcaacaaatacatctactattccacactactcactccccaccaataacactataccacatatcctc

SEQ ID NO: 31919 - DNA, 425 bp, Zea mays
  Clone ID: LIB3059-014-Q1-K1-E12
ggatgttggacttaatcagattgcactatttgaaggaaaagttgctggtggaaatgggtaacaagttcttagccgagacatatatagactcggacaactttttgactttttcaggatgttatctttctacgtgacaactgttggattctacttctgtactatgctaaccgtgctgaccgtgtacatatttctctatgggaaaatgtatctggccttatctggtgttggagaatcaattcaaaatagagcggatatactgcataacgccaccttgaatgctgctctgaacactcaatttcttttgcacattggtgtatttactgctgttcccatgattcttggtttcatccttgaatcaggtgttttaacggcttttgctcagtttattacaatgcagttccaaatgtgctctgtatttttcactt

SEQ ID NO: 31920 - DNA, 378 bp, Zea mays
  unsure at all n locations
  Clone ID: LIB3059-014-Q1-K1-E2
gacgatggtgctcctcgagcccctgaatactttaacggccctgtcaatgctcatgctaanggancctacctncgacataaggctgggcagcctcagcataccgaaaggcaacgggatcgccatacccgtcccgttcctccaccgagacagagaggtctggggcgacaacgccaatgacttcgatccgttgaggtttcagaacggggtcacgaacgcggccaagaccccgcaggctcttctgtcgttctcgatcgggccgagggcatgcatcggccagaacttcgcgatgctggaagcgaagtcggtgatggccatgatcatgaagaagttctccttcacgctttccttgagctacgtgcacgctcctgaggatcatat

SEQ ID NO: 31921 - DNA, 352 bp, Zea mays
  Clone ID: LIB3059-014-Q1-K1-E3
cggacgcgtgggcggacgcgtgggaccaactggcatcattgaactctcctgcttattgacggcagcaacaactactaccattcagccagctagctggtgtgagccctgctgccttcttgacacaacaacagttattgccgttctacctgcacgctgcgcctaacgctggcaccctcttacaactgcaacaattgctgccattcaaccaacttgctttgacaaacccagcagcgttctaccaacaacccatcattggtggtgccctcttttagatttcttatgagttatagttcaataataaagttttttgtctgatgtttgtggcttcccagaaataataaagtccatttct

SEQ ID NO: 31922 - DNA, 403 bp, Zea mays
  Clone ID: LIB3059-014-Q1-K1-E6
gttaattactctggaaatggccacatgcagagccccaacatcaacagcaacactgatgctccggttaatccgaacatagaagctgtcaaatggttcttcaaggaacggcttgatgttaatccaaaagaggagagcaggacattcttgacatttgtcatccctcatcacaaagaaccacttctgacgagattctttggagagttgcaagacagggaaggggagtttggaatatcagacattcaactcggtctgacaacacttgaagaggtgttcctgaacattgcaaagcaggcagagctggagacctctactgctgaaggtaccctggtgactctcaacctgtcatcaggaacaacaattcagattcccaaggaggctcgtttcgttggtattcctggaactg

SEQ ID NO: 31923 - DNA, 265 bp, Zea mays
  Clone ID: LIB3059-014-Q1-K1-F1
accgcactctacaccgtaacacctctcatctaaccaccgcagccctactaacaaagaaagacgcttatcacgatgtccagtgcacctatactcgttcaacaccaccttttccaacaacatttgcaccatcacaatacacctattatcacttatccttaagagctactcacttcacactactttcaccacccactttccataatcaactgactgtttctaactctactgcatacctacaacatcgaccacaaacacttaatccact

SEQ ID NO: 31924 - DNA, 516 bp, Zea mays
  unsure at all n locations
  Clone ID: LIB3059-014-Q1-K1-F10
cggttccggaatttcccgggtgcgacgccactgcgtctccgttgcttacccagaggttaatggggtcttgagntagtattnnntccaattgcatttattattttatttaaatgtccacactcctaagtgatctgctgtttatttnnngtcaattaagggtcacttagtcaanngcttgcagccnnttaaagggaccctcgatgcaaggctttanngggagatnccgaagnnctatttggnnatcttgtaattgatcgggaagcttcccatctgaatcatcgaaatttntgtactcattttgcaggatgtnnctttaatctccttccaaattntgaactgtaaatgagccctaattaaagccttttgcagtgaaaacataacgaccatgatgtttggtgaatataacctgtctttctctgatcccggaagcgtcatttgcgccttctnacaatttaatcanacaattaagatgcttaaacaaaggagcatcgagaaaggccgaggggattcgaaacc

SEQ ID NO: 31925 - DNA, 204 bp, Zea mays
  Clone ID: LIB3059-014-Q1-K1-F12
tccaatcccaatccatctccgggcattccggcgcgtttagttcattaggtcttctttctcatcgggggctagtgttattttacctttcttcttttctgtctattggttaattggttccccctgaatgtttttttgtttgtatagagagagaaagagaaaagaaggttagaagagaagcaagagaaatagatgaatcaaagtggt

SEQ ID NO: 31926 - DNA, 405 bp, Zea mays
  unsure at all n locations
  Clone ID: LIB3059-014-Q1-K1-D3
gcgcaagttgttgtagttgttgtgctatcaaaccttgctgcctactctcagcaacancggtttcttccattcaaccaagtagctgcattgaactctgctgcttatttgcaacaacaactaccattcagccagctagctgctgcctacccccaacaatttcttccattcaaccaactggcatcattgaactctcctgcttatttacagcagcaacaactactaccattcagccagctagctggtgtgagccctgctgccttcttgacacaacaacagttattgccgttctacctgcacgctgcgcctaacgctggcaccctcttacaactgcaacaattgctgccattcaaccaacttgctttgacaaacccagcagcgttctaccaacaacccatcattggtggt

SEQ ID NO: 31927 - DNA, 399 bp, Zea mays
  unsure at all n locations
  Clone ID: LIB3059-014-Q1-K1-B7
gtttcttggagctgcgcaaaaaactaacagaataccatacatgtacatatacaanagtncaagcttctgacaacagagcacagcacacaacaatacaatacactggagttcttaaggtaaccattacaatcaggcagctaatcgttggtgcagtttcaacacatatatagttccgcataccgcaggaaactatatgcatgcatcgacattatttggggggcatcggaccggagcatctcatatccatccagaccgaccgtgctcgtcagggtccgccatgtcctcgttcagctggtccatgtaggcctgctgatggtaccgtgtctgcagggaaggatcattgccatggtgctgaaggagtccctggaacggaccaagaacactactcccactgtgccc

SEQ ID NO: 31928 - DNA, 338 bp, Zea mays
  unsure at all n locations
  Clone ID: LIB3059-014-Q1-K1-B8
gaatggccgagataaccctagagccgagtgatcttatggcgcaaacaaacaaaaaagtantgccaaagttcactgaaatcttccccgtggaggacgcgaactacccttacagcgccttcatcgcgtcggtccggaaagacgtgatcaaacactgcaccgaccataaagggatcttccagcccgtgctgccaccggagaagaaggtcccggagctatggttctacacagagctcaaaactaggaccagctccatcacgctcgccatacgcatggacaacctgtacctcgtgggcttcaggaccccgggcggagtgtggtggcagctcaatggcgactgg

SEQ ID NO: 31929 - DNA, 416 bp, Zea mays
  Clone ID: LIB3059-014-Q1-K1-C1
atgttcatacctttcgggcttctttgtctccaaacttcaaatcatattgcagaaatcgtctgaccgctatgatgttgactgtgtgcctgatgcttacagaggaaataggcaagcttatattaaggacagctcgatttctaagaactgtactctggaagcgaaggttctggaatacatgagagcaccaatttatgtttattatgaacttgagaatttctatcagaatcaccgcaggtatgtcaaaagtagaagcgataaacagctgcgttttggggcaaaatacacggccgactcgtgcagtcctgttgagtgggataataatggttccccaattgttccctgcggcttgattgcctggagcttattcaatgatacatatggttttactcgtgggtccaaggaaataaaggtcaaca

SEQ ID NO: 31930 - DNA, 384 bp, Zea mays
  unsure at all n locations
  Clone ID: LIB3059-014-Q1-K1-C12
cccacgcctactcgtacgcgtgtagtcaagatcctctacagctagatctgccacaccaggatgtacttctgggatgccaaagggcatactcccgtgtaccctcagatctttggccaccaagctaaacgtattataaacagtgttgtagatggtgatactgacctaacgtacaacgaccatgtcctacctgtgttcactgtgcagtgcattgagacgatacacactgcaagctggctatatatcaacatgtgtgcaccgctgangatcaacaccgactcgtactgagatgatcgccgatagcaatacccaggttctaaatcaactacaagcctatataccactttggaaacacttacaccttgatcgagtacaccgacatgcata

SEQ ID NO: 31931 - DNA, 259 bp, Zea mays
  unsure at all n locations
  Clone ID: LIB3059-014-Q1-K1-C3
ggtgggttggcttctcctccccctccttttcgggttcgggttcgtgaggttctccgnagttacttttcaaaaatgagcggatcgagatagcatcatacaatgttgagtaccgctgcttcttcagcagcctcgcctgtgccacagactaccactcacttcacaactccttcagcacctacagcaaggtcctctagtccaaaatcattctagatcggcaaacacaaaaatcccacgtcttctacttctttaccttcttcac

SEQ ID NO: 31932 - DNA, 312 bp, Zea mays
  Clone ID: LIB3059-014-Q1-K1-C4
ccgtccatgaggaaattcttgctggctttgggcttcagcaaggggcagccccacttctgctagttcatcttcaaagggatcgacgcccggttcctgagcgaagccctgggcgtcagcatgcacgtcgccgagaagctgcagagccggcgtgaccagcgaggcgagatcgtccgcgtggagccggagcacggctttcaccagctgaatccgtcgccgtcgtcgtcgtcgttttcgttcccatcgtcacaagtccagtaccaaacttgccagctcgacgtcgacaggcacaacttctgcgccatggaggtgatg

SEQ ID NO: 31933 - DNA, 420 bp, Zea mays
  unsure at all n locations
  Clone ID: LIB3059-014-Q1-K1-C5
ctttcaagatggacgacaagttcaaggagatcgttgtggaccaggtcggggatggcggtaccagctacgaggacttcacaaacagcctccccgagaatgactgccgatacgcgatctatgatttcgactttgtcactgcagaagatgtccagaagagcaggatcttctatatcctatggtccccatcctccgccaaggtgaagagcaagatgctttatgcaagctcaaaccaaaaattcaagagtgggctcaatggcattcaggtggaactgcaggctactgatgcaagtgaaatcagccttgatgagatcaaggatcgggctcgctaggcatcatgatcatgcatcatggactcggcctactactgtggatttgtatgccattatagactnggtgctgtgaaagactgcttgatgattt

SEQ ID NO: 31934 - DNA, 408 bp, Zea mays
  Clone ID: LIB3059-014-Q1-K1-C6
cccacgcgtccgcccacgcgtccgcccacgcgtccgcggacgcgtgggggcgtgcagattatggcacctaatgctggtgagatcatccacgaagctgtcgtcgccttgcagtatggagcatccagtgaggacgttgctcgaacatgccacgcacaccctaccgtgagtgaagccctcaaggaggcttgcttgcaaaccttcgataaagcaatccacatataatttctcattttttgtgtccaaactccaaagtttgtggtaattttgggtctgttggaaaaaaggcccctgattgtcattttgtttttgtcggccatactgtgaattgaccctttgagttgtccatcttagcggggttttgtgcttgcttggcttggtttatccatccaaataataacctgatactat

SEQ ID NO: 31935 - DNA, 411 bp, Zea mays
  unsure at all n locations
  Clone ID: LIB3059-014-Q1-K1-C8
cccacgcgtccgcccacgcgtccgcatagtcatgcgtcaagtaatactctggatnnggtnaatggttttgatggtacagatacacattactttcacagtggtccacgtggccatcactggatgtgggattctcgcctatttaactatgggaactgggaagttttaagatttcttctctccaatgctagatggtggctcgaggaatataagtttgatggtttccgttttgatggtgtgacctccatgatgtacactcatcacggattacaagtaacatttacggggaacttcaatgagtattttggctttgccaccgatgtagatgcagtggtttacttgatgctggtaaatgatctaattcatggactttatcctgaggctgtaaccattggtgaagatgttagtggaatg

SEQ ID NO: 31936 - DNA, 83 bp, Zea mays
  Clone ID: LIB3059-014-Q1-K1-C9
cccacgcgtccgcccacgcgtccgcccacgcgtccgcccacgcgtccgggaacagtggaaaatttatgcaagcatttctgctc

SEQ ID NO: 31937 - DNA, 410 bp, Zea mays
  Clone ID: LIB3059-014-Q1-K1-D1
aagaaatagaagaggggaatgcgtctggactaattgctgtggctcccgagtcagaagggatgatgatgccccatttatagatggaaaccaagcagagggtggtgcactgtgggatatttttcgacgggaagatgtgagcaaactgcatgattatctaatgaagcatgctgatgagtttagacattgcaactttgagccagtgaagcaggttactcatcctatacatgatcagtgtttttatctaacaattgagcacaagagaaagcttaaggaagaatatggagtcgagccttggacatttgaacagaagctaggtgaggcagtatttatcccggcaggatgtccccaccaggttagaaatttgaagtcttgcataaaggttgcactagattttgtttctccggaaaatg

SEQ ID NO: 31938 - DNA, 394 bp, Zea mays
  Clone ID: LIB3059-014-Q1-K1-D11
caattgcccaattacaacaacaatccttggcacatctaaccatacaaaccatcgggacgcaacagcaacaacaatttctaccagcactaagccaactagctgtggtgaaccctgtcgcctacttgcaacagcagttgcttgcatccaacccacttgctctggcaaacatagttgcataccaacaacaacaacaattgcaacagtttctaccagcgctcagtcaactagccatggtgaaccctgccgcctacctacaacagcaacaactgatttcatctagccctctcgctgtggttaatgcacctacatacctgcaacaacagttgctgcaacagattgtaccagctctgactcagctagctgtggcaaaccctgctgcctacttgcaacagct

SEQ ID NO: 31939 - DNA, 272 bp, Zea mays
  Clone ID: LIB3059-014-Q1-K1-D12
aaggaccttcggcgcccgttcaggatccacatcttcccgagcgagttcttggtgggcgtcttcctcttcggaccacctccaaggctcttggtgtagcttgccactctcaccaatcaagttttcatgtctgatctcgacattcagatcccaactgccttcgatcccttcgctgaggccaatgctggggactctggtgcggcagcagggtcaaaggactacgtacacgtgcgcatccagcagcgtaatggtcgcaagagcctgaccaccgtcca

SEQ ID NO: 31940 - DNA, 417 bp, Zea mays
  Clone ID: LIB3059-014-Q1-K1-B5
atgtctctggtgtttctttgttttccaattgcaaatgctctcattgcaaagatcaaggatgtgagtcctttagttgatgagcttgttctgctgctgctttattgtgcatatacagtgggtctctacctgcacctcgctgtgtcggttgtgcatgaaatcaaggatgcccttggaatctattgcttcaggataactagaaaggaggcttgaactttgtagtgaagatatattattattacttcacaagtgctagcgaggagcaacacagttcgtcaccgtgcacgctgggagtgtgtgtgcccctggaaatgccacagccatctgattgtattgcgcagttatcttggtcatataacaatatagcagtgtgatgtacactgtagtagggtcgttagaagatatactgtgataaacttg

SEQ ID NO: 31941 - DNA, 185 bp, Zea mays
  Clone ID: LIB3059-036-Q1-K1-G2
acttaccacactttatcattctcctgccatatttataacttttaaaacccaatccaacatttccaattccctaccgatttcaacattcccatctacactactaatcattctatcattcactctacacctccttcacacttccacataaccttccccattaacacatcttctcttaacttcccaac

SEQ ID NO: 31942 - DNA, 445 bp, Zea mays
  Clone ID: LIB3059-036-Q1-K1-G3
gtccaggacaccatcgaccccaacgcacggatcgagttccgcaagaacacccaggacgagccgcacaagcgcaagcccgacatcagccgcgccaaggagttcctcgggtgggagccgaagatccccctgcgtgagggccttcccctcatggtctccgacttccgcaagcgcatcttcggcgaccaagacgctactgccaccaccggaaaccagcaaggttaggatgaaggagcgcacatgacatggaaatttttggtggccctgcttctagctgcttggttgctctctccttactgacaaaagctatgggccacgtagttcgttgggaatgtgttactggaatacctcggctgatgctgtaatgccattctttttttcccctgtattttttctttctcagttctctcagtccttagctatacaaaaaaaaagttcagttgaacag

SEQ ID NO: 31943 - DNA, 444 bp, Zea mays
  Clone ID: LIB3059-036-Q1-K1-G4
caattggttattgatgaagctgaacgcattctccatgatgcactctgtgtcataaggtgcttggtcagcaagagatttttgattgctggtggtggtgctccagaaatagagatgtcaatgcagctggctgcttgggcaaaggagcttcgagggatggagagttactgcatcaaggagtttgctgaggcgcttgaggtcatcccttacacattggctgagaatgctgggctcaacccaatctccattgtcaccgaactcaggaatcgccatgccagaggtgagaagaacactggcatcaatgtgaggaaagggcagatcacaaacatcctggaggagaatgtcgtgcagccgttgctggtgagcacaagtgccattacgttagcctgcgagtgtgtcagaatgatcttgaagattgatgacattgtcactgttaggtaagagcgt

SEQ ID NO: 31944 - DNA, 444 bp, Zea mays
  Clone ID: LIB3059-036-Q1-K1-G5
cccacgcgtccgcggacgcgtgggtggcggtttctttcgcaaacctcagctccgagggggggcttaaaaagcttgatgagtaccttctcactcgcagctacatcactggctaccaagcttccaaggatgacttggctgtctacacttcgttttcgtctgctccctcgtccaagtatatcaacgtagcaaggtggtttaatcacattgatgcgctcgtgaggctgagcggaattactgcagagggccaaggtgtgaaggttgaatcgtcagcagttccttcagccccaactccagatgttgctgaagcacaggccccagttgctgaggaggacgacgacgatgatgttgacctttttggtgaggagaccgaagatgagaagaaggctgctgaagagcgtgctgcagctgccaaggcttctggcaagaagaaagaatctgggaagt

SEQ ID NO: 31945 - DNA, 342 bp, Zea mays
  Clone ID: LIB3059-036-Q1-K1-G6
gttaatgtgctccatgctaaaactggatcacgtttgggtacatcctcatctcattgtgcgagattcaaaatctcgatcacttccatccaactcgctacttcttcaatggctaccactctttcaaatataatttccctgtctacacaacgtcttcacttgcaaactcctgcaattacctaacttaatcaccttgcatcaaatacatctttgcgctcctgacgctttacctaataactccatacctacaaaccttccaaacagattcgcaagctgaatcttaaatgaaaactgcccttaatgctaacatacagcccatcacatataatgattacgaccacgatg

SEQ ID NO: 31946 - DNA, 442 bp, Zea mays
  Clone ID: LIB3059-036-Q1-K1-G7
aagaaagaatctgggaagtcatcagttttacttgatgtgaagccatgggacgatgagagtgacatggccaagctcgaggaagctgttaggagtgtccagatggaagggttgctctggggcgcatccaagcttgtcccagttggatatggtatcaagaagctgcaaatcatgatgaccatcgtcgacgaccttgtctctgtcgacactctcattgaggactatctgtgcgctgagccagttaacgagtacgtacagagttgcgacatagttgccttcaacaagatctaggcgtgactttcgatcagtccttcccctggggtgctggcgatggtggtggctgggcaatgcaccagcctaatttatccatagctatatgtctgctttgtgtggccagtgatattgccgtgagtatttttggatcctattcgagtcgaatgtacca

SEQ ID NO: 31947 - DNA, 437 bp, Zea mays
  Clone ID: LIB3059-036-Q1-K1-G8
gttaagtatgttatcagctatcttttcttggacactgtacaatacttggatccggtgggaaaagtttgtacctcttataggtttctatttagtttttttctgccaatctcttcaagctaactcatgtacgtgtatgaatcacattgttatagtagctaacaatgtcagtagtgtaccaatcaataactgtattgcagtcaagaaaatagtaatttccttgactgattttgacatccccatggctttaacagtttaaaaactgaaaattgattctactatatttgtgttttaaggccttagtgtaggcgtacaatctacgtcgacgccaaaattaaatcaccttcctacatccatagttgatatgaactggtgagattcttactgatgcactaaatttcaatcttaggatactctttaattgatgtatgctttgcttc

SEQ ID NO: 31948 - DNA, 425 bp, Zea mays
  Clone ID: LIB3059-036-Q1-K1-G9
cccacgcgttcgattcttcaacccttcctgatccaaccgggcattcggaacaaggccttctgccttttatcacccttgttcctgcaacaaccgtcagccctattacagcagttacctttggtgcatttgttggcacaaaacatcaaggcacaacaactacaacaacttgtgctaggaaaccttgctgcctactctcagcaacagcagtttcttccattcaaccaactggctgcattgaactctgctgcttatttgcaacaacaactaccattcagtcagctagctgctgcctacccccagcaatttcttccattcaaccaactggcagcattgaactctgctgcttatttacaacagcaacaactaccaccattcagccagctagctgatgtgagccctattgccttcttgacacagcaacagtt

SEQ ID NO: 31949 - DNA, 283 bp, Zea mays
  Clone ID: LIB3059-036-Q1-K1-H1
aaaaaaaaaaaaaaaaaaaaaaaaaaaaattaaaaaaaaaaaaaaacaaaaaaaaaaaaacggaaacttaaacaatatgatcccaacttacaaacacatacatccaacttcaaccctcttctatacctaaacctaaatccaatcaacttccccacttttaccaacatcataactcataaaaccattacctttctcaacttactacttcattccacaacatctccacttatctccacctatattcaatactgacaaacaccctcattccttcacctttcccaac

SEQ ID NO: 31950 - DNA, 428 bp, Zea mays
  Clone ID: LIB3059-036-Q1-K1-H10
gggtccaagtgaccaacaacagggtttcagctttgggcaaaacacatcaagttggtggaaccagccacttccccaggttgaacagtcacgagtggtcaggccgcatgcaacggttgctccatttgatttagagaagactagagaaggcagtgggttcaaaatatttggtttccaagttgatacaaccaatccatcacctgtccaattgagctctccattgtctgctatccgagagcatgtggtacaaactcgaccatcggcaccagtgaatgaattgcaacctgtgcaaattgagtgcttgcctgaggtgtccgtaagcacagctggaactgcagctgagaacattcagcaagtccagcaaagttcgaaagatattcaaagcaagtcccagggcgcttcaacaaggagctgtacaaaggttcataagc

SEQ ID NO: 31951 - DNA, 426 bp, Zea mays
  Clone ID: LIB3059-036-Q1-K1-H11
agcgtggattccaacccgaggtgccgtgtctcccaggctcgtggcgaatgccgttgtgtaccgataccatgtgctcgtcgggacaggctccactcagctctttcaggccgtgctgtacgcgctctcacctgcaagtgacggcacacccatgaacgtcgtctcaccggcaccgtactactcgtcttacccatctgtgaccaactatctaaactctgcgctctaccgttgggctggtgatgccaatacatttgatggcgacacatgtattgagctcgtctgctccccaaacaaccctgatggtggcctccggaagcctgtcatcaaatccaagtctagcaagcctgtttatgacttcgcctactactggccgcagtacacacccatcaccgaggcagctgcccatgacatcatgctgttcaccgtctc

SEQ ID NO: 31952 - DNA, 416 bp, Zea mays
  Clone ID: LIB3059-036-Q1-K1-H12
ccctggcttccaacgccgaggtgccggtttctccacaggctcgtggggaatgccgttggggacgggtaccatgtgctcgtcgggacaggctccactcagctctttcaggccgtgctgtacgcgctctcacctgcaagtgacggcacacccatgaacgtcgtctcaccggcaccgtactactcgtcttacccatctgtgaccaactatctaaactctgcgctctaccgttgggctggtgatgccaatacatttgatggcgacacatgtattgagctcgtctgctccccaaacaaccctgatggtggcctccggaagcctgtcatcaaatccaagtctagcaagcctgtttatgacttcgcctactactggccgcagtacacacccatcaccgaggcagctgcccatgacatcatgct

SEQ ID NO: 31953 - DNA, 433 bp, Zea mays
  Clone ID: LIB3059-036-Q1-K1-H2
atgttatcagctatctttttttggacactgtacaatacttggatccggtaaaaaaattttatacctgttatacgtttctatttagtttttttctgccaatctcttcaagctaactcatgtacgtgtatgaatcacattgttatagtagctaacaatgtcagtagtgtaccaatcaataactgtattgcagtcaagaaaatagtaatttccttgactgattttgacatccccatggctttaacagtttaaaaactgaaaattgattctactatatttgtgttttaaggccttagtgtaggcgtacaatctacgtcgacgccaaaattaaatcaccttcctacatccatagttgatattaactggtgagattcttactgatgcactaaatttcaatcttaggatactctctaattgatgtatgcttttcttcaat

SEQ ID NO: 31954 - DNA, 442 bp, Zea mays
  Clone ID: LIB3059-036-Q1-K1-H3
gactgaatcacggatcattcggattgcacgggggtctggtcgtcctgtcagggatgtcgtcgacatgctggaagagtataagcggcttgctaaaatctggggcaagatgaagggtctcaagatcccaaagaaaggggagatgagtgcactgtcccgcaacatgaatgttcagcacatgagcaaggtccttcctccgcagatgcttaaacagattggtggcatgggcggtctgcagtctctgatgaaacagatgggatcgaaggagatgagcggaatgtttggaggcatgggtggcgagcggtaattttacgtcctgtttttggtggatcgtcgctgtgaacttgtgatgctaaattgagagggtttagtgctgtggtctgatcatcgtcagagactcagaggtttccatgaagatcagcctgcgaacaggcttactgtagct

SEQ ID NO: 31955 - DNA, 444 bp, Zea mays
  Clone ID: LIB3059-036-Q1-K1-E7
cccacgcgtccgcccacgcgtccggaaaacccaattcttcaaccctacaggatccaacgtgcaattgcatcaggcatcttacctttatcacccttgttcctccaacaatcatcagccctattacagcagttacctttggtgcatttattggcacaaaacatcagggcacaacaactcgtgctagcaaaccttgctgcctactctcagcaacaacagttacctttggtgcatttgttggcacaaaacatcagggcacaacaactacaacaactcgtgctagcaaaccttgctgcctactctcagcaacaacagtttctgccattcaaccaactagctgcattgaactctgctgcttatttgcaacaacaactagtactaccattcagccagccagctgctgcctacccccagcaatttcttccattcaaccaactagcagcattg

SEQ ID NO: 31956 - DNA, 426 bp, Zea mays
  Clone ID: LIB3059-036-Q1-K1-E8
cgtacgctttccacaacagcctggggatgaatagagccaagacatgggggtactgaagagagctgcatgcatcatgaacgcacaaccatatgaatctattctgagaccgatcctgtgtgcacatggcattgccttgcttggctattgacctggcccagtacggactagagccaccagcatcagggcggacgtaccctgatataacatatatatctgtagttgcgtatgctgctaccggcggagtccgattctgcgccatatgttgttcgctatatattgggttgtgcgggattttgtagcactgtggttcgagagatgctcattgggagcgatggacagctctctgctcgtatttgtcatcatgatagtatctaacggcgctcgccgagattatgaagcaatgctctaactgtctatgaacacgac

SEQ ID NO: 31957 - DNA, 381 bp, Zea mays
  Clone ID: LIB3059-036-Q1-K1-F1
caactagcaacatagaaagcacaatagtgtaccaacaatggcagccaaaatattttgctgccttatgctccttggtctttctgcaagtgttgctaccgcaaccattttcccacaatgctcacaagctcctatagcttcccttcttcccccatacctctcaccagcggtgtcttcaatgtgtgaaaacccaattgttcaaccctacaggatccaacaggcaatcgcaacaggcatcttaccattatcacccttgttccttcaacaaccgtcagccctattacagcagttaccttttggtccatttgggggccacaaaaccatcaagggaccaaccacctaccacaaccttgtgctagcaaaccttggctgcatactctcagc

SEQ ID NO: 31958 - DNA, 298 bp, Zea mays
  Clone ID: LIB3059-036-Q1-K1-F11
cccactcattccaaagaaaataaaaaaattaaaaaaaaatataataaaaccaaaaaaaaccctaccactcaagagcatctcaaactttcttacacgtccatccaacgtcatatctctactatcatatcacctaaatacaattcactcaccatctttttacaacatacctacttaaaaaacctcaacattacccaacttaatcatcttccaacacattccattttcctcaactaccttaataccaaaaataccaccacccatccacctacctaacatttacccacactaaatacttaaa

SEQ ID NO: 31959 - DNA, 429 bp, Zea mays
  unsure at all n locations
  Clone ID: LIB3059-036-Q1-K1-F12
ggcagcgatgagtcgtcagagacgagatatgatgacactgaccataagggttcatctgggcccaagaaaaggaaatctggtaacacgtcggctgaaggtgaaccgtctcaagctgctgttgtgcgctatgctacggttgagtcgccatatcccgcaaagggaaggtctgcctcaaagcttccagtgtctgcacctggcagggcagcgcttcctagtgccaccccgaatctgaacattgggatggacatttggaatacttctcctgccttggctgttcctgcagtgcagggggaagcgaatcctgngttggcgcttgcccgacgtgatagcgttactcaactggatgaacgtgaattgaagagggagaggcggaaacaatctaacagggagtctgcaaggagatctaggttacgcaagcagcaagagtgt

SEQ ID NO: 31960 - DNA, 443 bp, Zea mays
  Clone ID: LIB3059-036-Q1-K1-F2
cccacgcgtccggccgtcgccgccctacggctcagatcttcgtcgtcatcttctccggggacgagcacccaaagatggtggtccttcaaccagatcggttcctgagcgagctgacgagcatgtacgagcggagcacggagaagggctccgtctgggtcaccatgaagcgatcaactctcaagggcaaggcacagttgcggaagatggagaataaggggcaggaggtagagcacaggtgcctcgtccgcgcctccaatggcaagaagaacatctccacctcggtttctctaaaggagtacacaaagtttcaagcttcatacgcaacagttcttaaggcccatatgcatgctctgaagaaaagggagaggaaagacaagaagaagactgcagatgctgagaaggcaattgagaccgcacccaagaagcagaagaaagcatcttca

SEQ ID NO: 31961 - DNA, 443 bp, Zea mays
  Clone ID: LIB3059-036-Q1-K1-F3
cccacgcgtccggctttgtcttgggaggtgccattgggctatctatgtcattctgcacgtgccgtatcttgacgatgccccatacattcatgagaaattaatcagggaagttttatcacagtattgtgagtcatggagtagagatgatgctcaaaggcaatacattgtagaacttggtataccagaagaatggatgcatgaagctctggctctttatcacgaatactatggagataaacagggtgcactggagaatttgattcagtgtggcaactggaagaaagctcacactattttcgtgacttctgttgctcattctatgtttctgtcatctaaccatcaggaggtctggaagatcacaagtgccttggagaaccacaagtatgaaattgctgactgggaccttggtgccggaatatacatagacttctacgttctgaaga

SEQ ID NO: 31962 - DNA, 431 bp, Zea mays
  Clone ID: LIB3059-036-Q1-K1-F4
ggttggcttctcctccccctccggttcgggttcgggttcgtgagggtcttccgggttggggttcctgggtgaacggatcgaaatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaagcggcggcggtgggtacggtggtggccgtggaagcggcggctacggcggtggcgggcgccgtgatggcggcggcg

SEQ ID NO: 31963 - DNA, 442 bp, Zea mays
  Clone ID: LIB3059-036-Q1-K1-F5
catgcatgcttcatcacattgttgactgcataacgaaacacatcgtcgtcggatcggggatgatgagttccgtcgtcgtggatgctgctgctaccagcagcagcgagaagaagacgtcgtggccggaggtggtgggcatgtccatcaaggaggcgacggagactattctcaaggacatgcccaacgcgtacatccaggtgctgcctgttgggtcgcccgtgacgctggaccttcgccccgaccgcgtccgtatcttcgttgacaccgtcgccatgactccgacagttgggtgatacataccaaatgcaataaacaaaccctactttttattttatgtttccagttaataataaaccaggccttagcttcttggttgtccttccttgggtggtgttagcttctaagctactagtacaccattaaaaaaaggaggacctcatgt

SEQ ID NO: 31964 - DNA, 285 bp, Zea mays
  Clone ID: LIB3059-036-Q1-K1-F7
gccatggaagaagggcacctagcgtggtggtgccttttttcctgtttgtgtaatatgggtgcagttttttttgtgggtgattcgtgatttgttgttgtacctatagtcgacgcaacaggagctctggcatttcgattcattctgtctagtgaaaggacactgccatcatatgccgataaaaataacgcttcgtatcaaaaaaaaaaaaaaaaaaaaaaaaaaaaaaaaaaaaaaaaaaaaaaaaaaaaaaaaaaaaaaaaaaaaaaaaaaaaaaagtaaaaaaga

SEQ ID NO: 31965 - DNA, 438 bp, Zea mays
  Clone ID: LIB3059-036-Q1-K1-F8
caggcagtcaaatgggagcaatacatggcagaactcaccaccctggaccattctcctgccatcctggtgaccagaagaaccccagccaaggtttccaagggccgtttgatggcagcaggcccatgtacacgacgaatcaggctcggatgcacgctccacctcctccacacttccacggagccttccccaggaacgcatctcctcttgagttcccagcggggttccggggagcctggccgtccgtgcaggcacctccgatgccggcaccgtcacatccatcgtctttcccgccgtttcagttgaggccaccgccaccgtcgcagcaggatatgtctggcgcaggcggcaccaggtggcccggtggcaatcaaatctacaacccttttgcaccaacggctgcggcggcggctcagagagcggaggctgaccctgagtacg

SEQ ID NO: 31966 - DNA, 283 bp, Zea mays
  Clone ID: LIB3059-036-Q1-K1-G1
tttcgcaaacctcatctcctagtggtggcttaaaaagcttgatgagtaccttctcactcgcagctacatcactggctaccaagcttccaaggatgacttggctgtctacacttcattttcatctgctccctcgtccaagtatatcaacgtaacaaggtggtttaatcacattgatgcgctcgtgaggctgatcggaattactgcatagggccaaggtgtgaaggttgaatcgtcagcagttccttcagccccaactccatatgttgctgaagcacatgcccca

SEQ ID NO: 31967 - DNA, 425 bp, Zea mays
  Clone ID: LIB3059-036-Q1-K1-G11
cactcgtagagagaaggaaaaatatccccaaaccctagctcccgatctcgatggcgaacgctcgcgtcttcttcgacatgaccgtcggcggcgccccggcgggccggatcgtgatggagctgtacgccaacgaggtgcccaagaccgcggagaacttccgcgcgctgtgcacgggcgagaagggcgtgggcaagtccgggaagccgctccactacaagggctccaccttccaccgcgtcatccccgagttcatgtgccagggcggcgacttcacccgcggcaacggcaccggcggcgagtccatctacggcgagaagttccccgacgagaagttcgtgcgcaagcacaccgcccccggtgtgctctccatggccaacgccgggcccaacaccaacggctcccagttcttcatctgcaccgtcgcg

SEQ ID NO: 31968 - DNA, 444 bp, Zea mays
  Clone ID: LIB3059-036-Q1-K1-E6
cccacgcgtccggaccaactagcaacatagaaagcacaatagtgtaccaacaatgggggccaaaatattttgcttccttatgctccttggtctttctgcaagtgctgctaccgcgaccattttcccgcaatgctcacaagctcctatagcttcccttcttcccccatacctctcatcagcggtgtcttcagtatgtgaaaacccaattcttcaaccctacaggatccaacaggcaatcgcagcaggcatcttacctttatcacccttgttcctccaacaaccgtcatccctattacagcagttacctttggtgcatttgttggcacaaaacatcagggcacaacaactacaacaacttgtgctagcaaaccttgctgcctactctcagcaacagcagtttcttccattcaaccaactggctgcattgaactctgctgcttattt

SEQ ID NO: 31969 - DNA, 427 bp, Zea mays
  Clone ID: LIB3059-036-Q1-K1-D12
agaccaactagcaacatagaaagcacaatagtgtaccaacaatggcagccaaaatattgggcctccttatgctccttggtctttctgcaagtgctgctaccgcgaccattttcccgcaatgctcacaagctcctatagcttcccttcttcccccgtacctctcaccagcggtgtcttcggtatgtgaaaacccaattcttcaaccctataggatccaacaggcaatcgcagctggcatcttacctttatcacccttgttcctccaacaatcatcagccctattacagcagttacctttggtgcatttattggcacaaaacatcagggcacaacaactacaacaacttgtgctagcaaaccttgctgcctactctcagcaacagcagtttcttccattcaaccaactagctgcattgaactctgctgc

SEQ ID NO: 31970 - DNA, 441 bp, Zea mays
  Clone ID: LIB3059-036-Q1-K1-D2
cccacgcgtccgaaaaaaaaaaaaaaattaaaaaaaaaaaaaaaaaaaaaaaaaaaaaagaaaaaataaaaaaaaaaaaaaaaaaaaaaaaaaaaaaaaaaaaaaaaaaaaaaaaaaaaaaaaaaaaaaaaaaaaaaaaaaaaaaaaaaggccgccctttttaaagatcccaattttacttccccttccttccaacttaatactttttttttaggtcccccaaaattaatttaattgccccttttttaaaaacttcttaattgaaaaacccttggctttcccaaattaaatccctttgcaaaaaatccctttttcccaacttggcttaataccaaaaagccccgaacaaatcccctttccaaaaatttccccaccttaattggcaattggaaccccccttttaccggcacttaaaccccggctgttttggggtttacccca

SEQ ID NO: 31971 - DNA, 438 bp, Zea mays
  Clone ID: LIB3059-036-Q1-K1-D4
cggacgcgtggggcaacatagaaagtggaatccagtagcaacaatagagcaacaatggggaccaagatattttccctccttatgctccttgctctttctgcatgtgttgctaacgcgacaattttccctcaatgctcacaagctcctatagcttcccttcttcccccataccttccatcaatgatagcttcagtatgtgaaaacccagctcttcaaccctataggctccaacaagcaatcgcagcaagcaacatacctttatcacccttgtttcaacaatcgccagccctatctttggtgcagtcattggtacaaaccatcagggcacagcagctgcagcaactcgtgctacctgtgatcaaccaagtagctctggcaaacctttctccctactctcagcaacaacaatttcttccattcaaccaactgtctacattg

SEQ ID NO: 31972 - DNA, 438 bp, Zea mays
  Clone ID: LIB3059-036-Q1-K1-D5
cagagcagccgcatccacaacctgcctctctcgtcccctggcggcgtccgcggcaggagggcggaatctacggcgaggacggtgaaggatgtcaacccgcacgagttcgtcaaggcctactccgcccacctcaagcgctccggcaagatggagctccctgagtgggttgacattgtgaagactgcgaggttcaaggagcttcctccttatgatcctgactggtactacatcagggctgcatccattgcaaggaagatctacctaaggcaaggcatcggtgtgggtggctttcagaagatctacggtggccgccagaggaatggctcccgcccaccacacttctgcaagagcagtggtgctgttgcacgcaacatcctgcagcagctgcagattatgggcatcatcgatgtcgatcccaagggtggacgcctcatcacc

SEQ ID NO: 31973 - DNA, 444 bp, Zea mays
  Clone ID: LIB3059-036-Q1-K1-D6
ctctgattattaacaagcttcgtgcaggcatcaaggtctgtgctgtcaaagctcctggttttggggaaaacaggaaggcaaacttacaggacctcgctatccttaccggaggagaggtaataactgaagagctaggaatgaaccttgagaatgttgagcctcacatgctgggttcatgcaaaaaggtgactgtctctaaggatgacactgttattcttgatggcgctggagacaaaaagtctattgaagagagggcagaccagattagatcagcagttgagaacagcacttcagattatgacaaggaaaagctccaggaacggttggcaaagctctctggaggtgttgctgttctgaagattggaggagccagcgaagcagaagttggtgagaagaaggatagagtgacagatgcactgaatgctactaaagctgctgttgaag

SEQ ID NO: 31974 - DNA, 429 bp, Zea mays
  Clone ID: LIB3059-036-Q1-K1-D9
atgcgaattcccaggcaggcaggtcggttaggagggcaggaagaccgaagaccgagccgtgcgggggctcgggacgggaacgggacaggaccccaaaatctcagatccttcctgcccgcccgcccgtgcccgtcgacgcgtcgttcttgccggccgcgccccacctccgccctctcctcctccagggggatcggatacgccacaggctgcgcgatggtgctgtgggtcttcggctacggctccctcatctggaaccccggcttcgacttcgacgacaaaatcctcggcttcatcaagggctacaagcgcacctttaatctcgcttgcattgaccacagaggcacaccggagcatccggcgaggacctgcacgcttgaaaccgacgacgaggccatatgctggggaattgcatattgtgtcaagggtggt

SEQ ID NO: 31975 - DNA, 369 bp, Zea mays
  Clone ID: LIB3059-036-Q1-K1-E1
ctcggcggccggcctcctcttctcttcacccacacgctggtcatagagatgtcggctgcggaggcgaaggcggcggcggtcccggagtctgtgctgcggaagcgcaagcgggaggagcaatgggcagcggacaagaaggagaaggcgctcgcggacaggaagaaggcgctcgagagccgcaagatcatcttcgcccgcgccaagcagtacgccgaggagtaccacgcccaggagaaggagcttgtgcagctcaagcgtgaggcccggttgaagggtgggttctatgtgagcccagaggccaagcttctgtttgtggttcgcatccgtggtatcaatgccatgcaccccaagacccgcaagatcttgcag

SEQ ID NO: 31976 - DNA, 427 bp, Zea mays
  Clone ID: LIB3059-036-Q1-K1-E11
gagaccaactagcaacatagaaagcacaatagtgtaccaacaatggtagccaaaatattttgcctccttatgctccttggtctttctgcaagtgctgctacgacgaccattttcccgcaatgctcacaagctcctatagcttctcttcttcccccatacctctcaccagcgttgtcttcagtatgtgaaaacccaattcttcaaccctacaggatccaacaggcaatcacagcaggcatcttacctttatcacccttgttcctccaacaatcatcagccctattacatcaattacctttggtgcatttattggcacaaaacatcagggcacaacaactacaacaactcgtgctagcaaaccttgctgcctacgctcagcaacagcagttacctttggtgcaattgttggcacataacatcagggcac

SEQ ID NO: 31977 - DNA, 420 bp, Zea mays
  Clone ID: LIB3059-036-Q1-K1-E12
ggaatctaccaattgcttttcgtctcctgtccatcccttgggcgctaccgctcctctggcttggcaacgacgactggcgccgccgctgccagacttcgctgggcatctcgccggcgacgagctcccaccaggattagagaaggtgatggcgaggagtgacagctgcctggcgcgcgtgggtgccggagttgcgatcggtggcgcggtcggcggagccgtcggtgcttgttatggaacttttgaggcattcagatacaagatccctggattgctaaagatcagacatatcgggcaaactactgttggcagcgctgcaatttttgggcttttcttgggggctgggagcttgattcactgcggaaaatcctactagtttgtttccctcctttttctgaacacgactttgtcgatgtgcttcag

SEQ ID NO: 31978 - DNA, 442 bp, Zea mays
  Clone ID: LIB3059-036-Q1-K1-E2
gggagtgcagacagagctagggatgtcccaaatgattctacgagttcccgtcaacatagccgcgaccaaattgatgagcctaattctaaaaggcaaagaactagtgactgattggaatctacttgtgagctgagaatcttgccagttcttgatttaccccagcggatgatcaaaataaggacttgagacaaatggtggcagtattgagacaaaaatggattagctgtggtatatacttggcactgagggcactagacgaggcacctatgccttttttttttgagggggcgcatcttataagctgttatttttttagtgcaacgagcatacatgctgctggcatccaatccccaatatgtacaagttttaattcaggttgtgatcatttacgcaacgaatcaaagccttcgctctggtcattgccgtagcatacggaggactg

SEQ ID NO: 31979 - DNA, 434 bp, Zea mays
  unsure at all n locations
  Clone ID: LIB3059-036-Q1-K1-E3
cccacgcgtccgcccacgcgtccgggcagccagtcagccagaggagcctagagccagtggcgtcccgtccatcagccgccacaccacaaacacccaccactctgctctcgcccgcttgctttctctcccccgctccagcttatggcggaggcggcgccagcagccggcggcggcatcggggacatcctcgccacgagcgatcgggacttcctcgtccgcaactccggcgagcaggtgaagatcagcagcgttgaggcgagccctgtggccatctacttctccgcctcatggtgcccgccatgcaggaggttcacgcccaagcttattgaagtatacgaaaaactggcctcacagggcaagagcttcgaggtcgtctntgcttcggccgatcgcaatgaggaagctntcaatgaatactntgcaaagatgccatg

SEQ ID NO: 31980 - DNA, 443 bp, Zea mays
  Clone ID: LIB3059-036-Q1-K1-E4
gtcaagggtgatgctgaaaggaacttctttgttgagctttgggatgtttctggacatgagcgctacaaagagtgccggtcacttttttattcacaaattaatggtgtcatatttgtttatgacctctcccagaggaaaacaaagacaaatttgaacaagtgggcagtggaggtttctgaatctgggaccttttcagctcctcttgggtctggtggtcccggtggccttccagttccttacctagttattgccaacaaagtggatattgctccaagagatggtagaagagtgagcagtggtaatcttgttgatgttgctcgtcaatgggttgaaaaacaaggtctgcttccatccagtgaagtgcttccacttgcagataactttcctggcaattctggtttgctcacggctgccaaagaggcaagatatgataaagaagctct

SEQ ID NO: 31981 - DNA, 428 bp, Zea mays
  Clone ID: LIB3059-036-Q1-K1-D11
caagcagcaataatatttgactcgtcgatattatacaattccatgatcccgtgcagcagcgccagtactgtactcctccttttcatcttatacaacaccaaaagaatggatcgaaattcgtaacacatgacaacaggatgacaattacaagtgattaaaaaaagcacacatgtgaggggggaaaaggaaggaaactccgggaagaggctacgccaatgatggaaagatgcactaagctcaccggcgccgcctggagactacaggggaacttgtaccagtctgctgccttctaaaactaggcgaggacgtttggacgggagcatgctgtgcttggtaagaagaatgtgcggcaggctttgggcctgctggcgcagctgttggttgaagggtcgactccatgaaacaggctatgttcaatcgagtcctct

SEQ ID NO: 31982 - DNA, 428 bp, Zea mays
  unsure at all n locations
  Clone ID: LIB3059-013-Q1-K1-H6
cccacgcgtccggggaggtggagaaaaggtagttagtaaagagattaagccagcaagagatgaggtgatcgacaaggacctattgcaggccttcaggtactttgacataaatggagcaggatatctcaaggttgatgatttaaaatgtattcttcacaacatggggaagtttttatcaaacaaggacctgaaagacttggttcaaattgctcttgttgagagcaattctgcaagggacaatcgcataatctatcctaagcttgtgaagattgttgacctgtaatctggcactgcttggcccgcgtcagtccccttgaagttaaccatgctatgatcgttgagaagtcaattatgagaaactanttttgttacttattaatgggttcactgccatttttgtggctaccctgttctacgattatgctaca

SEQ ID NO: 31983 - DNA, 160 bp, Zea mays
  Clone ID: LIB3059-013-Q1-K1-H7
tctttactatctttcctaattctatctaatccagtcaactatttatttctcatataaatcatctactacaccataataaattcttttatatctcttaaaaattatttatctcatatcttatactttttacttacctttatataattaatttaatttattc

SEQ ID NO: 31984 - DNA, 223 bp, Zea mays
  Clone ID: LIB3059-013-Q1-K1-H8
gccgggtgcgatgcatctcggacttctcgagtggtgtttgcgtcagacagccagccgctgtggggctagtgttccaacatttgtcagcctgcttgcgcgaggaaggggggtcactgactcaagagaagggcctggtcataggctgctgcattatgaatttctgatgatgtcttatgtctgtactctgaatcaactatgtatgagatctcatctcctttctcct

SEQ ID NO: 31985 - DNA, 418 bp, Zea mays
  Clone ID: LIB3059-013-Q1-K1-H9
cccacgcgtccgcccacgcgtccgcccacgcgtccggtgcgatatggagtaaaatccgtggagaattaggtggagaagaaggttaagttcaacgctccttaggtgttcgatggtacgctagttgaaaatcgtgcgaagcgaagggtgtggatcaaaacaactcacaagacgatgtcggccgatgatcctgaagctagatgaactaagcgggtgtcagaataaaagttgatcgtcaagtggccatcatctaacaacactaacatagtgttatcccaggttataattttgttctgttgtggatggtgctaagtgccggtgggctcggccttcttatataaactgcgatccatttccgagcttcgaggaatcaacagtcaagcttcggcgaccaagagatcgaactcttcgagttctacga

SEQ ID NO: 31986 - DNA, 428 bp, Zea mays
  Clone ID: LIB3059-014-Q1-K1-A10
cgcactggtatgcctctatgccggatttcactccaatcacctgccggagcagctcgaggggaggctgacgatatagaaaacgaagcaaacgagcttatccgcatcaagaactatctctatggcaagctcgcggggcacacaggccattctgtcgagaagatccatgaggacctgtctagggtgaagcgcttcgacgccgaaggggctctcgagtacgggatcatcgaccgtattgtcaggccgtctaggatcaagaaagagggctccactgctcaaaggagggacatgcggaatctgggacttggctaataatagacgatcgaaatcctgttgtatcagaattttttgtgcaaaggatgcgcttattatgggagagcgagcgatgcactgttccaagctctacgcccgcgtaggtgttttgttgtgtc

SEQ ID NO: 31987 - DNA, 433 bp, Zea mays
  Clone ID: LIB3059-014-Q1-K1-A12
cccacgcgtccggtttgttccaaaattgttgctcattttttggaatctagaggtatggggggagaggctcttgagatagccacggatgctgactacaagtttgacctagctgtgcagcttggaaaattagatgttgcaaaggctatcgtcatagaagcacagagtgaatctaaatggaagcagttgggtgaactcgccatgtccacaggcaagctagagatggcggaggaatgccttcttcaagcgaaggatttaagtggcttgttgctattgtactcatctcttggagatgctgaaggaattgaaaagcttgcttctttggcaaaagaacatggaaaaaacaatgttgctttcctctgccttttcatgcttggtaaaatggaaagattgcatacaggtgcttgtagacagtagccgtatacctgaagctgca

SEQ ID NO: 31988 - DNA, 421 bp, Zea mays
  Clone ID: LIB3059-014-Q1-K1-A3
cccacgcgtccgcccacgcgtccggcggttcatcgtccgcatcatattcttggggccggtaacgctctccgcccgccgctcacacccacaacaaaccctcgtggccaagggcgccctcgcgccagatctgtcgcctgccttcgctgtagcttttccgtatcggatgagctcgaggggtacggcccggtctgggttagtttcctggagaggttcccatgaatgttaggttgcgactgcgatggaattgaagtacaagtactcggtggaaagctttgctggtgcatgtgattctgactagaaggcgaatatagagccaccaccgtgcgctttgatgcgtgcaactgaattcactgatgttctgcggaggcgcatctgatcagtgtggatttctgcaacttgtagttttatcccgagtgttatg

SEQ ID NO: 31989 - DNA, 332 bp, Zea mays
  Clone ID: LIB3059-014-Q1-K1-A5
caacaatggctaccaagatattaaccctccttgcgcttcttgcgctggttgtgatcgcaacaaatgcgttcattattccacaatgctcacttgctcctagtgccattattccacagttcctcccaccagttacttcaatgggcttcgaacacctaactttgcaagccaacatgcaacaacaagcgcttgcggcgagcgtcttacaacaaccaattgcccaattgcaacaacaatccttgccacatctaacaatacaagccatcacaacgcaacagcaacaacagttcctaccagcactgaaccacctagccatggtgaaccctgccgcctac

SEQ ID NO: 31990 - DNA, 410 bp, Zea mays
  Clone ID: LIB3059-014-Q1-K1-A6
atcaatgctgctgagttggccagttatgatcaagtcaagcagtcaattttgaaacgtcgctgggttcaaagatgatgtggtcacccacctttttgctggtcttggtgctggcttctttgctgtttgtgttggttccccagttgatgtggttaagtcgagaatgatgggtgactcagcctacaaaagcactctcgattgttttgtgaagacgctaaagaatgatggccctttggcattttacaaaggcttcctgccaaactttgcaagactgggatcttggaatgtgattatgttcttgacattggagcaggttcaaaagctgtttgtgaggaaagcgacaagctgaagatagagtttttgcagtcaggtggcgtacaattgacgcacagggtttttcttctatagacaaa

SEQ ID NO: 31991 - DNA, 206 bp, Zea mays
  Clone ID: LIB3059-014-Q1-K1-B1
catcaagatcaacgtcaccaacatgaactaagtcaaaatcatcaaactaactcactacaactcctagcaccgaatatactccaactacattatctattaatcaaaccaagcttactattctgtatcactcccaacatatcaacttctctctatatatctattctatcttcatttccaaatccactctttcaccttgctggtattat

SEQ ID NO: 31992 - DNA, 426 bp, Zea mays
  unsure at all n locations
  Clone ID: LIB3059-014-Q1-K1-B12
cccacgcgtccgcccacgcgtccgcccacgcgtccgctcagatacagctggaggcagttgtgtgnggaattgggactgcgcttggtgagctccctccttattttatatcacgagcagctcgcttatcaggaagcgagtcaaaagctgttcaggagcttgatgcagctacttccaaagaagatgggccagtagcatcatcccttaatcgaaccaagcgttggcttctctctcactcccaacatctcaacttcttctctatcttgattcttgcttcggttccaaatccactctttgaccttgctggtattatgtgtgggcaatttggtgtgcctttctgggagttcttggttgctactttgattgggaaagccatcatcaagactcatattcagacactatttatcgtgtccctgtgcaacaatcagc

SEQ ID NO: 31993 - DNA, 411 bp, Zea mays
  unsure at all n locations
  Clone ID: LIB3059-014-Q1-K1-B3
gtggtctcgatagaaatacttctcttacagtattttttgatgtctcaccgagtgaactagcnatccatccaggaaacgaaaatccccttatgtatatacaatttgtgacaagttaccaacacccagaaggtcaaatgaggataagagttactacgatatgcaggaaatgggtagatggttccactaataccgaggaattagttgaaggttttgaccaggaaactgcagctgttgtgttggcaagatacatctctttgaaaatggagatggaggaagagttcgatgcaacccggtggcttgatagatctctcatacgtctttgttcaagatttggggattaccggaaggatgatccctcttcatttagcctgcattcaaatttctcattgttccctcagtttatgtttaatc

SEQ ID NO: 31994 - DNA, 423 bp, Zea mays
  unsure at all n locations
  Clone ID: LIB3059-014-Q1-K1-B4
cagctctgctccccgccgctcctctccgcgccccttcatcccggatctcggcatgggcgcggccaccaccaacggctcggcggagcaggcgtccgcgcccgtgccggcgctcaagttcctcatctacggccgcacgggctggatcggggggctgctgggcggcctctgcgccgcgcgcgggatccccttcgtctacggcgccggcaggctcgagaaccgcgcccagctcgaggccgacatcgacgccgccgcgcccacccacgtgttcaacgccgcgggcgtcacgggccgncccaacgtcgactggtgcgagacgcaccgcgccgagaccatccgcgccaacgtcgtgggcacgctcacgctcgccgacatctgccggggccgaggggtcctgctcatcaactaccccacgggctgcatctt

SEQ ID NO: 31995 - DNA, 343 bp, Zea mays
  Clone ID: LIB3059-013-Q1-K1-H5
caggatccaacaggcaatcgcagcagggttgaagaattgggtattcacatactgaaggcccgctggtgagaggtatgggagaagaaaggaagctataggatcttgcaagcattgtgggaaaatggtctacgacaccttacatattataaacacgatctatactcatagaaacaacaatttcttacattcaaccaactggctgaattgaactctgctgattatttgcaacatcaactaccattcagtcagctagctgatgcctacccccagcaatttctttcattcaaccaactggcaggattgaactctgctgcttatttacaacatctacaactaccaccat

SEQ ID NO: 31996 - DNA, 378 bp, Zea mays
  Clone ID: LIB3059-013-Q1-K1-F8
gttggcttctcctccccctccggttctggttcgggttcgtgaggttctccggggtgggggttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaagcggcggcggtgggtacggtggt

SEQ ID NO: 31997 - DNA, 402 bp, Zea mays
  Clone ID: LIB3059-013-Q1-K1-G1
cccagctcttcaaccatataggcttcaacaagcaatcgcagcaagcaacatacctttgtcggccttgttgtttcaacaatcgccagccctatctttggtgcagtcattggtacaaaccatcagggcacaacagctgcagcaactcgtgctacctctgatcaaccaagtagctctggcaaacctttctccctactctcagcaacaacaatttcttccattcaaccaactgtctacactgaaccctgctgcttatttgcagcaacaactattaccatttagccagctagctactgcctactctcagcaacaacaacttcttccatttaaccaattggccgcactgaaccccgctgcttatttgcagcagcaaatactactaccatttagccagctagctgcagc

SEQ ID NO: 31998 - DNA, 413 bp, Zea mays
  Clone ID: LIB3059-013-Q1-K1-G10
cggacgcgtgggcggacgcgtgggttttttttttttttttttttttttttttaccctagagtagaaataacgagtgcatgtagtaaattgtcatattgcatcagttgataagttggtatctccggtgcaacttgcttgagtagttgagttgttgccaacactcaacactccacttgaaccacatattcttaaacattactagaacatcgaagagacacactacgcttacacaccgtcgtggaagaataattgaatagccccaataccacagtgatcgtgatctataaaggacaacaacatgccgttcaaggccccatttaatattaaaaggttttttaagtttaactactaatggtttttcctaagtttttttcaacaaccattgcttttgccggttttttttttgggatttt

SEQ ID NO: 31999 - DNA, 289 bp, Zea mays
  Clone ID: LIB3059-013-Q1-K1-G11
ggggatttgacaaactcgacttccggatctcgatcaccaaagttcgcccggatcgcaggtgggtcattcaaggccgtaacctgtacttagccggtatgcacatgtcgaagaacctctacgggaggtccacccacaagacagagggcctgatcaaattctaccactaccaccacttcataaacgtcattgaacagccttgccctgagtttgtgccaatgccagtcaacctgaccaagacgatgttccaaggggttccctatctataccacgataacattaaactattggc

SEQ ID NO: 32000 - DNA, 402 bp, Zea mays
  Clone ID: LIB3059-013-Q1-K1-G12
aagagttcttcagcgcctccaatgtttatgcctgcccgatttttccttgaacccatgccccttttactaacccgtgacccaaacgctggcgcggagatgccgatgcttcctatggcagcaggtataggtggtggcgccggtgggctccacctcaacggcgccgccctgttcggcaatccgatggccgcgccccagcccatgagcttctaccaccagatgggcacggggactgcttgcgcttgcggcttcgatgtttctgcccccgaaaataagccctcctcgatggtgtcgcaaaaagacgaccaggctaatggcgctgagatctcgtcgatgatgtccgtggccggcccaaggccttggaacaacaacaaccattaaaaatgattgcgtgtggaagtactg

SEQ ID NO: 32001 - DNA, 264 bp, Zea mays
  Clone ID: LIB3059-013-Q1-K1-G5
caattcaacaagctactttacatgcttctagtcctaggcaacttagcaattgaggataagcacattcatcagaacatgcacatgagcgtcaacttgcttgtttccctactaaagaaaaactgacagaatgtaagatgcatgtacatcaagagcaccatgaataatccatacagcgtgttctaagtctgctcttttgtgaagtctgctaagttctggcaccgaggttttattgaattaaactcttgttaaaagtatgtttttgga

SEQ ID NO: 32002 - DNA, 356 bp, Zea mays
  Clone ID: LIB3059-013-Q1-K1-G7
cccactcgtccgcccacgcgtcctaataaaaaaaaaaaaaaaaaaaaaaaaaaagaaagattaaaaaaaaaaaaaaaaaaaaaaaaaaaaaaaaaaaaaaaaaaaaaaaaaaaaaaaaaaaaaaaaaaaaaaaaagggcgccctttttaaagaatccaattttacttacccttccttccaacttaatactttttttatagtgtaacctaaattaaattaatttcccttctttttaaaacttcttaattggaaaaaccttggctttaccaaattaaatccctttgaaaaaaatccccttttcgcaagttggcttaataccaaaaagcccctaaccaatcgcctttccaaaaattttc

SEQ ID NO: 32003 - DNA, 421 bp, Zea mays
  Clone ID: LIB3059-013-Q1-K1-G8
ctttcaacaggaaaatcctctgagaaaactgatgtatttggctatggaattactctggtagggcttattacaggacaacgtgccttcgatctagctcgtcttgctaatgatgatgatgtcatgcttcttgactgggtcaaggggttgctcaaggagaagaaactggagagtctggtcgacgaagatctagaccacaactacatcgatgtcgaggtggaatctctgatccaggtggcgctcctctgcactcagagcaaccccatggaacgtcctaagatgtcggaggttgtgaggatgcttgaaggcgatggtctcgccgagaggtgggaggagtggcagaaggtagaagtggtacggcaagaggttgaactaagccctcatcgaacctcggaatggattctcgacttcaccggcaaccttc

SEQ ID NO: 32004 - DNA, 208 bp, Zea mays
  Clone ID: LIB3059-013-Q1-K1-H10
ttcccttctctacccactcttcctcccactcttcctaaaaaaaaaaaaaattttttaaaaaaaaaaaaacaaaaaaaaaaacaatgtcattatttaaatatattataccatatcaaaaatacaaaaaataaaaaatcaaacataataaaatattttatcttctttaattttttccaattcacttttcacttcctttacaatttacaac

SEQ ID NO: 32005 - DNA, 428 bp, Zea mays
  Clone ID: LIB3059-013-Q1-K1-H11
gtgatggtgctgaatatccatgcgatactgagtctcttgatgacgatctagatgatagaggtaaggaagatgaatttggagattcaactatcaggaagtctttcagttatgggtctctgcaatctgacaactatgttggtggcctagtttatgcccatgcaaagattgttggggagcatgaggaccggatatattatagtaaccgaaaaactgatgtcagtttccatgtagagaaaggattgccatcaaccacagagaatgggttgctaactgctaagcgcagtatacttccttggagaaagaggaaactgagtttacggtcgctgaaggctaaaggtgaacctctcttgaaaaaggcatatggggaagagggaagtgatgatattgaatatgatcgacgcttgctaacatcatttgatgaaatctgt

SEQ ID NO: 32006 - DNA, 400 bp, Zea mays
  unsure at all n locations
  Clone ID: LIB3059-013-Q1-K1-H2
cccaacaccacctcgcctgcgatcttcgtagcctccgtcgcgtcgagcatcgagtcaggtcggcctactgcggaaagtacaaggatgagctcatcaagaatgctgcctacattggcacccccggcaagggtatccttgctgctgatgagtccactggcaccattggcaagcgcctttccagcatcaatgtcgagaacgttgaggagaaccgccgtgccctccgtgagctcctattctgctgccctggtgctctccagtacatcagcggtgtgatcctcttcgaggagaccctgtaccagaagaccaaggatggcaagccttttgttgatgtcctcaaggagggaggcgtcctccctggcatcaaggttgacaagggcaccattgangttgttggcactga

SEQ ID NO: 32007 - DNA, 272 bp, Zea mays
  Clone ID: LIB3059-013-Q1-K1-H3
aaaaaaaaaaaaaaaaaaaaaaaaaaaaaaaataaaaaaaaaaaaaaaaaaaaaaaaaagaaagaataaaaaaaaaaaaaaaaaaaaaaataaaaaaaaaaaaaaaaaaaaaaaaaataaaaaaaaaaaaaaaaaaaaaaaaaaaaaaaaaaaaaaaaaaaaaaaaaaaaaaaaaaaaaaaaaaactaaattaataaaaaaacttttaaattcatccattttaatactcccttaataaaaaacatttttttacttatttaatattaccaaaa

SEQ ID NO: 32008 - DNA, 354 bp, Zea mays
  Clone ID: LIB3059-013-Q1-K1-F7
ggccaaaaagttgctcgcccagcagccagcgccttcaccagatcgagcaaaacggctgagctcagctcgacctaccactacctcccgcttggcgcctgggactggcaaccggcgtgcgcagaatgctgcccaccgggtgcaggtgcagcctcctctcctgcctccgccgcgacaagggcgaggcgggccgaaccgacccccgcgtcgcggacgagcccaccgcgtcgtcgctcggcaagggcagcgccgcggctcggcggttcgcgtgggccgagatcgagtccgtcacggcggggttctcgtccagggtcatcggccagggcggcttcagcaccgtgtacctggcctgcctct

SEQ ID NO: 32009 - DNA, 411 bp, Zea mays
  Clone ID: LIB3059-013-Q1-K1-E11
cccacgcgtccggcgctcaagttctcgcgcccacagccaaatttttctccactcaatgggggcataagctgcactgcagccatggacgccagcggagccggtagcaaggcgaagaagggggcggctgggcgcaaggctggcggccccaggaagaagtcggtgtcgcggtccgtcaaggccgggctgcagttccccgtcggccggatcgggcgctacctcaagaaggggcggtacgcgcagcgcgtgggcaccggcgcccccgtctatctcgccgccgtgcttgagtacctcgccgccgaggtgctggagctggccgggaacgcggcgaaggacaacaagaagacgcgcatcgtcccgcgacacttgctcctggcgattcgtaacgacgttgagctcggcaagctgctgtct

SEQ ID NO: 32010 - DNA, 268 bp, Zea mays
  Clone ID: LIB3059-013-Q1-K1-E12
tccccgtccacccaatccttccgccaatccttccgaacaaaaaaactaaatttaaaaaaacaaaaaataatacaataaatcaagaaaattatactacactgcagacaataaaccacaaacaaaccatatacaaaagctaaaaaagatactattaaacacaaagctaacttacccatcaagaaatctctatctccatccatcaaggctcctcttcactttctcctaaaccatatcgttcgctacctcaaaaatgatcaatacgctcaac

SEQ ID NO: 32011 - DNA, 377 bp, Zea mays
  Clone ID: LIB3059-013-Q1-K1-E2
gcaaagcggcagtgcgtagagaggatcgtcgaacagaacagcatgaagatggtcatcgttcgcgtcgtgtgcctggctctgtcagctgccagcgcctctgcaatgcagatgccctgcccctgcgcggggctgcagggcttgtacggcgctggcgccggcctgacgacgatgatgggcgccggcgggctgtacccctacgcggagtacctgaagcaaccgcaatgcaacccgcttgcggccgcgccctactacgccgggtgtgggcagccgaacgccatgttccagccgctccggcaacagtgctgccagcaacagatgaggatgatggacgtgcagtccgtcgcgcagcagctgcagatgatgatgcagcttgagcg

SEQ ID NO: 32012 - DNA, 380 bp, Zea mays
  Clone ID: LIB3059-013-Q1-K1-E3
aaaaacacaccaagcgaatcgcactaccaacgacctaacaccaatggctaccaagatagtaggcctccttgcgcttcttgcccttttagtgagcgcaacaaatgcgttcattattccacagtgctcacttgctcctagtgccagtattccacagttcctcccaccagttacttcaatgggcttcgaacatccatccgtgcaagcctacaggctacaactagcgcttgcggcgagcgccttacaacaaccaattgcccaattgcaacaacaatccttggcacatctaaccctacaaaccattgcaacgcaacaacaacaacaacagtttctgccatcactgagccacctagccgtggtgaaccctgtcacctacttgcaac

SEQ ID NO: 32013 - DNA, 442 bp, Zea mays
  unsure at all n locations
  Clone ID: LIB3059-013-Q1-K1-E4
gcgaagcgcactagcaacaacctaacaacaatggctaccaagatattatccctcctgcncgtcttgcgctttttgcgagcgcaacaaatgcgtccattattccacaatgctcacttgctcctagttccattattccacagttcctcccaccagttacttcaatggccttcgaacacccagctgtgcaagcctataggctacaacaagcgattgcggcgagcgtcttacaacaaccaattgcccaattgcaacaacaatccttggcacatctaacaatacaaaccatcgcaacgcaacagcaacaacagttcctaccagcactgagccacctagccatggtgaaccctgtcgcctacttgcaacagcaactgcttgcatccaacccacttgctctagcaaacgtagtttcaaaccagcaacaacaacaactgcaacaattttt

SEQ ID NO: 32014 - DNA, 191 bp, Zea mays
  Clone ID: LIB3059-013-Q1-K1-E7
aggaccttcgtctcccgttcattatctcacatcttcccgagcgagttcttggtgtacgttttcctcttcggaccagctccaatgctcttggtgtatcttgccactctcaccaatcaagttttcatgtctgatctctacattcatatcccaactgccttcgatcccttctctgaatccaattcttgtcactc

SEQ ID NO: 32015 - DNA, 228 bp, Zea mays
  Clone ID: LIB3059-013-Q1-K1-F1
cccacgcgtccgcctgtgtggtgcaaaactctgaataaaacctgaataaaacctgatggaggacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaataaaacaaattaaaaactctattaatacc

SEQ ID NO: 32016 - DNA, 428 bp, Zea mays
  Clone ID: LIB3059-013-Q1-K1-F10
cggacgcgtgggtagcaacatagaaagcacaatagtgtaccaacaatggcagccaaaagatttgcctccttatgctccttggtctttctgcaagtgctgctacggcgaccattttcccgcaatgctcacaagctcctatagcttcccttcttcccccgtacctctcaccagtgttgtcttcagtatgtgaaaacccaattcttcaaaccctacaggatccaacatgcaattgcatcaggcatcttacctttatcacccttggtccttcaacaatcatcagccctattacagcagttacctttggtgcatttattggcacaaaacatcaaggcacaacaactcgtgctagcaaaccttgctgcctactctcagcaacaacagttacctttggtgcatttgttggcacaaaacatcagggcacaacaact

SEQ ID NO: 32017 - DNA, 384 bp, Zea mays
  unsure at all n locations
  Clone ID: LIB3059-013-Q1-K1-F11
agaccattagctttatctactccagagcgcagaagaacccgatcgacaccatgagggtggggctcgttgccctcgctctcctggctctcgctgcgagcgccacctccacgcatacaagcggcggctgcggctgccagccaccgccgccggttcatctaccgccgccggtgcatctgccacctccggttcacctgccacctccggtgcatctcccaccgccggtccacctgccgccgccggtccacctgccaccgccggtccatgtgccgncgncggttcatctgccgncgncaccatgccactaccctactcaaccgncccggcctcagcctcattcccagccacacccatgcccgtgccaacagccgcattcaagcccgtgcc

SEQ ID NO: 32018 - DNA, 304 bp, Zea mays
  Clone ID: LIB3059-013-Q1-K1-F12
ccactcgttcgcttgcatttcctttaaatccttccctatttaatttttcaggaaaaatcccaccttttatgttttttttcattttagttccttttaatgtctcttgtttttttacctggacgctacttttctttgtcagcataatgcatatacaagttttatcatgtaagtaatctttcaattttcctgctgcatatgttgttttccactttttcccatgatcattaatactatacattctatcctattttaaatccttcctttttaaattattgaaacttttgcctttaattaaaattctaat

SEQ ID NO: 32019 - DNA, 433 bp, Zea mays
  unsure at all n locations
  Clone ID: LIB3059-013-Q1-K1-F3
cccacgcgtccgatatgaaacacatgtcggaatgagtagcccggaaccgaagataaagacagatgtaaactttagggatgaagtcctcccaagaataaaaaaacttggatacaatgcagtgcaaataatggcaatccaagagcactcatattatggaagctttggataccatgtaactaatttttttgcgccaagtagtcgttttggtaccccagaagaattgaagtctttgattgatagagcacatgagcttggtttgctagttctcatggatgtggttcatagtcatgcgtcaagtaatactctggatgggttgaatggttttgatggtacagatacacattactttcacagtggtccacgtggccatcactggatgtgggattctcgcctatntaactatgggaactgggaaattttaagatttcttctc

SEQ ID NO: 32020 - DNA, 258 bp, Zea mays
  Clone ID: LIB3059-013-Q1-K1-F4
cggacgcgtgggatgacgttcaagcggaggaacggcggacgcaacaagcacgggctgtgcgacgtcaagtacatacgctgctccaactgcgccaagtgctgtccaaaggataaggctatcaagcggttcttggtgaggaacattgttgagcaggctgctgtgagggacgtgcaggaggcttgtgtgcatgatggtatcatagtcgcccttattagttgcataatttagtcggatgatctatttataggttatctagag

SEQ ID NO: 32021 - DNA, 413 bp, Zea mays
  Clone ID: LIB3059-013-Q1-K1-E1
cagctagcaacatagaaagcacaatattgtaccaataatggcagccaaaatattttggctcgttatgctccttggtctttctgcaagtgctgctacggcgagcattttcccgcaatgctcacaagctcctatagcttcccttcttcccccatacctctcaccagcgatgtcttcagtatgtgaaaatccaattcttctaccctacaggatccaacaggcaatcgcagcaggcatcttacctttatcacccttgttcctccaacaatcatcagccctattacagcagttacctttggtgcatttattggcacaaaacatcagggcacaacaactacaacaactcgtgctagcaaaccttgctgcctactctcagcaacagcagttacctttggtgcatttgttggcacaaaaca

SEQ ID NO: 32022 - DNA, 441 bp, Zea mays
  Clone ID: LIB3059-036-Q1-K1-C1
cgcaacgcaacagcaacaacagttcctaccagcactgagccacctagccatggtgaacgctgtcgcctacttgcaacagcagctgcttgcatccaacccacttgctctagcaaacgtagttgcaaaccagcaacaacaacaactgcaacagtttctgccagcgcttagtcaactagccatggtgaaccctgccgcctacctacaacagcaacaactgctttcatctagcccgctcgctgtggccaatgcacctacatacctgcaacaagaattgttgcaacagattgtaccagctctaactcagctagctgtggcaaaccctgttgcctacttgcaacagctgcttccattcaaccaactaactatgtcgaactctgttgcgtacctacaacagcgacaacagttacttaatccattggcagtggctaacccattggtcgc

SEQ ID NO: 32023 - DNA, 432 bp, Zea mays
  Clone ID: LIB3059-036-Q1-K1-C11
cagcaaagcggcagtgcgtagagaggatcgtcgaacagaacagcatgaagatggtcatggttctcgtcgtgtgcctggctctgtcagctgccagcgcctctgcaatgcagatgccctgcccctgcgcggggctgcagggcttgtacggcgctggcgccggcctgacgacgatgatgggcgccggcgggctgtacccctacgcggagtacctgaggcagccgcagtgcagcccgctggcggcggcgccctactacgccgggtgtgggcagacgagcgccatgtaccagccgctccggcaacagtgctgccagcagcagatgaggatgatggacgtgcagtccgtcgcgcagcagctgcagatgatgatgcagcttgagcgtgccgctgccgccagcagcagcctgtacgagccagctctgatgcagcagcagc

SEQ ID NO: 32024 - DNA, 408 bp, Zea mays
  unsure at all n locations
  Clone ID: LIB3059-036-Q1-K1-C12
ggtcaatcgagctcgctatatgccccaatattcatttataattgctactaagacagttggcgcagaagtatatgtttttgactatagcaagcacccatctaagcctccactagatggtgcatgcaaccctgatttacggctgaagggacataattctgaaggatatggcttatcatggagtatttttaaagagggacatttgttaagtgggtctgacgatgctcaaatttgcttgtgggacattaaagcaaatagtagaaacaaaagtcttgacgccttgcagatttttaagcatcatgatggtgtcgttgaagatgttgcttggcacttgaggcatgagtacttatttgggtcagttggtgacgattatcatcttttgatttgggacctgcggtcnntccgccctac

SEQ ID NO: 32025 - DNA, 443 bp, Zea mays
  unsure at all n locations
  Clone ID: LIB3059-036-Q1-K1-C2
cggacgcgtgggcggacgcgtgggcggacgcgtgggcaccaagaaatccatcgagagggcgtcgacaggggaattaatggcgtcgtcgtctagcagcagccaccgccgcctcatcctcgcagccgccgtcctgctctccgtgctcgcggctgccagcgccagcgccgggacctcctgcgtgccggggtgggccatcccgcacaacccgctcccgagctgccgctggtacgtgaccagccggacctgcggcatcgggccgcgcctcccgtggccggagctgaagaggagatgctgccgggagctggcggacatcccggcgtactgccggtgcacggcgctgagcatcctcatggacggcgcgatcccgccgggcccggacgcgcagctggagggccgnctagaggacctgccgggctgcccgcgggaggtgcagaggggattcc

SEQ ID NO: 32026 - DNA, 437 bp, Zea mays
  unsure at all n locations
  Clone ID: LIB3059-036-Q1-K1-C3
gtcgcacatatctactattctatacttttaggagccagggccccaaccgccttggcagcgcagatgcttgcattgttcgctctcctagctctttgtgcaagcgccactagtgcgacgcatattccagggcacttgccaccagtcatgccattgggtaccatgaacccatgcatgcagtactgcatgatgcaacaggggcttgccagcttgatggcgtgtccgtccctgatgctgcagcaactgttggccttaccgcttcagacgatgccagtgatgatgccacagatgatgacgcctaacatgatgtcaccattgatgatgccgagcatgatgtcaccaatggtcttgccgagcatgatgtcgcanatgatgatgccacaatgtcactgcgacgccgtctcgcagattatgctgcaacagcagttaccattcaatgt

SEQ ID NO: 32027 - DNA, 444 bp, Zea mays
  Clone ID: LIB3059-036-Q1-K1-C4
cccacgcgtccggtggatctgtgaaccccatggcgcctctgcttgattaaactgcgagggatacatgataaactaagaccaccactcagatcaccaccatcttattcagatccaaaggaacggacgcagggggagtcgacgatgacggagggagggcggccgaacagaagattagaagctgaatgccgacagataaagttggttgatgctccagtatctggtggtgtgcgatccggcgttcatggacggagcgaaacccgcggcagcatgctgctccaccctgcgtgcgcaggaggcatgcttgtgcgtgtacgccaaagaccccaagtttgcaaaatacatcaacaaccccaacaccgccaaaacctttacctcgtgcggcatagccatccccaaatgctaagcaagcgctctgcgtcgtcgcttcgcttgctcttgctcttg

SEQ ID NO: 32028 - DNA, 444 bp, Zea mays
  Clone ID: LIB3059-036-Q1-K1-C6
cagaccattagctttatctactccagagcgcagaagaacccgatcgacaccatgagggggttgctcgttgccctcgctctcctggctctcgctgcgagcgccacctccacgcatacaagcggcggctgcggctgccagccaccgccgccggttcatctaccgccgccggtgcatctgccacctccggttcacctgccacctccggtgcatctcccaccgccggtccacctgccgccgccggtccacctgccaccgccggtccatgtgccgccgccggttcatctgccgccgccaccatgccactaccctactcaaccgccccggcctcagcctcatccccagccacacccatgcccgtgccaacagccgcatccaagcccgtgccagctgcagggaacctgcggcgttggcagcaccccgatcctgggccagtgcgtcgagttt

SEQ ID NO: 32029 - DNA, 443 bp, Zea mays
  Clone ID: LIB3059-036-Q1-K1-C8
ctcttgcacatcatttgaggctcatcaggttggtgttgatggtgggacacatactgagattgctgatgacaatcattacaggagtcacggctttggtggtggtgcagaacatgggttcttcggtaatcagtgtgacacaaaagagtgggacttcggtctcagtatcggttgggaaaagcatgattttttgtcaacaaacaatgtcatagaagaggtgttcgggaagtgctgtgacactgctgaccaggaccttatctgagccagacgcggaggcttcttgtcagctgcgaaaactttacggttctctgaattgtacagcagtagttggctattttgatttaatgcctcacttgttcttacaggaatctcatctctgttcttggaacatcatctgcttgtgatttcgtcacatgattaatgtaaatccgtagatatcatcaaaa

SEQ ID NO: 32030 - DNA, 430 bp, Zea mays
  Clone ID: LIB3059-036-Q1-K1-C9
ctggtgctctccagtacatcagcggtgtgatcctcttcgaggagaccctgtaccagaagaccaaggatggcaagccttttgttgatgtcctcaaggagggaggcgtcctccctggcatcaaggttgacaagggcaccattgaggttgttggcactgataaggagaccaccacccaaggccatgacgaccttggcaagcgctgcgccaagtactacgaggccggtgcccgctttgccaagtggcgcgctgttctcaagattggccccaatgagccatcacagcttgccatcgacctgaacgctcagggtctggctcgctatgccatcatctgccaggagaatggtctggtgccaattgttgagcctgagatccttgttgatggccctcatgacattgatcgctgcgcttacgtcactgagaccgtccttgc

SEQ ID NO: 32031 - DNA, 405 bp, Zea mays
  Clone ID: LIB3059-036-Q1-K1-D1
cggacgcgtgggcggacgcgtgggtttgaatccaccgaaactcccagaactgatagatgagttctaaagaacttggagttcggcctggcagcactaggtggcgagaaaggagcagcctacgaccggatagttctgaacgcagcattggctgaccactggttaggctgcagcggagccgagcacttcaacgttgcgctagaccgcgcgagggaagccatggatcgcggagactctgtgagaacgctcgtgagctacataaagatctcgcacagagtcttctaggctagctctcaccccgggtctcagtgagagatcgcacaattgggtcttagagccaaaactgggatatctttttcgcggagccagagggcctttgccactgcgtgtcggtgtttacgacccagc

SEQ ID NO: 32032 - DNA, 427 bp, Zea mays
  Clone ID: LIB3059-036-Q1-K1-D10
ccgacgcgtccgcttctcaccgtccaaccgtgcacaatgaattgaagcgccacgcggttgcaatattctattgccacgggcaggtgcgtcgcgtcgattcctggtcttcgagaggagcggaggaggagggcggcgagtgtggaggagaggcgagttcagctgtagcgtttcttttcttgcccgtggcggctgcggtgccacctcgaacgctgctccctgttctggggcttactgcggatcctgatctgagcatcattcagagaggaagaaatatgcttaggagaaagcatggctctgatgtcaactcagatgatgctgagcaaagagaagcacagattagtgaacttaaagctgctcttgagactttgtctgcccgtggcgagaagtactgcagtgaagcatgcttgagaagatatctggaagcccg

SEQ ID NO: 32033 - DNA, 428 bp, Zea mays
  Clone ID: LIB3059-036-Q1-K1-B9
ccgacgggaacccggacttcgcggcgctcgaggtgctccggcgcagggcctacgacggggccaaggcggacgcgtggtcctgcggggtcatcctcttcgtcctcctcgcgggccacctccccttcgacgacgccaacatcgccgacatgtgccgcagggcgcaccgccgggagtacacggtcccgcggtgggtgtcgcagccggcgcgccgcctcgtggcgcgcctgctggacccgaacccggcgacgcgcctcgccgtcgcggagctcgccggccacccctggttcaagcgctcgctcagcgtggactcccagctcggcggcctcctggacggccaggcggagcgcgagctggcgttccaggccccgccggcgctgaacgccttcgacatcatctccatgtccccagggctggacctgtcgggcctg

SEQ ID NO: 32034 - DNA, 440 bp, Zea mays
  Clone ID: LIB3059-036-Q1-K1-A3
cggacgcgtgggagaccgacaaggacttgcaggtttatgctcctgccgctaagctcaggtgcctataaccacgacgactgcccctcattgctcacatcctcctataccctgtatgttaccaccgtacctttcaccagcgatgtcttcagcctgtgaaaccccaattcttgagccctacaggatccaacaggcggtcacatgccgcatcttacctgtatcaccctcgaacgtacaactgtcatcaaccctattacatcaactacctatgatgcatttatagctacatctcatcacgctacagcagctactgcatctcgggctaccaaaccttgctgactacgctcaacatcagcagttacctttgatgctattgatggcacagaacatgagctcacagctgctacgacagctcttgctagccaaccttgatgtctactctc

SEQ ID NO: 32035 - DNA, 443 bp, Zea mays
  unsure at all n locations
  Clone ID: LIB3059-036-Q1-K1-A4
atgacttctggtgaggctgtcaagtacaagagctcattggacgcattccagcagatccgtaanaaggaaggccccaagtccctgttcaagggtgctggtgctaacattcttcgtgccattgctggcgctggtgtgctttctggctacgaccagctccagatcctcttcttcggaaagaagtacggctccggcggtgcttaaatggagaaaaatgatgacgaacaagagcagttcgctcccggtccagcccagtcaggatctggtcaagtttttgcctttcatatcgaagaaattaataatttatgtaggagaatttttccaacattcgttttgggcggagacattgatctcaaaacactcgtaactgtcctactaggtggtggcatgggtccccaaaacatggtcatagggtgtgtctagtctgcccttcgttgcagccgggc

SEQ ID NO: 32036 - DNA, 440 bp, Zea mays
  Clone ID: LIB3059-036-Q1-K1-A5
acgcgtgggagacggccaaggactggaagggcctccgcgtcaccgtcaagctcaccgtccagaaccggcaggccaaggtctccgtcgtcccctccgccgcggcgctcgtcatcaaggcgctcaaggagccagagagggaccgcaagaaggtcaagaacatcaagcacagcggcaacatcagcctcgacgacgtcatcgagatcgccaggaccatgaggcacaggtccatggccaaggaattggccggcaccgtcaaggagatcctcggtacctgcgtcagcgtcgggtgcaccgtcgacggcaaggaccccaaggacctgcagcaggagattgacgacggcgaggtggagatcccgtccgcttaagaaggattggtgtccaggactgtgttatctttgctgctgaagccattctctgcctagattttctcatatttattt

SEQ ID NO: 32037 - DNA, 444 bp, Zea mays
  Clone ID: LIB3059-036-Q1-K1-A8
cccacgcgtccggcaagtgctgctaccgcgaccattttcccgcaatgctcacaagctcctatagcttcccttcttcccccgtacctctcaccagcggtgtcttcggtatgtgaaaacccaattcttcaaccctataggatccaacaggcaatcgcagctggcatcttacctttatcacccttgttcctccaacaatcatcagccctattacagcagttacctttggtgcatttattggcacaaaacatcagggcacaacaactacaacaacttgtgctagcaaaccttgctgcctactctcagcaacagcagtttcttccattcaaccaactagctgcattgaactctgctgcttatttgcaacaacaactaccattcagccagctagctgctgcctacccccaacaatttcttccattcaaccaactggcatcattgaactct

SEQ ID NO: 32038 - DNA, 434 bp, Zea mays
  unsure at all n locations
  Clone ID: LIB3059-036-Q1-K1-A9
gtttgtgtcaatggcagagcgtcttgggaatgcccttatgcaggatcctgctatgtccagtatgcttgagaacttgaccagtccagctcataaggagcagcttgaggagaggatggcccgtatcaaggaagatccatccttgaagccaattcttgatgaaatagagaatgggggtccatctgcaatggtgaagtattggaatgaccctgaggttcttcaaaagattggccaggcaatgggtgttaaccttcccggagattctagtgtgtccactgtgctctctggacccgaagagactgangaggaaggaggggatgacgatgagtccattgttcatcacactgcaagtgttggtgatgaagagggtttgaagaaagctttagaaggtggagcagacaaggatgaagaagatgccgagggaagacgggcattac

SEQ ID NO: 32039 - DNA, 383 bp, Zea mays
  Clone ID: LIB3059-036-Q1-K1-B1
cggacgcgtggggacccacgcgtccgattaacattgtctccaatgctagctgcacaaccggctgccttgctcctcttgctaaggtcatcaatgacaagttcggtatcgttgagggtctgatgaccactgtccatgccatcactgctacccagaagactgttgatgggccctcatctaaggactggaggggtggaagggctgctagtttcaacatcattcccagcagcactggagctgctaaggctgttggcaaagtgcttcctgtccttaacggaaagttgactggaatgtctttccgtgtcccaaccgtcgatgtttctgttgttgatttgactgttaggcttgaaaagtcagcaacctatgatgagatcaaggctgcggtc

SEQ ID NO: 32040 - DNA, 419 bp, Zea mays
  Clone ID: LIB3059-036-Q1-K1-B11
cccacgcgtccgcccacgcgtccggtccaccccagccgccgccatgaagcgcaaccccggcgtcacgagctcccgccggaagtgccgcaaggcgcacttcacggccccgtcctccgtccgccgcgtgctcatgtccgcggcgctatcgacggagctccgccacaagtacaatgtgcgttccatcccgatccgcaaggacgacgaggtgcaggtcgtgcgcggcacctacaagggccgtgagggcaaagtggtgcaggtgtaccgccgtcgctgggtcatccacgttgagcggatcacccgcgagaaggtgaacggctccaccgtgaacgtgggcatccacccttccaaggtcatggttacaaagctgaagcttgacaaggaccgcaaggcgctcctcgaccgcaaggcccggggccgcg

SEQ ID NO: 32041 - DNA, 427 bp, Zea mays
  Clone ID: LIB3059-036-Q1-K1-B12
cccacgcgtccgcccacgcgtccggaaagagcagttcccaaaccaagcagtgaagtacgtgggcctggaggaagaagaccccttgttcgtcctactcttgaacgaactgaagaacctcatgctgatacagatatatcagctgttgatgcctccacagttcaggacaaaggggggccaccagcagagcaagaaacttctggaattttacctgtgttacagcctttgagtcgtaaacggcttatcacatcttcacagacggtagacagtgcctcgcagggtgaggctaatgatgtcaatcctccatctaagaagcccaaggaggaagaatcttcacaagggactagtgaactcaaaagtggtcaaccacctcttggggatgtagcggcacaggtaaatgtgcttccagccactgatgacctagatggac

SEQ ID NO: 32042 - DNA, 444 bp, Zea mays
  Clone ID: LIB3059-036-Q1-K1-B4
atacgctccattttataaccaaccggcggtccatctgaggaggaccaagaaacatagagagagcggttctacgtccgagtcgtcgcatcaggtcccctcgattcgccggcggcgccaccaaccaagctcatacatctgaattgactagtcaaactcagtgatctctttggggactaatcaaactcaagaactaagtttcatgtctgatctcgacgtccagcttccatctgcttttgatccgtttgcagaggcaaatgctgaggactccagtgctggtgctggatcaaaggactatgtgcacgtgcgtattcagcagcgcaacggaaggaagagtctgacaactgttcagggcttgaagaaagagtacagctacaacaagatcctcaaggatctcaaaaaagagttctgctgcaatggtactgtagtccaggatccagagctagg

SEQ ID NO: 32043 - DNA, 438 bp, Zea mays
  Clone ID: LIB3059-036-Q1-K1-B5
cccacgcgtccgcccacgcgtccgcttacgcgtgggcggacgcgtgggcggacacgagcctacatgtcttgatggagctacatttcctcatgtcctacatgcccaactccaaccttgctgacatctatagcttcctcaagacctgcccgagtcctcagttagagcgcctctttctgcagatcccaacaaacaccggtgatgcattcacggataacttcttgaaggtgcaggagtagcacccgccaaaaggtggattataaaaccttctattagacaagctgacaaatttcaatgagcaccctaatgagatgcagctagtaccattgctgctaatacagtctattagactgaagaaactatttctgattgctaccaaggaggatcaccctcaaggactgcgcaaggttcattcatatatgctgtctgattttcataaaa

SEQ ID NO: 32044 - DNA, 444 bp, Zea mays
  Clone ID: LIB3059-036-Q1-K1-B7
cggacgcgtgggtgcagctgttccggcgcgggcgtccggtggcagtgttccggtcgcgagctgggcgggtatacgcaggaccagctggaggtgggcgacgtcctggagcagcacggcctcaagtccgtcttcgccttcgaccctgccgcccgcaaacgcggcgtcgccatccgcttcaaccctcgcaacggccgctccctcctcccctacgcccctggttccacgatcttcctagacggcgagcccaaggattctttgctgaagcccatcacgaagatggtgattggggtcgccgctatgactgtggtagctgcagtcctattgaaggaggccaagatgcccgagtggcttcagtcatccaagctgggcgccgtgagcttcccaccatgggtgctggcttgcatggtcatcgtgttcatgaggctccggaagagaaccatggat

SEQ ID NO: 32045 - DNA, 443 bp, Zea mays
  Clone ID: LIB3059-036-Q1-K1-A2
gcccgtcgtccgtcgtcatggccgccgtggaggtgtgcgtgaaggccgccacggggaaggccgacacgctcggcgactgcccgttctcgcagagggtgctgctcacgctggaggagaagaaggtcccctacgaggtgaagctcgtcgacctcgacaacaagcccgaatggtttctgaagatcagcccagagggtaaggtgcctgtgttcaacggtggtgatggcaaatgcattgctgattctgatgtaatcacccaaaccattgaggagaagttcccaactccatctctggtcactcctgtagaatatgcatcagtgggatcaaagattttcccagccttcatcacattcttgaagagcaaggatgctagtgatggttccgagaaggcgcttctggatgagctgcaggcactggatgagcatctcaaagctcatggcccctac

SEQ ID NO: 32046 - DNA, 355 bp, Zea mays
  unsure at all n locations
  Clone ID: LIB3059-035-Q1-K1-G6
cccacgcgtccgcggacgcgtgggtggacttccggaggcccaaccgcggctgcgtcagggtggcgccggttgccggctgcggcggttcgcaccccccggcgcggctggtgtcgctgcccgggctggcctacttcaacgaccccgccaccagcctcagggcgctggagagggtgagcgacgccgcgtgcaggaaggcgtgcctggacgactgcgcctgcgcggcggcgcagttcgtctacggcaccgacgccggcgacggcttctgctacctgcagtcggaggtgctgtcgctggaaacgtcgcggccggaggtggtgcactacaactncaccatgcatctcaaggtgcgggccac

SEQ ID NO: 32047 - DNA, 412 bp, Zea mays
  Clone ID: LIB3059-035-Q1-K1-G9
ggagaagatggtgcttcggcggaaggtaaaggtaccgatgtggagatgaaagatgcggaaaatgctgaagacgagaagaaagatgtcccaagtgcagggaagactgaggaagttgacgataagaaagatgctgaaaatgtggagatgaaagatgctgcagagaagactgaggaagttgacgataagaaagaggaagcccctactgtagatgcagcagagaatactgtggaaggtgatgataagaaagaggagccccctgcagagaagactgatgagaaagaggaagccccagctgtagatgcagcagagaagaatgaggaaggtgatgataagaaagaggaggagccctctgcagagaagaagactgttgagaaagaggtggtccctgctgtagatgcagcagagaatactg

SEQ ID NO: 32048 - DNA, 112 bp, Zea mays
  unsure at all n locations
  Clone ID: LIB3059-035-Q1-K1-H1
tgccttatgttggaattatacataaaaacaaatacattaaanaaaaataaaaaaacaaaaaaataaaaaggaagaaacaaaataaaataaagaaaagaaaaataacaaataa

SEQ ID NO: 32049 - DNA, 316 bp, Zea mays
  Clone ID: LIB3059-035-Q1-K1-H10
ctcctgagaagtcctagacagtcaaacaacgcagcagcaatgctttagaagctccggtgaaacgacgagactacttatcgctagtctcccataccattggattacgggaagatcatatgaaggcaattagaatggacgaacagagcagcatatgtagcccatctacaatgcaagaagactggaaacgctccgatagtaacgggaactcatgtaccagatcattgtcctgatgcatcatctgtttgcctccatcaatatggagatgctgctcgattgctcctcatggagttgttttccttagaccatattgaaaatg

SEQ ID NO: 32050 - DNA, 414 bp, Zea mays
  Clone ID: LIB3059-035-Q1-K1-H11
cagcagggcacaacaactacaacaacttgtgctagcaaaccttgctgcctactctcagcaacagcagtttcttccattcaaccaactagctgcattgaactctgcttcttatttgcaacaacaacaactaccattcagccagctacctgttgcctacccccagcaatttcttccattcaaccaactggcagcattgaactctcctgcttatttacagcagcaacaactactaccattcagccagctagctggtgtgagccctgctaccttcttgacacaaccacagttgttgccgttctaccagcacgctgcgcctaacgctggcaccctcttacaactgcaacaattgctgccattcaaccaacttgctttgacaaacctagcagtgttctaccaacaacccatcattggtgg

SEQ ID NO: 32051 - DNA, 427 bp, Zea mays
  Clone ID: LIB3059-035-Q1-K1-H12
acccactcgtccgagaagggttcagctgttctgcgccctctcaccaggactctgactgctgttcgcgatggcatcttggaggatgttgtctacccagctgagattgtggggaagcgtgtcagataccgtctggatggttccaagattatcaagattttcttggacccaaaggagaggaacaacactgaatacaagctggagacctgcactgcggtctaccgcaggctgtgtgggaaagatgtggtctttgagtaccctatgaccgaaaatgcataaatatgatgccctctggatatctccactctatttcgttgattctgaatgttatgttgggtctccctatgtacttcaaaaaacatagttttgatgctaaagttgcctaggaatttggtacggtgaagtggcagtggacgtgaacaatgttaag

SEQ ID NO: 32052 - DNA, 444 bp, Zea mays
  unsure at all n locations
  Clone ID: LIB3059-035-Q1-K1-H3
ggcaatgggtgttaaccttcccggagattctagtgtgtccactgtgctctctggacctgaagagactgaggaggaaggaggggatgacgatgagtccattgttcatcacactgcaagtgttggtgatgaagagggtttgaagaaagctttagaaggtggagcagacaaggatgaagaagatgccgagggaagacgggctttacattttgcatgtggctatggtgagttgaagtgtgcagaaattctccttgaggcggaggccgcagttgatgccctagataagaacaagaacactccgttgcactatgctgctgggtatggtcggaaaggaatgtgtggatcttctgttgaagtatggtgctgctgtcacgctccagaatctggacgggaaaacccncatcgaggttgccaaactcaacagtcaagatgaggttctcaagttgc

SEQ ID NO: 32053 - DNA, 331 bp, Zea mays
  Clone ID: LIB3059-035-Q1-K1-H4
cccatgcgtccacgcgtgcgttcgaggagcccatcccgattggcctccatcctgaacccttcaaacgcaggttctttcccggcaatgacccaaaacgtcggcactctcggccccaagtcgcgctccgtcgacacgatctccggctgcctcaaggccggcatgtccgtcgcccggttcgatttctcgtggggggacgccacgtaccaccaggagacgctggagaacctcaagctctccatcaagtccaccaacaagctatgcgctgtaatgctctacaccgtgggcccggaactgcaggtggtgaacaagagcgagaccccgatctccctcg

SEQ ID NO: 32054 - DNA, 401 bp, Zea mays
  Clone ID: LIB3059-035-Q1-K1-H5
cccacgcgtccgcagatagcagcatagactgcacaatgccgcaaccaacaatggcgtgacggaatatcgcgcctgccttattctcgtaggtcttactgcacgtgctggtaccgggaccagtttaccgtagtgtacacaagctattatagcatcagttctatgcacgcgtacatatgaccagcgacgccttgtgtatgatggcacccatgtactactgcgtatgcgatccaacacgcaatggctactggacatataccgctatcagcttaggctctacgacaatcatggtgcttacgacagagactacctttgctgcattgattgactccaaatataccaggcacaacaactacgacaacacgtgcgtagcacaccttgatgactactatcagcaacagata

SEQ ID NO: 32055 - DNA, 481 bp, Zea mays
  Clone ID: LIB3059-035-Q1-K1-H6
ggactgcctggagccacgcgtgcgtccacgcacgcgtccgattccctgctaaaaaccctagcccatcagggcagcgaccttggagagccgtctccaatggcgctactccgagcgctccggcgagcccttccggcgctctcctcgccggcggcggttctcccccgtcgcgccccgcacccactacctcctccgcccgctcctcgtcggttcctggacccgatcgggctccgctccttctccgccgccgccgccaccgcgtcgcaggcgccgcccatgggggccaccctgttcggcgggctcatggacacccggttcccgaagcgccggccgggcttcgccaaccgccggaagagggctagcttgcgccccaaaggtccgtactactgggtgaagtgcaagcctgacgagcccataccagttagtcagccgaaccaggggagcgtacgagggaggaaggagaagaagcggatcaagcagcgca

SEQ ID NO: 32056 - DNA, 439 bp, Zea mays
  Clone ID: LIB3059-035-Q1-K1-H7
gagctgtgcttctctgttgtctcattgctctggcagaagctcatagcttctcccgaaggcagatgtctgcagaaagtacatcagctcaccaaggatggaggaaggttgtggatgcactttgtgatgtcgtttcagcctcaccaaccaaggcctcagctgctatcgttctccaggccgagaaggacttgcagccttggattgctagagacgacgaacaaggccagaagatgtggagagtcaaccaacgtatagtgaagcttatagcggagctcatgaggaaccatgacagccctgaagccttggtgatactcgctagtgcttctgaccttctacttcgtgctactgatggaatgcttgttgacggtgaagcttgtactttgccacagcttgagcttctcgaagtaaccgctcgagcagtccatcttattattgaatgggg

SEQ ID NO: 32057 - DNA, 433 bp, Zea mays
  unsure at all n locations
  Clone ID: LIB3059-036-Q1-K1-A1
caaaaaggcacttgagaaggcaaagactgaggtcgaggatcgacggaacctatacttggctgangagggtgaaatacttgctggaataccagctgcagaaggtgtgtcagatgctgacatgaataaacgtaattggttagctagaaggaaagcggagatgcttcagtctccaaaatttcatgtgtcgagaacaaggcttatcatctacaatttgcctaagactatgaccattaatgacgtaaagaagctttgcagagaagcagtcatttctcgtgctacaaaacaaaatcctgtcatccggaaggtgaatatcctgaagaatgaaaagaaaggcatacagaagcattcacgcggtgtagcctttgttgattttcaagaacatgaacacgctcttgttgctctaagggttctaaacaacaatcctgaaactttt

SEQ ID NO: 32058 - DNA, 430 bp, Zea mays
  Clone ID: LIB3059-036-Q1-K1-A12
aatgttaataagccgctggagggtttcttttgcccatggaaaggaccccaagtctgatcgttggggctcgtctgatgctattgcaattgctaccccacctccttctgatgatctccgttatttgaaatcatcagccctggatatttggttacttggatatgaatttccagaaacaataattgttttcatgcacaagcaaatacatgttttaagcagtcagaagaaaggaaatcttattgggaccctcaagaaggctgcaaacgaggctgttggtgttgacattgtgttgcatgtgaaaaccaagaatagtgatggtgctgacttgatggatgacatagtgcatgctgctcgtaatcaatcaaaatcagataagccagttgttggacacatagccaaagaggcacctgagggtaagcttcttgaaacatgg

SEQ ID NO: 32059 - DNA, 458 bp, Zea mays
  Clone ID: LIB3059-035-Q1-K1-G5
gagagagtgtgtgtgatcggtacaaggatcaccgctgtgcctgcgcgtgctgctgcaccgaatcgagtcagatcctgtccgaatccgagctaagggatggcaaccggtagtgaagcctcgaaggcagctgaggctgtggttgactggcataaacacgacagcaagaggatgctccatgcggtttaccgtgttggggatctggaccgcacaatcaagtactacacggaatgctttgggatgaaactgctgaggaaaagggatgttcctgatgagaagtacaccaatgccttccttggctttgggccagagaacaccaactttgcagttgaattgacatacaactatggcgttgaccagtatgacaattggaccgggctttgggcatttcgcaattgctaatgatgatgtgtacaagttagctgagaatatcaaatccaagggtggtaagatcacccgcg

SEQ ID NO: 32060 - DNA, 392 bp, Zea mays
  Clone ID: LIB3059-013-Q1-K1-C5
gcatgtacacgggccagttcgtctactgcggtcgccgcgccaccctctccatgggcggcgtgctgcccctgcgcgggatccctgagggtgccgtcgtctgcaacgtcgagcaccacgtcggtgaccgcggtgtcttcgccagggcctctggggactacgccattgtgatcagccacaaccctgacaacggcacatcgaggattaagctgccctctggcgccaagaagattgtccccagcagctgccgtgctatgattgggcaggttgctggtggaggcaggactgagaagccgatgctcaaggctggtaacgcgtaccacaagtaccgtgtgaagaggaacagctggcccaaggtgcgtggtgtggccatgaaccctgtggagcatccccac

SEQ ID NO: 32061 - DNA, 433 bp, Zea mays
  Clone ID: LIB3059-013-Q1-K1-C6
atcacggcgggcgccgacgtgctggtgatgccctcccgcttcgagccctgcgggctggaccagctctacgcgatggcatacggcaccgtccctgtggtgcacgccgtgggcgggctcagggacaccgtggcgccgttcgacccgttcagcgacgccgggctcgggtggacttttgaccgcgccgaggccaacaagctgatcgaggcgctcaggcactgcctcgacacgtaccggaactacgaggagagctggaagagtctccaggcgcgcggcatgtcgcaggacctcagctgggaccacgcggctgagctctacgaggacgtccttgtcaaggccaagtaccagtggtgaacccttcgcccttcgcatcaatatcttcggtttgatcccattgtacatcgcgcgtttgacggtctcggtgaagaacttcata

SEQ ID NO: 32062 - DNA, 250 bp, Zea mays
  Clone ID: LIB3059-013-Q1-K1-C7
aaaaatcttaaccacaatatcttactttccaatctaacataaacaagatcaaggagcgtctcattttccactccaacgtcacattccaatacgcgacccataacttgctcataataccggatcacatttattccataattactgctcccacctaccccaagacaatactacagttctcctacatttacaatatctatacctcgaactcttaatgcactaagacaatcactcacttaatcaatgcaacttt

SEQ ID NO: 32063 - DNA, 416 bp, Zea mays
  Clone ID: LIB3059-013-Q1-K1-C8
cccacgcgtccgcccacgcgtccgcccacgcgtccgagctgaacaagcagagtgttcgtcttatcaacaacaatgtcatcgaggagggccttgggaagcataatatcatctgcatcgaggaccttgttcacgagatcatgacggttggcccacacttcaaagaggccaacaacttcctctggccattcaagctgaaagcgccccttggtggcctcaagaagaagaggaaccactatgtggagggtggcgacgctggcaaccgtgagaactacatcaacgagctcatcaagaggatgaactaggctctcttgtatcctgtgagaatgcattcgatgtcggcatggatatgcaattttgttccatggctgtcatacgtcacgacttcaactaggaaatgggtcctgtttatgtttgca

SEQ ID NO: 32064 - DNA, 431 bp, Zea mays
  unsure at all n locations
  Clone ID: LIB3059-013-Q1-K1-C9
gcaggaaatgaccaaaagagaatacgtcgaagatcaagatgctgaagatcctgatgacgtgattatctcccttacaactcagattgcacgacgggatgaagaaatggctccttatatcacggaatcagaaaggaattacatatttggtgggatttccagtgttgctgctaatgcatcaataaaggcacttgctcaaatgaagtcaataaacttgttaggagtccagcaaatatgcaagaattcgatagctctggacaggctcttgcagccataccctcaatagatagtgaagcagtccaacagcgattggatcgcgttcgaacgttctatgagttgttaaatttgccttttgagtctttgcttggattcatcgcagaacatgaatatntgntntctgctaaagaatacctgagtgttctaaaggtcaatgt

SEQ ID NO: 32065 - DNA, 380 bp, Zea mays
  unsure at all n locations
  Clone ID: LIB3059-013-Q1-K1-D1
ctggccaagctctcggtcgtgcccgtcaggaggggctactggggaaacaagatcggcgagcgtcacactgtgccctgcaaggtcaccggcaagtgccggtccgtcaccgtgcgcatggtgcccgcgcccaaggggttccggattgtcgcttgccgcgttcccaaaaaaggccctcaagtcggccgcattgaagatggctttacctcgntccgtggctccaacaagacactcggtaacttcgtcaaaggaaccctttgattgtctgatgaagacctacggcttcctcactcctgagttctgggccgagaccaagtatgccaagaccccgttccaggagttcaccgacctcttggctaagccgacaaagggtcttctgatcg

SEQ ID NO: 32066 - DNA, 431 bp, Zea mays
  Clone ID: LIB3059-013-Q1-K1-D11
gcgcttgttgtgtcaacaatcgccagccctatctttggtgcagtcattggtacaaaccgtcgggtcacaacagctgcagcaactcgtgctacctgtgatcaaccaagtagctctggcaaacctttctccctactctccgcaacaacaatttcttccattcaaccaactgtctacactgaaccctgctgcttatttgcagcaacaactattaccatttagccagctagctactgcctactctcaacaacaacaacttcttccatttaaccaattggccgcactgaaccccgctgcttatttgcagcagcaaatactactaccatttagccagctagctacagcaagccgtgcttccttcttgacacaacaacaattgctgccgttctaccagcagtttgcggctaaccccgcaaccctcttacaactacaac

SEQ ID NO: 32067 - DNA, 263 bp, Zea mays
  Clone ID: LIB3059-013-Q1-K1-D12
caacaagcaacatagaaagtggaatccagtagcaacaatagagcaacaatggcgagcaggatattttccctccttatgctccttgctctttctacatgtgttgctaacgcgacaattttccctcaatgctcacaagctcctatagcttcccttcttcccccataccttccatcaattatagcttcaatatgtgaaaacccagctcttcaaccatataggcttcaacaagcaatcgcagcaagcaacatacctttatcgccctt

SEQ ID NO: 32068 - DNA, 388 bp, Zea mays
  Clone ID: LIB3059-013-Q1-K1-D2
ggtgatgcgacgcccgtcccgttccaagtcctgacaaccgagcgtacgctgagctggagtgaacggcgctggctaccggaagagccgagccggaccaagtctcctcgtccctcacctcgtcgccgatggagggcggcgactcgtccggcgccggcgccggcggcgccgtgggccgcggcggccaagtggcggagcgacgcgtcgcgggcgttccagtactacctggaccgctcgacgcctcacgccacggggcggtggctcggcacgctcgccgccgcggccatctacgcgctgcgggtttacatggtgcaaggcttctacatcgtcacctacgggctcgggatctaccttctcaacctcctcatcggtttcctctcccccatggtcg

SEQ ID NO: 32069 - DNA, 245 bp, Zea mays
  Clone ID: LIB3059-013-Q1-K1-D3
cccactcgtcccgcagccgctgcagcttacaaccaccaccaccaattcatctaccgagtccgttacatctgacacctacgtttcacctgccacctcccgttcatataccaccccctatccacctttcgccatcagtccacctatcatcatccgttcaagtgccgtccacaattcatctgccaacgtcaccatgccaataccctactcaaccaaccaagtcttaaactcatacccatacacaccca

SEQ ID NO: 32070 - DNA, 421 bp, Zea mays
  unsure at all n locations
  Clone ID: LIB3059-013-Q1-K1-D4
ccggagcaggcgaaacggcgccgacgacaatggcagcaacaagggcttccccggtccgtctgttgctgctgctcaccgtccagctgagcttgctcttccgcctccccgactccccctccaccctcgccctcgccctcgccctcgccgcggaaccagaccaacagaacgccaagcagcatcgccagcccgcgctgctggtgcagtcgacgtgcaactccaccagcttctacgacctctgcatcgccgcgctcgccgccgaccccgccagctccaccgncgacgtcccgggcctgggcggcatcgccgtgtccgccgccgcaaacaacgcctncggcacggccgncttcctcggcaacgccagcgacgccgcggccaccccgcatgcggaccgcgcgcgttcctcgccgagcaggcctaccac

SEQ ID NO: 32071 - DNA, 227 bp, Zea mays
  unsure at all n locations
  Clone ID: LIB3059-013-Q1-K1-D5
gtactcggtctcggaattcgccgggtgcgacgccacgccgtcgcgatgtgtactccactctnactggtggnnttttgagtgcnttggtattctcctaagnngatggccccagacgccntggagnncatgtctctccgttgcggtgtcaactttcttggaaagtgaagcnnagatgatttntngctgctgctaactaanngatggatgcccaacgacctcnnccaaat

SEQ ID NO: 32072 - DNA, 439 bp, Zea mays
  Clone ID: LIB3059-013-Q1-K1-D6
ctttatcgtccttgttgtttcaacaattgccagccctatctttggtgcagtcagtgtgacaaaccatcagggcacaacagctgcagcaactcgtgctacctctgatcaaccaagtagctctggcaaacctttctccctactctcagcaacaacaatttcttccattcaaccaactgtctacactgaaccctgctgcttatttgcagcaacaactattaccatttagccagctagctactgcctactctcagcaacaacaacttcttccatttaaccaattggccgcactgaaccccgctgcttatttgcagcagcaaatactactaccatttagccagctagctgcagcaaaccgtgcttccttcttgacacagcaacagttgctgcctttctaccagcagtttgcggctaaccccgcaacccttttacaactacaaca

SEQ ID NO: 32073 - DNA, 368 bp, Zea mays
  Clone ID: LIB3059-013-Q1-K1-D7
ggaaaccctagccgccatatctcacgatccactcgagcaccaagccgagggaagtttgtgagcgatggcgcgcggcgtggtgtcggcgaagggcggctcggtcgcgggcaagaagaaggggtcggtttccttcacgatcgactgcaccaagccagtggaggacaagatcatggaggtcgtctcgctcgagaagttcctgcaggagcgcatcaaggtcgccgtcgacaaggctgtcaacctcggcgactccgtcaccatctctcgcgagaagaccaaggtcaccgtcacctttgacggacgcttgtccaagaggtacctgaagtacttgaccaagaagtacttgaataagcacaacgtgcgggattggc

SEQ ID NO: 32074 - DNA, 361 bp, Zea mays
  Clone ID: LIB3059-013-Q1-K1-D8
ctcacgcatccgttgacgcatcccggctacaccgtccaactgctgtaccaggcggacggctacatccctcgggctggcagtatcacacgcctaaccagccacaacttcagcatcctgaacctcgtacagataagctcggctcctgtatacctgtaccaggacgccatcatgtttccgctctggaacttcaacgcctacatctccatctaccacatcaagggctgtacacgggtacagctcgtcagctacaacgctaccacgtctttagacgacctgctctgacctgcgctgctactcatcgcaccttactgctacctgcaagccacctatgctcactgagcaagctcgcattacatcgcct

SEQ ID NO: 32075 - DNA, 368 bp, Zea mays
  unsure at all n locations
  Clone ID: LIB3059-013-Q1-K1-D9
ctgccctatttcttcctcaagcccgcaggccgctccctctgctgtccagggtgcaggctgtcttctctcgcccctgctctcccctggccggaccggcccctagctcgagcagggagctcgtcgtcgcccatggctggcctcctctatacagcgaccgccaccccctgtagcttcccctctgcctcggcgcccccttcttcttgtacctccagcagcaaggatttaaccccccatggcgtgtggccttgcctgctccacggtctgcagcagccctgcgctcacctnccatggaaaaccagtccgcttcctgcctccggcaagccgcatttgttccctgcgcgagctcgctgcggggcgccctagccact

SEQ ID NO: 32076 - DNA, 418 bp, Zea mays
  Clone ID: LIB3059-013-Q1-K1-C4
cgagctgctaccctttttttatctttttatattataccaccaactgtccaatatactagttcggtcttatcaacaactatgtcatccaatatgcccttcctaatcataatatcatctccatctaacaccttgttcacgagatcatgactgttggcccacacttcaaagaggccaacaacttcctctggccattcaagctgaaagcgccccttggtggcctcaagaagaagaggaaccactatgtggagggtggcgactctggcaaccgtgagaactacatcaactagctcatcaagaggatgaactaggctctcttgtatcctgtgaaaatgcattctatgtcggcatggatatgcaattttgttccatggctgtcatacgtcacgacttcaactaagaaatgggtcctgtttatatt

SEQ ID NO: 32077 - DNA, 430 bp, Zea mays
  Clone ID: LIB3059-013-Q1-K1-A9
cggacgcgtgggcggacgcgtgggcaacaagcaacatagaaagtggaatccagtaggagcgaatagagcaacaatggagaccaagatattttccctccttatgctccttgctctttctacatgtgttgctaacgcgacaattttccctcaatgctcacaagctcctatatagttccctttttccccatatacttcacatcatttatagcttcagtatgtgaaaacccatctcttcaaccatataggcttcaacaagcaatcgcagcaagcaacatacctttatcgcccttgttgtgtcaacaatcgccagccctatctttggtgcagtcattggtacaaaccatcagggcacaacagctgcagcaactcgtgctacctgtgatcaaccaagtagctctggcaaacctttctccctactctccgcaacaac

SEQ ID NO: 32078 - DNA, 242 bp, Zea mays
  Clone ID: LIB3059-013-Q1-K1-B11
attcccgctcgagccactcgtcctccgagcgtccgcaactagcaacatattattcacaatagtgtaccaacaatgtcagccagaatatttttcctccttatgctccttggtctttctgcaagtgctgctactgctaccattttcccgcaatgctcacaatctcctatagcttcccttcttcccccttacctttcaccagtgttgtcttcattatgtcaaaacccaattctttaaccttacat

SEQ ID NO: 32079 - DNA, 373 bp, Zea mays
  Clone ID: LIB3059-013-Q1-K1-B12
cgcacacgcacgaccacgcgacccgccaaacacagcccgcagagacgcgactatgagggccaagtgggagacgaatctcatgaccaggctgaagaagaagcgcctgaagatgatgcagagatccaactaagctaataggcatagatcctagtagtctcatcataattgtgtatcgtggcttcgatacatgagtgcatcgatagatgtaagattctatttatgcatagacgttacgatattagttcaatggctccgtttgcaaacctgcacttgataggccatctatcctgcactctagctatatatcatatcgttgtgcttagacatatccataattctgtgctaagaacctatcatgatggagctttatgaa

SEQ ID NO: 32080 - DNA, 350 bp, Zea mays
  Clone ID: LIB3059-013-Q1-K1-B2
gcgaagcggcagtgcgtagagaggatcgtcgaacagaacagcatgaagatggtcatcggtcgcgtcgtgtgcctggctctgtcagctgccagcgcctctgcaatgcagatgccctgcccctgcgcggggctgcagggcttgtacggcgctggcgccggcctgacgacgatgatgggcgccggcgggctgtacccctacgcggagtacctgaggcagccgcagtgcagcccgctggcggcggcgccctactacgccgggtgtgggcagccgagcgccatgttccagccgctccggcaacagtgctgccagcagcagatgaggatgatggacgtgcagtccgtcgcgcaaca

SEQ ID NO: 32081 - DNA, 389 bp, Zea mays
  Clone ID: LIB3059-013-Q1-K1-B7
ctaacaacatacaaagcacaatttcgttccaacaatagctgccaaaatatttgggctgcttattctcctagctatttctgcaagtgctgctactgctaccatattccctcaatactcacaagctcctataacttaccttcttcccccgtacctatcaccaactgtgtcttcagtatgtgaaaacccaattcttcaaccctacacgatccaacatgcaatcacagctgacatcttacctttatcacccttgttcctccaacaatcatcagccctattacatcatttaccttttgtgcatttattgtcacaaaacatcatgtcacaacaactacaacaacttgtgctagcaaaccttgcttcctactcttatcaacatcattttcttccat

SEQ ID NO: 32082 - DNA, 414 bp, Zea mays
  Clone ID: LIB3059-013-Q1-K1-B8
atgttgtcagaattcacccctgagcagcagcatgcgttctgccagtttgtaacgtgtgctcctcggcttccacatggtggattggctgcccttagccccaagcttactatagttaggaagcatccttcaagtgctgtgaatacttcaaattcaactggggcagtagagtccgctgatgatgatttgcctagtgtgatgacgtgcgccaattatctgaagctgcccccctactccacaaaagaaatcatgcgcaagaagttgctttatgcgatcctggaaggccgaggatcatttgatctttcataagaaatatacaatatccgaactaacatacaggggtcagttttattctggagatttagtttcttggtccatgtataacactgagttgaggttaccagctcactcagcaaa

SEQ ID NO: 32083 - DNA, 413 bp, Zea mays
  unsure at all n locations
  Clone ID: LIB3059-013-Q1-K1-C1
ggggaagagagagagagagacggaaagggggagatgagccggagcctgnggatcccgtgaggttgctccatgaggcagcgggtcatgtggtgacggtggagctcaagaccggcgaagtgtaccgggggtccatggtcgagtgcgaggataactggaattgccagctcgagaacattaccttcaccgccaaggatgggaaggtttcgcagctggagcacgtcttcatcagaggaagcagagtgagatttatgattatacctgatatgctcaagaacgcttccatgttcaaacgcttggaagcgagaattatgggcaaaggatcagctattggagttgggcgtggacgtgcagttgcaatgcgtgctcgggctgcttctggtcgtggtggtggtcctgttgggcgaggcaacgcg

SEQ ID NO: 32084 - DNA, 415 bp, Zea mays
  Clone ID: LIB3059-013-Q1-K1-C10
cgcaattgaggctgctggcacagcatttcagctctacagctcgggtatcttcactgggggctgtggaacagcgctggaccatggtgtcacggccgtcggctacgggacagagaacggcaaggactactggatcgtgaagaactcatggggcagcagctggggcgagtccgggtacgtgaggatggagcgcaacatcaaggcgtccagcggcaagtgcggtatcgcggttgagccgtcatacccgttgaaggagggcgccaacccgccgaaccctggccccagcccgccgtccccgaccccggcgcccgccgtgtgcgacaactactactcgtgccctgacagcaccacctgctgctgcatctacgagtacggcaagtactgcttcgcctggggctgctgcccgctcgagggcgcc

SEQ ID NO: 32085 - DNA, 413 bp, Zea mays
  Clone ID: LIB3059-013-Q1-K1-C12
cccacgcgtccgcccacgcgtccggtacgagggcaatgttgaggccactggtgaggagtgctctgttgagccagctgatgagaggaggcctttccgtgctctcttggatgttggccttatcaggactacaacagggaaccgtgtctttggtgccctcaagggagcattggatggaggcctggatattcctcacagcgagaagaggtttgctggattcaagaaggacgacaagcagttggatgctgatacccaccgcaggtacatctatggtggccatgttgctgactacatgaagaaccttgctgaagaggagccagaaaagtaccagagccacttcagtgcgtacattaagaagggagttgaggctgatgaaatagaagcgctgtacaagaaggtccatgctgccatccgtg

SEQ ID NO: 32086 - DNA, 438 bp, Zea mays
  Clone ID: LIB3059-013-Q1-K1-C2
ggtttcccgctggacgcacgcgtccgcgccctctcctccagccgcttcacagcgccgccgctcgcctctccgactgccgccggagggccgttcaagaggttcgtggagatcgggcgcgtggcccttgtgaactacggcaaagactacggccgcctcgtcgtcatcgtcgatgtggtcgaccagaacagggcacttgtggacgcccctgatatggtcaggtgccagattaacttcaaacggctctcacttaccgacatcaagattgacatcaaacgtgtccccaagaagtcaaccttgatcaaggctatggaggaagctgatgtgaagactaagtgggagaacagctcatggggcaagaagctgattgtccagaagaggagggctgcactcaatgactttgacaggttcaaggtcatgctggcaaggatcaaaaagggt

SEQ ID NO: 32087 - DNA, 303 bp, Zea mays
  Clone ID: LIB3059-013-Q1-K1-C3
gcgaatcttacttgcactcttacaaactattttatcttatgttatctctctacacttgcctgacaactacccaagctttaagaaaccaaaaatttcctatttcattaacatacaccatcttatgatcactaaacctatctttatactatatattagaacctgtcattaattttcaagcaagacgacggtctttttataaccaacattcatacttacaagtacacttaattttcttaaaaatattttgtttcacctaaacctaaattaaaagtcctcccttaacaaaaccataactgtgaaaat

SEQ ID NO: 32088 - DNA, 168 bp, Zea mays
  Clone ID: LIB3059-012-Q1-K1-G4
tcccactcctcctctaactcttcatccttccccatatcacaatcattatagctactttgacaaatttcgctaatccaaaactcaatcctcactctttaaaatactacaagattcctttatcatatttacaccttattatttcaatccctacatctcattccacatcac

SEQ ID NO: 32089 - DNA, 414 bp, Zea mays
  Clone ID: LIB3059-012-Q1-K1-G8
ccgacgcgtccgcggacgcgtgggtccatctccatccccatcccgtgacccgtgcacggcgccggtgcaagtcctaacaagccgcatcgcatcgcatgcgtgtgctgtccgaccgccatctccgcagccggctggcctagctacctcacctcacctcacgcaggcacactgcacacacacccatggtggtggcggcgatgcggcggccgtgcgctgtgccagcgctgctggtggcggcggcgacggcgacgctagtgcttctgctgctgctgtcaccgtcgagcgcgcagccggtgccgtccccggcggcggcgccgggccccgcgggcgggaccgggatcgactcggcgtgcctgaactcgctgctcaacatgtcggactgcctcccgtacgtgagccaagggagcacggcgc

SEQ ID NO: 32090 - DNA, 413 bp, Zea mays
  Clone ID: LIB3059-012-Q1-K1-G9
gaaaatacagctttgaagcatgagcatgtcacaagcaaacctccatcgatagtcatggtagaggcacgggtgctcgatttcaatgaatgctccacacctgtgaggaagaaagacgataagaaagtggaaatggttttaggaggacctgcaacatcccctgttacttcctcgcatctttggataaatatgcggtagccctttgaggtgagtgggagtggggatgcttcgcctatgctgttcagtatgtacatgtctgttattcccataatttccaccgttttgaaatacacattccaattagtactttattctttgtgcttggtaccctaaatgtcaattcctaattgaaaatacattttttttgtagtgttaagatttgtaatgtgtcatttgattatgttaaatattaaaca

SEQ ID NO: 32091 - DNA, 235 bp, Zea mays
  Clone ID: LIB3059-012-Q1-K1-H11
catccttgctctctttgcccgatttatacgcacatcacattctcgaattattccacaatactcaattgctgctaatgcaaatcacgtacaatttatactagcaatgacttactactgctttgaaactctatctattcaagcctaccttctaaaactggcacttacagacagcacattacgactatcgaatggccaaatgcaacaacaattcttggccaattttacaaatgaagca

SEQ ID NO: 32092 - DNA, 392 bp, Zea mays
  Clone ID: LIB3059-012-Q1-K1-H12
acgcgtccgatttgacccaccgtccgaggttcgtgccatcattgagggccaaatgctgtcgatgctgtgccacgccgagaggtttggcatgccgaaccctcccaaacggatcatagcaaccggcggggcatcctccaacgaaagcatcctcaagtcagtcgcgcagatcttcggctgccctgtcttcacagtccagagacctgattcggcatcgctgggtgcagcgctgagagctgcccacgggtggctgtgcaacgcgcaaggtagcttcgtccccatctcgtgcctgtaccagggcaacctggagaagacctcccttggctcgaaactggcagtcccggccggcgacaaggagcaggaccggaagctcctccagaagtacaccatcctga

SEQ ID NO: 32093 - DNA, 430 bp, Zea mays
  Clone ID: LIB3059-012-Q1-K1-H2
gattggagaactcgacaccatgaaggtgctgatcgttgcccttgctctcgtggcgctggctgcgagcgccgcctccagtacaagcggcggctgtggctgccagacaccaccgtttcatctaccgcctccgttctatatgccgcctccgttctatctgccgccgcagcagcagccgcagccatggcaataccccactcaaccaccgcagctaagcccgtgccagcagttcggatcctgcggcgtcggcagcgtcggcagcccgttcctgggccagtgcgtcgagttcctgaggcaccagtgcagcccggcggcgacgccctacggctcgccacagtgccaggcgctgcagcagcagtgctgccaccagatcaggcaggtggagccgctgcaccggtaccaggcgacatacggtgtggtcctgcaatccttc

SEQ ID NO: 32094 - DNA, 244 bp, Zea mays
  Clone ID: LIB3059-012-Q1-K1-H3
cttctcctccccctccggttcgggttcgggttcgtgaggttctccggggggcggtttggggggttagcggatcgagatggcggcgtcggatgttgagtaccgctgcttcgtcggcggcctcgcctgggccacggacgaccactccctccacaacgccttcagcacctacggcgaggtcctcgagtccaagatcatgctcgatcgggagacgcagaggtcccgcggcttctgcttcgtcaccttc

SEQ ID NO: 32095 - DNA, 429 bp, Zea mays
  Clone ID: LIB3059-012-Q1-K1-H5
cagaaataaaatcaataatagagagagatgaggtagcaacaccggctgcttaatctctgcttttccgtcctctttatctccagcgcatcgtaaagggaggagcggagcggcgaattcttgtggtttcccaagatgtcttctccaagcaagcgccgggagatggacctcatgaagctgatgatgagcgactacaaggtggatatggtgaacgatgggatgcaggagttctttgttgaatttcgtgggcctaacgaaagcatttatcaatgatggatttggaaggtttgaagagaactggcaaattcctgttcttaccaattcccattgattgggttcattaataagatatattacccaaatgtcgatgaaatgtctggttcagtctgtttggatgtcattaaccagacatggatcccaatgtttgatctt

SEQ ID NO: 32096 - DNA, 307 bp, Zea mays
  unsure at all n locations
  Clone ID: LIB3059-012-Q1-K1-H6
attccctctgtcaaaggttcttgtttcatgtagtcattcaaacccctgacgtatctgaggtgatcactgtgaagaaagcaaccgctccatacaatgcatacttgaagggcttgttctcggatatgctctgattaaatgggtggcccatgtagtttacagcaaaggttgccacctggatcatcatgttcaccatgtacgaaaccgtattcacaagaaattattttccttggctttgttggcaactgcatcccatgttatatgataattngatattgccatacgacacttgagtatccatgtagagaca

SEQ ID NO: 32097 - DNA, 294 bp, Zea mays
  unsure at all n locations
  Clone ID: LIB3059-013-Q1-K1-A1
gataggggcctaccatgggggtgactgactcaagagaagggcctggtcataggctncggcagtatgaatttctgatcatgtcttatgtctgtactctgaatcaactatgtatgagatctcatctcctttctcctactgaatgaatgaatcattattggctaaaaaaaaaaaaaacaaaaaaaaaaaaaaaaacaaatacaaaaaaaaacaaacattcaaacaaaaaaaaagcgagccgcccactctaaaagaatccaacttacttaccctttcttgctacattgtacctctttt

SEQ ID NO: 32098 - DNA, 261 bp, Zea mays
  Clone ID: LIB3059-013-Q1-K1-A11
tattcccactctacccactcatcctaagaaaaatatatcactatctcctaccttttttatctattttttttatttttttttatatgattttttttaaatttttgtccccctttttttttttatttttttttttctttttcatatttttattctttttattcttatttcttctttttcccttctttttatattttttctttttcttttcattattatattatatttcttcctatataatttttcatttttttatatttattt

SEQ ID NO: 32099 - DNA, 431 bp, Zea mays
  Clone ID: LIB3059-012-Q1-K1-G2
cccagctcttcaaccatataggcttcaacaagcaatcgcagcaagcaacgtacctttgtcgcccttgttgtttcaacaatcgccagccctatctttggtgcagtcattggtacaaaccatcagggcacaacagctgcagcaactcgtgctacctctgatcaaccaagtagctctggcaaacctttctccctactctcagcaacaacaatttcttccattcaaccaactgtctacactgaaccctgctgcttatttgcagcaacaactattaccatttagccagctagctactgcctactctcagcaacaacaacttcttccatttaaccaattggccgcactgaaccccgctgcttatttgcagcagcaaatactactaccatttagccagctagctgcagcaaaccgtgcttccttcttgacacaacaac

SEQ ID NO: 32100 - DNA, 411 bp, Zea mays
  Clone ID: LIB3059-035-Q1-K1-F12
acttgaagggtggtgccaagaaggttgtcatctctgctcctagcaaggatgcccccgtgtttgtcgttggtgtcaacgagaaggagtacaagtctgacattaacattgtctccaatgctagctgcacaaccaactgccttgctcctcttgctaaggtcatcaatgacaagttcggtatcgttgagggtctgatgaccactgtccatgccatcactgctacccagaagactgttgatgggccctcatctaaggactggaggggtggaagggctgctagtttcaacatcattcccagcagcactggagctgctaaggctgttggcaaagtgcttcctgtccttaacggaaagttgactggaatgtctttccgtgtcccaaccgtcgatgtttctgttgatgatttgactgtta

SEQ ID NO: 32101 - DNA, 117 bp, Zea mays
  Clone ID: LIB3059-035-Q1-K1-F2
ggtaaagccttggcatatcgatgagatgaggttcgtctctaggtctaggttgtttgtgtctgtaccattgatggtttaccgttgcatttggtagcggacatatcatttgagtttctg

SEQ ID NO: 32102 - DNA, 252 bp, Zea mays
  Clone ID: LIB3059-035-Q1-K1-F3
cccacgcgtccgtctggacatcgagacccttctgcttcaccactgactgcatcctgctgttgaactagctcagtttgagcacaggattacatttcatacactttaccagctcttctaagaagccctcaggataaccgaaatggccaggctgtataaagtgtgcatcctgacatactcgtgaatgtcagatctaagatgtaagatacggtgatttaagaccgacgcattgacagtcgcttataacgtcacgac

SEQ ID NO: 32103 - DNA, 397 bp, Zea mays
  Clone ID: LIB3059-035-Q1-K1-F4
gcaactggcgagactgcacatgggctgggcacctaggtgcaatggttggcacaaaacatcagggcacaacaactacaacaactcgtgctagcaaaccttgctgcctactctcagcaacagcagtttctgccattcaaccaactagctgcattgaactctgctgcttatttgcaacaacaacaactactaccattcagccagctagctgctgcctaccaccagcaattgcttccattcaaccaactggcagcattgaactctcctgcttatgtacaacaacaactactaccattcagccagctagctgctgagagccctgctgccttcttgacacagcaacagttgttgccgttctacctgcacgctgcgcctaacgttgcaccctcttacaactgca

SEQ ID NO: 32104 - DNA, 426 bp, Zea mays
  Clone ID: LIB3059-035-Q1-K1-F5
cccctacgaggtgaagctcgtcgacctctacaacaagcccgaatggtttctgaagatgagcccacagggtaaggtgcctgtgttcaacggtggtgatggcgaatgcattgctgattctgatgtaatcacccaaaccattgaggagaagttcccaactccatctctggtcactcctgtagaatatgcatcagtgggatcaaagattttcccagccttcatcacattcttgaagagcaaggatgctagtgatggttccgagaaggcgcttctggatgagctgcacgcactggatgagcatctcaaagctcatggcccctacatcaacggggagaacgtatcagcagctgatcttagcctggggccaaagctcttgcacctgcaggtcgcactggagcatttcaaaggctggaagatcccagaaaacct

SEQ ID NO: 32105 - DNA, 453 bp, Zea mays
  Clone ID: LIB3059-035-Q1-K1-F6
gcgccctgccggagagaaagtttaccatgtcttcgacaatcaattccctgtagcggtggaacgattgcagtttgatgaacaactctctatggaaaatgtgacgacgcttataacagaggctgatggataccagcctcacttgatagctccagaacaaggatatagacgccttatagaatcttgtcttattagtatcagaggtcctgctgaggcggctgttgacgcggtccatgcaattctcaaggaccttgtccgcaaggctatcaatgaaacacatgaactgaagcagtttcccacccttcgtgtggaagtaggcaatgcagcttttgagtcattggatagaatgagggatgaaagcaagaaaaatacattaaagctagttgacatggaatgcagctacttgacagtagatttcttcaggaagcttcctcaggatgttgagaagggtggaaa

SEQ ID NO: 32106 - DNA, 395 bp, Zea mays
  Clone ID: LIB3059-035-Q1-K1-F8
cctcaagatccagtacactcgggtgccgtgcaactggcgagggctggacatcgggttgaaggtggacgccggctcgaacccgaactacttcgcggtgctcatcgagtacgagtccggggacggcgagctggagtccgtggagctcatgcagcgcggcggcggcggcgggggggcgtgggcgccgatgcagcagtcgtggggcgcggtgtggcggtacaactccggcgacaccctgcaggcgcccttctccgtccgcctcacctccggctccggcaggacggtcgtcgccagcaacgtcatccccgcggggtggacgcccggcgccacgtaccgctcggtcgtcaacttcgacaactaacgaggacggacggacggaccgaaattaacggacgccc

SEQ ID NO: 32107 - DNA, 455 bp, Zea mays
  unsure at all n locations
  Clone ID: LIB3059-035-Q1-K1-G1
ctgaagattcggcgatggcggcgacgatccaatccgtgaaggcgcgccagagctgtgacagccgcggcaaccctacagtcgaggtcgacgtgttttgctcagatggaacctttgcaagggcagctgttcccagtggagcatcaactggtgtatatgaagctctggagttgagggatggtggctctgactatttggggaagggtgtctccaaggctgtgaacaatgtgaattctgttattggacctgctctgattggcaaggaccctacagcacagactgagattgataacttcatggttcaacaacttgatgggaccaaaaatgagtggngatggtgcaagcaaaagcttggtgctaatgcgattctggctgtgtcattagctgtttgcaaagctggngctagcatcaagaggattcccttataccagcacattgccaacctagctgggaacaag

SEQ ID NO: 32108 - DNA, 409 bp, Zea mays
  Clone ID: LIB3059-035-Q1-K1-G10
cccactcgtccggccatatcgccacagtctgcacggagcagattggtcagaaatgcgaacgatttttcagcccttcaaacttcatgaagtttgagaaggatgattctgggaggattgctatcctaccattttatctttatgtcatgcgaacagtttctcttactcaagcaagaattgatatgagtgagcttgatgaggattctgatggtttccttcagcctcatgaaatggaagcatatattagaggactcatccccaatttggcgcaattgcgcgatatgcccactgcatttgttcagatgtactgccgcatagctgcacgcaagttctttttcttctgtgatccacacagacgggggaaagcatgcataaagaaagtgttgctgatcaattgtcttcaggagctaat

SEQ ID NO: 32109 - DNA, 406 bp, Zea mays
  Clone ID: LIB3059-035-Q1-K1-G11
gcagagagctatgttttccccattgtcgacccacactattgcatactgagccccagggtcgcccagcagccatggcgcccaaactctctgctcccatcgtactccttggcgcagtgggagaagctaccatgggcgccacccgacctgcagcttcgccttgccgacgcccagaaattgcagcatcagctcctaccctctctacatggccgacgctcatagctccagcagacgctcctccatacttcccatggcgtactgcatcagacgccttgaagcaaccacgccatggcttgcgactcggagtcctacctgcttgcatgctgatgctcagtgcccatggtgcttgataggtgctcgacgaaatgtgcggcaaccacgtcggcttcgtgcactgtcgactcgctgg

SEQ ID NO: 32110 - DNA, 409 bp, Zea mays
  Clone ID: LIB3059-035-Q1-K1-G12
gcaacatagaaagcacaatagtgtaccaacaatggtagccaaaatattttgcctccgtatgctccttggtctttctgcaagtgctgctacgacgaccattttcccgcaatgctcacaagctcctatagcttctcttcttcccccatacctctcaccagcgttgtcttcagtatgtgaaaacccaattcttcaaccctacaggatccaacaggcaatcacagcaggcatcttacctttatcacccttgttcctccaacaatcatcagccctattacatcaattacctttggtgcatttattggcacaaaacatcagggcacaacaactacaacaactcgtgctagcaaaccttgctgcctacgctcagcaacagcagttacctttggtgcaattgttggcacaaaacatc

SEQ ID NO: 32111 - DNA, 433 bp, Zea mays
  Clone ID: LIB3059-035-Q1-K1-G2
gcattcagaaacacacctagcgaagcgcactagcaacgacctaacaacaatggcttccgagacattatccctccttgcgcttcttgccctttttgtgagtgcaacaaatgcgttcattattccacaatgctcacttgctccgagtgccattattccacagttcctccctccagttacttcaatgggcttcgaacacccagctgtgcaagcctataggctacaacaagcgcttgcggcgagcgtcttagaacaaccaattgcccaattacaacaacaatccttggcacatctaaccatacaaaccatcgcaacgcagcagcaacaagcactgagccacctagccgtggtgaaccctatcgcctacttgcaacaacagctgcttgcattcaacccacttgctttggcaaacgtagctgcattaccaacacaacca

SEQ ID NO: 32112 - DNA, 442 bp, Zea mays
  Clone ID: LIB3059-035-Q1-K1-G4
taccggttcggactggctggagccacgcgtccgccatcagggcacagcagctgcagcaactcgtgctacctgtgatcaaccaagtagctcgtggcgaacctttctccctactctcagcaacaacaatttcttccattcaaccaactgtctacactgaaccctgctgcttatttgcagcaacaactattaccattcagccagctagctactgcctactctcagcaacaacaacttcttccatttaaccaattggccgcactgaaccccgctgcttatttgcagcagcaaatactactaccatttagccagctagctgcagcaaaccgtgcttccttcttgacacagcaacagttgctgcctttctaccagcagtttgcggctaaccccgcaaccctcttacaactacaacaattgttgccctttgtccaacttgctttgacag

SEQ ID NO: 32113 - DNA, 411 bp, Zea mays
  Clone ID: LIB3059-035-Q1-K1-F11
caggtgagggataaacaaattgtgcgagtacttgggaaggcaccaacaatagcagcggctgcctacttgagattagcaggaagacctcccgtccttcctttaaatactctatcttattcagagaacttcttgtacatgctggactctttgggtgacagaacatataaaccaaatcctcgacttgctcgagctctagatattctttttattctgcatgctgaacatgaaatgaactgctccactgctgctgttaggcaccttgcttcaagtggtgtggatgtatttactgctctttctggtggtgttggagctctatatggtcctctgcatggcggcgcaaacgaggcagtacttaaaatgttaaatgagattggaagcatggaaaatattccagatttcattgtaggagtg

SEQ ID NO: 32114 - DNA, 434 bp, Zea mays
  Clone ID: LIB3059-035-Q1-K1-D7
gagattgtgaaggaagtctcttcctacctgaagaaggttggatacaaccctgatgagatctacttcgttccaatctctggttttgaaggtgacaacatgattgagaggtccaccaaccttgactggtacaagggcccaaccctacttgaggctctggacttgatcaatgagccaaagaggccttcagacaagcccctgcgtctcccccttcaggatgtgtacaagattggtggtattggaactgtccctgttggacgtgttgagactggtgtcattaagcctggtatggttgttacttttgggcctactggtcttactactgaggttaagtccgttgagatgcaccatgaggctctccaggaggcccttcccggtgacaatgttggcttcaacgtgaagaatgttgctgtgaatgatctgaagcgtgggtatgt

SEQ ID NO: 32115 - DNA, 342 bp, Zea mays
  Clone ID: LIB3059-035-Q1-K1-E1
ccgacacatgcgtggcaaacgtagttgcaaaccaggcacaacaacagctgcaacagtggctgccagcgctcaggcaactagccatggtgaaccctggcggctacctacaacagcaacagctgctttcatctagcccgctcgctgtggccaatgcacctacatacctgcagcaacaattgacgcgacagattgtaccagctctgactcagctagatgtggcaaaccctgctgtctacttgcaacagctgcttacattcaaccaactgactatgtcgaactctgatgtgtacctacaacagtgacgacagttgcttaatatactagcaatggctaacccattgg

SEQ ID NO: 32116 - DNA, 411 bp, Zea mays
  Clone ID: LIB3059-035-Q1-K1-E11
cccacgcgtccgcccacgcgtccgaagaccctgcgttgtctcaagggagtcaaaagagtgcgcgttgtgggtcaggcgaatccggttaagaagcagactgctgccacgctgagttacatacagtcttggaacaagttgcagtcggagataagaaaccgacgtgctttcatggtcaccgaaggacgcaacaggaagaagaagcaggagaaccaaatgaaacttgaggcaaaactgcataatttgcagattgaatggaatggaggctcggatactatggatgaaattcttgctaggatacaacaacgggaagaagcagcagtaaagcgtgagcgagccatggcgtacgcgttcaaccatcagtggagagcaaggtctgccacaagtctaggaaacttcagctatgaagtcggt

SEQ ID NO: 32117 - DNA, 411 bp, Zea mays
  Clone ID: LIB3059-035-Q1-K1-E12
gaccaactagcaacatagaaagcacaatagtgtaccaacaatggcagccaaaataggttgcctccttatgctccttggtctttctgcaagtgctgctaccgcgaccattttcccgcaatgctcacaagctcctatagcttcccttcttcccccgtacctctcaccagcggtgtcttcggtatgtgaaaacccaattcttcaaccctataggatccaacaggcaatcgcagctggcatcttacctttatcacccttgttcctccaacaatcatcagccctattacagcagttacctttggtgcatttattggcacaaaacatcagggcacaacaactacaacaacttgtgctagcaaaccttgctgcctactctcagcaacagcagtttcttccattcaaccaactagctgc

SEQ ID NO: 32118 - DNA, 427 bp, Zea mays
  Clone ID: LIB3059-035-Q1-K1-E2
cccacgcgtccgcccacgcgtccgccactgcaagctctgtgaaacaagccattgagtggtggaatgatttccatcttttgaatactgaaaagctttgtcaaatgatggaaatcatttcaccactgcaagctctgtgaaacaagccattgagtatcctaatcatttttttttacaatagatatattagaactcgcatcttatttgagagttatactattttacttaccagtacagttccttaactggttgctgcagacctcttaaaaaatgtggggtcagtgatggagagatatgcatgatagcaaacattgtgcctgagaccgttgaagaggtttacgcactaatgccatctctcaaggctaataggtcagctatcgaaagttcagtcaccgaggttcttaccgtcctcgcaaacatattagcttgc

SEQ ID NO: 32119 - DNA, 210 bp, Zea mays
  Clone ID: LIB3059-035-Q1-K1-E3
cgagagcgtacgctgacctttttgcatgcactgtacgtggacgtgcccattcccgtcgcgggcgaaccaacgcgacacctacacctcgctcgtccgtagccatcgttgctcttcgctcgcatgtcaccgttaacgcgcgtaattctgcactctaagctgatatgctgctatcgctaaccagctcaacacgctccacggatgaacgatagc

SEQ ID NO: 32120 - DNA, 174 bp, Zea mays
  Clone ID: LIB3059-035-Q1-K1-E4
cccgcgcgtgcgcagactccaactgcattcttctacctcatgtaaccaacagcaatactgcccataatcagattctgtatgagcaggcacttaactcatcattggtcttagctggcgaaatcatcatgcaccatactcgtatctccattcttcaagtacttgctcttcttctta

SEQ ID NO: 32121 - DNA, 455 bp, Zea mays
  Clone ID: LIB3059-035-Q1-K1-E5
cccacgcgtccgatgactccaacagcaaccgtctgcctcatgtcacggacagcagaacgacccataggaggatactgagagaaggtctcaaccaccatgggcttagtgggaatcatcttcaccataccggcatcaccattcttcaggaacttgggctccttctcaagctccttgccagaccgcctatcgatcttggttatgagctcagcaaacttgacagcaatgtgggaggtgtggcagtccagcactgtggcatagccattgccaatctgcccagggtggttcatgatgatgacttgggaggtgaagctagcagcctacttggcagggtcatccttagagttggaggccacgtacccacgtttgagatccttcacagcaacgttcttcacattgaagccaacattgtcaccaggaagggccttccggacgcgtggggcatttacaccgtgtga

SEQ ID NO: 32122 - DNA, 417 bp, Zea mays
  Clone ID: LIB3059-035-Q1-K1-E6
gtgttgctcagagtttaagttcttctgccgttgaggagcttgtaaccctgaagagcactcaaatgcttgggctcagtacttgctctatggctggagctgcgattttgcggatactgcaagtcctatctacactaacttcgtgtgtgatggatagtagacatgagcaagatttaggacaggaagagcagtcttttctgtgggatctgaatgctggtcttcaacctttgtggcaagagttaagtgattgtataagtgccacagaggcaaaacttgtacacaattcatcattcgcttcccatgccccatcggtggatgctttagcagttagtgcttcatcatctgttgcttcaccgcttcctccaggcactcagcgcttgttgccgttcatagaatcatcctttgccctatgcgagaagc

SEQ ID NO: 32123 - DNA, 433 bp, Zea mays
  Clone ID: LIB3059-035-Q1-K1-E8
cccacgcgtccgacaggatgaggactaccgtgcatgctgcgctttgcattgtgcttgtgataatgtcttcaacactgtcatcttgcgaggacgatgagaaggtatctatcgcatgtgacacaggatgcaatgccgcgatctcccgcctcaaatgcttcctgatggcctattctgaagggaaagtgttggtcagcagcaactgcgaaacgccgaccaggtgcggctgcgtgtttcgtcacaaacaagatgcagcccttatcgccggcgacgttggcaacaaaaagggatactgatggcagacgtgtacttcttggttgaataatactgctagaattaatatgggcaccaacgaaatatctataatgttattcttcagtgtaatgcttccagcatgttctgttttagtataactaaatatctatctttccccccc

SEQ ID NO: 32124 - DNA, 407 bp, Zea mays
  unsure at all n locations
  Clone ID: LIB3059-035-Q1-K1-E9
cccacgcgtccgcccacgcgtccgcccacgcgtccgcagttacttcaatgggcttcggacacctagctgtgcaagcctacaggctacaacaagcgcttgcggcgagcgtcttacaacaaccaattaaccaattgcaacaacaatccttggcacatctaaccatacaaaccatcgcaacacaacagcaacaacagttcctaccagcactgagccaactagatgtggtgaaccctgtcgcctacttgcaacagcaggtgcttgcatccaacccacttgctctggcaaacgtagctgcataccaacaacaacaacaattgcaacagtttctgccagcgctcagtcaactagccatggtgaaccctgccgnctacctacaacagcaacaactgctttcatctagccctctc

SEQ ID NO: 32125 - DNA, 456 bp, Zea mays
  Clone ID: LIB3059-035-Q1-K1-F1
cggacgcgtgggcgacgcaccacacgcacacggacaactccagcagcggctccgagcgcgtgctctcgccgtcgccggacctgcccgaccgcgaccacgccgagagccagcccgccgccgccgggtggtggcctgtcggaagcgactggggcagcgccgccgaggacgggttcatggtcgacgtcgacgtcgacgacgggagctcgctgttcgggccgctgtccccggggctgttcgcgcgcgtcgacgccgccgcgttcggcttcggcgacatgctcgcgtcgtacctgcacaaaccgttctgatgcaacgcgacgcgagcgcgcggccaccccgcgcctgcgtgctcctctaggccactgaccactgacatggacattctggtcgtcgtgtagctcggttcaggacgaatcgagagccggccggtctaggtgtagtgctgcgaaaccaacacca

SEQ ID NO: 32126 - DNA, 449 bp, Zea mays
  Clone ID: LIB3059-035-Q1-K1-D6
cccacgcgtccgtgcgcctctacatttcttctctctctgctcctccgcctccgcctgagccatccaagacagggatcgccatgtcggactcggaggagcaccacttcgaatcgaaggccgacgctggggcgtccaagacctacccgcagcaggctggcaccgtccgtaagaacggcttcatcgtcatcaagaaccgcccctgcaagggtgtggaggtttctacctccaagactggtaagcatggccacgccaaatgccactgtgtcgccatagacatattcaatgggaaaaagcttgaagatattgttccttcatcacacaactgtgacattccgcatgtgaaccgcactgagtatcagctgattgatatttctgaggatggatttgtgagccttcttacttcagatggcagcactcaggatgatcttagactcccaactgatgagact

SEQ ID NO: 32127 - DNA, 142 bp, Zea mays
  Clone ID: LIB3059-035-Q1-K1-C12
cagttcactaacaagtgatttcgtgtgtaaccatgagctggtcgcattcgcgtcccgtctgatccaacaacaaacattgtctcacaatgtgattgattgtagaagcaagcttttgtcacagggcgatgttgctcacttgtgg

SEQ ID NO: 32128 - DNA, 384 bp, Zea mays
  Clone ID: LIB3059-035-Q1-K1-C2
cgcgccggaatggctggaccgacgcagctgccgtgcggctagtcgtcgccctcccgttcgggttcggggtcgagaggttctacggcgttcgggggcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggtcgt

SEQ ID NO: 32129 - DNA, 416 bp, Zea mays
  Clone ID: LIB3059-035-Q1-K1-C3
ctagaaatactgcagaactggagccaaagttagatgcttgccgtccatctcgattaaagccctggaatgacagatgtttaccgaagaacaagatttgcttccattgcatttatggttgtaccattcaccagcttatggtggcacgtaggatggcattgtcatgcactcatgctaaaacgatgaagactgtttaatgtagacctagatgatctttgcggatgggagaaaagtgccagtttgcaaacttatagcccaggaaaggagaagtggtttaagaaatcgtttggattcaacatattggatttatggtgagaccgtcacatgatttttatttgtatgtgggcaactactcgtgttagcgttcaggaaaactcatacattcggatgttgcaaatacgtcttcaaggatttttgat

SEQ ID NO: 32130 - DNA, 455 bp, Zea mays
  Clone ID: LIB3059-035-Q1-K1-C4
cggacgcgtggggcacaatagtgtaccaacaatggcagccaaaatattttgcctcctgtgggctccttggtctttctgcaagtgctgctacggcgaccattttcccgcaatgctcgcaagctcctatagcttcccttcttcccccgtacctctcaccagcggtgtcttcggtatgtgaaaacccaattcttcaaccctacaggatccaacaggcaatcacagctggcatcttacctttatcacccttgttcctccaacaatcatcagccctattacatcagttacctttggtgcatttattggcacaaaacatcacggcacaacaactacaacaacttgtgctagcaaaccttgctgcctactctcagcaacagcagtttcttccattcaaccaactagctgcattgaactctgcttcttatttgcaacaacaacaactaccattcagccagcta

SEQ ID NO: 32131 - DNA, 435 bp, Zea mays
  Clone ID: LIB3059-035-Q1-K1-C5
gatggatatgcgcttggactgcacgcaccagggttcttcgacaaggtgctacatgtgcggaaatgtcttctgcagagtgagccagcagataaggttcttgcagttgttcaagaaacctggatggatcctgccataggcctcacaccttatgatgtccataagcatgttgggtttctcaagcatctgatgataagaactggaagaaacatcagcactggaactccagaagtaatggtcaattttgtgacgtcatgttataagccagatgtattgatgcctcttgttgataaaatcacaaaaatacctgaagtggttagtgtcataaataatgtgaactcgtctgttggtaattcatctgtgggtgaacaagaatatactttgtacgggaagccaaacattacagatatgttgagaggacttgcgttccagatatct

SEQ ID NO: 32132 - DNA, 432 bp, Zea mays
  Clone ID: LIB3059-035-Q1-K1-C6
cccacgcgtccgcccacgcgtccgatttgaatgcccatgagtcaaaagccactatgagtcggacgggcgcaacttgttatatatctagggatgggatgtcgtttggcatgtactccattttgaaagtgtccaagtgagactttatacatatatgcagttgagagatggaattaataataagagcaaacgcaaaaaaaaagaaaaaaaaaaaaaaaaaaaaaaaaaaaaataacaaaatacaaaaagataaaaaaaaaagaggacatctctgataaagaaacaaaaagaacatgaaaatgcaaaaaaaaaaggggggggcccccaatttttccttatcttttcctttgggaaacggggccccccccccttggggcaccaaaatttttgatttgggcccccccaaaattttttggaaagcccccttttgggggc

SEQ ID NO: 32133 - DNA, 438 bp, Zea mays
  Clone ID: LIB3059-035-Q1-K1-C7
cggacgcgtgggcggacgcgtgggcggacgcgtgggtttgcaacaacaacaactaccgttcagccagctacctgttgcctacccccagcaatttcttccattcaaccaactggcagcattgaactctcctgcttatttacagcagcaacaactactaccattcagccagctagctggtgtgagccctgctaccttcttgacacaaccacagttgttgccgttctaccagcacgctgcgcctaacgctggcaccctcttacaactgcaacaattgctgccattcaaccaacttgctttgacaaacctagcagtgttctaccaacaacccatcattggtggtgccctcttttagatttcttatgagttatagttcaataataaaagtttttgtctgatgtttgtggcttcccagaaataagaaagtacatttctagattc

SEQ ID NO: 32134 - DNA, 409 bp, Zea mays
  Clone ID: LIB3059-035-Q1-K1-C9
cccacgcgtccgggcgagcgcaccgtgttctccgccgacccggccttcaaccgcctgctgctggccgcggagggccgcgccgtgagctgcagctacccgtcgtccatcgccacgctgctgggcccgcggtcgctgctgctcacctcgggccccgcgcacaagcgcctccactcgctcacgctgacccgcctcggccgcccggcctcgccgccgctgctggcgcacatcgaccgcctcgtcctcgccaccatgcggggctgggaccgccccggcgccgtgcgcctcctcgacgaggccaagaagatcaccttcaacctcaccgtgtggcagctcgtcagcatcgagcccgggccgtggaccgagagcgtccggcgcgagtacgtgaagctcgtcgacggcttcttctcca

SEQ ID NO: 32135 - DNA, 436 bp, Zea mays
  unsure at all n locations
  Clone ID: LIB3059-035-Q1-K1-D1
gaggctcaagacgtacgagggcgtcccgccgccgtacgacaagaccaagcgtatggtgatcgctgacgctcttaaggttctgaggctacagcctggacacaagtactgcctcctcggcgagctctctaaggaggtcgggtggaactaccatgacaccatcagggaacttgaggagaagaggaaggagaaggccaaggttgcctacgagaggaagaagcaattggccaagctgcgtgtcaaggccgagaaggcagccgaggagaagttggggtctcagttggagattcttgcccctatcaagtactgaagagctgtgctttgtcatcagttttggggaacatctagtctttgttttaagtgttcggtaacagtttgtgacagtataatctggtaaaccgtgttattnttctgccactcctatttgaacacattttct

SEQ ID NO: 32136 - DNA, 386 bp, Zea mays
  Clone ID: LIB3059-035-Q1-K1-D10
attcctcccaacaccacctcgcctgcgatcttcgtagcctccgtcgcgtcgagcatgtatcatgtcggcctactgcggaaagtacaaggatgagctcatcaagaatgctgcctacattggcacccctggcaagggtatccttgctgctgatgagtccactggcaccattggcaagcgcctttccagcatcaatgtcgagaacgttgaggagaaccgccgtgccctccgtgagctcctattctgctgccctggtgctctccagtacatcagcggtgtgatcctcttcgaggagaccctgtaccagaagaccaacgatggcaagccttttgttgatgtcctcaaggagggaggcgtgctccctggcatcaaggttgacaagggcacca

SEQ ID NO: 32137 - DNA, 407 bp, Zea mays
  unsure at all n locations
  Clone ID: LIB3059-035-Q1-K1-D11
cggactcgtgggggattggcagttggatcttactgggattgcactagcttttgtacggtgatgtgctcttagcatgtttgcaatgaatatactggaattcataccattttagttgtgtcatgctacagggccatttttgtacttttcctcatggagcatctagcaatcacagccggctatgtgttcaacatcaaaggtgttctcgcagctccacccagaactatgctctttctaggaaggatttttctcctataactcaagatgtggaaggcttccttcacaatgttgttaacatgggttttcttgaccgtctgaaattagcgtggaagataatgttttctgcaccaaccacaaaggatacctccaatgcaaacatcgcanaacagaggcttaagatgatcctgttc

SEQ ID NO: 32138 - DNA, 402 bp, Zea mays
  Clone ID: LIB3059-035-Q1-K1-D12
cccacgcgtccgggatgccctaaatgcaaccaaggctgctgttgaggaaggtattggggttggtggaggatgcacccttttgcggcttgcagctaaagtcgatgccatcaaggatacactggagaacgatgagcagaaggttggagctgaaatagtaaggagggccctgagctacccacttaaattgattgctaaaaatgccggtgtcaatggcagcgtcgtcactgagaaggtcctttctaacgataacttcaagtatggttacaatgctgctactggacagtacgaggacttgatggctgctggtatcattgatcctactaaggtggtgagatgctgtttggagcatgccgcgtcggtggccaagaccttcctgacatctgatgttgtggtcgtcgatat

SEQ ID NO: 32139 - DNA, 452 bp, Zea mays
  Clone ID: LIB3059-035-Q1-K1-D2
gtacctcagaagcttggagagcctaaaatcaaggagccaccattaaaactcaagaatgatgctgagaaagcttcgaatgttgtttctgatggaagagaggagcataagttaaaagtgccaacatcagaaacttcaaatgtggtttatgatccaagtccaagggatgggcagaacttagattcatcaccgacagctgtacctttggctgttacaatgaataaaaaagagcatgtgattgatatggaaaaggctgataattttgttgaggaccaactgcatcctccgcagccaatggcactgcggactgaaaaagtcactgtcaatcccagtgtacgtacaagaaggggaagagtaccttcagttgaaaaggtggaatcgacgactactgtcaagtccttttccattgcatcccttcaacaatataccaatagtttcagtgaggaaaatatcat

SEQ ID NO: 32140 - DNA, 299 bp, Zea mays
  Clone ID: LIB3059-035-Q1-K1-D3
cccactcatacgctcacacatcctcccatgcatgcgcggacacttgtaatcaaaattgggggtaaatcttcttcaaatgttgcatctgatactcataaatgagcatcagataaaaacgccaacatcactacacttctaaatgtaacttatcatccaagtccaacgctatctcactacttagattcatcacctaccgatccacttttgccaggtacaattaataacacatagcacgtaatttatatatccaaacctgattattacgacgtctaccaactgaatactcctcatacaccgac

SEQ ID NO: 32141 - DNA, 397 bp, Zea mays
  Clone ID: LIB3059-035-Q1-K1-D4
gaagattgagtcaattgctaagctgtatggtgctagtggcgttgaatattccgagcagggtgaaaagcagattgagatgatcaccaagcaagggttatgcagcctccgcatttgcatggcgaagactcagaactcattctcacatgtaccgtacatgaagggcgctccgaccaggctgtgctatgtcgataagagacgtgagggccaacatcggcgctgggcacatctacccgatcgatgggcaccatgagcacgatgcctggccttctgaccagaccatgcgtttaccagatcgacgtcgacactggcatcgggaaggtcatggggctgtcatgaattgaacgacgtgatggtatcattcagagaacgtatattcggtggcatccctggatcgagt

SEQ ID NO: 32142 - DNA, 465 bp, Zea mays
  Clone ID: LIB3059-035-Q1-K1-D5
gttgttgatgaacatttcaatactgtactcctgaactgttatgatgcaattggcatagggcttatgatcagaataattcatcagcaccagctcatcatgtttaagcggcgaatcccatgtttggactcttacctagacaaagttaatatgtcactctggcctcgcttcaagatggtgttcgacttgcatttgaacagcttgcgaaatgcaaatattaaaacactttgggaggatgatgtccatccacactatgttacaaggagatatgctgaatttacagcttctctagttcatctcaatgttgagcatggggacggtcagcttgatctaaatttggagcgattgcggatggccattgaggatttgcttgttaagttggctcaagatgttttccaaaccgaagctacaaactgtctttctgataaacaactatgatttaacaatttccattttgaaggaagctgg

SEQ ID NO: 32143 - DNA, 384 bp, Zea mays
  Clone ID: LIB3059-035-Q1-K1-C11
ctagcgcacgagctctccggaccttggagatccccaggagcgagatcagcgactccgtggtggaatccgtggcgccgcggctgccgaacgtcactttcctcgacatcagcagctgcacgaagatgggggcccgcggcctggaggcgttcggcaagcactgcaagtccctggcggggctgcggcgggtgatgcacccgatcgacctggcggacagggcgtgccagcacgacgaggcgcacgccatcgcgtgcagcatgcccaggctgcggcacctggagatggggtacatgctggtggcgacggaggcggtggcggagatcctggggcggtgccgcgagctcaggttcctggacctgcgcggctgctgggcggtggacgacaagc

SEQ ID NO: 32144 - DNA, 270 bp, Zea mays
  Clone ID: LIB3059-012-Q1-K1-E2
cggacgcgtgggtgctggcatgcattttttcccgccctggacagtgtgggcgttctggggggttcatccttgagggtaaagagcttgagttctacatgaagaagctacagaggaagaagggcaagagcgctgtagcttagagcattctcatggattgtcttgcaccgaaatgtgtgtcctgatgagtacactttttttggttagtcgtctcaagttcagagcgttatgccatgtattcagacctgattagtacactcttttctaaaagcg

SEQ ID NO: 32145 - DNA, 172 bp, Zea mays
  Clone ID: LIB3059-012-Q1-K1-E3
taagaaaaaaaaaaaaaaaaaaaaaaaaataaaaaaaaaaaaaaaaaaaaaagagaaaaaggaaaatttaaaaaagggccttcccctctatagcttccaatcttactttcccttacatacaacttcatacctcttctatagtatcacctaaatccaattcactgcccttcgt

SEQ ID NO: 32146 - DNA, 318 bp, Zea mays
  Clone ID: LIB3059-012-Q1-K1-E4
gtccggaatcccagcaggcatgtcggcgagtacggcaggaagaccgaataccaagccttagagaatctcgggacgggaacgggacaggaccccaaaatctcagatccttcctgcccgcccgcccgtgcccgtcgacgcgtcgttcttgccggccgcgccccacctccgccctctcctcctccagggggatcggatacgccacagtctgcgcgatggtgctgtgggtcttcggctactgatccctcatctggaaccccggcttcaactatttctacaatatcctcggctatatcaatggctacaagcgcacctttaatc

SEQ ID NO: 32147 - DNA, 279 bp, Zea mays
  Clone ID: LIB3059-012-Q1-K1-E8
ggcggttctggcggtggtggtggcttcggcgctggcggctacggtggtggcttcgggggcgccttggggaacggaggcgccgctggtggttttgatggagaagctggcaacggcggcggtggaggaggaaacggtggcggtgacggcgctggtggtggttacggcagctccggtgctggcgatgagcttcatggcgtatctggtagtggcgacggaggcgaggctgggtataatggcaagggaccctccagcggtggactctggagcaagcgtggccat

SEQ ID NO: 32148 - DNA, 307 bp, Zea mays
  Clone ID: LIB3059-012-Q1-K1-F1
caccagttacttcaatgggcttcgaacatccagccgtgcaagcctacaggcgtacaactggcgcttgcggcgagcgccttacaacaaccaattgcccaattgcaacaacaatccttggcacatctaaccctacaaaccattgcaacgcaacaacaacaacaacagtttctgccatcactgagccacctagccgtggtgaaccctgtcacctacttgcaacagcagctgcttgcatccaacccacttgctctggcgaacgtaactgcatacaatcaacaacaacatctgcaacagtttatgctagtgc

SEQ ID NO: 32149 - DNA, 338 bp, Zea mays
  Clone ID: LIB3059-012-Q1-K1-F3
cattcagccagccagctgctgcctacccccagcaatttcttccattcaacgaactagcggcattgaactctcctgcctatgtacagcagcaacaactactaccattcagccagctagctgctgtgagccctgctgccttcttgacacagcaacaattgttgtcgttctacctgcacgctgcgcctaacgttggcaccctcttacaactgcaacaattgctgccattcaaccaacttgctttgacaaacccagcagcgttctaccaacaacccatcattggtggtgccctcttttagattgctaatgagttatagttcaataataaagtttttttgatg

SEQ ID NO: 32150 - DNA, 398 bp, Zea mays
  unsure at all n locations
  Clone ID: LIB3059-012-Q1-K1-F5
ggaaaacattcactgactgttttaactgcttgccagtgtcagcattgatagacgaaaggatcctctgtatgcatggtggtctatctccagagttgaacaagctcgaacaaatacttaatctgagtcgccccacagacgtgcctgatactggattgctctgtgaccttctttggtctgatccttctaatgaagcaacaggatgggccataaatgatcgaggtgtttcatatacatttggtcctgataaagtttctgaattccttgataagcatgatttggacctcatctgccgagcccatcaggttgtcgaaaaatgatatgagnttttcgctagccggcaaactgttaccatgttttcaagcccttactactggggagaatttgataacgcttgtgcc

SEQ ID NO: 32151 - DNA, 268 bp, Zea mays
  Clone ID: LIB3059-012-Q1-K1-F7
gcgacgcgttcgacgactcgtgcgaacactcgttcggctaccgaactgaattatgttagtactaagagtgaaaagggggatgtggatgatcctgacaatgcaagcaatggataatctctgcagacgcataatctgctaccgacagtaaatggtgatatggacgagcaattagaatatgctacaggaagtgctgcaagttgtgaagcacaagtgtatgcatatatgtgtctcaaggaaagtttgaaccaatgcaattcatggaatgaat

SEQ ID NO: 32152 - DNA, 423 bp, Zea mays
  Clone ID: LIB3059-012-Q1-K1-F8
cccacgcgtccgcagaaacacacctagcgaagcgcactagcaacgacctaacaacaagggctaccaggatattatccctctttgcgcttcttgccctttttgtgagcgcaacaaatgcgttcattattccccaatgctcacttgctcctagtgccattattccacagttcctccctccagttacttcaatgggcttcgaacacccatctgtgcaagcctacaggctacaacaagcgcttgcggcgagcgtcttacaacaaccaattgcccaattacaacaacaatccttggcacatctaaccatacaaaccatcgcaacgcaacagcaacaacaatttctaccagcactaagccaactagctgtggtgaaccctgtcgcctacttgcaacagcagttgcttgcatccaacccacttgctctgg

SEQ ID NO: 32153 - DNA, 253 bp, Zea mays
  Clone ID: LIB3059-012-Q1-K1-G1
gagccaactagctgtggtgaaccctgtcgcctacttgcaacagcagttgggggcatccgacccacttgctctggcaaacatagttgcataccaacaacaacaacaattgcaacagtttctaccagcgctcagtcaactagccatggtgaaccctgccgcctacctacaacagcaacaactgatttcatctagccctctcgctgtggttaatgcacctacatacctgcaacaacagttgctgcaacagattgta

SEQ ID NO: 32154 - DNA, 419 bp, Zea mays
  Clone ID: LIB3059-012-Q1-K1-G10
cagcaaggcacctaagatccaacggcttgtgacacccttgaccctccagaggaagcgggctagaatcgctgacaagaagaagaggataactaagaagaagtctgaggctgctgagtaccagaagcttcttgcccagaggctgaaggaacagagagaccgccggagcgagagcttggccaagaggaggtccaagctttctgccgccgccaaggcttctgctgccacctctgcttaagaatgttcagtgttttgggatctttgtaaggtctatcttgtaacggcaaaagtgttttgggatctttgtaagctccatagttcacatcacttaagtgtttctgctagtagtggatccacaactatttgcttgcttggctctgagtcacacctgaccgatcaatgcaggtgtcactttgctttta

SEQ ID NO: 32155 - DNA, 78 bp, Zea mays
  Clone ID: LIB3059-012-Q1-K1-G12
cccacgcgtccgattttgtgtagttttttaccacaaaaaaaaaaaaaaaaagaaaacgaaaatttaaaaaaataccaa

SEQ ID NO: 32156 - DNA, 227 bp, Zea mays
  Clone ID: LIB3059-012-Q1-K1-C5
cggacgcgtggggaagccgatgctaccgcctacgccgacgctggtggcgaccagtgcgagcctggctgttccatcggcaccgaggacgacgccgacgccgactgccagcgcgcgcagcagcagcagcatggccgccaccaccaccaacccaggcagggcggcgggccctcgtgcagtgtcatgtgaactagcatacccatgcatgcatgtttggtggtgtcgctctc

SEQ ID NO: 32157 - DNA, 416 bp, Zea mays
  Clone ID: LIB3059-012-Q1-K1-C6
accatccaggtgctggtgggctactgtgccgtgtacatattcatgcagacgttcatggtcccagtggccattttcatgtccctgcttgccggggccctctttgggcagctcggtggtctagccctggtgatctttgctgccactgccggtgcttcttcctgttatttcctgtccaagctagtagggaaaccactggtcttctcgttgtggccagacaagctcacgttcttccaaaagcaggttgcaaaaagaagagagaagctgctgaattacatgcttttcctgagagtcactccaacactgcccaatactttcatcaatttttcttcacctatagtgggtgtgccataccatactttcttctttgcgacggccattggcctcgtaccagctgcctatgtgactgtcaaggctgg

SEQ ID NO: 32158 - DNA, 429 bp, Zea mays
  unsure at all n locations
  Clone ID: LIB3059-012-Q1-K1-C7
gcaattcatgtctgctttgcaagcatttangcggcgtgttgcatactccaatgttggggatgatcatattgttgggtggagaacatcatctatcagaaaagattctgaactacccaagtgggttgattcaaccaacaagatttacccgcatattgtatatgaggaactatccaaagcagaagctcctgatcaatgtgctgacacaagataactgcacacctagagaacaccttttacaaggacttaagcgccgttccatgggaaaaggtggatgttaagtttcacaatagtaaagtaagatctgcagcacatagtgtgattcaggtaaaagatcctgtgatgcatagcgaaggtgccgacgtcatacagcatatgattgaccaatttattctatagtaaaagccctggtctttggaaacagacctggac

SEQ ID NO: 32159 - DNA, 416 bp, Zea mays
  Clone ID: LIB3059-012-Q1-K1-D12
gaaagacataggcttgcggaaacactggactttgagattaagcgctgggctgctgggaaagaaggcaatttgcgtgcattgctatcaactttacaatatgttctttggccagaatgtgggtggcaacctgtatccctcactgatttgatcactgctgctgctgttaaaaaagtgtacagaaaagcaacactgtgtatccatcctgacaaggtgcagcaaaagggtgcaaatctccaacagaaatatatcgctgagaaggtttttgatctccttaaggaggcgtggaacaaactcaactctgaagagctcttctaaacagcctcacgactgaacatagcgtcgcccctcagggtctgcacaaggtactctcggaagaaactcacaagctggagtggcttgaggttggtcggggggaa

SEQ ID NO: 32160 - DNA, 372 bp, Zea mays
  Clone ID: LIB3059-012-Q1-K1-D2
cggactcgtgggctggtctccatctctatcagagagctccgtccgtcacgttcccctggttccattcatggagaatatgctccacctagccccgtcgtcgtcccaggcattggccttggaccgctcctccgtcttctcgcgtgagcacgtgccgccggccgtctccgctgtcacctccctgccagttatcgacatgtctcgcagccgcgacgaggtccgccgcgctatcctcgactccggcatggagttcggcttcttcctggtggtggagcacagcatcccagatgaggtgatgcgcgacattctggaggtgtgcgaggagttcttccagctgccggcggctagcaaggcgtacatgtacttggaggacag

SEQ ID NO: 32161 - DNA, 427 bp, Zea mays
  Clone ID: LIB3059-012-Q1-K1-D4
aaagatttgtgagggtgatccgcgctgagaagagatggctaagatcgcgggggcggcgtcagctgcgctgtgcttcgcggccctggtggccgtggccgtctgccaaggcgaggtcgagcggcagaggctcagggacctgcagtgctggcaggaggtccaggagagcccgctcgacgcgtgccgccaggtcctcgaccggcagctaaccggcggcggcggcggcggcggcgttggcccgttccggtggggcaccgggctccggatgcggtgctgccagcagctccagtacgtgagccgcgagtgccgctgcgccgccatccggagcatggtcaggggctacgaggaagccatgccgccgctggagaaaggctggtggccatgggggcggcagcagcagccgccgtcgctaggaggaaggaggaggaca

SEQ ID NO: 32162 - DNA, 398 bp, Zea mays
  unsure at all n locations
  Clone ID: LIB3059-012-Q1-K1-D7
agaagccgtggattcgggtttgtgaccatgtcttcggtcgaagaggttgaggtggctggtgaccagtttaatggctatgtgcttgatggaagaagtttgagggtgaactctgggccgncaccacccagagatcggtcatcaccgtcaccgcaaagacccaggggtgatgccaacagggtctacgtgggtaacctttcctggggagttgacaattcagctctcgcaaacctgttcagtgagcaaggtgaggtactggaagcaaggatcatctatgacagggagagtggaaggtcaagggggtttggttttgtcacgtacggttccgccgtagaggttgagaatgcaatatctaatctcgatggcgctgacttggacggctgacagatccgtgttacggt

SEQ ID NO: 32163 - DNA, 168 bp, Zea mays
  Clone ID: LIB3059-012-Q1-K1-E1
ccgacgcgttcgtggacgcgtgggcggactcgtgggggcaggtcgtcaagggggtctggaagacttaagaccgagccgtgcgggggctcgggacgggaactggacaggaccccaaaatctcagatccttcctgcccgcccgcccgtgcccgtcgactcgtcgttcttg

SEQ ID NO: 32164 - DNA, 407 bp, Zea mays
  Clone ID: LIB3059-012-Q1-K1-E10
cggacgcgtgggctttggcggatcgaatgaaggaaggaaggaggagatggggggctgcatggatgtgcacaaaaaccggtggatcgaagagtggaacgccggccgcgagaacctcgagttcaatttccgctggacccgccgcagcctcgccgtcgtcggcctcttcggcctcgctgtccccatcctcgtctacaagggcatcgtccgcgaattccatatgcaggacgaggatgcaggccggccatacaggaagttcctgtaagcggcgtccagggccgcaggagacgtcgatccctcgaccggggctgcgaggaggggagtttccattcagtttgtgtcggtattgttttagtctgaatctgatggagcagtttggaatgctgaactattgtgcctgatccaaaatg

SEQ ID NO: 32165 - DNA, 382 bp, Zea mays
  Clone ID: LIB3059-012-Q1-K1-A5
cggacgcgtgggcggacgcgtgggtggagaagccataaggaaatatggggttttccatgaatggacgttctggaccatggtaccggtattaatgaatgccgtgggtggaattcttgttggtcttgtcacaacttacgcaggtggtattagaaagggttttgttatagtctcagctctccttgtaactgcactgctacaattcgggtatgatgggaagccaccatcactctactgcctgatggcattaccacttgttgcgacaagcatattcatctaccataagtatccatatgtggataagaagaagaaagtctgatgcacataattgtcagagatgggaagtatcatcagcatgatgtaatgctaaccttattttgtccac

SEQ ID NO: 32166 - DNA, 426 bp, Zea mays
  unsure at all n locations
  Clone ID: LIB3059-012-Q1-K1-A7
accaggccgaaggaaaacaatcctgaaaccaagccatgggtctgcaggaggaatttgaggagcatgcggagaaggcaaagaccttgcctgagaacacgagcaatgagaacaagctgatcctatacgggctctacaagcaagccacggttggagatgtgaatcccaatcgtccggccatattctaccaaaaggacagggccaagtgggatgcctggaaggctgttgaaggcaaatcgaaggatgaggcgatgaatgactacatcaccaaggtgaagcagctccaggaggaagctgccgcctcttaaaagtctcttaatagtgttgccaaacagctatttgtcagatgagctttgtgccatttcctcattagaagtatatcattcgatccattggggatctgtgaaccatgtnacctgttatgtaact

SEQ ID NO: 32167 - DNA, 408 bp, Zea mays
  Clone ID: LIB3059-012-Q1-K1-B10
accagatcgtcgcttggttgaaggagtactttgacggcaaattgacgccgtgcagggagtctgagcctattcctgaggtcaacaatgagcctgttaaggtggttgtcgctgacaacgtccacgacttcgtcttcaaatctggcaaaaatgtccttattgaattctatgccccctggtgcggacactgcaagaagctggcgcccatcttggacgaggcagccaccactctccagagcgacgaggaagtcgtgattgctaagatggacgcgactgccaatgacgttcccagtgagtttgacgtccaaggctacccgaccttgtacttcgtgaccccgagcgggaaggtgacatcctacgacagcggcaggacggcggacgacatcgtcgacttcatcaagaagagcaagg

SEQ ID NO: 32168 - DNA, 390 bp, Zea mays
  Clone ID: LIB3059-012-Q1-K1-B11
gagaccaccaccgctctgcctcgcctcgcctcacctcacctcacctcacctggccgagtagggttttgtaccgccgtggatctcgccgtccccgccatggacgtctcgcacgcgggatcctccgtcgccggcgaggctccgaccaccggggagcaccggatggggactaccatcgtcggggtctgctacgaaggcggcgtcgtcctgggcgccgattccaggaccagcactggaatgtatgtagccaaccgtgcttcagacaagattactcaactgacagacaatgtgtatgtctgtcgctctggatctgctgctgatacacaagtcatttcggattatgtacgctatttccttcaccaacacacaatccagcttggacaaccagctacc

SEQ ID NO: 32169 - DNA, 420 bp, Zea mays
  unsure at all n locations
  Clone ID: LIB3059-012-Q1-K1-B12
ggcgatggatgttctccgcaatgtggtccaccagcaaaacccaaacctccggaccagtcagcttgccgcattatcactgaccgaaggcattatgtcctaacttgaaggccataacaaactatcttcagtttccaactcagtgcgggtgtttccagaggttgtctggcacatgacagtattgttccttcgatactatggttggacttgtgaatgttgtttccatactggatgttaggttttatttgcgccctacggtgacctgccgttaaggcaaagaacttatttgcaagtctgagcactattttggggggtggggtgggggggtgcgttgtttntataactgtcttttttnccctagttggaagttttcttactcaattgaatgaaccagggaacttattgcatactatcaaatggttt

SEQ ID NO: 32170 - DNA, 170 bp, Zea mays
  Clone ID: LIB3059-012-Q1-K1-B5
ccacgcgtccgctgaactgaggacgatgatccagaaccgatccagctatcatcaagtgccgcggcgactacggcccatattgtaccacgtgacgagagaactctcttcgtgactttctccaacggataccccttcaccgcggatgaactgtacgaattctttatggggaa

SEQ ID NO: 32171 - DNA, 318 bp, Zea mays
  Clone ID: LIB3059-012-Q1-K1-B8
caactagcacatagaaagcacatagtgtaccaacaatggcagccaaaatatttgcgtccttatgctccttggtctttctgcaagtgctgctaccgcgaccattttcccgcaatgctcacaagctcctatagcttcccttcttcccccgtacctctcaccagcggtgtcttcggtatgtgaaaacccaattcttcaaccctataggatccaacaggcaatcgcagctggcatcttacctttatcacccttgttcctccaacaatcatcagccctattacagcagttacctttggtgcatttattgccacaaaacatcag

SEQ ID NO: 32172 - DNA, 433 bp, Zea mays
  Clone ID: LIB3059-012-Q1-K1-C10
caacaagcaacatagaaagtggaatccagtagcaacaatagagcaacaatggcgaccgagatattttccctccttatgctccttgctctttctacatgtgttgctaacgcgacaattttccctcaatgctcacaagctcctatagcttcccttcttcccccataccttccatcaattatagcttcaatatgtgaaaacccagctcttcaaccatataggcttcaacaagcaatcgcagcaagcaacatacctttatcgcccttgttgtttcaacaatcgccagccctatctttggtgcagtcattggtacaaaccatcagggcacaacagctgcagcaactcgtgctacctctgatcaaccaagtagctctggcaaacctttctccctactctcagcaacaacaatttcttccattcaaccaactgtctacac

SEQ ID NO: 32173 - DNA, 425 bp, Zea mays
  Clone ID: LIB3059-012-Q1-K1-C12
ctgaaccccgctgcttatttgcagcatcaaatactactaccatttagccaggtagctgcagcaagccgggcttgcttcttgacacaacaacagttgctgccgttctaccagcagtttgcggctaaccccgcaaccctcttacaactacaacaattgttgccctttgtccaacttgctttgacaaacccagcagcctcctaccaacaacacatcattggtggtgccctcttttagattgcttattagatgtaattcaataataaagttttttggatgatgtatgtggccaaccagaaataaaaagttacatttccagattctaaaaaaaaaaaaaataaaaaaaaaataaataaaaaaaaaaaaaaaaaaaatataataaaaaataaaaataaattaatataaaaattataaaatttttttttttt

SEQ ID NO: 32174 - DNA, 342 bp, Zea mays
  Clone ID: LIB3059-012-Q1-K1-A4
gatggttccaaggttggtgtctatggaaagcctgcaaatgaagattttggggcagatagtgcccactggaaacgggttgtaagtaaatcgtatgtgaatggcatgggaattgactggtccaaagtgagaaatgtcatggacatgagagctgtctatggaggttttgctgcagctctgagggaccaaaaggtctgtgtcatgaatatcgtgccgatcgattcaacagacacgctgcccatcatctacgatcgcggattgtttgacatgtaccatgactggtgcaagtctttcagcacttacccaaaaacttatgaccttctgaactcggaccatctgttctca

SEQ ID NO: 32175 - DNA, 420 bp, Zea mays
  Clone ID: LIB3059-035-Q1-K1-A9
acgcgtccgaaaacatttcggtctcatctccgtccacatccgtcctccagcactccagctgcatcggcgaggaccgccgtagcgatttgcgaagcaagggacgggagaggaacccgaggaaggcgaaaatgatctaccgcaactggtcgctgctctcgtccacagtcgtcatttggggcggcgtcgccaccgccggcctcgccggtatcttcctcttgggcggcaaggagaaattcaatggttatctgtgccgcgaaggcgagaggcttaggcagcaggacagagccgcgatgggccgaagctaagcgttagcttctttggtatctcaagggagcaatagcccttcgaaatttcacaagattcctgcgtccctaccagaacaagtccctatctagggactaggatggaatccatccttct

SEQ ID NO: 32176 - DNA, 409 bp, Zea mays
  Clone ID: LIB3059-035-Q1-K1-B1
gctgaatttgaagaaaatgaagtctatgcaatcgatattgtcaccagcactggggaggggaagcccaagttattggatgagaagcagaccaccatctacaaaagggctgtagacaagaattataacctgaagatgaaagcgtcaagatttattttcagtgaaatcagccagaagttcccaatcatgcccttcactgctagggcattagaagagaagcgtgcacgcttaggcttggtggaatgcatgaaccatgagctattgcagccgtaccctgtacttcatgagaagccaggtgaccttgttgcacacataaagttcactgtgctgctaatgcccaatggatcggataggattacatcatatccgctacaggagttaaagccaacaaaatccattgaagacaatgctg

SEQ ID NO: 32177 - DNA, 410 bp, Zea mays
  Clone ID: LIB3059-035-Q1-K1-B11
cggacgcgtgggaccatacaaaccatcgcaacgcaacagcaacaacaatttctaccagcactgagccaactagctgtggtgaaccctgtcgcctacttgcaacagcagttgcttgcatccaacccacttgctctggcaaacatagttgcataccaacaacaacaacaattgcaacagtttctaccagcgctcagtcaactagccatggtgaaccctgccgcctacctacaacagcaacaactgatttcatctagccctctcgctgtggttaatgcacctacatacctgcaacaacagttgctgcaacagattgtaccagctctgactcagctagctgtggcaaaccctgctgcctacttgcaacagctgcttccattcaaccaactgactgtgtcgaactcttctgcgta

SEQ ID NO: 32178 - DNA, 402 bp, Zea mays
  Clone ID: LIB3059-035-Q1-K1-B12
cccacgcgtccgcccacgcgtccgcccacgcgtccgacggccagaggaagctaccagggtcgatcgatcgagagagagagagagagagcatggctggcaggagtttcctgattcggtcccccaaggaggaggagtccaacgccgccgtcagagaagctgtactgctgggagcaaagaacgccgcaatagctggtactgtggttgcagttcccacgttggttggctgccgtgtccttccttgggctaaggcgaatctcaactacactgcacaagcactcattatatctgcagcctgtattgctggcttcttcatcactgctgacaaaaccattctacggaacgcacgacaaatcaccatcgggaagcttgacaagtcaacttgatgcatagatgtagctgaag

SEQ ID NO: 32179 - DNA, 442 bp, Zea mays
  unsure at all n locations
  Clone ID: LIB3059-035-Q1-K1-B2
cccacgcgtccggttgggccagccggagcgttgccttcccaacattcaaggcagtatgccataaatcttgctgagggtagcagcagtagtgtacgtgacggtaatcggaaatgggaaagtcagggccttgatcttaactcaggccctggaagtatagatttagaaggaaaggatgaacggatgcctttaccagtcagacaaaatttgatcccacccctacatggctttgtggaggatcaaggaagaatttaccaaatgccagttgtaggaacaaagagaaaggaacctgatggcagttgggactcagaaaggtctacatacaagcagttaccatggcaatgagggctctgaaagagatcattttgcaccgactggtctgcgaatgagcatatcacctgcatgtanagcttggcccgtgtgttcttcagtcactggactacac

SEQ ID NO: 32180 - DNA, 407 bp, Zea mays
  Clone ID: LIB3059-035-Q1-K1-B3
cccacgcgtccgagttcgcaaagcatgctcaagcttccttaaagcttagcaaggtgtgcatgggaatttctttctcaactggaagccgacgagaattattaacagctgacatgcaccttaaaagtaccttgaaacagacgatggacttctcatacactgaggagtacaaagctcttgctaactgtcttgaagatatgaagaacctgattgccgatactgcctaggttgatgcatgcaagttttggacgctggatatgataatgtattggccgtttctaattaagcattgctattgttgtcttgttgggaatcaagatcacattatcggactctgttaacacacacagagatgccaagacaagtgaacctgcgccagagactgtaagcgaatatggtgtgctgctaca

SEQ ID NO: 32181 - DNA, 400 bp, Zea mays
  Clone ID: LIB3059-035-Q1-K1-B4
ggatctcctatctggcgacgagctcctgataaaccaacatctcaacgccggcgtattggagggtgttctgtgggacgtagaggcaaagttgctcacgcgaggtgctgttgatgtggacataggtgccaattcatacgtcgagggtggtgaggacgaaagcgttgatgacacagctgcgaacgtggttgatattgttgacacatttcgtgtacaggagcaacctccttttgacaagaaatcatttgcgtcttacatcaaaaaatacatgaagaatctcactgctgtgttgcagccagagaaagcggatgagttcataaagggtgtcgagggtgctaccaagtttcttcttagcaagctgcatgacctccaaatttttgatggtgagtccatgaaggatgat

SEQ ID NO: 32182 - DNA, 462 bp, Zea mays
  Clone ID: LIB3059-035-Q1-K1-B5
cttgctgattcagatctggtctatgaaaagtctgttgcttttacaaagtcaattccgcgaagactggtttttgagaatactcgaaggaagtccagtgccaggagaaatgtgccagacaatcatgcaagaactaaaacacatcttgtagaaaataaaatgttgagcagttctgttgaaaataaatttatcgttaatggaggatctgcaatgcagacagaccatggacaagagtttctttctgatgttgttcatcaaggtaccttaagagtagatgaactagcaaagttactagcttgagaggtgattgctcttttatcaaccacatagaccagtatcaacatcctttgaaacatatgcaagatttgcatgaactctgaattggttaaaacaggtctcaagtctgttgcgtcgtggtgagtcctttttaaccttgaaatactgaactataatcctgtgcgatgt

SEQ ID NO: 32183 - DNA, 425 bp, Zea mays
  unsure at all n locations
  Clone ID: LIB3059-035-Q1-K1-B7
cccacgcgtccgtgcagcccgacggcgacgccctactgctcgcctcagtgccagtcgttgcggcagcagtgttgccagcagctcaggcaggtggagccgcagcaccggtaccaggcgatcttcggcttggtcctccagtccatcctgcagcagcagccgcaaagcggccaggtcgcggggctgttggcggcgcagatagcgcagcaactgacggcgatgtgcggcctgcagcagccgactccatgcccctacgctgctgccggcggtgtcccccactgaagaaactatgtgctgtagtatagccgctggctagctagctagttgagtcatttagcggcgatgattgagtaataatgtgtcacgcatcaccatgggtggcagtgtcagtgtgagcaatgacctgaatgaacaattgaaatgaanaa

SEQ ID NO: 32184 - DNA, 453 bp, Zea mays
  Clone ID: LIB3059-035-Q1-K1-B8
ctataggatccaacaggcaatcgcagctggcatcttacctttatcacccttgttgctgcaacaatcatcagccctattacagcagttacctttggtgcatttattggcacaaaacatcagggcacaacaactacaacaacttgtgctagcaaaccttgctgcctactctcagcaacaacagtttcttccattcaaccaactagctgcattgaactctgcttcttatttgcaacaacaacaactaccattcagccagctatctgctgcctacccccagcaatttcttccattcaaccaactgacagctttgaactctcctgcttatttacagcagcaacaactactaccattcagccagctagctggtgtgagccctgctaccttcttgacacaaccacaattgttgccgttctaccagcacgctgcgcctaacgctggcaccctcttacaact

SEQ ID NO: 32185 - DNA, 401 bp, Zea mays
  Clone ID: LIB3059-035-Q1-K1-B9
gaacgaacggcgatcatttctcccaatatataaagatgcaaaattaagagtcacaagtaactctgaaagaaaatacaaaattaaccaaggtactacaaaggtggctttgatgaggtctcggaatgacacttagttccttttcagcgtttgccaccgccgccacccaacttggggcctttggaacccttctgaacagcacccttcgtctgcgccttctgggacttggacacctcagccttcttcgccttcttctcatccttggtcttcttgatgcgctccttgatctcacgaagagcagcttctctagcagcatctcggacttcaggcttctcagctctcttcttctggatcacttccaaggaagcacccacaatggacctcgagtatggcttcttggtggc

SEQ ID NO: 32186 - DNA, 451 bp, Zea mays
  Clone ID: LIB3059-035-Q1-K1-C1
cccacgcgtccggagaccaacaagcaacatagaaagtggaatccagtagcaacaacagagcagcaatggcgaccaagatattttccctccttatgctccttgctctttctgcatgtgttgctaacgcgacaattttccctcaatgctcacaagctcctatagcttcccttcttcccccataccttccatcaatgatagcttcagtatgtgaaaacccagctcttcagccctataggctccaacaagcaatcgcagcaagcaacatacctttatcacccttgttgtttcaacaatcgccagccctatctttggtgcagtcattggtacaaaccatcagggcacagcagctgcagcaactcgtgctacctgtgatcaaccaagtagctctggcaaacctttctccctactctcagcaacaacaatttcttccattcaaccaactgtctacact

SEQ ID NO: 32187 - DNA, 412 bp, Zea mays
  Clone ID: LIB3059-035-Q1-K1-C10
agacaaagaaatgggctgagcctcatctggaaactgctaacacacaatggatgcctggtgctaaacaaaaatgggctaccttgaagaaacatgcacaggcctatgatcaaatggcctcagagaaatcattggatgcttatcaaacatcaagtgactctagaaggcctcatcttgttaatgcacatcaagtctgttgatccctattctcaggaagccaataaatcatccaagccatatgttgatcaaatagctacagctactaaaccacatgtcgagaaagtcacaactgctctcaagccttatactgaaagatcacgacatgtatatggacagtttcttgagacagctactacatatcatccagcagctcacgcaactatctcggattaccttcaccggcatgagtttacaa

SEQ ID NO: 32188 - DNA, 430 bp, Zea mays
  unsure at all n locations
  Clone ID: LIB3059-035-Q1-K1-A8
aggccttacggagaagattggcggatggaatgctaccataatttcaaaggatgaattgagcactcagccttctattgtatgcgagatcgagccatctcttctgcgctcatgtgaggagcggttgaaggatgtccaagggagggtcgaagtgctgtctgtctccacgcacgtagaaagtggcccatctgtggaacaacacaacagtgtggaagtgccacaagcggctcctgtaaaggaacctgatgctgttgctcagataagtgagaccatgcagaaacagagcatttctactgaaagccagggcaatgcacaaggcaagcaacagagaaagtgcaaggagtgtgatgtactcgtggaggacaagctntacagagagcactgcaagagtgggtggcacatacacaactacacacgccacangaatgggctc

SEQ ID NO: 32189 - DNA, 241 bp, Zea mays
  Clone ID: LIB3059-034-Q1-K1-H3
aaaaaaaataaatacctaactataaaataaattaaaaacaataacaactaaaataaaaggaaagcacacatcaaacattcactcaccaaaaaaaaaaaaccaaaaaccataacaaaaccaactaaccaacaaccagatcgcctatttcaaggacacctttaacctcttcgacaatgaccgctacaatttcattacaaccaaagatcaattaactttcattccatcactttttcaaaaccca

SEQ ID NO: 32190 - DNA, 431 bp, Zea mays
  unsure at all n locations
  Clone ID: LIB3059-034-Q1-K1-H4
acgcgtgcgaactactttcatctaacccgcttgcggtgggcaatgcacctacgtgcctgaaacaacagttgctggaacaaaatggaccaactctgactcaactagctggggcaaaccctgctgcctacttacaacagttgcttccattcaaccaactggctgtgtcaaactctgctgcgtacctacaacagcgacaacagttacttaatccattggcagtggctaacccattggtcgctaccttnctgcagcagcaacaacaattgctgccatacaaccagttctctttgatgaaccctgccttgcagcaacccatcgtttgaggtgccatcttttagattacatatgagatgtactcgacaatggtgccctcataccgacatgtgtttcctagaaataatcaatatattgattgagatttatctcgattt

SEQ ID NO: 32191 - DNA, 425 bp, Zea mays
  Clone ID: LIB3059-034-Q1-K1-H5
cggacgcgtgggttcacggcgcatgattacaacgccaccgtggagttctactgggcggccttcctggtggagtccaactcggatgacccgcaggcgcacagcgtcatgaaccgtgtcatcgcctggcgcgccatcgccaagcacgccaagaactggaagggcgtggactacctcgtcttcaactcatacatctggtggctcaacacattcgagatgaaagtcattcgccgtcatcagcatcagcttgaaaaggaggaggagggggtgaggtggagcaagtacgcccttgtggaccggccggtggcgtaccgggaggtgctcaagacgtgggccaggtgggtggaccgccacatcgaccccaaccgaacaagagtcttcttcatgggcatgtcgcccaaccacgtcacgccgtgggcgtggggtaa

SEQ ID NO: 32192 - DNA, 455 bp, Zea mays
  Clone ID: LIB3059-034-Q1-K1-H6
ccacgcgtgcgaggcttcaaccctataggatccaacaggcaatcgcagctggcatcttaccttggtcagccttgttcctccaacaatcatcagccctattacagcagttacctttggtgcatttattggcacaaaacatcagggcacaacaactacaacaacttgtgctagcaaaccttgctgcctactctcagcaacagcagtttcttccattcaaccaactagctgcattgaactctgctgcttatttgcaacaacaactaccattcagccagctagctgctgcctacccccaacaatttcttccattcaaccaactggcatcattgaactctcctgcttatttacagcagcaacaactactaccattcagccagctagctggtgtgagccctgctgccttcttgacacaacaacagttattgccgttctacctgcacgctgcgcctaacgct

SEQ ID NO: 32193 - DNA, 410 bp, Zea mays
  Clone ID: LIB3059-034-Q1-K1-H7
gcactggaaacagaacttaaaaacaaattgtctatacttggtctgatgccatctgcagctttggcagaggtactgaagcaattgaaggacaaatcattaaagcgagcagggctgactgaagaacaattgcaagagcagattgagcagagaaatgtcgcaaggaagaataagcagtttgagatatctgatggaatcaggaaaaaccttgctaccaaaggcatcgccctgatggacgaaccttctggtacagtatggagaccatgcgaaccagagcggtctgaagagtcatgattagctcactgactcaacaagtgatggcggtgtaaaatgagatttttgcctgagggcagttatcgcattttgaagactaacaaaaatcgccatctcttgatgtggtattctacagggta

SEQ ID NO: 32194 - DNA, 442 bp, Zea mays
  Clone ID: LIB3059-034-Q1-K1-H8
gtgccgggatgatactgctggggggtgatagtactggtcacacgactattgcggcgggccatgtcctgccggcgtcgtatctgaactcccaagacgccgccgccgtcagacagtacatcaacacgtccagcaagccgactgcctccatcgtcttcaacggcacggcgctgggcaccgctccagctcccgtcgtcgcctacttctcatccagggggcctagcactgcgagccctggcatcttgaagccagacgtcattgggcccggcgtcaacgtcgttgcggcatggccgttcaaggtcgggccaacaacaaacaccgtcggccgtgaccgtgacgacgacgaccaacatggagcagcagcagctactttcaactccgtatctggaacatccatgtctgcacctcacctcagcggcatcgcagctgtcatcaagagcgcaca

SEQ ID NO: 32195 - DNA, 447 bp, Zea mays
  unsure at all n locations
  Clone ID: LIB3059-035-Q1-K1-A1
aataattagaaccacggaactggctgctgctcaagaccgcctaactgatttggagaggcaaaaggatgatattatgaggtcctattcccctgccgcactgctcaacaagctccaaacatcaatggcaaagttggatgaggagtccgaggagctgcaccagaagttcctggagaaggacatcgaccttccaacctttgtgcagaagtacaagaagctccgcacggcttaccacaagcaggcgttgctccatctcgccggccagacatcactccgctgacatccggccaggcgtcatggcaactttgttgtatttctgctcgcctgttcttgttctacactatgcttggccctgttttacgagtgcagcctcttgtagggatttgccgaacatcagcggatattgcatgtatagttntatgtcttgcaaaaacgtcttatgtactctgg

SEQ ID NO: 32196 - DNA, 414 bp, Zea mays
  Clone ID: LIB3059-035-Q1-K1-A12
cgtgaacccgccgccgacgcagcagcaggagacgcgccaaggagagcccgcaaggaggcgactatgagggccaagtggaagaagaagcgcatgaggaggctgaagaggaagcgccgaaagatgaggcagagatccaagtaggctgatggggattgtggatggtggtgtcggcatagttgtgttacgtttcttcgatgcgtgagttcatggagagatgtcacatcctagttcgtcgtcaccgtttgccatgggtccaatggctcgtcttggaaacctgcacttcagtaggccatctatcgtggtttctagctatatccagagttttgtgctaagacaaatcagtcagtcgttttgtgaacctattatgatggagctttatttgctgctaatatcgacctacctgttaagtaaaaa

SEQ ID NO: 32197 - DNA, 354 bp, Zea mays
  Clone ID: LIB3059-035-Q1-K1-A2
gaccaccaatgcgttactggattcagactttcaggcacatgtaggcgatttcgatctgatgagggttattcctgatggaatggatcatgaaaagattaccagcgaaagccaacgaggctatctggctcctgagtacattatgttcgacaaaccaactgcaagttgtgatgtatacagctttggaataatactattggagcttgctagcggcaaactgccgatagaaaagtcatgctctgttaagacatatggaattcgaaactcgttgctcccgctggcaaggcacggcagatatgatgaaattgcagactcataactgagcgacaaggtctctgaatctgaactgacatgaat

SEQ ID NO: 32198 - DNA, 342 bp, Zea mays
  Clone ID: LIB3059-035-Q1-K1-A4
ctgagaacgaggaggaataggaggcttataccttatagacgcaccgccttatctctgtgatatgaactctggatgtgttgagacactcatactgtagccttttaagggatgagttttgatgtttaaattggtcttctgaatgtttttaagcgtgctgggacttctcatgtgatgcttacataatcgagtccaagaattgatggttctaaaaaaaaaaacaaagataaaaacaagcaaacatagaacattaaaaatatgcaaatcataacttccctgacatacggccaggtatctatgcaacaatgaaaaaaaaaaggggggccctttttaagggtccaagtt

SEQ ID NO: 32199 - DNA, 448 bp, Zea mays
  unsure at all n locations
  Clone ID: LIB3059-035-Q1-K1-A6
attcctcccatctcccaagacctcctcagacccgagaagcgcagctgcggccatggacgccaccggcactggagctggagggaaggcgaagaagggagcggccggtcgcaaggccggcgggccgaggaagaagtcggtgacgaggtccgtgaaggccgggctccagttccccgtcggccgcatcgggcgctacctcaagaagggccgctacgcgcagcgcgtcggcagcggtgcccccgtctacctcgcggccgtcctggagtacctcgccgctgaggtcctggagctcgccggcaacgctgccaaggacaacaagaagacgcgcatcgtcccgcgccacgtgctgctggcgatccgcaacgacgaggagctcgggaagctgctgaccggcgtgaccatcgnccacggcggcgtgttgcccaacatcaacccggtcctgctgcccaag

SEQ ID NO: 32200 - DNA, 447 bp, Zea mays
  Clone ID: LIB3059-035-Q1-K1-A7
acccacgcgtccggtgggatgaacaacaacagtacgtgctggacacgtcggtgctgccgcacgagccggagagcatgcgtgagctgcggctggtgaccgacaagcacgagtgggggttcatgcagtcgtccccggacgaggcgtcgctgctgcggatgctgatcaagctgagcggcgcgcggcggacgctggaggtgggcgtgttcacgggctactcgctgctggcgacggctctggcgctgcccgccgacggcaaggtcatcgcattcgacgtgagccgcgagtactacgacatcggccgccccttcatcgagcgcgccggggtggcgggcaaggtggacttccgggagggcccggcgctggagcagctggacgagctcctcgccgacccggccaaccacggcgccttcgacttcgccttcgtcgacgccgacaagcctaactacg

SEQ ID NO: 32201 - DNA, 439 bp, Zea mays
  Clone ID: LIB3059-034-Q1-K1-F7
gggatccagaaaattgatgccaggatacctgctgggttcttagaagggatgacaagagttattccaggcttggctggagctaatattatggaaaggcttcggaatgctcctgttgatacaaaccatcagggcacagcagctgcagcaactcgtgctacctgtgatcaaccaagtagctctggcaaacctttctccctactctcagcaacaacaatttcttccattcaaccaactgtctacactgaaccctgctgcttatttgcagcaacaactattaccattcagccagctagctactgcctactctcagcaacaacaacttcttccatttaaccaattggccgcactgaaccccgctgcttatttgcagcagcaaatactactaccatttagccagctagctgcagcaaaccgtgccttcttcttgacacagcaacag

SEQ ID NO: 32202 - DNA, 437 bp, Zea mays
  Clone ID: LIB3059-034-Q1-K1-F8
aagatgaagggtgattactacagataccttgctgagttcaagactggagctgagagaaaggacgccgctgagaacacgatggtggcatacaaggctgcccaggacattgctctggctgagcttgctccaactcaccctattaggcttggactggcacttaacttctcagtgttctactatgagattctgaactcacctgatcgcgcctgcagtcttgcaaagcaggcttttgacgaggccatctcggaactggacaccctgagcgaggagtcctacaaggacagcactttgatcatgcagctccttcgtgataacttgaccctatggacctctgacatctcggaggaccctgctgaagagattagggaggcgcccaagcgggactcgagtgaggggcagtaaagccggctttatgtgcctagaaactagtagctagt

SEQ ID NO: 32203 - DNA, 414 bp, Zea mays
  Clone ID: LIB3059-034-Q1-K1-F9
agagcaatggaaggagaagtttgaagataactcaatatggtatgagcacaggttgatggatggcatggtggcctatgctgtgaaaagtgatggtgggtatgtttgggcttgcaaaaactatgacggagatgtacagagcgattttcttgcccaaggttttggttctctgggtttgatgacttctgtgctgttgtcttctgacgggaaaacattacaggctgaggctgctcatgggactgtcactagacatttcaggctacatcagaaaggacaggagacaagtaccaacagtattgcctccatattcgcttggacccgtggacttgaacacagggcaaagctggataaaaatgatagtctgctggatttcacacacaaacttgaatctgcatgtgttgaaacggtggaatctgg

SEQ ID NO: 32204 - DNA, 434 bp, Zea mays
  Clone ID: LIB3059-034-Q1-K1-G1
atccagaaaattgatgccattatttctgctgggttcttagaatggatgacgggaggtattccaggcttggctggagctaatattatggaaaggcttcggaatgctcctgttgatacaaaccatcagggcacagcagctgcagcaactcgtgctacctgtgatcaaccaagtagctctggcaaacctttctccctactctcagcaacaacaatttcttccattcaaccaactgtctacactgaaccctgctgcttatttgcagcaacaactattaccattcatccagctagctactgcctactttcagcaacaacaacttcttccatttaaccaattggcctcactgaaccccgctgcttatttgcagcaacaaatactactaccatttagccagctagctgcagcaaaccgtgcttccttcttgacacaacaac

SEQ ID NO: 32205 - DNA, 390 bp, Zea mays
  Clone ID: LIB3059-034-Q1-K1-G12
cccacgcgtccgcgcttccgagcagacgtcctccttggataaggggataggcgcgaggaagagcggcctatccgcatccgcataaatcccagtcaaattgaacgagagcgccactcccctctgctaatcccagtcaaatcgaagcaagcatggccatggcggccgtgggcgtgggcggcgcagtggcgttcctcctcccgcagcgccgccagggcgccgtcccctggagcggcgggcggcggcgggcgcccgtggcggtgcgcgcgtcgtacgaggccggggtgggcgtgatggcgaccaaggtggggatgatgacctacttcgatccggagacggtgaagccggtgccggtgaccgtggtcgggttccgggagggcggcaacgtggtga

SEQ ID NO: 32206 - DNA, 294 bp, Zea mays
  Clone ID: LIB3059-034-Q1-K1-G2
attccatcagcttccatcgaccaaagtatgtatgaccctcactcaatttggatatggaagctctttaattagatttactatgctaccaacatattcatgtcttaacactcaaccatgctcattcttccattgcggggcatgtaaatgtggtattcatttgaaaaactatcaacatactcatgtgcatcccactgtatcaaacattcaaacattatgattgatatgattccatgatacacgtgaaattagtgcttttaaacctgtcataggagacatactcctttcacaatttag

SEQ ID NO: 32207 - DNA, 439 bp, Zea mays
  Clone ID: LIB3059-034-Q1-K1-G3
cccacgcgtccgcttgttaagctcattggttattgctcagatggtgacaaccggcttgtggtgtatgaatttatgcccaagggaagtttggagaaccatctgtttagaagaggtgctgatcctttgtcatgggcaataaggctcaaagttgccattggagctgctaggggcttgtcatttttacatgatgccgaaaaccaagtcatatatcgtgatttcaaggcatcaaacattcttctcgattcggaattcaacgcaaaactttcagattttggcttggcaaaagccggtccaactggggataaaacccatgtatccacacaagtcatgggtactcatggatatgcagctccagagtacattgcaacagataacggtcagttggtggagtctgaaagagttgcaggtgaagaccctgagcagcagtcggttggttaag

SEQ ID NO: 32208 - DNA, 428 bp, Zea mays
  unsure at all n locations
  Clone ID: LIB3059-034-Q1-K1-G4
gccatcatctgccaggagaatggtctggtgccaattgttgagcctgagatccttgttgatgggcctcatgacattgatcgctgcgcttacgtcactgagaccgtccttgctggctgctacaaggcgctcaacgagcaccatgtcctcctggagggtacccttctgaagcccaacatggtgactccaggcttcgacttccagaaggtgactcctgaagtgattgctgagtacaccgttcgtacccttcaaaggaccgttcctgctgctgtgcctgctgttgtcttcctctctggtggacagagcgaggaagaagccacccgcaacctcaatggcatgaacaaactcagcaccaaagagccctggtccctgtcttctcctttcgccgtgcccttcaggcgagcaccctcaagcctgngctggcaaggtgg

SEQ ID NO: 32209 - DNA, 428 bp, Zea mays
  unsure at all n locations
  Clone ID: LIB3059-034-Q1-K1-G5
gcggcagtgcgtagagaggatcgtcgaacagaacagcatgaagatggtcatcgttctggtcgtgtgcctggctctgtcagctgccagcgcctctgcaatgcagatgccctgcccctgcgcggggctgcagggcttgtacggcgctggcgccggcctgacgacgatgatgggcgccggcgggctgtacccctacgcggagtacctgaggcagccgcagtgcagcccgctggcggcggcgccctactacgccgggtgtgggcagacgagcgccatgtaccagccgctccggcaacagtgctgccagcagcagatgaggatgatggacgtgcagtccgtcgcgcagcagctgcagatgatgatgcagcttgagcgtgccgctgccgncagcagcagcctgtacgagccagctctgatgcagcagcaacagc

SEQ ID NO: 32210 - DNA, 427 bp, Zea mays
  Clone ID: LIB3059-034-Q1-K1-G6
cggaagcgtggggagctgaacagtctgcgaagcaacagaagattaagatatgggagaactatgtcgagggtgaaaatgcttccaatggatccacacctgaatctaaacaaaagcaaattctcaaggttgttgtcacggaagttcttggtggtgggaagttttatgttcagacaatgggtgaccagagggtggcttcaattcaacagcagcttgcatctttgaaacttaaagatgcgccggtcattggtgcttttaatcctgtgaagggagagatagtcctcgcacaatttagcgttgacaactcctggaacagagctatgattgttaatggacctcgttctgttgaatctccggacgacaagtttgaagtattctatattgactatggcaaccaagaggtggttacctacagtcgtttacgacctgt

SEQ ID NO: 32211 - DNA, 394 bp, Zea mays
  Clone ID: LIB3059-034-Q1-K1-G8
acgacgcgttcaatgtgcctatgaattggcgaatgaagcaacatgagaaggttcttggggaacgtgacctaaacccagaatcaactgttgttgctatcttgcactatcctatgcattatgctgggccaactgatgctcaatgtcatgctaaggctcgtattaatgctgacgcaaatttctatatcgctggaagggatcctgatggtatgagccacccgacacagaatagggacctctatgatgctgatcactgaaagatggttttgagcatggctactgtcctcgagaggctcaacatccttgctttcaaggacgctgcatatgacacaaagcataagaaaatggctttctttgatccatcaaggatagatgattctctctccatcactggcac

SEQ ID NO: 32212 - DNA, 377 bp, Zea mays
  Clone ID: LIB3059-034-Q1-K1-G9
gaaagacagaagccaagactgaggcgttatcaccacaggcataggtggcggagatggagttgtgcccgtatctgtggcctggcaacaatgttaaataaaaggaatgctttatgttgtgctttcaagttgataaattgtggcaacaggagattttgctttacgtaggcaatatattgagaagctactcttactcatccaccatgaataatctttgctgcagtggagcttcatgtcggcgaacaatgcaaacgttgtacttctttcatgcgattgagtagttgatgttttacttctgttgccaccaacagttgaacgctgtacttgcagattgataagatctccgtgctttctaaaaaaaaaaaagactagtgggaaaa

SEQ ID NO: 32213 - DNA, 396 bp, Zea mays
  Clone ID: LIB3059-034-Q1-K1-H10
agcaaatactgatccttgttattctgcatttcacgatgaagagtggggagttcctggtcacggtgacaggaagttatttgagctgctagtactgtcaggggcattagctgaactgacatggccagcaattctgaataagagagacatattcagggaagttttcatggattttgacccagtatcagtctcaaaattaagtgagaagaagattatcgcacctggaagccctagcagttccttgttatccgaacagaaactgcgcggtgttattgaaaacgcacgccaaatactcaagatcatagaggaatttggatcgtttgataaatactgttggagcttcgtgaatcacaaacctatattgagccggttcaggtactcccgtcaagtgcctgtcaa

SEQ ID NO: 32214 - DNA, 274 bp, Zea mays
  Clone ID: LIB3059-034-Q1-K1-F6
cagctagctggtgtgagccctgctaccttcttgatacaaccacagttgttgccggtgtaccagcacgctgcgcctaacgctggcaccctcttacaactgcaacaattgctgccattcaaccaacttgctttgacaaacccagcagcgttctaccaacaacccatcattggtggtgccctcttttagatttcttatgagttatagttcaataataaagttttttgtctgatgtttgtggcttcccagaaataagaaagtacatttctagattctt

SEQ ID NO: 32215 - DNA, 408 bp, Zea mays
  Clone ID: LIB3059-011-Q1-K1-H10
gatgattttttggcctctctcccagagaatgactgccgatatgcgctgtatgatttgcatttggttactgttgagaatgtgcagaaaagcaagattttcttcattgcctggtccccatcgacatcccgcatacgtgctaagatgctgtactccacgtcgaaggaccgcatcaagtacgagcttgacgggttccactacgaaatccaggctaccgacccatcggaggtggacatcgaggttctccggaagcgggctcactgaagctggttctccttttgaagggacctgtgaagggccgtgaaccttcagccagatgcaaattcaattatcaacgatgaagctcccgccgtggtgtttgttaataagttcctgtaagcatatcatttagtcgctatgcatgacactagc

SEQ ID NO: 32216 - DNA, 165 bp, Zea mays
  Clone ID: LIB3059-011-Q1-K1-H11
ctgtttttacacagcaacaaaaggtcccatggctcccagaagaccatgaaggttcgggtctatgatgtaattccttgttatctgccaattatgtatggactatggacatgtgttgcgctgttcaacttactactacaaataagtaatcgataatgttcccttccc

SEQ ID NO: 32217 - DNA, 417 bp, Zea mays
  unsure at all n locations
  Clone ID: LIB3059-011-Q1-K1-H12
cccggtggaccgagcgtccgtacattcacagttacaaattgaaccttcatctaaaaactcagcaccctgaacacggggaanaggaaaacggtaaggtcggtgcttctggtgggcagcatgctgcgaacgaacacacttaccagtataactatgccgaggttggcgagattgcaccaaaccccaaaaggagcaagacgaatcatgggcacaaggtccactcatccaaagcctacaatgccaaggtttcgagagcaatgccttctgacattggcgtcaggaaccagtggccaggtaaagctacgtaccaagatgatagtgaagagacggaagaagatggaggcaacaacattgaagatggctggagatatggcaacaatgatgacgatgaggaaacaccagatgaagattgacctttat

SEQ ID NO: 32218 - DNA, 234 bp, Zea mays
  unsure at all n locations
  Clone ID: LIB3059-011-Q1-K1-H2
ccctctgcgaccacgcgtccgaaaanaaaaaggtttttaaaaaatttaaaaaaaataaaaaaaaaaaaaaaaaaaagaaaaatttcgaaaattataaaaaccaagaaaaccaaaacaaacaaaaaaaaaccacccaaacaaaaccaaacaaccacctataaaaaaaccaaaacaaaaaaaattaaaaaaaacccacataaaaaaaaaactgcccttcccaaaaccaaaaccccc

SEQ ID NO: 32219 - DNA, 438 bp, Zea mays
  Clone ID: LIB3059-011-Q1-K1-H3
cccacgcgtccgcccacgcgtccgcgcaaattgcaccaagaaatccatcgagaggccggcgacaggggaattaatggcgtcgtcgtctagcagcagccaccgccgcctcatcctcgcagccgccgtcctgctctccgtgctcgcggctgccagcgccagcgccgggacctcctgcgtgccggggtgggccatcccgcacaacccgctcccgagctgccgctggtacgtgaccagccggacctgcggcatcgggccgcgcctcccgtggccggagctgaagaggagatgctgccgggagctggcggacatcccggcgtactgccggtgcacggcgctgagcatcctcatggacggcgcgatcccgccgggcccggacgcgcagctggagggccgcctagaggacctgccgggctgcccgcgggaggtgcagaggggatt

SEQ ID NO: 32220 - DNA, 439 bp, Zea mays
  Clone ID: LIB3059-011-Q1-K1-H5
cttctccagaaaggttatggtttgggatctggtatttctctgttcatggctaccaatgtctgtgagaatatcatctggaaggcatttagccccacaaccatcaacagtggtcgtggtgctgaattcgaaggggctgtcattgcactgttccatctgttgattacgagaaccgataaagtccgtgctcttcgtgaggctttctaccgccagaaccttccaaatgtgaccaatttgcttgccactgtcttggtattcctcatagttatctatttccaaggcttccgtgttgtgcttccagtgagatcaaagaatgctcgtggccagcaaggctcatatccaattaagctgttctacacttcaaacatgcccatcattcttcactctgcgctgattaccaacctctattttatatcccagcttctctacaggaagtacagtg

SEQ ID NO: 32221 - DNA, 430 bp, Zea mays
  unsure at all n locations
  Clone ID: LIB3059-011-Q1-K1-H6
gcacagcacatagaagtgaaatccataccaccaccgaaccacggattgcctacganaaattgttcccttctttacccccttggctctttctcaatggttgctaacccaaaaattttccttaaaggtcacaagaatctcatatagttcccttttttcccatatacctcacataaatgatctctacagtttgaaaacccccatctcttcagccctataggctccaacaagcaatcgcagcaagcaacatacctttatcacccttgttgtttcaacaatcgccagccctatctttggtgcagtcattggtacaaaccatcagggcacagcagctgcagcaactcgtgctacctgtgatcaaccaagtagctctggcaaacctttctccctactctcagcaacaacaatttcttccattcaaccaactgtctac

SEQ ID NO: 32222 - DNA, 380 bp, Zea mays
  Clone ID: LIB3059-011-Q1-K1-H7
gccttcttcttcaaggtgctcaagcaggtgcacccggacattggtatgtcgtccaagggcatgtccatcatgaactccttcatcaacgacatcttcgagaagctggctgccgaggccgccaagctcgcccgctacaacaagaagcccaccataacctcccgggagatccagacttcggtgcgcctcgtccttcctggcgagctcgccaagcacgccgtctccgagggcaccaaggccgttaccaagtttacttcctcttagatcgccgccgcacggagcgacggctctgtttcgtttcctcgtacttttaggccagtgctaataggttgctcgaggaacaatgtagtgtggaaatttctaatatattccaaattgtgctg

SEQ ID NO: 32223 - DNA, 443 bp, Zea mays
  Clone ID: LIB3059-011-Q1-K1-H8
cccacgcgtccgatacaagacagcctattattcattttatctgccgggggcatgtgggctgctgctctctggcgagaatttggacaattatggtgatgtagagaacatccttgttgaaatgggaacatactttcaagtccaggatgactatctggattgttatggtgatcctgaatttatcggcaagattggaacggacattgaagattacaagtgctcatggctagttgtgcaagcccttgagcgtgctgatgagagccaaaagcgcattctatttgaaaattatggcaagaaagatccagcctgtgtggcaaaagtgaagaacctctacaaagaacttgacctagaggcggtatttcaggagtacgagaatgagagctacaagaagctgattgcagacattgaagcccagccaagcattgcggttcagaaagtgctgaaat

SEQ ID NO: 32224 - DNA, 391 bp, Zea mays
  Clone ID: LIB3059-011-Q1-K1-H9
ggtcctccaacaatcatcagccctattacatcagttacctttggtgcatttattggggcaaagcatcagggcacaacaactacaacaacttgtgctagcaaaccttgctgcctactctcagcaacagcagtttcttccattcaaccaactagctgcattgaactctgcttcttatttgcaacaacaacaactaccattcagccagctacctgctgcctacccccagcaatttcttccattcaaccaactggcagcattgaactctcctgcttatttacagcagcaacaactactaccattcagccagctagctggtgtgagccctgctaccttcttgatacaaccacagttgttgccgttctaccagcacgctgcgcctaacgcttgcacc

SEQ ID NO: 32225 - DNA, 360 bp, Zea mays
  Clone ID: LIB3059-012-Q1-K1-A1
cgcgtacgcgggcgcgtgggcggacgcgtgggtggttaagccatatggaaatatggggttttccatgaatggtcgttctggtccatggtaccggtattaatgaatgccgtgggtggaattcttgttggtcttgtcacaacttacgcaggtggtattagaaagggttttgttatagtctcagctctccttgtaactgcactgctacaattcgtgtatgatgggaagccaccatcactctactgcctgatggcattaccacttgttgcgacaagcatattcatctaccataagtatccatatgtggataagaagaagaaagtctgatgcacataattgtcagagatgggaagtatcatcagc

SEQ ID NO: 32226 - DNA, 409 bp, Zea mays
  Clone ID: LIB3059-012-Q1-K1-A10
cccattcgagccacgcgtccgcgttcaggattatacaactcaccaatccatgcgcactaccaacaacctaacaacaagtgctggtaatatattagccctgcttgcgcttcttgcccttattgtgagcgcaacacatgcgttcattattccacaatgctcacttgctcctagtgccatcattacacaggtcctctcaccagttacttcaatgggcttcgaacacctagctgtgcaagccaacatgcaacaacaagcgcttgcggcgagcgtcttacaacaaccaattgcccaattgcaacaacaatccttgccacatctaacaatacaagccatcacaacgcaacagcaacaacagttcctaccagcactgagccacctagccatggtgaaccctgccgtctacttgcaa

SEQ ID NO: 32227 - DNA, 424 bp, Zea mays
  Clone ID: LIB3059-012-Q1-K1-A11
attcaaaaacacaccaagcgaagcgcactagcaacgacctaacaccaatggcgaccaggatattagccctccttgcgcttcttgcccttttagtgagcgcaacaaatgcgttcattattccacagtgctcacttgctcctagtgccagtattccacagttcctcccaccagttacttcaatgggcttcgaacatccagccgtgcaagcctacaggctacaactagcgcttgcggcgagcgccttacaacaaccaattgcccaattgcaacaacaatccttggcacatctaaccctacaaaccattgcaacgcaacaacaacaacaacagtttctgccatcactgagccacctagccgtggtgaaccctgtcacctacttgcaacagcagctgcttgcatccaacccacttgctctggcgaacgt

SEQ ID NO: 32228 - DNA, 423 bp, Zea mays
  Clone ID: LIB3059-012-Q1-K1-A3
ctgctatgtttgctggaccgcagttcattcccattggtggaaacatcatgggtcatgcgtcaaccacaaggcttgctcttcgcaaggggcgaggggaggaacggatctgtaaagtaataagctctccctgccttgctgaagccgaagcaaggtttcagttagcttctgaaggtattgcagatgttaaggattgagaccatacctgctttacaggcatcttcagatccattggtctgctatttgctttgtcattccttgggccaactttcgtgttacctcaccttgatgtacaaaacggtttcgttcacatatgtgaatgcacgcctgttactgatttaagcgtcctgttgtaaataaaacgatgcctgttgccctgttgtgtgttgcatgtaatcgacaactctacatatcacaaaataaaaa

SEQ ID NO: 32229 - DNA, 425 bp, Zea mays
  unsure at all n locations
  Clone ID: LIB3059-011-Q1-K1-H1
cccacgcgtccgcggacgcgtgggtgtacgccaacgaggtgcccaagaccgcggagagcttccgcgggctgtgcacgggcgagaagggcgtgggcaagtccgggaagccgctccactacaagggctccaccttccaccgcgtcatccccgagttcatgtgccagggcggcgacttcacccgcggcaacggcaccggcggcgagtccatctacggcgagaagttccccgacgagaagttcgtgcgcaagcacaccgnccccggtgtgctctccatggccaacgccgggcccaacaccaacggctcccagttcttcatctgcaccgtcgcgaccccttggctcgacggcaagcacgtcgtcttcggccaggtcgtcgagggcatggacgtcgtcaaggccatcgagaaggtgggcacccgcaacggc

SEQ ID NO: 32230 - DNA, 444 bp, Zea mays
  unsure at all n locations
  Clone ID: LIB3059-011-Q1-K1-F3
ggagattcagatccacacacatccgcatccctctctcctcggtttcctctcccaccaggaacccccggatcgcagcgatctccgccgccgccctctctgggattccgcgcgacaaagtcaggcgtagaggctccaggaggaggagggaggcgcagcagggcgggtgggggagatgttcctctgggactggttctacggggtgctggcctccctcggcctgtggcagaaggaggccaagatcctcttccttggcctcgacaacgccggcaagaccacgctgctccacatgctcaaggacgagcggttggtgcagcaccagccgacgcagcacccgacgtcggaggagctcagcatcggcaagatcaagttcaaggcgttcgacctcggcggccaccagatcgcgcgccgcgtgtggaaggattactacgcanaggttgatgctgt

SEQ ID NO: 32231 - DNA, 445 bp, Zea mays
  Clone ID: LIB3059-011-Q1-K1-F4
cagaaacacacctagcgaagcgcactatcaacgacctaacaacaatggcttccaagagattatcccgccttgcgcttcttgccctttttgtgagtgcaacaaatgcgttcattattccacaatgctcacttgctccgagtgccattattccacagttcctccctccagttacttcaatgggcttcgaacacccagctgtgcaagcctataggctacaacaagcgcttgcggcgagcgtcttagaacaaccaattgcccaattacaacaacaatccttggcacatctaaccatacaaaccatcgcaacgcagcagcaacaagcactgagccacctagccgtggtgaaccctatcgcctacttgcaacaacagctgcttgcatccaacccacttgctttggcaaacgtagctgcataccaacaacaacaacagttgcaacagtttct

SEQ ID NO: 32232 - DNA, 444 bp, Zea mays
  Clone ID: LIB3059-011-Q1-K1-F8
cggacgcgtgggcggacgcgtgggctggctctgtcagctgccagcgcgtctgcaatgcagatgccctgcccctgcgcggggctgcagggcttgtacggcgctggcgccggcctgacgacgatgatgggcgccggcgggctgtacccctacgcggagtacctgaggcagccgcagtgcagcccgctggcggcggcgccctactacgccgggtgtgggcagacgagcgccatgtaccagccgctccggcaacagtgctgccagcagcagatgaggatgatggacgtgcagtccgtcgcgcagcagctgcagatgatgatgcagcttgagcgtgccgctgccgccagcagcagcctgtacgagccagctctgatgcagcagcagcagcagctgttggcagctcagggtctcaaccccatggccatgatgatggcccagaacatgccg

SEQ ID NO: 32233 - DNA, 418 bp, Zea mays
  Clone ID: LIB3059-011-Q1-K1-F9
cccacgcgtccgcccacgcgtccgcagctagctagcagatcgtttcgagtgaagatggaaaggtgtagagagatggaaaggatgagttcgtcgctgcagtactgggtggaggagcacaagctctcaaccatcggagccgtgtgggcgacggcggtgggcgcgtcggtggcgtacagccggcggcgggcgccggcgcgggcgacgggcatgcgcctcatccacgccaggatgcacgcgcaggcgctcacgctcgccgtcctcgggggagccgcgctcgcgcaccactaccacggcaagagcaccaacgccgggaagaggcagcagcaggaggacctggactacggcttctactcgcagctgccgccggccaccgacgccgacggcaacgagaacgagcgctggagctggtagagcatgc

SEQ ID NO: 32234 - DNA, 259 bp, Zea mays
  Clone ID: LIB3059-011-Q1-K1-G10
acttatcactttcccttcttccttcttacttcaacaacaaggatttgttttatatcaacgttttcttacaaacatatctcctttctttaaacatcaactattacttacattttacctcacaatttcactcaaccattaacaccttatccctcaaactacaatttctaccattatcatccaccctatttaataaacaatataatctttatactacaacaactatttcataatatcaaaccatacttctatttactaatat

SEQ ID NO: 32235 - DNA, 360 bp, Zea mays
  Clone ID: LIB3059-011-Q1-K1-G11
cgcaaattgcaccaagaaatccatcgagaggccgtcgacaggggaattaatggcgtggtcgtgtagcagcagccaccgccgcctcatcctcgcagccgccgtcctgctctccgtgctcgcggctgccagcgccagcgccgggacctcctgcgtgccggggtgggccatcccgcacaacccgctcccgagctgccgctggtacgtgaccagccggacctgcggcatcgggccgcgcctcccgtggccggagctgaagaggagatgctgccgggagctggcggacatcccggcgtactgccggtgcacggcgctgagcatcctcatggacggcgcgatcccgccgggcccggacgcgcagct

SEQ ID NO: 32236 - DNA, 450 bp, Zea mays
  Clone ID: LIB3059-011-Q1-K1-G2
cggacgcgtgggcaagcgtggaagacggcgagctatatggcgtgcaatcgcggcgtggaggagcaggaggaccccagcgcggcgtctgcagccccagctccggcggctgtggctagggcgagggcggcgcggcctccgaggccaaggagccgcaaggggctcggcgtgcggcacctgctgaagccctgccgattccttgcagctgtccagagggcgaatgccagggtgagggaagcgggggaggcgaccctcgtggcagcgcttgcggcggcccaaaaagagagcgagagggagaacgaggtggtggccgatgtatgcggcgggtggaagagtgaggatggaagtttaaattgtggatactcaagcattagaggcagaagggtaaacatggaagacttctatgacataaaatcttctagagttgatgataagcaaataaatttttttgga

SEQ ID NO: 32237 - DNA, 443 bp, Zea mays
  Clone ID: LIB3059-011-Q1-K1-G3
cccacgcgtccgctcaaaggctcatgcggcaagtcgctcgcgccgttcccgcaagggtgcttctactgcaacgccctcggagggctcaagtgctacgagaaccccaagcacaaggtcaccgctgtccccgccgacgaagaagagatctgcggtgccactttcaaggtggtggaagggtctactgtcctgacggcgctgcactgatctatcatcatcaggcggaggcgatgcgatgatgatgcagaactttgtacatgcgttggtggatggtggtgtaacatagtggctgccaacaagtcatgctcatgcaaaccgatgaatctatctctgtatcatcgatctcggttgcttgctagtccagactccagacatggctatatatatatagctggtgctaataaataggagtataatcgtcatatcgatcggttgcgtgtggaatg

SEQ ID NO: 32238 - DNA, 444 bp, Zea mays
  Clone ID: LIB3059-011-Q1-K1-G4
aaatactgtgatgtctaaaagaaagttgaatcgacttgtgacagagaactgggtagaggggtgggatgatccccgcttgttgacactggctggactccggcggcggggagtatcatcaaccgcaataaattcctttatccgtggaatcgggataacaagaagtgacaacagcttaattcgtgttgatcgtctagaataccacatcagggaagagcttaacaaaacagcccctcgaaccatggttgttttgcgtcctctaaaggtggtaataactaacttggaagaaggaaaagtactagaccttgatgggaaaatgtggccagatgcttctgatactgatgcttcctctcactataagcttccgttctcaagaactgtctacattgagaaaactgattttcgccttaaggactcaaaagactactatgggctggcccctggtaa

SEQ ID NO: 32239 - DNA, 180 bp, Zea mays
  Clone ID: LIB3059-011-Q1-K1-G5
tcccactcgtccgaaaaaaaaaaaaaaataaaaaaaaaaaaaaaaaaaaagaaaaaatagaaaaattaaaaaaaataaatacattcataaaataacaaaaaatacaaaaaaatacattcatatataatatctacttaaatttaaatctcattaaacttaaatctttttcaaccttacttt

SEQ ID NO: 32240 - DNA, 399 bp, Zea mays
  Clone ID: LIB3059-011-Q1-K1-G9
ccttcacattgactgttataatggcaactaatcgggcagacactctagatcctgctgtgttgggtcctggtagacttgacaggaaaattgagttccctctgccagaccggcgtcagaagaggcttgtttttcaagtttgcactgccaaaatgaacctcatcgctcaggttcattttggcagtgcaaacttgaacctgagcgatgaggttgatttggaagattatgtttccagaccggataagatcagtgctgctgatattgctgctatctgccaagaggctggcatgcatgctgtccgcaaaaaccgatatgtcatcctccccaaggactttgaaaagggctaccgaaccaacgtgaagaagcccgagacagactttgatttctacaaatgagtcaacc

SEQ ID NO: 32241 - DNA, 394 bp, Zea mays
  Clone ID: LIB3059-011-Q1-K1-F12
gcaggctatccgcccggtcagcaagaagatggctttcgtcgtgctgcgccagagcaggagcagcgtgcagtgcgtgctcgttgccagcgccgacgccggcgtcagcacgcaaatggtgcgcttcgccaccgccttaagcaaggagtccatcgtcgacgttgagggcgtcgtgtccctccccaaggagcccctcaaggccaccacgcagcaagttgagattcaagtcaggaagatctattgcatcaatagggctatcccaacccttccaattaaccttgaagatgcagctcggagtgaggcagattttgagaaggctgaactggctggagaaaagcttgttcgtgttggtcaagatacccgcttgaactacagagctattgatctacgaacaccc

SEQ ID NO: 32242 - DNA, 219 bp, Zea mays
  Clone ID: LIB3059-011-Q1-K1-E10
cctactcaaatatctaacacctcctcaaacaaacttttcacaacattactcattacaatactaatacctatactctttctacccataaaaatctctattcccaccctatactacaatgacatcctccccaaattccatatacattacacaataataccaataccatcaataatatcactttaaaccaactccatcacaactccaaacactaatccctct

SEQ ID NO: 32243 - DNA, 416 bp, Zea mays
  Clone ID: LIB3059-011-Q1-K1-E11
gcattgctggatcgttagctgggaagccatccgatggacgcctggtaaatagttacggttgggacttggaagatctcccaatgatgcttctgcagcaggttgccagccaagtaatccactggctccacgatgaagcggtggtccttgggatgaacgcgacaatagatttcctgtgcctgtacttggaccttgaccaaggtgaaacactaggcctggtggcacacgttgacccggatgacacctacggctgcgtctcatggtacctcactcttgatcatcacccaacggaggaagggaagatgtcagcgggtagtccggagctagaggagcgcaggtttttggggtacctttccccggaattgctttactctaccctgatggacctggtaaaactgtgcagcacaggtgtccaacgc

SEQ ID NO: 32244 - DNA, 423 bp, Zea mays
  Clone ID: LIB3059-011-Q1-K1-E12
cgaatccctcgcatcgcattcgcagcctttgctgcatcacaccaccgcgaaaccccggcaggcgcatcgatggcgcctaaggcggagaagaagccggctgcgaagaagccagcggaggaggagcccgctgccgcgaaggccccggcggggaagaagcccaaggccgagaagcgcctcccggcggccaagtcgtccggcaaagaaggcggcgacaagaagggtaagaagaaggcgaagaagtcggtggagacctacaagatctacatcttcaaggtgctgaagcaggtccacccggacatcggcatctcttccaaggccatgtccatcatgaactccttcatcaacgacatcttcgagaagctcgccggcgaggctgccaagcttgcgcgctacaacaagaagcccaccattacctctcgggag

SEQ ID NO: 32245 - DNA, 446 bp, Zea mays
  Clone ID: LIB3059-011-Q1-K1-E2
cacagataagaaaggttaccgcaaaccgcttgctagcatctaaacagaccattcctcggtactactggacagtagatgcacgtgttgacaaacttgtcaagttgcgaggtgaactgaatccactgcaggatgcttctggtggaaagaaaatatctatcaatgatcttgtcatcaaggctgcagctttggctcttagaaaggtccctcagtgtaacagctcatggatgaatgattttattcgccaatatcacaatgtgaacatcaacgtggctgtgcagactgaacacggattgtttgttccagtaattagggatgcagacaagaagggacttggtacaattgctgaggaagtgaagcagttggctcaaaaagcaagagacaatagcttaaaaccagcagattatgagggtggcaccttcacggtatcaaacttgggaggtcccttc

SEQ ID NO: 32246 - DNA, 442 bp, Zea mays
  Clone ID: LIB3059-011-Q1-K1-E3
cccacgcgtccggctttacctcccaggtcatcatcatgaaccaccctggccagatttgcaatgtctgtgccccagttctggactgccacacctcacacattgctgtcaagtttgctgagctcgttaccaagattgataggcgatccggcaaggagctggagaaggagcccaaatttctcaagaacggtgatgctggtatggtgaagatggttcccactaagcccatggtggtggagaccttttctcagtatcctcctcttggtcgatttgctgtccgtgacatgaggcaaacggtggctgtcggagtcatcaagagtgtggagaagaacgacccaactggagccaaggtgacgaaggctgctgccaagaagaaatgatctatctgtctggtgctgtgcttgcttgttggttacctcgtggaagcttaaaatatctcgtcttg

SEQ ID NO: 32247 - DNA, 341 bp, Zea mays
  Clone ID: LIB3059-011-Q1-K1-E4
ggaggaggaggcagcgcctgctgttgctgccactcctgaggtcgcagcgaccgaggaggaagcggcggcccctgctcccgaggccgccgtcgagtgagtccagccagcgccggacggcggccgatctagctcgctgcgtcagcctgtcacctggcgtgcgccgcgctggtgccactgccacggcaacagcacggcatggcgccggcataggtcgctaggaaaaacctgcttttgtgttcgggttcacgtcgtgtcctacgtggcgcggcgggccccgcctagtaaaggagcgtaggagcgtcgttttgtgttgtggtcgaataaataatgtgtctgtgtgc

SEQ ID NO: 32248 - DNA, 426 bp, Zea mays
  unsure at all n locations
  Clone ID: LIB3059-011-Q1-K1-E6
ggacgagcaagctgatcaagtcggtgaccggcctggagctgccggtgcggccggtgggcacgctcatctgctactggaaggtgaggcccgggcgcgagcaggagctcaccccggaggccgggttcccgacgttcgccagctacggcgacccctacatctacagcacgccgtcgatggagttcccggggctgatcaagatcgccatgcacggcggcccgccgtgcgacccggacggcagggactggtccacgggcgcgggcgacctggtggagccggtggcccggtggatcgacgccgtcatgccgggccacgtcgacaccgccggcgggcccgtcgtccgccagtgctgcatgtactccgtgacccccgacgacgactacgtcgtcgacttcctcggcggngagttcgggaaggacgtcgtcatcg

SEQ ID NO: 32249 - DNA, 440 bp, Zea mays
  Clone ID: LIB3059-011-Q1-K1-E7
agcgagacaattggaattgtggatcataagtttgtttcatcaatgaagagggggtcagatctggtcaacattgctcggggacgcctgctggactacaaggctgtgtttgatcacctggaatcgggccatctagctggtctggggattgatgttgcttggatggagccatttgatcctgaggaccctgttctgaaattcccaaacgtcattctaacgccccatgtggccggcgtcaccgagtattcctacagaactatggcaaagtctgttggtgacaccgcccttcagcttcatttaggcgaggcgttcacggaggtagagttcgtcaactaaaaaaccgtccaggcggcagccgtagacgcatgccattcgtgggctatcggaaccgctgatgcgatcatttgtagagaataatggatccgcgacttgtaagaataaac

SEQ ID NO: 32250 - DNA, 436 bp, Zea mays
  Clone ID: LIB3059-011-Q1-K1-E8
attctgacggccaaggggcagccagatgtcgccacccggctgttcctgcggaggctggaggttgagctgaagctgccagtgctcgcgctggtggattctgatccatacgggctcaagatcttgtcggtgtacatgtgtggttccaagaacatgtcgtatgacagtgccaatctgacgacgccggacatcaagtggctcggtgtccggccgagcgacctggacaagtacagagtgccggagcagtgccgtctccccatgaccgatcacgatatcaaggtggggaaagagctgctcgaggaggacttcgtgaagcagaatgagggctgggtgaaggagctggagacgatgctgcgcaccaagcaaaaggctgagatacaggccctcagttccttcgggttccagtacctcaccgaggtctacctgcctcttaagttgc

SEQ ID NO: 32251 - DNA, 433 bp, Zea mays
  Clone ID: LIB3059-011-Q1-K1-E9
cctctacctaccggagcagggagcacgccacacgagccctttccgccgccgccaaaggggtgagcgttcctaagaccaagaagacctactgcaagaacaaggagtgcaagaagcacactctccacaaggttactcagtacaagaagggtaaggatagcctgtctgcccagggaaagcgccgttatgaccgcaagcagtcaggatatggtggccagaccaagcctgtcttccacaagaaggccaagaccaccaagaaaatcgtgttgaagctgcagtgccagagctgcaagcactactcacagcacgcaattaagaggtgcaagcattttgagattggtggagacaagaagggcaagggaacatctctcttctaagtttctcatcgcccatctcgatgttggatcgaagctatgggtctactactgttctaaaa

SEQ ID NO: 32252 - DNA, 448 bp, Zea mays
  Clone ID: LIB3059-011-Q1-K1-F1
cccacgcgtccgattcacgtgcagctgtcgggagcaggcaatggcgccggatctaagggaactcggggccgccgctccagcccgtggcgcctacctcgccggcgtcggtgtcgcggtcctcctcgctgcctccttcctcccagtagccgagtcgtcctgcgtgcgagataactcattggtgagagacataagccaaatgccgcaaagcagctatgggattgaaggattgtcacatataacagttgctggtgcgctcaatcatgggatgaaggaggtggaagtgtggcttcagacaataagtccaggtcaaaggacgccaatccacaggcattcctgtgaagaagttttcactgtcctcaaagggaagggtacgctcttgatgggatcaagctcactaaagtacccagggcagccacaggaaattcctttctttcagaataccacattt

SEQ ID NO: 32253 - DNA, 406 bp, Zea mays
  Clone ID: LIB3059-011-Q1-K1-F11
gtgcgcctccatgaggaacggcggtgccaccgaagtcgtcgccggggatgagtcgtcgtcctggccgtgggcaggcgtgttcagggtccccgacgggtggacggcggcgcggagcgagctgggcggggtcatgaaggccaccaaggccgtggccatgttccaggcgctcgccgtcaagagaggcgccgtcctcaaggacaggactgaggtggtggacatcacctcctccaagcgaggtgaaggagaggggtcaatcatctcggtgaggacgtccagcggcgaggagttccacggcacgaaatgcatagtgacagtgggcgcatggacgagcaagctgatcaagtcggtgaccggcctggagctgccggtgcagccggtgcacacgctcatctgctactggaaggtg

SEQ ID NO: 32254 - DNA, 424 bp, Zea mays
  Clone ID: LIB3059-011-Q1-K1-C11
gtttagtttcgaaaaaatctgaaaaaaaattctggtcgaggggaggaggcgatgtcggcgcgagtggcggtggtgcctaatgggggcccgggcgctgtccccgcggtggtgtcgccgggagctgtcggcgtggctcagcctctcccgaccacgtcgctctacgtgggcgacctggagggggccgtctcggactcgcagctgtacgaactcttcagccaggcggggcaggtggtgtcggtgcgcgtctgcagggatgtcacctcgcgccgctcgctcggatacgcctacgtcaactacagcaatcccttggatgctgcgagagcattggaagtgctgaactttgctgctcttaacaacaagcctatccgggtgatgtattcaaaccgtgatccaagcagccgcaggagtggatctgctaacattt

SEQ ID NO: 32255 - DNA, 396 bp, Zea mays
  unsure at all n locations
  Clone ID: LIB3059-011-Q1-K1-C12
cccacgcgtccgcccacgcgtccgcggacgcgtgggttgagcgggtgagacatttgaggagagtccgaggtgttagcaaagatctggggtgtagctgggttgagctctacaaccgagttcatgtgtttgttgttggggaacaacaacatcctgaagcggaaaatataaatgtagagttgataaggctagcgaagcatatgaaggacgaagagtgtttcctgtttgatgacgaaaaggatgaactaggagattctcatgaaggtgaacaaatggaattgatatcaacaacatattactgagttcgcaagagattgatcccatgatgtcagacaaacaccctgttaaagcaatgtgtgacatccgtgatttggggttattntatgttgtattttcttt

SEQ ID NO: 32256 - DNA, 426 bp, Zea mays
  Clone ID: LIB3059-011-Q1-K1-C5
aaaagtgatgctgtggatcctccaaagaaaagaggacgtccaaaaggggggggatccgtcaatgggacacccagtacctcagctactccgagcacaaaggggaaaactgccggcaaggttaccaaagaaacacctaaaactggccccaaccttaaaaaagaacttgagaagaactccaaggacaaggctaatgtttcaactgggacaaaagatgataagagtgtgagcaaacctaaggaggctattatcaaaggcaaggattcaaaagacgaaggcaagtccactgaaggaaaagctaagcctggtcggaaaccaaaaaatgctggtactcctgcgggtgattctgacaaagagaagcaggaggtagaagtcaaggcagctgaaatagaggaggcatcaggaaatgcttccacagggaagaagcgt

SEQ ID NO: 32257 - DNA, 440 bp, Zea mays
  Clone ID: LIB3059-011-Q1-K1-C8
ctggaggagggcaacttgatttgctcatcttggattgcctatacaggacgggttctgacaatgtgcacttgtgttgggaccagacactagatgctgttaggaggatttgccccaaaagagcactgcttattgggatgacccacgagatggatcatcacaaggacaaccaaacattggaagaatggtccaggagggaggggattgacgtgcagttagctcgtgatggcttgcgtgtctacattgatctgtagccgtgaaaggaaaatatgccatactcagcgaaccgcgccaggctttctggctgatgtaacatccattcccacttgtgaagaaagtgcaaactgactaaaaaggcgagcctatttggtgcatcattttacgtttcgctagtttatacgtgaatctctgaataaaaaagagaaaaagaaaagaaaagagag

SEQ ID NO: 32258 - DNA, 368 bp, Zea mays
  Clone ID: LIB3059-011-Q1-K1-C9
cgcacgcgtccgcgccagccagccatcgtcacactggtgagctctgcactctgcttggctccgagcttcagtgccttcgttgtttggtccacgcagtccacacacacacaccagtacgtccagctgcactgcaccaatggccgccgtcgaggtccaggtcccgactgccgctcccgtcgaggaggttgcccagctggccgccgcctccgccgtcgagatcccgaacgaggagaccgctgctccggcggtggagaccgaggtcgtcgtcgctaaggagccggtgccggccgaggccgagactgagtccaaggaggtcgaggtcgaggctgaggccgaggccgaggccgtagctgaggctgagccgaccg

SEQ ID NO: 32259 - DNA, 400 bp, Zea mays
  Clone ID: LIB3059-011-Q1-K1-D11
gcgtgctccaccggtctctgcttcttggcgtcgattcctcctctctcagcctcttgttcttcgggctcctcctgcttcctcatgatcaagcgtgtgtcctctgctccgtccttgtccagatggacgatccaatacaagcaattgggacatacaatatatcggagaagccacgttctggcctttgctagtgcagatgcaccacaaggcaaaagaagctcaggtgagaatgttgtgatggttgatccactggaagctaagcgcctagctgctaaacaaatgcaagaaattagggccaaagaaaagctgaagaggcgccgtcaagcagaagcgatcaacggggcattggcagtgataggactcacggctggattgctagtggaggctcagacaggaaaggaca

SEQ ID NO: 32260 - DNA, 427 bp, Zea mays
  Clone ID: LIB3059-011-Q1-K1-D12
ctgacgcgtgcgctgtttgtgaggaatgcgacatgctgaagatagagtttttgcagtgatggggcctacacttgacgcacagggttgttcttgtatagacaaaaggggagaaatgacacctccaatctcgagaattgtcgaacaaggacagatctgacacctcaattgcgagaaataaacatcacagccgacagttgcatgatccctgaacgaataaattcagaactagaaaacagatgtcactaaacaacatgtggtgaatgttggaacttgaactgctctacttaagtgggcatctgctgctgcatgctttgcatggatttaatgattcgtttattttcttacttgtactgaagtgctctgattcggtacgatcacttgttgtgaagtgcttgaatgctatatggtatcatgagaattaataaac

SEQ ID NO: 32261 - DNA, 430 bp, Zea mays
  unsure at all n locations
  Clone ID: LIB3059-011-Q1-K1-D2
gacactcaatccttgaatgctaaattttatacttaactccatgctcaccagatcccggactacaatggcatggctaacaactcgaatgatcctaacaaccttaccacttcctataaagacattaacaaggatctaagcgtacattttaagaacacactgtagactgcctatgcacttggccagttggctttgaccaatgctatgctataccttgaggatgttattgctcacatgcaggcatttccattgcacagatactactgttgtgttcgtcgcacctggcacactaagaatgatcactccaataggcanggtccaatacatgattaaatgagaacaatgtcatcctgcatttgatgaacaatgctgatactcacgatgatgtgcatagctaagatcttgacatgctctatattttacacgttcatgt

SEQ ID NO: 32262 - DNA, 443 bp, Zea mays
  Clone ID: LIB3059-011-Q1-K1-D6
gcaacatagaaagtggaatccagtagcaacaatagagcaacaatggctgccaagatagtttccctccttatgctccttgctctttctgcatgtgttgctaacgcgacaattttccctcaatgctcacaagctcctatagcttcccttcttcccccataccttccatcaatgatagcttcagtatgtgaaaacccagctcttcaaccctataggctccaacaagcaatcgcagcaagcaacatacctttatcacccttgtttcaacaatcgccagccctatctttggtgcagtcattggtacaaaccatcagggcacagcagctgcagcaactcgtgctacctgtgatcaaccaagtagctctggcaaacctttctccctactctcagcaacaacaatttcttccattcaaccaactgtctacattgaaccgtgctgcttattt

SEQ ID NO: 32263 - DNA, 421 bp, Zea mays
  unsure at all n locations
  Clone ID: LIB3059-011-Q1-K1-D7
aacgccttcaagcccatctcggtagccggagaacgagcagcagcggaggcgatgtcggccccgtatcccggccacacgccggcgcaaggcgaggaatctgcctccccctcctcgtggcctcccagaaagctccagagtttcacaccagggctgtggtcacaatacaaagcttatgaggatgcagttgtggagaacattaaaggaactattgcggatgctctggttcttgtgagagagcatcaggcggaggcaattggatgtgccactgttgcaggattcattctgttcagaggccctcgaagatttttataccgcaatacctttggccgtttgaagactgagaaagatttactgaatgatgccgagcanagtatgatggagtaccanacatctattcagaactttgaagaaagaattcaaa

SEQ ID NO: 32264 - DNA, 221 bp, Zea mays
  Clone ID: LIB3059-011-Q1-K1-D8
cggacgcgtgggcggactcgtgggcaactacaacaattgttgcccttggtccaactggctttgacagacccagcggcctcctaccaacaacacatcattggtggtgccctcttttagattgcttattagttgtaattcaataataaagttttctggaaatgtaacttcttatttctggttggccacatacatcatccaaaaataagaagttacatttccag

SEQ ID NO: 32265 - DNA, 238 bp, Zea mays
  unsure at all n locations
  Clone ID: LIB3059-011-Q1-K1-A7
taatataacancctatacttacaccttccatantacaatctctaaattccccactttcaatatcttacaatttaaattctattcctacatcaatttttaaccttctttaccattaaaattctttataaaccattcattattttctcatcaaactctcaactcaaaaacattctcttctttccattaatctttaaatctcaaatccctgttcccaactattttcccatatcacttcttt

SEQ ID NO: 32266 - DNA, 443 bp, Zea mays
  Clone ID: LIB3059-011-Q1-K1-A8
gctaaatacagcaatggctaccaatggtttaacaacattgctcattgcgggacttgagcatcgagaagctattgcccgcttgactctgctgaaactcataaaggttgtctatgagcatcatcctcgaccaaaacagctcatagtagagaatgacctccctcagaagctacagaacctcattgaagagcgcagggatggacaacggggcggccaacaagtgttggtcaaacaaatggccacctcattgctgaaagctctgcacatcaatacagtattgtgatattggtggatcatatgttttcctctcaagttgtatatgtttgccctagaggagaaggtgtcttttccttttgctctgctgtggtggtttctcatgagcaccagactcatctgttgtacctgatccctcttttttcgggagaaaggttttttaggtgcaggat

SEQ ID NO: 32267 - DNA, 326 bp, Zea mays
  Clone ID: LIB3059-011-Q1-K1-B11
tcccactcaacccactcgtccgcagaaaaaaacaaaaaccaaaaaaaatttacataaaaaaaaaaaaaaaaaaaaaaaagaaaaagtaaaattttaaactaacaaaaaaccacaccaacaacaacattaacatcaaacacacaaaaatcctccaacaccctcaaatcatccaaccaccttaaaacaccataatttaactaccatcttccttatctacttctaaaactacatcatccttatcaccctatttcattaccaccactttaatatatctatccaaccattcttcaaacaatattactcaactaacatactaattctatttc

SEQ ID NO: 32268 - DNA, 450 bp, Zea mays
  Clone ID: LIB3059-011-Q1-K1-B3
ccgacgcgtccgcccacgcgtccgcattcagaaacacacctagcgaagcgcactagcggcgacctaacaacaatggcttccaagacattatccctccttgcgcttcttgccctttttgtgagtgcaacaaatgcgttcattattccacaatgctcacttgctccgagtgccattattccacagttcctccctccagttacttcaatgggcttcgaacacccagctgtgcaagcctataggctacaacaagcgcttgcggcgagcgtcttagaacaaccaattgcccaattacaacaacaatccttggcacatctaaccatacaaaccatcgcaacgcagcagcaacaagcactgagccacctagccgtggtgaaccctatcgcctacttgcaacaacagctgcttgcatccaacccacttgctttggcaaacgtagctgcataccaacaa

SEQ ID NO: 32269 - DNA, 347 bp, Zea mays
  Clone ID: LIB3059-011-Q1-K1-B4
ccgacgcgtccggtaattccttgttatctgccaattatgtatggactatggacatgtgttgcgctgggcaacttactactacaaataagtaatcgatatgttcccttccaaaaaaaaaaaaaaaaaaaaaaaaaaaaaaaaaaaaaaaaaaaaaaaaaaaaaaaaaaaaaaaaaaagaaaaaaaaaaaaaaaaaacaaaacataaaaaaaaaaaacataaaacgtcatacattttcaatagagtaacctaaattaaataaactggccactgttaaacaactttcggactcaaaaaaacttgcctttacccacctaaatttccttgcagcacattcaattttccccag

SEQ ID NO: 32270 - DNA, 441 bp, Zea mays
  Clone ID: LIB3059-011-Q1-K1-B5
aacgaaacccagctgcaccagcaacttctgccagcagacccaacgacggaagcttttgttttctttcttttcatcgccgccgctcggggttcaaggttcagcgcgtccccgaatgacgggcacgtacgaggccttcgaccgtcctgctcctcccaactccgccggctaccggaccgacaaagtccggcgaaagcggctgacggcgcagaagaggaaagagatcaaggaggcgttcgacctcttcgacatcgacggctccggcaccatcgatgcaagggagctgaacgtcgcgatgagagcccttggattcgagatgacacctgagcaaatcgggcagatgatcgcggaggtggacaaggacggcagctgcaccatcgacttcgacgagttcgtgcacatgatgacggacaagatgggcgagcgggacgcccgtgacgagct

SEQ ID NO: 32271 - DNA, 428 bp, Zea mays
  Clone ID: LIB3059-011-Q1-K1-B6
gaagcaagggaatcacatcgccatggcagccaagatgtttgcattgtgggcgctcctggctctttgtgcaaccgccactagtgctacccatatcccagggcacttgtcaccactactgatgccattggctaccatgaacccatggatgcagtactgcatgaagcaacagggggttgccaacttgctagcgtggccgaccctgatgctgcagcaactgttggcctcaccgcttcagccgtgccagatgccaatgatgatgccaggtatgatgccaccgatgacaatgatgccgatgccgaatatgatgccatcgatgatggtgccgactatgatgtcaccaataacgatagctagtatgatgccaccgatgatgatgccaaacatggtttcaccaatgatgatgccgagtatgatgccttcgacgatga

SEQ ID NO: 32272 - DNA, 422 bp, Zea mays
  unsure at all n locations
  Clone ID: LIB3059-011-Q1-K1-B7
cccacgcgtccgcggacgcgtgggcgtacgcgtgggctcttttccaggtccanaccggaagaatctccaaccgggcggtgggcggtggcggcagccggcaggatctgtgccgcgatggcgacgtcgaacacggcgcggatggaggacggcggcggcgacctgcggagcaccatcaagaagtggaatatcatctaccctgtctacctcaactccaagaagacggtcgccgagggccgccgcatcgccgctgccaaggcctgcccggaccccacctgcatcgagatcgctgactgctgttcgcacctcaagatcccccacgccatcgagttggataaggcgtaccctcgggatttcttccaagtggggagggtcagggtgcagcttaagaaagatgacggctcccccgtcaatcctgctattaa

SEQ ID NO: 32273 - DNA, 420 bp, Zea mays
  Clone ID: LIB3059-011-Q1-K1-B8
ggcctgttcacctttacggctgcatacttaccatgggtcctattgggcttctctatcgtggtgggaagcagcacatgggttgatctcttgggtatgattgctggacatgtgtactactttctggaagatgtatacccacggatgactggccgccgtccgctgaagacaccgtccttcatcaaggcgctatttgctgatgacaatgttgtggtggcacagccacccaatgctgggattggtgctggtgcaaggtttggtgctatgggtctagatccccaggctcaatgatatgaattactttcagtgacctgaggctgtgactgatctgagatgcggcagtctgttcctctgcgcaagttgcggaactgtacaagtcattgttcttgtatttatacaggctagatgagaattcttgtgcat

SEQ ID NO: 32274 - DNA, 449 bp, Zea mays
  Clone ID: LIB3059-011-Q1-K1-C1
aggacgcctacatcccgctcaccacctacctccgcacctacaagatcggcgactactgctacattagggagaacggcaccgtccacaaggcgatgccgcacaagttctaccacggccgcaccggtcgcgtctggaacgtcaccaagcgcgccatctgcgtctagataaacaagcacgtgaatggtcgcatcatcaggaagcgtatccatgtccgcgtggagcatgtgcagccgtcccgctgcacacaagagttccgcctgaggaaggtgaagaatgaccagctgaaggcggatgcaaaggagcgcggccaggtcatcagcaccaagaggcagccgttgggccccaagcctggcttcatggttgaggggactaccatcgagaccgtcactcccattccgtacgatgtggtcaatgatcttaaaggctgatactaagttgttgtttggtct

SEQ ID NO: 32275 - DNA, 407 bp, Zea mays
  Clone ID: LIB3059-011-Q1-K1-C10
cggacgcgtgggcggacgcgtgggtagcaacatagaaagcacaatagtgtaccaacggtggcggccaaaatattttgcttccttatgctccttggtctttctgcaagtgctgctaccgcaaccattttcccacaatgctcacaagctcctatagcttcctttcttcccccatacctctcaccagcggtgtcttcagtatgtgaaaacccaattcttcaaccctacaggatccaacaggcaatcgcagcaggcatcttacctttatcacccttgttcctccaacaaccgtcagccctattacagcagttacctttggtgcatttgttggcacaaaacatcaaggcacaacaactacaacaacttgtgctaggaaaccttgctgcctactctcagcaacagcagtttct

SEQ ID NO: 32276 - DNA, 443 bp, Zea mays
  Clone ID: LIB3059-011-Q1-K1-A6
attgatcagacgcctgccatggcggatcagttcgtggattcggcgaagaatgtgatcgttgaggaggtgaacaagggcctgaacccaggaatggtggttctgcttgtggttgcaagcttcctgctgctcttctttgtggggaactatgcgatgtatgtgtatgcgcagaagacgctcccgccaaagaagaagaagccggtgtcgaagaagaagctgaagagggaaaagctgaagcagggggtctctgcgccgggagagtaaacggccatgctgccgatcctcccgtccagagctcctattcacatgattattaaagaaaaaaatttatatatatataccagctggagccgtagtgttggagtaactttgttctgtagatgctctgtctttaatggtacatctgtattggagactttaatggcctgagccgagctagtatgctt

SEQ ID NO: 32277 - DNA, 436 bp, Zea mays
  Clone ID: LIB3059-010-Q1-K1-H12
ctgtagcgtgggtactacaaacacaccgagcgaagcacattatccacaacctaacaacattggctaccaagatattatgagtacttgcgcttcttgcgctgtttgcgagcgcaacaaatgcgttcattattgcacaatgctcacttgctacaagttcaattattacacagttcttcccaccagttactccaatgggcttcgaacaccgagctgtgcaagcctataggctacaacaagcaattgcggcaagcgttttacaacaaccaatttcccagttgcaacaacaatccttggcacatttaacattacaaaccatcgtaacgcaccagcaacaacaattcttaccagcattgagccacctagccatggtgaaccctgccgcctacttgcaacagcaattgcttgcatcaaacccatttgctctggcaaacgtatt

SEQ ID NO: 32278 - DNA, 286 bp, Zea mays
  Clone ID: LIB3059-010-Q1-K1-H2
cccacgcgtccggagccaagaagaaaggagggtgctctgacggcggcagaacggcaatgtccgacaggaggcgcggcacctgcgccagcaccggcactcgcaaggatgaggtgacgacccgacagtacaccatcaaccttcacaagcgcctcaacggatgcacgtttaacaagaaagcgccgaatgccatcaatgagatcacgatgatcgcccaaacaacaatggataccaacgatgtccggatcgatgtgaagctcaacatgcacgtctggagcacacgaatccg

SEQ ID NO: 32279 - DNA, 433 bp, Zea mays
  Clone ID: LIB3059-010-Q1-K1-H4
cacagcagcaggcgtcccctgtcttcgtccttccgaaatcccaatcctccctccgagtcccccatcccaaaactcggagctccgaagctggcactggcatcgcggcaatgccgaggccgcccacaatggtgatccaggacgactacatcgacatggacctgaccccggcagccacaccggagccctcgccagcctcgccccgcttcgagttccagagcgccggcgccggcgccgccggcgacaggcatagggaggcggcgttcgcgtcccccgcggacgagctgttctacaagggcaacctgctgccgctccacctgccgccgcggctgcagctcgtgcagaggctcctccaggaccaggagcagccgccgccgctgcgaggggcgaagcgggatgcggagtcggatgccacggcggcggcggcggcagagcg

SEQ ID NO: 32280 - DNA, 435 bp, Zea mays
  Clone ID: LIB3059-010-Q1-K1-H5
cggacgcgtgggcggacgcgtgggcggacgcgtgggcgcggcgaagaagccggcggaggaggagcccgcggccgagaagacgaccgccgggaagaagcccaaggcggagaagcgggtccccgcgggcaagtccgccggcaaggagggcggcgagggcaagcgtggcaagaagaagggcaagaagagcgtggagacgtacaagatctacatcttcaaggtgctgaagcaggtgcacccggacatcggcatctcctccaaggccatgtccatcatgaactccttcatcaacgacatcttcgagaagctggccggcgaggccgccaagctcgcgcgctacaacaagaagcccaccatcacctcccgcgagatccagacctccgtgcgcctcgtgctccccggcgagctcgccaagcacgccgtctctgagggcaccaa

SEQ ID NO: 32281 - DNA, 435 bp, Zea mays
  Clone ID: LIB3059-010-Q1-K1-H7
ggtctacgagttctacaaagcacggtggagcgggtcacggccccgcgcaccgtctccgcgttcctcgagaagggcgtcctctccgtccccgagttcattctcgccggcgacaacctcgtcgccaagtgccccacctggtcctgggaagcgggcgatccaagcaagaggaagccgtatctccccgccaataagcagttcctcgtcacccgtaatgtgccctgtttaagacgtgccatctcggttgaggaagagtatgatgcagcaggagcagaggtggttctcgatgaggatggcgaaggctggcttgcaacacatggagtgcaagcatcaaagacagaagaggaggaagacattccctctatggacaccttggacatagggagatctgatggaataaagtctatcccctcttactttagcggtggcaaggatgaa

SEQ ID NO: 32282 - DNA, 241 bp, Zea mays
  Clone ID: LIB3059-010-Q1-K1-H9
caactatatatatacacttgcacacagcggagtgggctactcgagatgcgcttcgccaggcgctgacgccttaggagataagtttacctacccatagcacgtcaccacgaatgggcctgaggacattgctggagggcaattcgctggttgcaaatgcacaaccgatattgaacgaaaaccgtttccttggtccaaggagatggagcatgtatgaagtatcaggaaacggtcaaaccaagtc

SEQ ID NO: 32283 - DNA, 407 bp, Zea mays
  Clone ID: LIB3059-011-Q1-K1-A10
cgttcagcattcagaacacaccaagtcgaagcgcactatcaacgacctaacaacgggggctgtcaagatattagccatccttgcgcttcttgccctttttgtgagcgcaacaaatgcgttcattattccacaatgctcacttgctcctagtgccattattccacagttcctcccaccagttacttcaatgggcttcgaacacctagctgtgcaagccaacatgcaacaacaagcgcttgcggccagcgtcttacaacaaccaattgcccaattgcaacaacaatccttgccacatctaacaatacaagccatcacaacgcaacagcaacaacagttcctaccagcactgagccacctagccatggtgaaccctgccgcctacttgcaaaagcagctgattgcattca

SEQ ID NO: 32284 - DNA, 424 bp, Zea mays
  Clone ID: LIB3059-011-Q1-K1-A11
agccaaaatattatgcctccttatgctccttggtctttctgcaagtgctgctacagcgaccaggttcccgcaatgctcacaagctcctatagcttcccttcttcccccgtacctctcaccagtgttgtcttcagtatgtgaaaacccaattcttcaaccctacaggatccaacatgcaattgcatcaggcatcttacctttatcacccttgttcctccaacaatcatcagccctattacagcagttacctttggtgcatttattggcacaaaacatcagggcacaacaactcgtgctagcaaaccttgctgcctactctcagcaacaacagttacctttggtgcatttgttggcacaaaacatcatggcacaacaactacaacaactcgtgctagcaaaccttgctgcctactctcagcaacaa

SEQ ID NO: 32285 - DNA, 393 bp, Zea mays
  Clone ID: LIB3059-011-Q1-K1-A12
cacaaggccacaatccaagccgaagaaccctaggcggtggcggcgcatcctgcatagcccacggtagtgtcagcgagccagcgacctcgagtagcagcagaggctccgcaggggcgaaaaggtgtgaagcttccttcggagatcccagtagcagaagcaacgcaggcatcggcttgcgacaggagaggacggagatgacgcagaagcagaccctgttcaaggggcagagcaagaagaagactatccctcccaaccgccacggcaaggcgcctcatgttcgtaaaggaaagagagccgtcaagcccaccaagttcacaaaggacatggacgccgagaaggaactcaccaagttcatcaaccagtgcaacgaaataaaagctgcgaatcttgcta

SEQ ID NO: 32286 - DNA, 391 bp, Zea mays
  Clone ID: LIB3059-011-Q1-K1-A2
cggacgcgtgcgcgacccactcgtccttaaagatctgtcaaacaaacatgtactcatggtccgtttggacaactttgcaaaagttgacattccagtgaccaatttgattgaagatgttaaagtgtatattggatgaaattcacaaaaatctgttcaaaacatatcaagaaaggagagattcatgtgttcaggtcgtaaactatttggatgaattcacaactgctctcaataacaaaaggtacatctaggctcctttgtgctatgaagaggaagttcagaaagatgtgaaatctcgcacaaacagtgaactcgcagctgcgaaaacattgtgtactccatttgagcagccagaacttccagaaggtattctgtgctttgcatctggaaagcc

SEQ ID NO: 32287 - DNA, 434 bp, Zea mays
  unsure at all n locations
  Clone ID: LIB3059-011-Q1-K1-A3
cacgcgtgcggaggaaactacagaaccaaatgtttgcctgagtgatgatatagagacaaatgagtgtgtgaatgacagcggttgctgctggcaagacaaatctgctaatgtaacagcctgtagggacaccttccgtggtagagtgtgtgaatgccccactttcaatggcgtacaatttaaaggcgatggctacagcaattgtgaacctgctggaccaggaaaatgcttgataaaccatggaggatgttggcatgaaactcgcaacggaaaaacattctctgcttgccaggaatctggagatgggaaatgcctgtgcccagctggtttccgaggggacggcgttaaaaaatgtgaagacattgatgagtgcaaggagaaaaaagcttgtcagtgtcctgaatgcaactgcaaagatacatggngtggctatgact

SEQ ID NO: 32288 - DNA, 448 bp, Zea mays
  unsure at all n locations
  Clone ID: LIB3059-011-Q1-K1-A4
cggacgcgtgggcggacgcgtgggcggacgcgtgggggaaaagggacaagggcaagtgaagagataggcgtcgtcgtttgatctgctgccggagtgcgaagaggaagaggaagaggaagaggagcgccggagttgtaaagatgttcctggtggactggttctatggggtgctggcatcgcttgggctgtggcagaaggaggctaagatcctcttccttggcctcgacaacgccggcaagaccaccctcctccacatgctgaaggacgagcggctcgtacagcaccagccaacgcagtaccccacgtcagaagagttgagcatcggcaggatcaagttcaaggcgttcgaccttgggggccaccagatcgcccgccgcgtctggaaggactactacgccaaggttgatgctgttgtgtacttggtggatgctgntgacaaggaacgttt

SEQ ID NO: 32289 - DNA, 453 bp, Zea mays
  Clone ID: LIB3059-011-Q1-K1-A5
ccacgctcgacccagacactccatctgctggagggtctttaggtccttacttaggaggcacgttgtctctgaagctgacagcttcgtgaccaccactggcaacaaggatatcatcatggttgaccacatgaggaagatgaagaacaatgccattgtctgcaacattggccactttgacaatgaaattgatatgctcggccttgagacctaccctggcgtcaagcgcatcaccatcaagccccagactgaccgctgggtgttccccgagaccaacactggcatcattgtccttgctgagggtcgcctgatgaaccttgggtgtgctactggccatcctagctttgtcatgtcctgctcattcactaaccaggtcattgcccaacttgaactgtggaaggagaagagctctggcaagtatgagaagaaggtgtatgtgctccccaagcaccttga

SEQ ID NO: 32290 - DNA, 429 bp, Zea mays
  Clone ID: LIB3059-010-Q1-K1-H1
gccagtcaactatttacgctgggataagaaggaagaacaatcctctgatttgtacagattctgccgtctcatgaccaaattccgcaaggaatgtgaatctcttggccttgaggacttcccgacttcagaacggttgaaatggcacgatcatcagcccgggaagcctgactggtcagaggcaagccgattcgttgccttcaccatgaaggacgaaaccaaaggcgacatctacgtggccttcaacaccagtcaccttccggtggttgtcgggcttccagagcgctctgggttccgatgggagccggtggtggacaccggcaaggaggcaccatatgacttcctcaccgatggcctaccagatcgtgctgtcaccgtataccagttctctcatttcctcaactccaatctgtatcctatgctcagctactc

SEQ ID NO: 32291 - DNA, 428 bp, Zea mays
  Clone ID: LIB3059-010-Q1-K1-F5
cacccactctactactcgaagttactaccagcagcttgcttcaacagtagaagagagcgagaggatggcgtcaccgaagccctcgtcggcggccctgctcctcctggcggcggcggccgtgctggcgctggcgcgcgcggacctgacgcacgacaactgcgtgaagaacaagaaggtgacggtgcagaacctgtgcagccacgacgtgacgctgacgctggagccgctggccaacagcccgccgctgttcgcgggcacctacacgctgcacccgcgcagccacgccgagttccccgtgtgctggtggacggggcgcctgcgcgcgcccgacgccgcccaggtggagttccacgtcggcgtcgacggcggctccttctacctggcccccaacgcgcagccgggccagcgcgtcccggtctccgtcaccc

SEQ ID NO: 32292 - DNA, 423 bp, Zea mays
  Clone ID: LIB3059-010-Q1-K1-F6
cccacgcgtccgggaacatcgaaaattatgttttgagggaccaggaaactcggtatcgtcaaaggtatcttgatcttatggtaaaccatgaagtgaggcacatcttcaagacacgatctaaaattgtctcatttatccgaaagtttcttgatgaccgtgaatttttggaggtggagactccgatgatgaacatgattgctggtggagcagctgcaaggccctttgttacacatcacaatgaattaaacatgcggctttttatgcgcattgctcctgaattatatctgaaggaactggttgttggtggattggaccgtgtttatgaaattggaaagcaattcaagaatgaaggaattgatttaacacacaatcctgaattcacaacttgtgaattttatatggcgtatgccaattataatgatt

SEQ ID NO: 32293 - DNA, 422 bp, Zea mays
  Clone ID: LIB3059-010-Q1-K1-F9
attaaaaactgcaagataaaccattctgtagttggactccgatcttgcatatctgaaggtgctatcatagaggacagtttactaatgggtgcggactactatgagacagaagctgataaaaaactccttgccgaaaaaggtggcattcctattggtattgggaaaaattcatgcatcaggagagcaatcattgacaagaatgctcgaattggagacaatgttaaggtattccaaactgatgttccaacggtcaagaatattaatttagatttttccttaggatattacataatacttgatatgccattttgtcctcttatttttaacatttatttttgaaaatattaacttgaaaatatgaataggcttgcatgctcttttttaaatatgactgtctatacttatctttccctaattgcctg

SEQ ID NO: 32294 - DNA, 432 bp, Zea mays
  Clone ID: LIB3059-010-Q1-K1-G1
gtgtgtgcacaggattcttgatcatttcttggcaatggaccaagcaaatggtggcgagtccccatgcttggatgatgtcatggcatccccatccttgacaccgatcacaagtgttgccaagctaattgacggctatcttgcagaaattgcaccagatatcaatttgaagcctcctaagttccaagctctggcctctgctattcctgaatatgcccggccactggatgatggcctttatcgtgccattgatatatacttgaaggctcattcctggctgtcagaagctgaaagggagcagttctgccggctgttggactgccagaagctctccctggaagcatgcacccacgccgcccagaacgagaggctgccgttgcgcgtggtggtgcaagtcctcttcttcgagcaactccagctaagaacctcgatcgc

SEQ ID NO: 32295 - DNA, 431 bp, Zea mays
  Clone ID: LIB3059-010-Q1-K1-G10
ggcattacaacagtactcaattcaaggacttcagttcttgcagctgccaatccaattgcaggacgctatgatgatcttaagactgcacaagataatattgatctacagaccaccattctttctagatttgatcaaatctttattgtcaaagatatcagaatgtatgaccaagataagcgaatagcaagccacattatcaaggtgcatgccagtggtgcagcagcgtcatccgcaaacacagagggaagtgaaggagagaattggcttaaaaggtacattcagtactgccgtgcaacatgcaaaccacggctttcagaaaaagcagctgagatgctgcagaacaaatatatcgagattagacagaaaatgaggcagcaagctcacgagacagggagggctgcagcaatacccatcactgtgaggcagcttga

SEQ ID NO: 32296 - DNA, 306 bp, Zea mays
  Clone ID: LIB3059-010-Q1-K1-G11
cccacgcgtccggcttggcaagaggaggaaagccgaagaagatggaagtgaggaagaattgaagaggacaagaaatgagacagaaagctatacaagcaatggcagaggccgtgggagaggtcgtgggagaggtcgccgtggtgtacgtggagcttggcgggaggtggtcacaagtcctgagcaattcaaggaggagaatcaatctagcaaggtatatggtctagtaaataaagtcgtcgatcaaagcatgacaactgtcaaatgtatctttgattaagtaaagtatcactcaagatttccagtttc

SEQ ID NO: 32297 - DNA, 426 bp, Zea mays
  Clone ID: LIB3059-010-Q1-K1-G12
ggagggcaccaagctaatattccagttgcaaaaggagcgctaggaagaggaagcaacgagccatggcctccggtggcccgaaacccaaactagcctacatcatcttgtacgtgagggacgtggagaaggccgcctccttctacgacgccgccttcggctacaccgtccgccgcctcgaccagtcccgcaagtgggcggagctggagagcggggcgacgaccatcgcgttcacgccgctgcaccagcgggagacggacgagctgtcgggggcggtgcagctgccggactcgtcggccgccggccggggctccgtagaggtctgcttcgcctacgcggacgtcgacgcggcgtacaagcgcgccgtggacaacggggccgtggccgtgagcgcgccggatgacaagccctggggccagaagtccggct

SEQ ID NO: 32298 - DNA, 422 bp, Zea mays
  Clone ID: LIB3059-010-Q1-K1-G2
ggcggatgtggagaaggcgctgtgggcccagatcggcatcttgcatggcggtggcggcctggtcggggacagcagctacggggcgcaggaggaactcgacgaggaagaggccaaggagatcgacagcgcccgcgcgcggcgccggaaggcggcctacgagatggccatcgcctcaggcggcgccagctcgctcatcctgtccaactacgcgcagctcctgtacgagatcgacaaggacatcgagagggcggagatgtacttcaagcaggcggtggccgccgagccggcggacggcgaagcgatgcggaggtacggcatgttcctgtggcacgcccgcggcgacacgggcggcgcggaagacatgttcaccggcgccattgacgcggagcccgagagcagccaccaccggagcagctacgcgt

SEQ ID NO: 32299 - DNA, 433 bp, Zea mays
  Clone ID: LIB3059-010-Q1-K1-G3
aaaacatcagggcacaacaactacaacaacttgtgctagcaaaccttgctgcatactctcagcaacatcagtttcttccattcaaccaactggctgcattgaactctgctgcttatttgcaacaacaattaccattcagccagctagttgctgcctacccccagcaatttcttccattcaaccaactagcagcattgaactctgctgcttatttacagcagcaacaactactaccattcagccagctagctgatgtgagccctgctgccttcttgacacaacaacagttgttgccgttctacctgcacgctatgcctaacgctggcaccctcttacaactgcaacaattgctgccattcaaccaacttgctttgacaaactcaacagtgttctaccaacaacccatcattggtggtgccctcttttagattgc

SEQ ID NO: 32300 - DNA, 429 bp, Zea mays
  Clone ID: LIB3059-010-Q1-K1-G4
cccacgcgtccgcggacgcgtggggaagggtgtatacttaaattttcttaactttctcataaatgatagcatctatcttcttgacgagagtttgaacaaaattcttgaactgaaagaaatagaggctgaaatggctaacatagttgagtgggagcgcagacctgctcaagaaagagaggagcggctgcgtgtatttcatcagtgggaaaatattgttcgttttgacatgaggctagccaatgaggatgttggaatgcttgcattcactctgaacaaattccagcacctttccttctccctgaaatggtggaaagggttgccagcatgcttaattacttcctcttgcaacttgctggtccccagaggaaatctttgactgtaaaggatccggagaagtacgagttcaagccgaagcagcttttgaaacag

SEQ ID NO: 32301 - DNA, 432 bp, Zea mays
  Clone ID: LIB3059-010-Q1-K1-G7
atcttttagtaacctttcaataggcgtcccccaagaactagtaaacatggcaaaactgttgagcctgttcttagccctctcctttgtagcagctatgtttgccataggctctcatgctgatggagactgtgagaatgacctccaaagcctgataagtgactgcaagacatacgtgatgttcccagctaatccaaaggtccctccttcggatgcttgctgtggtgtcatcaagaaggcaaacgtttcttgcttgtgctccaaggtcaccaaagaaactgagaaggttgtgtgcatggagaaggttgtgtatgttgctgagcagtgtaagaggccatttgagcatggcttccagtgcggaagctacaaggttccagcaaactgatgatatcgcaagatggaagcgcttgacgtagtctttagatttcaattgtt

SEQ ID NO: 32302 - DNA, 432 bp, Zea mays
  Clone ID: LIB3059-010-Q1-K1-F4
cgagaacggctggaagaaccgagagcgctccggaaatgtcggcgggtgagctgcggttggagctggacgagctgcggcggctggagagcctcgccaagcacccccgcgtccagatcctcctcgccaacgaaatccgcaacgttgaagcgaagttggcgaaggcaaccgaaccatcgcctgagccactggcggcggcttctgcgccagcgcccgcgcccgctgcgcgtcctgttttaagctacgtcactcttgggtcgttcagctgggagcaggacaacgagaagattaggatatatgtttcccttgagggagttgagcaagagaaggtggagactactttcaagccaacatcagtggatataaagtttcatgatgtcaaaggcaagaattaccggtgtgctataccaaagctgaacaaggaaattgttcctg

SEQ ID NO: 32303 - DNA, 273 bp, Zea mays
  Clone ID: LIB3059-010-Q1-K1-E10
cccacgcgtccgactgtatgcattgctagtgtagtattctgtgacaaaaccaataatcaaaccagcccacagacctgtgcaagatgatccagatgaacgacatgatcctgactctgatatggaagtggatgatcacaaggctgtggaagagtcatcgaggaggagcattctaggtataaaaatcaagagagaatttggtgaaaatgcgaccagagttcaggatggtggcagaatcgcatttgaacatagaggactggaacccatggcagaaga

SEQ ID NO: 32304 - DNA, 320 bp, Zea mays
  Clone ID: LIB3059-010-Q1-K1-E11
gatcagcaaacggcggtgcgtagagaggatcgtcgaacagaacagcatgaagatggtcatcgttctcgtcgtgtgcctggctctgtcagctgccagcgcctctgcaatgcagatgccctgcccctgcgcggggctgcaggtcttgtacggcgctggcgccggcctgacgacgatgatgggcgccggcagactgtacccctacgcggagtacctgacgcagtcgcagtgcagcccgatgtcagcagagccctactacgccgattgtggacagcctagcgccatgttagagcggttctggcgacaccactgccatgagcata

SEQ ID NO: 32305 - DNA, 428 bp, Zea mays
  Clone ID: LIB3059-010-Q1-K1-E12
acaacaactcgtgctagcaaaccttgctgactactctcagcaacaacaggttctgccattcaaccaactagctgcattgaactctgctgcttatttgcaacaacaactagtactaccattcagccagccagctgctgcctacccccagcaatttcttccattcaaccaactagcagcattgaactctcctgcctatgtacagcagcaacaactactaccattcagccagctagctgctgtgagccctgctgccttcttgacacagcaacaattgttgtcgttctacctgcacgctgcgcctaacgttggcaccctcttacaactgcaacaattgctgccattcaaccaacttgctttgacaaacccagcagcgttctaccaacaacccatcattggtggtgccctcttttagattgcttatgagttat

SEQ ID NO: 32306 - DNA, 433 bp, Zea mays
  Clone ID: LIB3059-010-Q1-K1-E2
ctgactgctgttcagaactgcaaacatatgccaattatgtgctgtaatataatcaagatacaatagatctgatgagtggtatacattatgctgaagataaagataacaagacttcttacagttaatgtatacaatctttagcagctataagcagactgaattacaccaatgttaacactagcaaggagcatatgcgcctgcaaatgattaagtgaaacatatcgatctatatttcaattgtgcagatatctatatttgcattactgcatagtctcgaacatactgcaactatgaatgtttgcctccaaattttccatagatttcgagtcatgagagaatcgagctccatatgtcgactctgaatttactctcttttggatgcgatgtgcattagccttttcttcataaaaatcaaaatcatccagaattgatg

SEQ ID NO: 32307 - DNA, 434 bp, Zea mays
  Clone ID: LIB3059-010-Q1-K1-E3
caaggcacaacaactacaacaacttgtgctaggaaaccttgctgcctactctcagcaacagcagtttcttccattcaaccaactggctgcattgaactctgctgcttatttgcaacaacaactaccattcagtcagctagctgctgcctacccccagcaatttcttccattcaaccaactggcagcattgaactctgctgcttatttacaacagcaacagctaccaccattcagccagctagctgatgtgagccctgttgccttcttgacacaacaacagttgttgccgttctacctgcacgctgcgcctaacgctggcaccctcttacaactgcaacaattgctgccattcaaccaacttgctttgacaaacccaacaacgttctaccaacaacccatcattggcggtgccctcttttagattgcttatgagt

SEQ ID NO: 32308 - DNA, 415 bp, Zea mays
  Clone ID: LIB3059-010-Q1-K1-E4
cggacgcgtgggcagccggggaaggagcacgcgatggacccccggcccgaggccatcgtccaggactacaaggccgccaacaagctcaaggacaaggtggcgctcgtgaccggcggcgactccggcatcgggcgcgccgtgtgcctgtgcttcgcgaaggagggcgcgacggtggccttcaccttcgtgagggggcaggaggagaaggacgcggaggagacgctgcgtgcgctgcgcgacatcgggtccgagacgggcgcgcgcgagccgatggccctgcccgccgacctcgggtacgaggccaactgccgggaggtggtggagcgggtggcgtcggcgtacggcgggcgcatcgacgtggtggtgaacaacgcggcggagcagtacgagcgggagagcatcggggacgtgacgg

SEQ ID NO: 32309 - DNA, 376 bp, Zea mays
  Clone ID: LIB3059-010-Q1-K1-E5
gcagtgcgtagagaggatcgtcgaacagaacagcatgaagatggtcatcgttctcgtcgtgtgcctggctctgtcagctgccagcgcctctgcaatgcagatgccctgcccctgcgcggggctgcagggcttgtacggcgctggcgccggcctgacgacgatgatgggcgccggcgggctgtacccctacgcggagtacctgaggcagccgcagtgcagcccgctggcggcggcgccctactacgccgggtgtgggcagccgagcgccatgttccagccgctccggcaacagtgctgccagcagcagatgaggatgatggacgtgcagtacgtcgcgcaacagctgcagatgatgatgcagcttgagcgtgccgct

SEQ ID NO: 32310 - DNA, 280 bp, Zea mays
  Clone ID: LIB3059-010-Q1-K1-E7
cccagcgtccgcccaaacgtagaacatactaggatgcacgctgcgtaaccggctgcgccattatggacttcggcttgagaacgagagctaagtgcataagaactggagccgcgcgagccgatgctcaaggctcatgaagtcgatcgtagaccaggtcatggattatgagcacaacgttggccatgctatgtagatatgatgaatgcgtcatgaccaatttgatgaagcataagattgagtatcaagatttatttggcacacagcttggcgccaaatcggg

SEQ ID NO: 32311 - DNA, 324 bp, Zea mays
  Clone ID: LIB3059-010-Q1-K1-E8
cccacgcgtccggttcattattccccaatgctcacttgctcctagtgccattattccacagttgctccctccagttacttcaatgggctttgaacacccagctgtgcaagcctacaggctacaacaagcgcttgcggcgagcgtgttacaacaaccaattgcccaattacaacaacaatccttggcacatctaaccatacaaaccatcgcaacgcaacagctacaactatttgtaccagcactaaaccaactagctgaggtgaaccctgtcgcctacttgctacagcacttgcttggattcgacgcacttgctctggcaaacat

SEQ ID NO: 32312 - DNA, 431 bp, Zea mays
  Clone ID: LIB3059-010-Q1-K1-F1
cccacgcgtccgctatatttctagcgggtccaccacttgtaaaggctgctacaggagaggagatatctgctgaggaccttggtggagcatcagtacattgcaaggtatcaggagtctcagatcattttgcacaagatgaaattcatggacttgagttggggcgaaacattgtgaagaacctgcacttagctgctaaaggaacaaatattcagagttctgcttgtggttaccaagagccattgtacgatgtagaggaacttcgctccattgcaccagctgatgtgaaacagtccttcgacattcgttcaataatagcccgtattgttgatggaagtgaatttgatgagttcaaaaaattgtatggaacaacactagtgactggttttgcaaggatatgtgggcaaccagttggaattattggaaacaatggc

SEQ ID NO: 32313 - DNA, 427 bp, Zea mays
  Clone ID: LIB3059-010-Q1-K1-F10
attaaaaactgcaagataaaccattctgtagttggactccgatcttgcatatgggaaggtgctatcatagaggacagtttactaatgggtgcggactactatgagacagaagctgataaaaaactccttgccgaaaaaggtggcattcctattggtattgggaaaaattcatgcatcaggagagcaatcattgacaagaatgctcgaattggagacaatgttaaggtattccaaactgatgttccaacggtcaagaatattaatttagatttttccttaggatattacataatacttgatatgccattttgtcctcttatttttaacatttatttttgaaaatattaacttgaaagtatgaataggcttgcatgctcttttttaaatatgactgattatacttatctttccctaattgcctgcataa

SEQ ID NO: 32314 - DNA, 217 bp, Zea mays
  Clone ID: LIB3059-010-Q1-K1-F11
cggcgcgtgggatggtgaatacgagggggtaggacgatgagtggctgtggggatgggagaggtgcagcttggcggcgaggcgcgcttgggcggccggtgtcgggatcgttcaggagcgggtgctcgagcatggcgcgtgtgggtgcccggcggtgaggctcgccgtgtggtacattgcggtggctgctgctgtgggggggacacttctgtacgcccg

SEQ ID NO: 32315 - DNA, 421 bp, Zea mays
  Clone ID: LIB3059-010-Q1-K1-F12
gagaaggcggcggcagtgggcggactcggaggagccggggcggcggacgcggcgcagcagcagcagctggcagcaggggaggccgcggcggcgcgggtgcggcccgtggagacgctgcttcgcgcggcaccgctggggctctgcgtggccgccatgaccgtcatgctccgtaaccagcagagcaacgagtacggcgccgtcgcctactccgacctgggaggcttcaagtacctcgtctacgccaacggcctctgcgctgcctactcgctggtatccgcgttctacactgccgtgccgaggcctgccaccgtgtcgcgctcctggctcgtcttcctcctcgaccaggtgttcacgtacctgatcctggcggcgggcgcagcggcggcggagctggtgtacctcgcctacaacggtgacaagg

SEQ ID NO: 32316 - DNA, 431 bp, Zea mays
  Clone ID: LIB3059-010-Q1-K1-F2
aaaaaacaaacgatatataaatagcagaaatacaaaaatagaaaaggctgatacaaggagaggagatatctgctgaagaccttggtggaacatcagtacattgcaaggtatcacgagtctcagatcattttgcacaagatgaaattcatggacttgagttggggcgaaacattgtgaagaacctgcacttagctgctaaaggaacaaatattcagagttctgcttgtggttaccaagagccattgtacgatgtagaggaacttcgctccattgcaccagctgatgtgaaacagtccttcgacattcgttcaataatagcccgtattgttgatggaagtgaatttgatgagttcaaaaaatcgtatggaacaacactagtgactggttttgcacggatatgtgggcaaccagttggaattattggaaacaat

SEQ ID NO: 32317 - DNA, 416 bp, Zea mays
  Clone ID: LIB3059-010-Q1-K1-E1
aacaaaactgtggaattctataatatatcaaagtaaacatgtttcaggaaacatctggtgttaagattgcaccggggctgtatttaccagcacatccgtgcttctacgtaaacactatataacaattataagcagtttcaattgcaaccatataaacactttgaaggagcgtcagtgccttcaactagttcactgacccatcttgatctttatttcaattgtgcagatatctatatttgcattactccaaagtctcgaacaaactccaactctccatgtttgcctccaaattttccatagatttcgagtcatcagagaatcgagctccatatgtcgactctgaatttcctctcttttgggtgcggcgtgcattcgccttttcttcataaaaatcaaaatcatccagaattgatgtt

SEQ ID NO: 32318 - DNA, 424 bp, Zea mays
  Clone ID: LIB3059-010-Q1-K1-C4
gtctgactcagctagctgtggcaaaccctgctgcctacccccagcaatttcttccattcaaccaactggcagcattgaactctgctgcttatttacaacagcaacagctaccaccattcagccagctagctgatgtgagccctgttgccttcttgacacaacaacagttgttgccgttctacctgcacgctgcgcctaacgctggcaccctcttacaactgcaacaattgctgccattcaaccaacttgctttgacaaacccaacaacgttctaccaacaacccatcattggcggtgccctcttttagattgcttatgagttatagttcaataatgaagttttttggatgatgtttgtggcttcccagaaataagaaagtacatttctagattctaaaaaaaaaaacaaaaaacaaacacaaaa

SEQ ID NO: 32319 - DNA, 435 bp, Zea mays
  Clone ID: LIB3059-010-Q1-K1-C5
cccacgcgtccggcaacatagaaagtggaatccagtagcaacaacagagcaacaatggcgaccaagatattttccctccttatgctccttgctctttctgcatgtgttgctaacgcgacaattttccctcaatgctcacaagctcctatagcttcccttcttcccccataccttccatcaatgatagcttcagtatgtgaaaacccagctcttcagccctataggctccaacaagcaatcgcagcaagcaacatacctttatcacccttgttgtttcaacaatcgccagccctatctttggtgcagtcattggtacaaaccatcagggcacagcagctgcagcaactcgtgctacctgtgatcaaccaagtagctctggcaaacctttctccctactctcagcaacaacaatttcttccattcaaccaactgtct

SEQ ID NO: 32320 - DNA, 260 bp, Zea mays
  Clone ID: LIB3059-010-Q1-K1-C7
ggtaatttttctacagatgaaccactgctagcacagtagtgatccaacaactgctgacaagatatttagcctccttaggcttattggtctgctgcggacatgctgatagcacaaccattatcacggagtgctcagaatctgctatagcaaccgtgctaactccgtacctatcacgagagacgtcttcggtatgtgaaaacccatttgttgaaccttataagatccaacacgctgtcctagatggcttgttacctttatca

SEQ ID NO: 32321 - DNA, 434 bp, Zea mays
  Clone ID: LIB3059-010-Q1-K1-C8
ctttcatgaagcactgttcagttcaggttcaaccaaattcagctcccctgaatcatgtgcagctttgcagattatctctaacatgcattggatttgctgaacgcctgttgtgggttcaaatgctggacctaagccataatagtctgagatcagtcgaaggattggaggctttgcagcaccttgtgttcttgaacatcagcaacaaccagatcagtggtttcacagcacttgaatcccttacgaagataatctcattgaaagttctggatttatctttcaacaagattggagctcactcaattgacacaacacggtatatctgctcgtctccattctcacacaaaatggaagcaagtgaagcttttgaagcgtaccagaaggtaaatatcaacgtggaggaatactgggatgccatactgtttttcagatctctg

SEQ ID NO: 32322 - DNA, 425 bp, Zea mays
  Clone ID: LIB3059-010-Q1-K1-D10
cccacgcgtccgcccacgcgtccggcactgttttatgtggtcttcatgctgtcagcctgtgctctgttctcaaagacatggattgaagtttctggttcatcagcaaaggatgttgctaagcagctcaaggaacaacaaatggtgatgccaggccatcgtgagtcaaacttgcagaaggaacttaaccgatacatccccactgccgctgcatttggtggtgtatgcattggcgcattgaccgtcctggctgatttcatgggtgcgattggttcaggaactggtatattgctcgctgtgacaatcatataccaatacttcgaaacctttgagaaggaaagggcgactgagcttggtttctttggtttttgattagtagctgtggaaccttaacttggctatagctgaattttcttgtaagtccctgt

SEQ ID NO: 32323 - DNA, 419 bp, Zea mays
  Clone ID: LIB3059-010-Q1-K1-D11
cggcaagctagagacgaggctcgatcagtccactacgctaaacgaagcagtctccgtggagaacaaggggaagccgcagccccagcgtcagcgcgcagctgagcaggaagctccgagcggcttcgtgctccctgacctcaacctcccggcagacgtctgacggctgcctgaatctgtcgatcggtggccagatcgagctatagcacgctaacctcatagctaaactgtacatagaagaagaagctgcgccagaaggaggggggtggggttctgaacggccacacttaccaggatactgaggcagaagaagaacggaggttatctttgtgtcataagttgtcgacgtttagggtttagagccgtcgtgatcgtatcctccggcctgaacaacgttgttttatgttcagagcggaggaccc

SEQ ID NO: 32324 - DNA, 425 bp, Zea mays
  Clone ID: LIB3059-010-Q1-K1-D12
gtccaaaatatccctctgaagaactgtgccatgagaagaaggcattgtacaagcttatttcaagattgcactcctcaatttcagtgcatattgcttatgattaccttcttgatgaatctactaactcatggggacaaaatctttctttgttgtatgaccgcgtcctgaagtacccagaacgtgtccagaatctgtacttcacctacctgtttgttcttcgggccgtgacaaaagcagcaaattatcttgagcaggctgagtacaataccggcaatcctgaagacgacttgaaaacagaatctcttgtgaagcagttgctttacaattccaagttaagatctgcatgtccattgccttttgatgaagccaaactttggcaaggcgaaaatggtcctgagctaaagcaagagattcagaagcaattt

SEQ ID NO: 32325 - DNA, 432 bp, Zea mays
  Clone ID: LIB3059-010-Q1-K1-D4
aaccgtcccggcctcagcctcatccccagccacacccatgcccgtgccaacagccgcatccaagcccgtgccaacttgaaggaacctgccgcgttggcagcaccccgatcctgggccagtgcgtcgagttcctgaggcatcagtgcagcccggacggcaacgcctaattgttggcttaatggccggccgtgccggagcaatgtttgcaggaacttaagccagttgagcccgcagcaccggtaccaggcgatcttcggcttggtcctccagtccatcctgcagcagcagcgtaaagcgggcaggtctcgtggctgttggcggcgcacatagcgcagcaactgacagcgatttgcgggctgcatcattcgactctatgcgcttactcctgtgtcggcggtgttctccactgtagaaactatgtgctgttgtata

SEQ ID NO: 32326 - DNA, 425 bp, Zea mays
  Clone ID: LIB3059-010-Q1-K1-D5
gtgccttctcatgtcatgtcatcaactatgtttacaagtgtgaaaggtccagttgcctctgcttctgagacaactaactcccaacaacgcaacagtaacgctaaaagctgtcagtttccaggatgtgtgaaaggagcaagaggggcatcagggcgttgcatagcacatggcggcggtaggcgttgccagaaacctggttgtgagaagggcgctgaagggaggacaatctattgcaaggcccatggtggaggcaggagatgtcaatttctcgggtgtacaaagagtgctgaagggcgcacagaccactgcatagctcatggtggtggccgccgctgcagccatgaaggttgctcccgagctgctcgtggaaaatctggcctgtgtatcaagcatggtggtggcaaaaggtgtcagaaggagaactg

SEQ ID NO: 32327 - DNA, 424 bp, Zea mays
  Clone ID: LIB3059-010-Q1-K1-D6
gtgccttctatgtcatgtcatcaactatgtttacaagtgtgaaaggtccagttgcctgtgcttgtgagacaactaactcccaacaacgcaacagtaacgctaaaagctgtcagtttccaggatgtgtgaaaggagcaagaggggcatcagggcgttgcatagcacatggcggcggtaggcgttgccagaaacctggttgtgagaagggcgctgaagggaggacaatctattgcaaggcccatggtggaggcaggagatgtcaatttctcgggtgtacaaagagtgctgaagggcgcacagaccactgcatagctcatggtggtggccgtcgttgcagccatgaaggttgcttccgagctgctcgtggaaaatttggccctgtgtatcaagcatggtggtggcaaaaggttgtctgatggagaac

SEQ ID NO: 32328 - DNA, 434 bp, Zea mays
  Clone ID: LIB3059-010-Q1-K1-D7
aggaagtgggcaagtggtgaatggtgacaagaatgttgcatacacccataagaaccttcgcttacaatgaggctgtttttgtgcttgatcaggattcgtgtctatccagtgatgtttgatagtttcatcaggcaggagcatagaatggtgaatcttttcgattgaggactgtgaatccatggatgttcagtcattgtttgtgtagacattgtggtgagcttggaggccaccccacctactcaataaagcagtgctgggagtaatagagcactgatgtactgagggtgcctaggttaaacacgaggaaccggttatatttgtttcgcggtcgaacacaatcaattttttgttggtgacttgtttcttatgattctacatattttaaggtttatgtgctgtcctaaccgtggtctttgataccggttattttggat

SEQ ID NO: 32329 - DNA, 434 bp, Zea mays
  Clone ID: LIB3059-010-Q1-K1-D8
ctcatcgactccagattggagaactcgacaccatgaaggtgctgatcgttgcccttgctctcctggcgctcgctgcgagcgccgcctccagtacaagcggcggctgtggctgccagacaccaccgtttcatctaccgcctccgttctatatgccgcctccgttctatctgccgccgcagcagcagccgcagccatggcaataccccactcaaccaccgcagctaagcccgtgccagcagttcggatcctgcggcgtcggcagcgtcggcagcccgttcctgggccagtgcgtcgagttcctgaggcaccagtgcagcccggcggcgacgccctacggctcgccacagtgccaggcgctgcagcagcagtgctgccaccagatcaggcaggtggagccgctgcaccggtaccaggcgacatacggtgtggtcctg

SEQ ID NO: 32330 - DNA, 236 bp, Zea mays
  Clone ID: LIB3059-010-Q1-K1-D9
cctgaatcaagtgagaagttggcaatgggtgaattttttgggataaaacctcctgtgaagaaggttgatatcgatattgcaacacatatagttgttgaagacgacgggccaaaaagaagcatgctttacatagagacagccgatcggcctggcctacttcttgagataatcaagatcatcgcggacacaaatattgatgtggagtcagctgagatcgatactgaaagtttggttgc

SEQ ID NO: 32331 - DNA, 416 bp, Zea mays
  Clone ID: LIB3059-010-Q1-K1-C3
gcggaggtctcaagctccaggagtaattccggttggatctggacgacgaggaagctatacatttctttcaagatcttattaaccattgccttaggtcttttgttccttaaattggttaaaaccttccttaaatggcttaatattggccggtaccccagcttatggcctaaaaaccaggtttaatctgtacattcttactgtgacaagccaccggtataagccagaaacgacactgatggatggaagcctaagcgcctagcatttggggttcaagctgcgccgcatctgcgaattgattgggctcatacacagcatgggcaatcttttcgtgcccgtgacacccatgaattttggttgtcagatgtcacttttgatagtataaattcgtcacgcactgttgtagacctatgggcatt

SEQ ID NO: 32332 - DNA, 420 bp, Zea mays
  Clone ID: LIB3059-010-Q1-K1-B10
cggacgcgtgggctgcgtacacggtctccctcttcctgtcagtagtagagtgagagtgaggcagcgagtgggagacaaggggaaatggggaagggagcgcaagggagcgatgcggcggcggcgggcggcgaggtggaggagaacatggcggcgtggctggttgccaagaacaccctcaagatcatgcccttcaagctcccgcccgtcggcccttatgatgtccgcgtgcgcatgaaagcagtggggatttgcggcagcgatgtgcactacctcagggagatgcgcatcgcgcacttcgtggtgaaggagccgatggtgatcgggcacgagtgcgcggtcgtggtcgaggaggtgggcgccggcgtgacgcacctgtccgtgggcgaccgcgtggcgctggagccgggcgtcagctgctgg

SEQ ID NO: 32333 - DNA, 419 bp, Zea mays
  Clone ID: LIB3059-010-Q1-K1-B11
ggcaaagattacatatatgccgtcacccccttacttgaagatgctttaatggatagagatctggttcaccggcagactgctgcatctgctgttaagcacatggctctaggtgttgctggcttgggttgtgaggatgctcttgttcatctgcttaactatgtttggcccaacatatttgagacatctccccacgttataaatgctgtcatggaggcaattgaggggatgagggtcgcactaggtgcggctgtgattttaaattattgcctgcaaggtctcttccatccagcaaggaaagtacgagaagtgtattggaagatatacaactctttgtacatcggcgcgcaggatgcacttgttgcttcttatcctgccctggaagacgatggggataacatctttagtcgtccagagttggc

SEQ ID NO: 32334 - DNA, 423 bp, Zea mays
  Clone ID: LIB3059-010-Q1-K1-B2
cccacgcgtccggccctaatcttcatcaccaactgatagctgaacgcggcatccttcctgtcatcccctcttatgcccacatttcgttcctttcacaccggagaccggagagcagagacgtgcacagcagaacgcggaagcaagaggaggcgatcgactactcgaccagacctctccgttcttgtctccgatggcggctcgcgtactagcggccctagctctcgccctcgccctcgtcggcctacccgcgcccacgcgggcgtccaacgacgagggggacgcgctctacgcgctgcggcagcggctgtcggaccccaacggcgtgctgcagagctgggatcccacgctcgtcaccctctgcacttggatccacatcttctgcgaccaggtcggtcgcgtcgtccgcctggacttgggcaactc

SEQ ID NO: 32335 - DNA, 342 bp, Zea mays
  unsure at all n locations
  Clone ID: LIB3059-010-Q1-K1-B3
gagacgaccgccgccgcatcggaccgtgcccgagccccccttctcctcgctgactcggctcccctcctccgccgtcgccggaggcgaagcaagtggggaccacagaagcattagctgggtgaacccactcaaagggggcagggaattgtgtgctagtttgaatggctgctacaaagcttcaggccctttggaaccacccggctggccccaaaaccattcatttctgggcgccaacattcaaatggggcatcagcattgccaacatagccgactntgctaaaccacctgaaaagatatcttaccctcagcaagttgctgttgcatgcactggactcatttggt

SEQ ID NO: 32336 - DNA, 433 bp, Zea mays
  Clone ID: LIB3059-010-Q1-K1-B4
cactactacagtgcccgccgccgctgcgtccaccaccacctcctttcccaactcctccgcgtacccccgccctctccggcggcccgcgtaaccacccgcgcagatggcgacggcggccacggcgtccgcgacggcggcgacccgcttcacgctcctagcgggcgccggcctccgcagccgcatcacccgcctccccaccgccgtgcggttccagcgccagcgggggctcaccaccaccgcgctcctgaagaccgccgacctgcagcccaaggagcagggcaagcccgagacgctcgactaccgcgtgttcctcgtcgacggcggtggccggaaggtgtcgccgtggcacgacgtcccgctgcgcgccggggacggggtgttccacttcgtcgtcgagatacccaaggagagcagcgccaagatggaggtcgcc

SEQ ID NO: 32337 - DNA, 430 bp, Zea mays
  Clone ID: LIB3059-010-Q1-K1-B5
ggcaagtgggaggcatcaccagaggatgatataagacattggtccaagttcccatcatttatgcctcttctgagtcagattgagacagacggtggcaagtctctggactttagcaactatccttacatatttatgagatggaaagaacagtattttgtcaatgttggagttgactgtgggttaaccatcgctggtttctactacgtctgcttttcttgtagcgatggctccatcagtggattttattatgatccaaatagcagtccatttcagaagctcgaattgaagtgtaccaatgagaaaagttctggattcaccttttcatcctatgagctgcagtgacagggccagatgcatatagtgtgtactgaactcatactcgcctaatgctgctgtattgaaagaaacgagtggtggtttatgcaacact

SEQ ID NO: 32338 - DNA, 411 bp, Zea mays
  unsure at all n locations
  Clone ID: LIB3059-010-Q1-K1-B6
cggacgcgtgggcgcacgcatgcgaggacaggtacaacaagtccaagctcgtgcactccatcatgcgccacgtcgccgagacgctcgaggtcgacctcgagccgctctaccagcggattggctggccgctctaccgcaagtacggtcacgccttcgaggccttcaagctcatcgttgcggaccctgacgctatcctcgacgtactcacctatgaggaaaaggaggtcggcccagatggccaggaggtggctaaggtggtgcctgctgtcacccctgaggttaaggattcactggtgaagaacataaggaggaggatgacaccgcagccactcaagatccgtgctgatatagagatgaagtgcttncagtttgatggagtgctccatattaagcaagctatgaagaaagctg

SEQ ID NO: 32339 - DNA, 276 bp, Zea mays
  Clone ID: LIB3059-010-Q1-K1-B7
gctttaagagcatctgcaaaaggttccttaaagcgacagacttcaattacaaatgcaaatactagagcagttcagcaagtgatgatggaaggaaacacccaaacattacccagggggccaggacacaaacaaaggtttttcaacaccacaacctggctcgacaggcaaacagattcctgcgagcagagcagtatttgcatatgcaattgaagtcatgacgctttaagagcatgtcgcaaacggttacttggggcataagcattgccaacatagccg

SEQ ID NO: 32340 - DNA, 108 bp, Zea mays
  Clone ID: LIB3059-010-Q1-K1-B8
gcggcgatgattgagtaataatgtgtcacgcatcaccatgggtggcagtgtcagtgtgagcaatgacctgaatgaacaattgaaatgaaaagaaaaaagtattgttcc

SEQ ID NO: 32341 - DNA, 411 bp, Zea mays
  Clone ID: LIB3059-010-Q1-K1-B9
cggacgcgtgggtagctgcattgaactctgcttcttatttgcaacaacaacaactaccattcagccagctacctgttgcctacccccagcaatttcttccattcaaccaactggcagcattgaactctcctgcttatttacagcagcaacaactactaccattcagccagctagctggtgtgagccctgctaccttcttgacacaaccacagttgttgccgttctaccagcacgctgcgcctaacgctggcaccctcttacaactgcaacaattgctgccattcaaccaacttgctttgacaaacctagcagtgttctaccaacaacccatcattggtggtgccctcttttagatttcttatgagttatagttcaataataaagttttttgtctgatgtttgtggcttccc

SEQ ID NO: 32342 - DNA, 342 bp, Zea mays
  Clone ID: LIB3059-010-Q1-K1-C1
gactactacagtgcccgccgccgctgcgtccaccaccacctcctttccgaactcctccgcgtacccccgccctctccggcggaccgcagtaaccacccgcgcagatggcgacggcggccacggcgtccgctgacagcggcgacccgcttgacgctcctagcggacgccggcctccgcagccgcatcacccgcctgcccaccggcgtgcggttccagcgccagcgggggctcaccaccaccgcgctcctgaagaccgatgacctacagtccaaggagcagggcaagcccgagacgctagactacacgcgtgatcatggtcgacggcggagcccggaaggtgtc

SEQ ID NO: 32343 - DNA, 425 bp, Zea mays
  Clone ID: LIB3059-010-Q1-K1-C10
cccacgcgtccgcccacgcgtccgctccgtccctcgaagcttctctggtttcagacgcaaccccgcgggtcgcgggatcaaggagccagagagcgggacgcagcgagcgttccgccggagatcgagaccgtagctagggtttgaggcgccgggctgcggtggacgagatgtcgacgccggcgaggaagcggctgatgcgggacttcaggcgcctgcagcaggacccgcccgccgggatcagcggcgcgccgcacgacaacaacatcatgctctggaacgccgtcatattcgggccggatgatacgccgtgggacggtggcacgttcaagcttaccttgcagtttacagaagattacccaaacaagccaccaactgttcgatttgtctctaggatgtttcatccaaatatatatgctgatggaagc

SEQ ID NO: 32344 - DNA, 418 bp, Zea mays
  Clone ID: LIB3059-010-Q1-K1-C11
cggacgcgtggggcagcagccgcagccatggcaataccccactcaaccaccgcagctaagcccgtgccagcagttcggatcctgcggcgtcggcagcgtcggcagcccgttcctgggccagtgcgtcgagttcctgaggcaccagtgcagcccggcggcgacgccctacggctcgccacagtgccaggcgctgcagcagcagtgctgccaccagatcaggcaggtggagccgctgcaccggtaccaggcgacatacggtgtggtcctgcagtccttcctgcagcagcagccgcagggcgagctcgcggcgctgatggcggcccaggtagcgcagcagctgacggcgatgtgcggtctgcagctgcagcagccaggtccctgcccttgcaacgcagctgccggcggtgtctactactga

SEQ ID NO: 32345 - DNA, 427 bp, Zea mays
  Clone ID: LIB3059-010-Q1-K1-C12
gacactgggtggtgtcatgaccaagattatcccacggaatacaaccttgcctacctcaaagtcggaagttttctcaacagcagctgatggccagactagtgtggagatcaatgttctccaaggagaaagagagtttgtgagagacaacaagtctattggtagcttccggcttgatggaatccctcctgccctacgtggtgtaccacagatcgaagtcaagtttgatattgatgctaacggtatcctctctgtcagtgctgtggacaagggtacagggaagaagcaggatatcacaattactggtgctagcactctgccaaaggacgaggtggagaggatggttggcgaatctgagaagtttgcaaaggaggacaaggagaagcgagacgccattgacaccaagaaccaatccgagtcggtcatctac

SEQ ID NO: 32346 - DNA, 432 bp, Zea mays
  Clone ID: LIB3059-010-Q1-K1-C2
cgcattcctcccatctcccaagacctcctcagacccgagaagcgcagctgcggccatggacgccaccggcactggagctggagggaaggcgaagaagggagcggccggtcgcaaggccggcgggccgaggaagaagtcggtgacgaggtccgtgaaggccgggctccagttccccgtcggccgcatcgggcgctacctcaagaagggccgctacgcgcagcgcgtcggcagcggtgcccccgtctacctcgcggccgtcctggagtacctcgccgctgaggtcctggagctcgccggcaacgctgccaaggacaacaagaagacgcgcatcgtcccgcgccacgtgctgctggcgatccgcaacgacgaggagctcgggaagctgctgaccggcgtgaccatcgcccacggcggcgtgttgcccaacatcaa

SEQ ID NO: 32347 - DNA, 448 bp, Zea mays
  Clone ID: LIB3059-010-Q1-K1-B1
gtcgacccagcgtccgcccagcgtccgtcggaaatctccatcccgcatcgctgaaggagggccaggttgggcatggcaaccttctcgaggttgacgctgaggaggttgccgttcatcttgacgaaccgcaagagctcgtcgaaggagccgaagagcccaagccagaattcaaaattgcggaggaacgaggggctgcggaaccggatctgggcggcgatgactacctggccgacctggtggcttgacaggccgaggctgcggagctcggcgacgcggagagacagggtcttccccacgtcggtgcaaaggagtctgggatcattggcgatgacggttgtgaggtcggtgccggagatgtcgaggcccgccaggaaggcgaggacgacgtcgggcttcgagggagacctgaggtcgaggatccttttgattttggatgccttgaggacct

SEQ ID NO: 32348 - DNA, 428 bp, Zea mays
  Clone ID: LIB3059-009-Q1-K1-H2
gccattcgatgagcttgttgttgacagcaaggattttgatgtcgctgcactgatgaagtgtattgatgctagcaccatccctagagttgtcacttttgacaagaaccctgacaaccacccatacctcatgaaattcttccaaagctcagcccccaaggctatgctgtttttgaacttctccaccggaccttttgattctttcaagtctgcctactctgctgccgcggaggaattcaaggacaaggaaatcaagttccttattggtgacatcgaatccagccagggtgccttccagtactttggcctgaaagaggaccagacaccccttatcctcatccaggatggtgactccaagaagttcttgaaggttcacgttgaggctgaccagatcgtcgcttggttgaaggagtactttgacggcaaattga

SEQ ID NO: 32349 - DNA, 432 bp, Zea mays
  unsure at all n locations
  Clone ID: LIB3059-009-Q1-K1-H4
cgcaaattgcaccaagaaatccatcgagaggccgtcgacaggggaattaatggcgtcggcgtctagcagcagccaccgccgcctcatcctcgcagccgccgtcctgctctccgtgctcgcggctgccagcgccagcgccgggacctcctgcgtgccggggtgggccatcccgcacaacccgctcccgagctgccgctggtacgtgaccagccggacctgcggcatcgggccgcgcctcccgtggccggagctgaagaggagatgctgccgggagctggcggacatcccggcgtactgccggtgcacggcgctgagcatcctcatggacggcgcgatcccgccgggcccggacgcgcagctggagggccgcctagaggacctgccgggctgcccgcgggaggtgcagaggggattcgccgncaccctcgtcac

SEQ ID NO: 32350 - DNA, 421 bp, Zea mays
  Clone ID: LIB3059-009-Q1-K1-H5
atgtgaacccttggagcgtaatcattgcgatatcatacttgatacattatgtaaaaaaacaatggaaaaactactacaacccttcacgacatgcagagatgtgttaaaaacaacacacaacacacttgagtccccaaagactatgaacttggagatctttggaattcattctatgaatggagcgcctgtggcgttggtacttcagtgtgcatcgctccgggtgagacagtggttcaatacttagtgccatatctattagcaattcaatttgtacaccaacacgagaaatgctcctgtttcacatagcatgatttatgatggaagattcgatcggaataaccattatagtgtttggatgtacactcatggatttcaagctctattacgcatgcacactattgtagttgaatggaatggggag

SEQ ID NO: 32351 - DNA, 359 bp, Zea mays
  Clone ID: LIB3059-009-Q1-K1-H6
accacgcgtccggggtcggcttctcctccccctccggctcgggtccgggttcgtgaggtcctccggggttcgggttcgtgggtgagcggatcgagatggcggcgtcggatgttgagtaccgctgcttcgtcggcggcctcgcctgggccacggacgaccactccctacacaacgccttcagcacctacggcgaggtcctctagtccaagatcattctcgatcgggagacgcataggtcccgcggcttcggcttcgtcaccttctccacggatgaggcgattcggaacgccatcgagggcatgaacggcaaggagcttgacggtcgcaacatcaccgtcaacgaggcccattcccgtggc

SEQ ID NO: 32352 - DNA, 449 bp, Zea mays
  Clone ID: LIB3059-009-Q1-K1-H7
cccacgcgtccgcagaaacacacctagcgaagcgcactagcaacgacctaacaacaatggctaccaagatattatccctctttgcgcttcttgccctttttgtgagcgcaacaaatgcgttcattattccacaatgctcacttgctcctagtgccattattccacagttcctccctccagttacttcaatgggcttcgaacacccagctgtgcaagcctacaggctacaacaagcgcttgcggcgagcgtcttacaacaaccaattgcccaattacaacaacaatccttggcacatctaaccatacaaaccatcgcaacgcaacagcaacaacaatttctaccagcactgagccaactagctgtggtgaaccctgtcgcctacttgcaacagcagttgcttgcatccaacccacttgctctggcaaacatagttgcataccaacaacaa

SEQ ID NO: 32353 - DNA, 361 bp, Zea mays
  unsure at all n locations
  Clone ID: LIB3059-009-Q1-K1-H9
gtgcgctctcgctctccctctgtctgcgacgagacttggtgggctaccgccgctgcgcttcgccaggtgctgacgccttcgccgatcacttcgccggcgatagcactcaccaggaatgggcctgtggacattgctggagggttttttgcttcttgcaaatgcgttagcgatattgaacgaagaccgcttccttggtccaaggggatggagcatgtctgaagtatcaggaaacgggcaaaccaagtcgttcaagggccagatcgtggggcttatctacgctacacagtttctgcggatgcccttaattgctctcaacgttctcatcatcngtgtcaaattggtgtctggctgagcctgatga

SEQ ID NO: 32354 - DNA, 439 bp, Zea mays
  Clone ID: LIB3059-010-Q1-K1-A1
gcaacatagaaagcacaatagtgtaccaacaatggcagccaaaatattttgcttccttatgctccttggtctttctgcaagtgctgctaccgcaaccattttcccacaatgctcacaagctcctatagcttcctttcttcccccatacctctcaccagcggtgtcttcagtatgtgaaaacccaattcttcaaccctacaggatccaacaggcaatcgcagcaggcatcttacctttatcacccttgttcctccaacaaccgtcagccctattacagcagttacctttggtgcattttgttggcactaaacatcaaggcacaacaactacaacaacttggtgctaagaaaccttgctgcctactttaagcaacagcaagtttcttccattcaaccaactggctgcattgaactctgctgcttatttgcaacaacaacta

SEQ ID NO: 32355 - DNA, 432 bp, Zea mays
  Clone ID: LIB3059-010-Q1-K1-A2
cccacgcgtacgcccacgcgtccgcggacgcgtggggggaggcagcagctgttctggggcggcgtgattggagatatgaacaaaatgaaaatcgatggcgacaataactttggggagcagaagagccatcaccgatgcaggcgcaagaagcatgatgtgaggattttggattccttgagttgaagagcttcataaggctaaaagtggtgaagcgtacatgtgttggttgtagtgttccttcactagcagcagctatttatcgatagcatgtctttgttgcagcatccactgatagagcagacaactagttactagtgtttcgacattttgtatggcacagatgtttcataatagttccctagtatctgggcgagaatttccatgagtttatctatgacggcttcaaagtgtagcttatgtgctaagaacatg

SEQ ID NO: 32356 - DNA, 364 bp, Zea mays
  unsure at all n locations
  Clone ID: LIB3059-010-Q1-K1-A3
nccacgcgtccgagaactgaaacggaactccctctctgcctcatggtctctgcggcggcggaatccgatccacgcatcttcgctcagacttggtggtgtacgagcagccatagatgtgcagacatccctattggaagaagatccgaacaagaattatcaagaagacaaaaggagtgttgaaacaggagtgcatcaactttcatgagataatgatccagtggacgtgccaatgacaaggtcatagaagaagctatgcttgaggaagctatgagtgactgaaggatttcattttccgtactatcatgtttcaactttcattggccagtcatcaaagaagtatatgatgtgtttggatttggggttc

SEQ ID NO: 32357 - DNA, 69 bp, Zea mays
  Clone ID: LIB3059-010-Q1-K1-A5
ccttgttcggtggatttacggtctgtataatatttatgcacgcttgcactttatccatggtatttgtat

SEQ ID NO: 32358 - DNA, 433 bp, Zea mays
  Clone ID: LIB3059-010-Q1-K1-A6
ctggatctagagcgcaagcgtggcgaatggcagtaaatttctacactgaagcaatatagataaatgaaaaagtggctgcatactacagcaacagacctgctgcctttctagaactaactagctaccgtcaggctgaggcacattgcacaagtgccatcgaactcgattccaagagcgtgagaagcttatttacggagaggcactgcaagggagatgctaggttattataaggaggccgcagatgatttcaaccacgcgcttgttctataaccaatgaacaagacctgtggtgtcgccatcaacaggttccagaagctgtgtgcttgaatatgaatctgcatgaagatatgataaccatgatattttgtgcacacacaagatgtgcgtgtcacagatgcgggattgaagtacctgactacaaccgacggatgct

SEQ ID NO: 32359 - DNA, 433 bp, Zea mays
  Clone ID: LIB3059-010-Q1-K1-A7
cccacgcgtccgtcggaaatctccatcccgcatcgctgaaggagggccaggttgggcatggcaaccttctcgaggttgacgctgaggaggttgccgttcatcttgacgaaccgcaagagctcgtcgaaggagccgaagagcccaagccagaattcaaaattgcggaggaacgaggggctgcggaaccggatctgggcggcgatgactacctggccgacctggtggcttgacaggccgaggctgcggagctcggcgacgcggagagacagggtcttccccacgtcggtgcaaaggagtctgggatcattggcgatgacggttgtgaggtcggtgccggagatgtcgaggcccgccaggaaggcgaggacgacgtcgggcttcgagggagacctgaagtcgaggatccttttgattttggatgccttgaggacct

SEQ ID NO: 32360 - DNA, 159 bp, Zea mays
  Clone ID: LIB3059-010-Q1-K1-A8
gggcaggggaggaaaaaaatctaaccctagcatccgcagcgctagggttcggcggttgcgatggcggctgcactcatgtaccctcagacgttgaagtgttccagcagccctaaatgctcagacatcctcatcgtaagaagctcctaacaagatttatta

SEQ ID NO: 32361 - DNA, 421 bp, Zea mays
  Clone ID: LIB3059-009-Q1-K1-H11
gtgagtttgacgtccaaggctacccgaccttgtacttcgtgaccccgagcgggaaggtgacatcctacgacagcggcaggacggcggacgacatcgtcgacttcatcaagaagagcaaggagaccgcaggcgccgccaccaccaccaccacccaggcgccaccggcatccgagaaggcagccgccgccgagcccgtcaaggacgagctgtgagcatccaaggtgtggacggctgtggctgcgtaagcatgggaggaaaacctggcgctaacgtgcctccaacgcctagtttttgcgggaccagagggagagagagagagggacggagttagagagagaggggatctgcgacgtgttttgctctgcggcggcatgtctgtgtatcccattgaagttatgtacacaattacaccgcggtcggt

SEQ ID NO: 32362 - DNA, 447 bp, Zea mays
  Clone ID: LIB3059-009-Q1-K1-F8
cgtcgagacccaaccataccagcggcgccgcaggctgacgaggaggcggagtagagtggccggactacctcgacacctccactgcaaccatgggtatctcacgtgattcgatgcacaagcgccgggccaccggtggaaagcagaagacgtggcgcaagaagcgaaagtatgagcttggccgccagcctgctaacaccaaactgtctagcaataagacagtgaggagggtccgtgtccgtggaggcaacgtgaagtggagggctctccgattggatacaggtaactactcgtggggaagtgaggctcttacccgcaagacccgcatcctggatgtggtctataatgcatcaaacaatgagcttgtgaggactcagactcttgtgaagagcgccattgtacaagttgatgctgctccattcaagcagtggtacctcactcactatggag

SEQ ID NO: 32363 - DNA, 423 bp, Zea mays
  unsure at all n locations
  Clone ID: LIB3059-009-Q1-K1-F9
aaaaatatgaattcatgacatctgatcaccagtatatttcccggaaacatgaggaggataaggtgattgtgttcgaaaagggagatttggtatttgtgttcaacttccactgcaacaacagctattttgactaccgtattggttgtcgaaagcctggggtgtataaggtggtcttggactccgacgctggactatttggtggatttagcaggatccatcacgcagccgagcacttcaccgncgactgttcgcatgataataggccatattcattctcggtttatacaccaagcagaacatgtgtcgtctatgctccagtggagtgataaccgggtactcgttgctgcgcggcatgtgtggggctgtcgatgtgaggaaaaaccttcttccaaaacccgcagatgcatgcatgcatgctacaat

SEQ ID NO: 32364 - DNA, 429 bp, Zea mays
  Clone ID: LIB3059-009-Q1-K1-G1
gtcaagaagtgcgttgagctgttttttgagattgcggagaacaaggaggactacaacaggttctatgaggtcttctccaagaacctcaagcttggcatccacgaggactccacgaacaggaccaagattgctgagctcctgaggtaccactcgaccaagagcggggatgagctgaccagcctcaacgattatgtgaccagcatgaacgagggccagaacgacatcttctacatcactggtgagagcaagaaggctgtggagaactacccgttccttgagaaactgaagaaagagggctatgaggtgctgttcatggtggatgccattgacgagtattctattggacagctgaaggagtttgagggcaagaagctcgtctctgccaccaaggagggcctgaagctggacgagagtgaggatgagaagaag

SEQ ID NO: 32365 - DNA, 452 bp, Zea mays
  Clone ID: LIB3059-009-Q1-K1-G12
ttccgggtcgaccagccgtcggggtcttaaggcacaccaaaccacactgcgacccacagaaggcgaggcgaaaggcaaggcaaagcggcgcggtgggcatgatgtttgacgatcaagacctgggcttctttgccaatttcctgggcatctacatctgagcctaggttattgcgtaccactttgagaaggcataaccgagatacgcaagtaactggtgtcctttagtgcgaagatcccattatttgcaagccgaattacggctctccagagagcttgagctagagagatggcttgaaacgttcattgcgtactatggagcctaggcatgcaactgctggcataataggcatgtccaaggctgaatacgctgaattagagaatactggagaattcaggaaccgtgttaagtactgcagatgggcggcagtatctcgtactaatgtatgcatgcc

SEQ ID NO: 32366 - DNA, 272 bp, Zea mays
  Clone ID: LIB3059-009-Q1-K1-G4
ccgtcgtcgtgggctcccgtcgctggagacaccaatgggtgtactgggtggggcccatggtcggcgccggcctctccggcgtcgtctacgagcacctcgtcgccggcccggccgccgaggaggaggagcccgcgccgagctgcggcgaccgccgtcgtgcgtagaggactacatgcatgcaagagcagcaggacgtcgtcgtcgtccccgctcctcggaatcttctgaataaaaaaaacagcttgcatgcgtgctcaattgttgtgtgtcgt

SEQ ID NO: 32367 - DNA, 449 bp, Zea mays
  Clone ID: LIB3059-009-Q1-K1-G5
ggtgttttgaaggaagccagggttttcaaggaactggtggtagcaccaacatcaaaggctcttgtccatgttttctttgcacaacgttccacgacaaaggtgccaggtgtaactgatgttcaactgaaaccaaggccaattagaaaagttgctgttattggtggtggtctgatgggctctggaattgctacatcacttcttgttagcaatatttctgttgtgctcaaggaagtgaaccctcagtttctgcaaaggggagagaaaatgatagcaggtaatcttgagggcctgataaaaaaaggttcactaacaaaggataggatgcacaaggccatgtcgcttttcaagggcgctttggattattcagatttcaaggatgttgatatggttattgaggctgttattgagaagattcctttgaagcaatcgatattttctgacattgaaaa

SEQ ID NO: 32368 - DNA, 443 bp, Zea mays
  Clone ID: LIB3059-009-Q1-K1-G6
gcctgacatagttgtagcaacccctgggcgcataatagatcatctgcgcaattctctttctgttgggcttgaagatctagctgttgtgatccttgatgaggctgatcgcttgcttgaattgggcttcagtgctgaaattcaagaactgattcgtatgtgtcctaaaaggaggcaaactatgcttttctctgctacaatgacagaagaaattgatgaacttgtaaagctttcactaaacaagcctgtacgccttgaagctgatccttctctgaaacggcctgcaacattgactgaagaggttgttaggatacgacgagcacgtgagtcaaatcaagaagctgttcttcttgcactcttgttgaagactttcaagcgaagtgttatcatttttagtgggacaaagcaatctgcacacaggttaaaaataatatttggtctctctg

SEQ ID NO: 32369 - DNA, 446 bp, Zea mays
  Clone ID: LIB3059-009-Q1-K1-G7
gggcgcggccggggtggcggtgcccacgtactcgccggacccgcacgccgacttcctccggtccatggaggagatggccgcggcgctgcggctggacgcgcggcgccgcggcgacagggcgcgcctccacgagctgctgctctgctacctcgcgctcaacgacaggcgcgcgcacaagtacgtcgtcagcgccttcaccgacctcctcctccgcctcaccgccgccgccgcagccgccaacctcagcgacgacgaccggcacgagtaaccgccttttttttcacggtcatggccgtgcgtacggacagaatttcgggtacggcggaggctcaaaaatcctcgacagcatgagcgagcgttccaagatcacccagagctgtacatactgcctccagctccagatcgagctccgtagctagaaatctgttcgtgtgcgcagcattttg

SEQ ID NO: 32370 - DNA, 442 bp, Zea mays
  Clone ID: LIB3059-009-Q1-K1-G8
cggacgcgtgggcggacgcgtgggaccatgagggtgttgctcgttgccctcgctctcctggctctcgctgcgagcgccacctgcacgcatacaagcggcggctgcggctgccagccaccgccgccggttcatctaccgccgccggtgcatctgccacctccggttcacctgccacctccggtgcatctgccaccgccggtccacctgccggcgccggtccacctgccaccgccggtccatgtgccgccgccggttcatctgccggcgacaccatgccactaccctactcaaccgccccggcctcagcctcatccccagccacacccatgcccgtgccaacagccgcatccaagcccgtgccagctgcagggaacctgcggcgttggcagcaccccgatcctgggccagtgcgtcgagtttctgaggcatcagtgcaacccga

SEQ ID NO: 32371 - DNA, 430 bp, Zea mays
  Clone ID: LIB3059-009-Q1-K1-H1
ctccctcaggtttagtgttcgcaatggcggccttcaacaagcttggtggccttctaaggcacagtgctctggtgagcggtatcactggtggctcttctcctgcagtgttcaatgctgcacggctcatgtctaccaagctatttattggtggtcttgactggggtgttgatgacgtgaaactaagagaagcatttagcagctttggagaggttactgaagcgagggtgatcacagacagggagactgggaggtcaagaggctttggctttgtgaactactccgacagtgatgctgccaaggaagctatttctgcaatggatggcaaggaaattgatgggcggcaggtacgtgtcaacatggctaatgagagacctgctgggaaccgtggtggtggcggctatggtggcggcggctatggaggtggtggcta

SEQ ID NO: 32372 - DNA, 449 bp, Zea mays
  Clone ID: LIB3059-009-Q1-K1-E2
cgaagatattcttaggtgtatgaagaaagtcacaccaatggacttgaagcagactgttcaagtagataaagaccttgtgatccgtgcctattatgctggacatgttataggggctgccatgatttatgcaaaagttggggatgctgctatggtatacactggggattacaatatgacaccagatagacatcttggggccgcacagattgatcgtctgaagttggatgtattgataacagagtccacatatgctaaatctatacgtgactcaaagcctgtccgagagagggagtttttaaaagcggtacataaatgtgtttctggtggaggtaaagttctaattccaacgtttgctctgggaagagctcacgaactatgtatgttactggatgactattgggagaggatgggcttgaaagttcctatttatttttcaactggtttaacca

SEQ ID NO: 32373 - DNA, 396 bp, Zea mays
  Clone ID: LIB3059-009-Q1-K1-E3
gattccgggtcgaccacgctcgatcgcgcgcgctctttgtgcgcgcatggagaagcgcgaatgcttgcaaatagacagcctaccccagtcagtctgcgcggtcctacccaattagactcgagacgctaaaaaaaggtgtgtgagatccactggggcacaagtttttgaaaagaaatgtctcacggggtttgagctggccgattgctgcaacagttcatgaacaagtctgcatgaaaggatgcctttcacctttgggtccgggttaccccttccatgtccttcgtatcaacaagatgctttcgtgtgctggggctgataggctccagactggaatgaggggtgcctttggcaagccttaaggcacctgttctaaggtggacaattggcaggtactcc

SEQ ID NO: 32374 - DNA, 446 bp, Zea mays
  Clone ID: LIB3059-009-Q1-K1-E4
cttcgcacgcgaaaaccctagcagttcggtagtccctctcctctcgaggtattagcagtcgaccggttcctcggagcacgatgaagtttgctgctgcctacctgcttgctgtactcgctgggaacgccagcccctgcggtgacgatttgactgccattctggagtcagttggctgtgaagctgacaatgaaaagatggaactcctgctgtcccaactgagcggtaaggacatgaccgagcttattgccgcgggcagggagaagtttgcttcagtcccatgtggtggcggcggtgtcgctgttgcggcagctgcacctgctgctggcggagctggtcctgcagctgatgcagagaaagaagagaatgtggaagagaaagaataaagcgatgatgatatgggcttcagcctcttccactaggctgaacagccatcacagtattgtttt

SEQ ID NO: 32375 - DNA, 445 bp, Zea mays
  Clone ID: LIB3059-009-Q1-K1-E6
agcctttatccattcttgtgtttctcgattggattgttgttaaacactattgctatcttctaccgatcattagcagctataccatttggcacaatggttgtcatgtttattctttgggctttcatctccttcccgttggttctattggggactgtagttggtagaaattggagtggtgctcccaacaacccgtgtcgtgtgaaaacgatcccgcgcccaattcctgaaaagaagtggtaccttacaccttctgttatttcactgatgggtggacttctccccttcggcagcatcttcattgagatgtacttcgtattcacttccttctggaactacaaggtgtactacgtctatggtttcatgttgctggtgtttgtcatcctcataatagtcaccatatgtgtcactattgtgggtacttatttcttggtgaatgctgaaaact

SEQ ID NO: 32376 - DNA, 431 bp, Zea mays
  Clone ID: LIB3059-009-Q1-K1-E7
gattttaccaaaacacttcttatagaagcggactgaaaagctggggcgtttggcagaccgcaccagattttggtggccggaagttgaaaaaagcccaaacaaacagggccacagtatggaaatcattagctctgtggactgtggtcaggaaaaagaacagccaacaaataaacgtgcaacgtcagaaagtactacagaatcaagcacataagcatccagggagaacattagaagggacaagctgaacgagagattcttggaattgggtgccattttggagccagggaaaactcctaaaatggacaatacagctatattgagtgatgctattcgtgtagtacgtgaattgcgtagtgaatcaaataagctcaaggattcaaatgagaatcttcaagagatgattaatgagctctaagtctatactatttcat

SEQ ID NO: 32377 - DNA, 292 bp, Zea mays
  Clone ID: LIB3059-009-Q1-K1-E9
gcagaccaagatgatccagatgaacgacatgatcctgactctgacatggaagtggatgatcacaaggctgtggaagagtcatcgaggaggatcattctaggtataaaaatcaagagagaatttggtgaaaatgcgaccagagtacaggatggtggcagagtcgcatctggacatacacgactggaacccattgcagaagacatcggttccttcaagcaagctcctgcagatgccaatgcaatgggcattgatgaaccaagcaatgtcaagaatgaacctgagagctcaacta

SEQ ID NO: 32378 - DNA, 433 bp, Zea mays
  Clone ID: LIB3059-009-Q1-K1-F1
cccacgcgtccggcgcctcccggcgggcaagtccaaggagggcggcgagggcaagaaggggaaaaagaaggcgaataagtccgtggagacctacaagatctacatcttcaaggtgctgaagcaggtgcaccccgacatcggcatctcgtacaaggccatgtccatcatgaactccttcatcaacgacatcttcgagaagctcgcggccgagtccgccaagctggcgcgctacaacaagaagcccaccatcacctcccgcgagatccagacctcggtgcgcctcgtcctccccggcgagctcgacaagcacgccgtctccgatggcactaaggccgttacgaagttcacctcgtcttaggatccttgtaatggtcatgtgggcgtcagcagtaggcgtggctcaatttatgtgatactgctagcgatggatgat

SEQ ID NO: 32379 - DNA, 418 bp, Zea mays
  Clone ID: LIB3059-009-Q1-K1-F11
cccacgcgtccgcaaaacatcagggcacaacaactacaacaacttgtgctagcaaaccttgctgcctactctcagcaacagcagtttcttccattcaaccaactagctgcattgaactctgcttcttatttgcaacaacaacaactaccattcagccagctacctgctgcctacccccagcaatttcttccattcaaccaactggcagcattgaactctcctgcttatttacagcagcaacaactactaccattcagccagctagctggtgtgagccctgctaccttcttgatacaaccacagttgttgccgttctaccagcacgctgcgcctaacgctggcaccctcttacaactgcaacaattgctgccattcaaccaacttgctttgacaaacccagcagcgttctaccaacaac

SEQ ID NO: 32380 - DNA, 438 bp, Zea mays
  Clone ID: LIB3059-009-Q1-K1-F3
cggacgcgtgggtggtgctgctgaagagtcaataagatatcttccaccatctgcaattggtgaagcaagtggttttgatgcgaagggttttgcggttgaaaataaaggcaagagtttggaggccattgttgaacaagtacgcgatggcagtactgttcgtgtgtatttagtccctagttttcagtttgtccagatatatgttgctggagtacaggccctatcaatggggagacgcccatctgcacctactgtaattgctgaaactgatgatactgctaatgacactaacggtgaagattttgagggaacacctgtccaactgactacagcacaaagacttgttgcatctgcagcttctgctgaaatttcaccatataggtatggaagataagcctatgcactttacataggctatagttttcaacatatatttgcgta

SEQ ID NO: 32381 - DNA, 400 bp, Zea mays
  Clone ID: LIB3059-009-Q1-K1-F5
cgtgtatttccgcggtttattctatgacactgcaaatgatcctgagggtggttactatgcaaggggcgcccgtgcatcagtctgggagaacttcaagaacaacccgctcttcgacatctcaacggaccacccacccacgtactacgaggacatgcagcgtgccgtcttctgcctgtgcccgctgggctgggccccgtggagcccccgtctggtggaggcggtggtgttcggctgcatcccggtgatcatcgccgacgacatcgtccttcccttcgcggacgcgatcccgtgggaggagatcggtgtcttcgtggccgaggacgacgtcccgaggctggacaccatcctgacgtccataccgatggaggtgatcctccggaagcagaggctgctcgcgaat

SEQ ID NO: 32382 - DNA, 430 bp, Zea mays
  Clone ID: LIB3059-009-Q1-K1-E12
ggcgccgcaggctgacgaggaggcggagtagagtggccggactacctcgacacctgcactgcaaccatgggtatctcacgtgattcgatgcacaagcgccgggccaccggtggaaagcagaagacgtggcgcaagaagcgaaagtatgagcttggccgccagcctgctaacaccaaactgtctagcaataagacagtgaggagggtccgtgtccgtggaggcaacgtgaagtggagggctctccgattggatacaggtaactactcgtggggaagtgaggctcttacccgcaagacccgcatcctggatgtggtctataatgcatcaaacaatgagcttgtgaggactcagactcttgtgaagagcgccattgtacaagttgatgctgctccattcaagcagtggtacctcactcactatggagtggaca

SEQ ID NO: 32383 - DNA, 427 bp, Zea mays
  Clone ID: LIB3059-009-Q1-K1-C7
ggttgatggaagcattgactagtatactgataggctcactctgtcacagtaaggggtgtgggggtcggatgtccatgtgtatatatggatagatgcgtgtatgtgtgtcttgggctcttggctggttctggaaggaccaaatgggctctcggctggttctggaaggaccaaatgaaaaaaagggtgtgctgttcttgaacaggggacctgcctgaaattggcttagaacaagcaatcaagtatctatcaactacactgtcattattgtgtgattttgcaaatttgctcttgcgaaacatggcaagttcatcatttcttctgcatggagttggtgttgcccacccctttgtgctagttccttggtaatatgtaatatatgatatatcaagactcaagagtgtttctgaaaaatatgcaacgacttcag

SEQ ID NO: 32384 - DNA, 98 bp, Zea mays
  Clone ID: LIB3059-009-Q1-K1-C8
aaaaaaaaaaaaaaaaaaataaaaaaaaaaaaaaaaaaaataagaaaaagaaaagagaatgggtaaataaagatgtaaatagtgtatatatggatata

SEQ ID NO: 32385 - DNA, 421 bp, Zea mays
  unsure at all n locations
  Clone ID: LIB3059-009-Q1-K1-C9
ncggtgatgttacatcattgggctcacttaatgacttcctgagtacttcaagatcacatgatcaatatttacagctccagtcagatttttccaaaacttccaggttccgtgcctcggctgctagtgcaattaagccaagctctgtctatcaagccagcctaagtccgagatctggcacttttaaagatggggtaccaagggcttcatgtgcaagggttgttgggagggacaagctgaagcgtcgtgtggaatggttaggcccgttaactgctccgcttgatacgaatcctttgacaatcaaccctgattctgccagtgagaagtgtgatgcagattgttcaaagaacaatgttagctcagttccgttggacctgcctctttcgtttaccctgttgccttctatttactcccttggcactcg

SEQ ID NO: 32386 - DNA, 396 bp, Zea mays
  Clone ID: LIB3059-009-Q1-K1-D1
accacgcgttcggcaaggccttcagaccgggagggctccctgtcctgtcccccgcgccgccgcggatggacggagccaccacgccggcatcaggcgccctcgtcaggctctgcctgccttcgctcctcctctttctgtaccggtgctgcagatgtgaggctgttgagatggagagaacccttgcgatgatcaagcccgatggtttgtcaggtaagtacacagaagcaatcaaagaggtcatcttggattctggatttcatatcgtcaaagaaaccgaagtccagcttgatgctgagagggcatctgtcttctatgcggagcatttccaaagaagcttctttgacagcctagtcaagtacataacaagtggttcagttcttgctatggatctggaaa

SEQ ID NO: 32387 - DNA, 409 bp, Zea mays
  Clone ID: LIB3059-009-Q1-K1-D10
acgcgacaacaacctgctgggcaagttcgagctctccggcatcccccctgcaccccgtggtgtgccacagatcaccgtgtgctttgacatcgacgccaacggcatcctgaacgtgtctgccgaggacaagacaacggggcagaagaacaagatcacaatcaccaacgacaagggccgtctctccaaggaggagatcgagaagatggttcaggacgctgagaagtacaagtctgacgatgaggagcacaagaagaaggtggaggccaagaactcgctggagaactactcctacaacatgcgcaacacgatcaaggacgagaagattgcgtccaagctgccggccgatgacaagaagaagatcgaggacgccatcgacgcggccatcagctggctggacgccaaccagctc

SEQ ID NO: 32388 - DNA, 397 bp, Zea mays
  Clone ID: LIB3059-009-Q1-K1-D12
cacgcgtccgcccacgcgtccgctgctcttccatcgcgccagtgttttgagaagctggtcggcgctcctagatcccttcgcctctctcgcgttcgaggctaggtagccgtcaccatgagccgctcggggcagcctccggatctcaagaagtacatggacaagaagcttcagattaagctgaatgcaaaccgtgttgttattggcacacttcggggattcgaccagttcatgaatctggtgatcgacaacactgtggaggtcaatggaaatgacaagacagatattggaatggtggttatcaagggaaacagtgttgtcatgatcgaggcacttgaaccaggtgccaaatcgcagtgaatccttatttttcaactgatattgtcgcaacctggaaacc

SEQ ID NO: 32389 - DNA, 418 bp, Zea mays
  Clone ID: LIB3059-009-Q1-K1-D2
cccacgcgtccgcccacgcgttcgcccacgcgttcgcccacgcgttcgggcgggagcagcagctgtggagacggcggcggcggcggcagcggccaacggaaaagcgtgctggcacgccgtcaaggggcccgggtacgccacgccgctggaggccatggagaagggccccagggagaagctcgtctacgttacctgcgtctacaacggcactggaattaacaagccggattaccttgcgacggtggatttggatcccagctctactacatactcccaggtgatccacaggctcccggttacccacatcggcgacgagctgcatcactctggctggaactcctgcagctcctgccacggtgacccatctgccaagcgccgtttgctgatcctgccttccttgctgtcaggccttgtgtat

SEQ ID NO: 32390 - DNA, 437 bp, Zea mays
  Clone ID: LIB3059-009-Q1-K1-D5
cggacgcgtgggcgcttgcgaggtggtatgcagatctttgtgaagaccttgactggcaagaccataaccctggaggttgagagctccgacaccatcgacaacgtgaaggcaaagatccaggacaaagagggcatcctccagctgcttgccagcgaagatcagacgctgctggtctggggggatgccctctttgtcctggatctttgctggcaagcagctggaggatggccgcaccctagcagactacaacatccagaaggagagcactctccacctggtgctccgcctccgtggtggtcagtaagccatggttcatttaagctgctgctgtacctgggtatctgcgtcgtctggtgccctctggtgtacctctatatggatgtcgtcgtctaataaacatctgtggtttgtgtgtcatgaatcgtggttgttgcttc

SEQ ID NO: 32391 - DNA, 444 bp, Zea mays
  unsure at all n locations
  Clone ID: LIB3059-009-Q1-K1-D6
ggcacatcttccatcattacaagattatcagaatatgcatactcatggaatataccttcagtcctttgccttttccaacaagttgggttaacacttgagatatcatcatttaattgggaagggccatcgtctaaccacttataactgtcattttcaggataatgcatttgcttataccctaacttgtaatcaataccggcaacattgtcatccaggcggcatgaattagtgatccttccagagaaacatactatgcaaaacaaatgtcatattaataatctagaaacaactttgagatgggttttatctattgatgaggaacctgttaagaaatgtttgattcgcctgtagctgcaaggaatgctaactttnttttggttggtctctgcggaggatgccattgtcagttgtaaatattggcagcatattaggaaacatattatc

SEQ ID NO: 32392 - DNA, 364 bp, Zea mays
  Clone ID: LIB3059-009-Q1-K1-D7
acatgccatttactcgtggtgagaaacgttcagttgaggttgtgaaggtcacagatgagatgaattcatctgctgcctatggcaagctccgccttgagcggatgaacaagaaacatcttggtgcccgccagaagaaggcagctgatgcagataaggaagataagaagtgaagcggctgaagatagtaccctgatacggtctattcagtcattagtgaatgctactacttaaagtgcttgttctatgcatactttgcggtaatggagatagatccctgacatacattcagctgtcctactgtttgatgccatggactagtaagctaactcaaatttttaatgtgttatgggatttttgcgtatgt

SEQ ID NO: 32393 - DNA, 431 bp, Zea mays
  Clone ID: LIB3059-009-Q1-K1-D8
cccacgcgtccgcccacgcgtccgcgtcaagacacttgttgaggctgttgcagacagttgcccagaggcgttcatccatatcatcagcaacccggtgaattccacggtgccaattgcagctgaggttctgaagcagaagggtgtctacaatcccaagaagcttttcggggttaccaccctggatgttgtcagggccaacacatttgtggcgcagaagaagaaccttaagctcatcgatgttgatgtcccagttgttggtggccatgctggaatcacaattctgccactgttatcgaagaccaggccatctgtcaccttcacagatgaggaaactgaggagctgacaaagaggatacagaatgccgggacagaggtggtggatgccaaagctggtgctgggtctgctaccctgtccatggcctatgccggtg

SEQ ID NO: 32394 - DNA, 201 bp, Zea mays
  Clone ID: LIB3059-009-Q1-K1-E1
cggacgcgtgggttttttttttttttttttttttttttttttttttttttaatttttttttttttatttttttttttttatttttttatttaatttatttattttttatatttattgttttgttgagattacaattattgcatctgcaaaacgagtacttcaaacatacaagggacaaatgattacaaaagtaaactagac

SEQ ID NO: 32395 - DNA, 416 bp, Zea mays
  Clone ID: LIB3059-009-Q1-K1-E11
cccacgcgtccgcccacgcgtccgcggacgcgtgggcaggaatgggcctgtggacattgctggagggttttttgcttcttgcaaatgcgttagcgatattgaacgaagaccgcttccttggtccaaggggatggagcatgtctgaagtctcaggaaacgggcaaaccaagtcgttcaagggccagatcgtggggcttatctacgctacgcagtttctgcggatgcccttaattgctctcaacgttctcatcatcgttgtcaaattggtgtctggctgagcctgatgaattggtatctgttccacctttatgtaagagctgagagatcccaaatttaattgtactcaaggttgctgtaaatatgctgcttctgttgattctaatgtggatttctgttattgttgtcgtaaattaatt

SEQ ID NO: 32396 - DNA, 445 bp, Zea mays
  Clone ID: LIB3059-009-Q1-K1-C6
cgcaacccgttcacgggcaagaggcagtggcttggcaccttcgacacggccggcgcggcctccgcagcctacctatccgcttcccggagcttcgccgacgagaagcgccgccgccgcgggcagcctgtgccctcttcctcaccagttccttcggcaagcgccaccccgacggcctcctcttcgtcgtccacctcgactgctccgttcgcgcacccgtcgccgtcgtctgttcttggacccgccaccaaggaggcgccgctgaacccgcagtccccggagctggtcgcgacaccaacgctcgtcctgccgtccgatgagtccgcggagctgccggacgacccggagttctaccaggaccttctccgcggcctgcagctgccagacatcagcccgatggacttccgtgccgggcttgacgctctggacgtctccgatgcgcccttcg

SEQ ID NO: 32397 - DNA, 388 bp, Zea mays
  unsure at all n locations
  Clone ID: LIB3059-009-Q1-K1-B3
catttgaactcatctggaggaagttntgtccatatatccggatgatgtatgaaagtttctctggtgtgatgattcctgttctctatgtaatggaatgcgcaatttcagggaagattctatggtcattgacgttggagaaccaaccgactgggtgaaaatcaatgtgcggcagactaaagattgctttgaagtctatgcactagttcctggacttctacgtgaggaggtgcatgttcaatcaaatcctgctggacgtcttgttattacaggtgatccaaagcagcccgataatccctgtgagatcactccgttcaagaaggtggtcaacttgccatcaagaatcaatccttaccaaacatccgctgttgtcacgcttcatggtcagctg

SEQ ID NO: 32398 - DNA, 399 bp, Zea mays
  Clone ID: LIB3059-009-Q1-K1-B6
ccgtcgtcgtcgtcgttttcgttcccatcgtcacaagtccagtaccaaacgtgccagcgcgacgtcgacaggcacaacgtctgcgccatggaggtgaggcacagcgtcgaacggctggaccaggccgacgtctacagccctggggctgggaggatcacacgcctcaccagccacaagttccccgtcctcaacctcgtacagatgagcgcggtgcgggtagacctgtaccaggacgccatcatgtcgccgttctggaacttcaacgcccacagcgccatgtacggcatcaggggcagtgcaagggtccaggtcgtcagcgacaacgggaccacggtgttcgacgacgtgctccgggcggtgcagctgctcatcgtaccccagggctacctcgtcgccacc

SEQ ID NO: 32399 - DNA, 417 bp, Zea mays
  Clone ID: LIB3059-009-Q1-K1-B7
gcgtcggcgacgccatcggccggatggcgcgcgacgagggcgtgcgcagcctctggcgcgggtcctcgctcaccgtcaaccgcgccatgatcgtcacggcgtcgcagctggccacgtacgaccaggccaaggaggccatcctggcgcgccgcggcccgggcgccgacggcctcgccacgcacgtggccgccagcttcaccgccggcatcgtcgccgccgccgcgtccaaccccgtcgacgtcgtcaagacgaggatgatgaacatgaaggtggcgcccggcgcgcccccgccctacgccggcgccgtcgactgcgccctcaagaccgtcaggtcggagggacccatggcgctgtacaaggggttcatccccaccgtgatgcgccaggggcccttcaccgtagtgctcttcatcacgc

SEQ ID NO: 32400 - DNA, 406 bp, Zea mays
  Clone ID: LIB3059-009-Q1-K1-B8
gcgccgggccaccggtggaaagcagaagacgtggcgcaagaagcgaaagtatgagcttggccgccagcctgctaacaccaaactgtctagcaataagacagtgaggagggtccgtgtccgtggaggcaacgtgaagtggagggctctccgattggatacaggtaactactcgtggggaagtgaggctcttacccgcaagacccgcatcctggatgtggtctataatgcatcaaacaatgagcttgtgaggactcagactcttgtgaagagcgccattgtacaagttgatgctgctccattcaagcagtggtacctcactcactatggagtggacatcggtaggaagaagaaggtgcctgttgctaagaaggatgcgactgagggacaagagggtgaggctatagct

SEQ ID NO: 32401 - DNA, 423 bp, Zea mays
  Clone ID: LIB3059-009-Q1-K1-B9
ctagcaacatagaaagcacaatagtgtaccaacaatggcagccaaaatattttgcttccttatgctccttggtctttctgcaagtgctgctaccgcaaccattttcccacaatgctcacaagctcctatagcttcctttcttcccccatacctctcaccagcggtgtcttcagtatgtgaaaacccaattcttcaaccctacaggatccaacaggcaatcgcagcaggcatcttacctttatcacccttgttcctccaacaaccgtcagccctattacagcagttacctttggtgcatttgttggcacaaaacatcaaggcacaacaactacaacaacttgtgctaagaaaccttgctgcctactctcagcaacagcagtttcttccattcaaccaactggctgcattgaactctgctgctta

SEQ ID NO: 32402 - DNA, 294 bp, Zea mays
  Clone ID: LIB3059-009-Q1-K1-C1
cccacgcatccaaagggccatgctgggagacagattcccggcgtgcgttcaaaggccgtcaccgtatctggcgggtccctgatcagcctcatgagagccatgaacgagtaaactggagcttaaaaaactgcatggtctctggagcattctacacgctggcgcaccgcacacctgtagcgctgacacaagccatcgccgacctgaacatgagatgaaccatgatgagcttttgccatacttctagcgatacaagtgacttcgaactatatatccgaaattgctagtgcaagggcg

SEQ ID NO: 32403 - DNA, 208 bp, Zea mays
  Clone ID: LIB3059-009-Q1-K1-C10
ggtgatgttacatcattgggctcactgaatgacttcctgagtacttcaagatcacatgatgaatatttacagctccagtcagatctttccaaaactttcaggttccgtgcctcggctgctagtgcaattaaaccaagctctgtctatcaagccaggctaagtccgagatctggcacttatacagatggggtaccaacggctccatgtg

SEQ ID NO: 32404 - DNA, 428 bp, Zea mays
  Clone ID: LIB3059-009-Q1-K1-C12
tccgaattttccttgaagatggacaccaaattggatgtgctcagtcatacccaaagaacatgggactttatggacaaagagcaggatgcctgagtattttgtgtgaggatgagatgcaagcagttgctgtcaagagccaactgcaacagatcgcaagaccaatgtacagcaacccacctgttcatggtgcactggttgtttctataatcctcagtgatccagaattgaagagtttgtggttaaaagaagtcaagggtatggctgatcgtatcattggaatgcggaaggcacttaaggaaaatcttgaaaagctaggttcacctttgtcatgggatcatatcactaatcagattggaatgttctgctacagtgggatgacacctgaacaagttgaccgtttaacaaatgaataccacatttacatgacc

SEQ ID NO: 32405 - DNA, 443 bp, Zea mays
  Clone ID: LIB3059-009-Q1-K1-C4
cccacgcgtccgggccaatgtccgtgagatttttgacaaggctaggcagtctgctccgtgtgtcctcttcttcgatgagctcgactccattgctactcagagaggaagcagtgttggtgacgcgggcggtgctgctgacagggtgttgaaccagctgcttactgagatggatggcatgaatgccaagaagacggttttcattatcggcgcgactaacagaccagatatcattgaccctgccttgctgaggccaggacgcctcgaccagcttatctacattcctctgcccgatgagcagtccaggcttcagatcttcaaagcctgcctcaggaagtctcctgtggctaaggacgttgacttgcatgctcttgccaagtacacccagggtttcagcggagcagatatcaccgagatctgccagcgtgcgtgcaagtatgccatca

SEQ ID NO: 32406 - DNA, 376 bp, Zea mays
  unsure at all n locations
  Clone ID: LIB3059-009-Q1-K1-B10
gaagatggtcatcgttctcgtcgtgtgcctggctctgtcagctgccagcgcctctgcaatgcagatgccctgcccctgcgcggggctgcagggcttgtacggcgctggcgccggcctgacgacgatgatgggcgccggcgggctgtacccctacgcggagtacctgaggcagccgcagtgcagcccgctggcggcggcgccctactacgccgggtgtgggcagccgagcgccatgttccagccgcttccgcaacagtgctgccagcagcagatgaggatgatggacgtgcagtccgtcgcgcagcagctgcagatgatgatgcagcttgagcgtgccgctgccgncagcagcagcctgtacgagccagctctgatg

SEQ ID NO: 32407 - DNA, 283 bp, Zea mays
  Clone ID: LIB3059-008-Q1-K1-H12
ggccggaagcggggcgaccagcagcggacggcagcacgaaaggaaaccaaagccaaacaacgaaaaaagagaggaacaaagcgggacaaaaggaacaggaaacccaaccggaaaaggggccgcaaagaaacaccaaagccaggcaaagagaagaagcgacgaaaaaagaagaagaagaaacaacacaaagaggccacggagccaaaaccaaaaagggaggaagccagaaacaacaggaccaagaaccaaaacaggcagggcaccagaaacccaaggaggaagg

SEQ ID NO: 32408 - DNA, 364 bp, Zea mays
  Clone ID: LIB3059-008-Q1-K1-H9
gctgctcatccggaagctgcccttccagcggctggtgcgtgagatcgcgcaagacttcaagaccgaccttcggttccagtcctccgctgtcgccgcgctgcaggaggccgccgaggcgtatctggtgggtctctttgaggacaccaacctctgcgccatccacgccaagagggtcaccatcatgcccaaggacatccagctcgcgcgccgcatcaggggcgagagggcctgattgctgctctgtcttcctgtttctgtaatgtctgaactaggctatggactctatcgcttcttgttctgcaatcgttgtaccgatgttcttggcatatctatctggctgtttaattaatatttattttgggct

SEQ ID NO: 32409 - DNA, 310 bp, Zea mays
  unsure at all n locations
  Clone ID: LIB3059-009-Q1-K1-A1
cacacgccgtcctagtagcctncctggacaatgatgttaagttcggcaaggttttcctttctctttttttattctactgcgtggtctatgtgtatattgccaaaggcatgcgtgagccatgcgcccggtgctggggcgcagagaccatctgatggtggaaacaccggaaataagagcgtgccgctgtgtgttttctttgaaggaataaaaatggtgttcgtgttgtgcattgcttaaaataattataaattatttatttttattttttttattaattatttcattattttttatttaattttttatcttt

SEQ ID NO: 32410 - DNA, 398 bp, Zea mays
  Clone ID: LIB3059-009-Q1-K1-A10
tccggcagacattgctccggaggtactctatcgccgggaatacgacggcaagatggcagacgtttggtcttgtggagtgactctttacgtgatgctggttggtgcatacccttttgaggaccccgatgatcccaagaatttcagaaaaacgattgggagaatagtgtcaattcaataccagataccagagtatgtccacatatcccaggattgcagacagctccttgctaggatcttcgtcgcaaatcctgcaaagagaataacaattaaggagattaggaatcacccctggttcctgaagaatttgcccagagagcttacagaagctgcgcaagcgaagtactacaaagaggacaacggtgcccccaccttctctgatcaaacagtcgaagagatca

SEQ ID NO: 32411 - DNA, 428 bp, Zea mays
  unsure at all n locations
  Clone ID: LIB3059-009-Q1-K1-A11
cgccgtctgccttctgcgcctacatttcggcctctgtcccttgcaagttcaatctcacctgcaaccatgggtaaagagaagtcccacatcaacattgtggttattggccacgttgactctggcaagtcgaccaccacaggacacctgatctacaagcttggaggcattgacaagcgtgtgatcgagaggtttgagaaggaggctgctgaaatgaacaagcggtccttcaagtacgcatgggtgctcgacaagctcaaggctgagcgtgagagaggtatcaccattgatatcgctctgtggaagtttgagaccaccaagtactactgcacggtcattgatgcccctggacaccgtgacttcatcaagaacatgatcactggtacctnccaggctgactgtgctgtccttatcattgactccaccactgg

SEQ ID NO: 32412 - DNA, 292 bp, Zea mays
  Clone ID: LIB3059-009-Q1-K1-A12
cgcagcgtccggctatgcgaagctcaatcaatctactcatagcaagttcactaatacctgataagatgcttgaagacaagaacactataaccgttccggaccatgtccatgatgactctgaccagcgtatcagatcaggacacctgagatacatgctaccacgcataggacatcgtgtgatccataggcttgagaaggaggctgctgcaatgaacaagccggacttgatgtgcacatgggtgcttgacaagctcaacgcttagactgaaagaggtctcaccattgacatgtg

SEQ ID NO: 32413 - DNA, 452 bp, Zea mays
  Clone ID: LIB3059-009-Q1-K1-A2
cacgtagatgctggaggaggatgtggaagttccagtctcatctgcaaatgaagctccaaacgatactatgaagatggacacagatgatgtgccaagtgatcctgctgctggatctgatgtgactatgcaggagcagcctcctgcagctggaaatggagcacaagataatgaggaaaagtctgtttcgatggaaactgatgcaaaggttgagccgtcaaaaaagaaagttaagaaaactactgttccggtccatgagttggtctatggggccttggctgcagctgacctgcagaaggctgtagagaaagagtatgagatggctcttcaagacagagtaatggaagaaacataggagaagaagaatgctgttgaagcttatgtgtatgacatgcgtaacaagctatatgacaagtacagtgattttgtcacacctgaagacaaggaaagtttgg

SEQ ID NO: 32414 - DNA, 447 bp, Zea mays
  Clone ID: LIB3059-009-Q1-K1-A3
tctatcagtaccatcaatcatcattcatcttagtagtataggcaccaaatcaagtctgcggcatcaattatctaactccaaaaaccatgaagctggtgcttgtggctcttgctttcattgctctagtatcaagtgtttcttgtacacagacaggcggctgcagctgtggtcaacaacaaagccatgagcatcaacatcatgcacaacaacatcatccacaaaaacaacaacatcaaccaccaccacatcatcaccagcagcagcaacaccaacaacaacaagttcacatgcaaccacaaaaacatcaccaacaacaagaagttcatgttcaacaacaacaacatcaaccgcaggaccaccaccaccaacaacaacaacagcaccaacaacaacttcaatgtgaaggccaacaacagcatcaccaacaatcacagggccatgtgcaac

SEQ ID NO: 32415 - DNA, 163 bp, Zea mays
  Clone ID: LIB3059-009-Q1-K1-A4
ctttctgcttcgacctctagcgaatacatctgggggctagggctccagtgcgcctgtacaaccggacacgaggctaggctgggcatggagggaatcgtgacgggccgaaagaagtccctgccagagacagctaacggggctgtcgacatcgggaagcgctcca

SEQ ID NO: 32416 - DNA, 426 bp, Zea mays
  unsure at all n locations
  Clone ID: LIB3059-009-Q1-K1-A6
gngaagtctaccatacttaatttaacttgccggtgatcttacccctactgaaggcgaggtaaggaggagccagaagctgaggattggacgatactcgcagcattttgttgacctactgacaatggaggaaaatgcagttcaatatttgttgaggcttcacccggaccaggagggaatgagcaaagcagaggctgtccgcgctaagctcgggaagtttgggttacctggacacaaccatctcacgccaatcgttaaactatccggcgggcagaaggcccgagttgtgttcacctctatatcaatgtctcagcctcacatactcctgctcgacgagccaacgaaccacttggacatgcaaagtatcgatgcattggcagacgcgctggatgagttcacaggaggtgtcgtcttggtcagccacgactc

SEQ ID NO: 32417 - DNA, 398 bp, Zea mays
  Clone ID: LIB3059-009-Q1-K1-A8
cccacgcgtccggcgacatcccgcccaggggcctgaagatggcggggaccttcgtggggaactccacctccatccaggagatgttccgcagggtgagcgagcagttcaccgccatgttcaggcgcaaggccttcctgcactggtacaccggcgaggggatggatgagatggagttcactgaggccgagagcaacatgaacgatctggtcgccgagtaccagcagtaccaggacgccaccgccgacgaggagtacgaggacgaagaggaagaggagaacgtggcagaatagccatgacctccggtgccctttttcagggccaccgcattcgacaggttgtgtctctgtgaatgagtttgtttgtttcttttctctgcttctcgtggcttgcgtcatgga

SEQ ID NO: 32418 - DNA, 339 bp, Zea mays
  unsure at all n locations
  Clone ID: LIB3059-009-Q1-K1-A9
ctcccgaccgccgccgtcgccgcctcctctccccagcacccggagctcgaccgaacgccgctcaccatgatcatccccaagaagaaccgcaatgagatctgcaagtacctcttcaaggagggcgtgctgtatgccaagaaggactacaacctggcgaagcacccgcagatcgatgtgcccaacctccaggtgatcaagctcatgcagagctttaagtccaaggagtatgttagggagaccttctcctggcagtactactactggtatctcaccaacgatggcattgagcacctacgcaactacctgaacctnccgtctgagatcgtgcctgccacgctc

SEQ ID NO: 32419 - DNA, 429 bp, Zea mays
  Clone ID: LIB3059-008-Q1-K1-H11
ccaggatctgagtcagtatcagaggtgggtgggccaaagaagagcatgctggttgtgtcagagtttattggctgctcgccgtcactgagtggtgctattagggtcaatccatggaatatagaggcaacagcagaggcgatgaatgaggccatttcaatgccagaacaggaaaaacagttgaggcatgagaaacattaccgttatgtcagcagccatgatgttgcttattggtcaaagagcttcatcctagacttggaaagggcttgtagggaccactttaagaggacatgttggggcatagggttgggttttggtttcagggtggtggccttggacgctcatttcagaaagcttaacatggattcaattgttaatgcttatgagatttcagggagcagggctatattgcttgattatgatggaacactg

SEQ ID NO: 32420 - DNA, 340 bp, Zea mays
  Clone ID: LIB3059-008-Q1-K1-F11
cggacgcgtggggacatcttacagcttctgccatccaagattcaggttggagtcttctctgctaccatgccacctgaagcccttgagattacccgcaagttcatggacaaaccagtgagaattcttgtgaagagagacgagctgacccttgagggtattaagcaggtctatgtgaatgtggacaaggaagactggaagctggacacactgagtgacctgtatgagaccctggccattatccagagtgtcatctatgtcaacacccgacgcaaggtggactggctcactgacatgatgaggagcatggaccacaccgtttctgtcactcatggtgtcatgg

SEQ ID NO: 32421 - DNA, 432 bp, Zea mays
  Clone ID: LIB3059-008-Q1-K1-F12
caacaagcaacatagaaagtggaatccagtagcaacaatagagcaacaatggcgaccaagatattttccctccttatgctccttgctctttctgcatgtgttgctaacgcgacaattttccctcaatgctcacaagctcctatagcttcccttcttcccccataccttccatcaatgatagcttcagtatgtgaaaacccagctcttcaaccctataggctccaacaagcaatcgcagcaagcaacatacctttatcacccttgtttcaacaatcgccagccctatctttggtgcagtcattggtacaaaccatcagggcacagcagctgcagcaactcgtgctacctgtgatcaaccaagtagctctggcaaacctttctccctactctcagcaacaacaatttcttccattcaaccaactgtctacattg

SEQ ID NO: 32422 - DNA, 327 bp, Zea mays
  Clone ID: LIB3059-008-Q1-K1-F6
gccacgcgagcgagcagaaacacaccaagcgaagcacatgagcaacaaccgaacaacaaaggctaccaagagaggaacccaccgagcgcaactggcgcaaagtgcgagcgcaacaaaggcggtcaagaggccacaatgcacacacgctacaagctccaggatcacacagcacctcccaccagggacttcaaggggctgcgaacacccaggagggcaagcctataggcgacaacaggcaagggcggcgagagagggacaacaaccaaaggcccagtagcaacaacaatccggggcacatctaacgaaacaaaccaggggagcgcaaca

SEQ ID NO: 32423 - DNA, 354 bp, Zea mays
  Clone ID: LIB3059-008-Q1-K1-G10
cccacgcgtccgcccacgcgtccgctcgcctcctctccctagtctccacgacgcaagggagagtgacggaaagcgacgcggcgcgagcgaggagggccaaggcgaagaggggaagcaccgcaccaggacccttgttcgccgccgccgcctctgatctccgcgaggttgtcaggattcaatatgtcgaccagcacattcgctacttcctgcacgctgttgggcaatgttagaacaacgcatgccttccagacagcggtgaagagcccttcgtctctaagcttcttcagccaagttacgaaggttccaagcctgaataccttcaagaaactggatgtctccgccatggctgtatac

SEQ ID NO: 32424 - DNA, 390 bp, Zea mays
  Clone ID: LIB3059-008-Q1-K1-G11
gtcactggacatctcctaaataatcctcagtcgttacttctgctagtccatgccatgcttatactggtgatcaagatgcctatgtctccaccaccgtcgctcagccgcttgcctctgtgttggctcgccggatctactatccgacgcgccactgtttgcgctgtgcttaaggtcctactcaccggtcttctcgtcgacagcgccagtcgtgtctcccgccacaccgacactttttctccatcgctcgactccgtgctcagcgctctcaccatcaccgcgtctctcctcgccggtgttcgccgggcatacgctcaacctcgccaccgtgggacttacctcgccttcaaaccgtgttcgccgcagcccagccatcgtctacctctacgctta

SEQ ID NO: 32425 - DNA, 290 bp, Zea mays
  Clone ID: LIB3059-008-Q1-K1-G12
accacgcgtccgcccacgcgtccggccacggggctcgcaatcaagcactccctcggccagtcccacccggtcaagctcgcgcctttcagcccggaccaggaggacgcgtcggtgctgtggacggagagcaaggacgtgggcaagggcttccgctgcatccgcatggtcaacaacacccgcctcaacttcgacgccttccacggcgacaaggaccacggcggcgtgcacgacggcaccgtcgtcttgctctggtagtggtgcaaggtcgagtaccatatctgtatgatcct

SEQ ID NO: 32426 - DNA, 238 bp, Zea mays
  Clone ID: LIB3059-008-Q1-K1-G2
caccatcagactgtcgatcctgccgggagaatccaggccaatgcctaattgacctcatctccctcaaaatctagaagaataaagtcgccgagtatgtgcacaagttagctcctcgtcaacatgtgcgcatttagaccgacagagtctctgtagtgaattcagctcgtgttagctcctggctaacgagctgaccatacggctttagttatgtgaagttggcgcgatttcgtcatgtcat

SEQ ID NO: 32427 - DNA, 312 bp, Zea mays
  Clone ID: LIB3059-008-Q1-K1-G4
gggaccacataggttggctttggagccggaccaggatgctttagcagagctgaaagatgtcggtttgcagttggccgtatccttcagtggagaaggttcaatacttgctattggtggtgaagatgggtatttaagagttttcaactggcctaccatggggtctgttctcacagaaatcgatactaaaacatcgattaaggatcttactatctgtttggacgagaagtttcttgctgagaataggagcagtggcccatgtagagtgggtggttagcagtcatctgaagttgtagccagtctgccaagagatac

SEQ ID NO: 32428 - DNA, 307 bp, Zea mays
  Clone ID: LIB3059-008-Q1-K1-G5
gacacactagcatgcagcctgcgagctacgggctactggtagcatctacaacgtctgcgatctaactaaatgtccgcactgaaccgcggtgccttatttgcagcagcaaatgctactaccacttagccagctagctacagcaagccgtgcttccttcgggacacaacatcaggtgctgacggtctaccagcagtatgcggctaacctcgcttccctattacaactacaacaattggtgccctttgtcaaaattgatgtgacagacccaggagccttctaccaacagcacattattggtggtgccctc

SEQ ID NO: 32429 - DNA, 398 bp, Zea mays
  Clone ID: LIB3059-008-Q1-K1-G6
ataaacacaccaagcgaagcacattatcaacaacctaacaacaatggctaccaagatattatccctccttgcgcttcttgcgctttttgcgagcgcaacaaatgcgttcattattccacaatgctcacttgctccaagttccattattacacagttcctcccaccagttacttcaatgggcttcgaacacccagctgtgcaagcctataggctacaacaagcaattgcggcgagcgtcttacaacaaccaatgtaccagttgcaacaacaatccttggcacatctaacaatacaaaccatcgcaacgcaacagcaacaacaattcctaccagcactgaaccacctagtcatggtgaaccctgccgactattgcaacagcagttgcttgcatcaaaccc

SEQ ID NO: 32430 - DNA, 248 bp, Zea mays
  unsure at all n locations
  Clone ID: LIB3059-008-Q1-K1-G7
caggaacagctgagaaggaggaacatggtggggtaagaacgagagtgcaaaccgagaagctgcacntgcacgaccaagcaacacatcgcagcatgactcatgaggacacctgagtaagatgacaaacgagcgtcactcggatagaaggcgacggaacacataagacaaacacgggacggatgcgtatcctaaaaaaccgattgtacgagcgaggcaggaaatgacagatgcgcagaatatgaggaaca

SEQ ID NO: 32431 - DNA, 437 bp, Zea mays
  Clone ID: LIB3059-008-Q1-K1-E9
gtaaaaccacatgacagtgaaggcaaaccagggccgcagcaagccgggcaagctcaggcatcaagcaacccagcacaagggggcggctatcctgcaccaccgccatactaccatggtcagtatccaccatactatccacccccaccaccatacggtggctacatgcctccaccgcgcatgccctacccaccgcaatatccgccttaccagccgatgctagctcaaccagcacaggtacaggctagttcatctcggcaaccaccgcatgcaggtggagggcagcagcagccgcctgatggccctccagctcagcagcagccacagcagccaattcagaactgaagtcctgtcaagatgttgggtattggtactgctctaactgctcggcaggagaatgcaacccccgtgggtcaccagctttcgtaatttcttaattt

SEQ ID NO: 32432 - DNA, 429 bp, Zea mays
  Clone ID: LIB3059-008-Q1-K1-H10
cccacgcgtccggttcggcattggtggaatatgtaactcctgtgttgatcctgcaaatgctttaatcattactcagtgtggtggaatcccattggttatacaatgcttatcgagcccagtgcggaatactgtgacttatgcgcttggggctttgtattacctttgtaacccttcgacaaagaaggagatcctgaaaccagatgtagttagtactataagagagtatgcttcagctggaactgtgaataacaactttagcaatctggctaatgctttcttggagaaacatgttgatccatgatatgacaattttacagggtagactaaagcttacacatttcgtgtacctgtggtgttttcatattctggatatgaactaaagaaactagagcttagatctcatgctttcattgttttgggcacgatgct

SEQ ID NO: 32433 - DNA, 428 bp, Zea mays
  Clone ID: LIB3059-008-Q1-K1-C12
gtggatctcaagaacaatacacccttttgattttagatcctggtcatagaactgcagatctagaaaggtccctaagaagcaaaaatggatggcagcgtctggtgaagagaggtgtccacacgctcaggaagccacagtatcagttatgttatgtggatcctggaattgctagttcagaagagatggagcaactgaagactattgatagtatgcttgtcaggttttaggttcctgaaaacaggatgaggattatatgtgttttgcacacagggcacttccctggttgaagaaacatgaacatctaatccattgtcgaacggtgcgctgtacgaatgactcatcatggatgggcctgcagaaagatctttgacgcttgtctaactgaatctgttttcatactggatttactgttttttttaggtcctttt

SEQ ID NO: 32434 - DNA, 306 bp, Zea mays
  unsure at all n locations
  Clone ID: LIB3059-008-Q1-K1-C7
ggcacaacaactacaacaacttgtgctatgaaaccatgctgcctactctcagcaacagcagtttcttacattcaaccaactggctgcattgaactctgctgcttattnagggcaacaactaccattcagtcagctagcgagtgcctaccctcagcaagttcatacattcaaccaactggcagcattgaactctgctgcttatttacaactgcaacagctaccaccattcatccagctagctgatgtgagccaaagtgcctaaatgacgcaacaacagatgttgacgttctacctgcacgctgcgcc

SEQ ID NO: 32435 - DNA, 446 bp, Zea mays
  Clone ID: LIB3059-008-Q1-K1-C9
gccgcggtccgtccggattcccggtcgcccacgcgtcgggaccgtgggtgaaactatagctggattacatggagaggcggcaatgagaccgtctggccccgccggagggagacggagacggagacgagacggatggcgcatgcatcggtgtggtggatcggcgcggcatgtgtgtgtgggctgtacatatacatctgtacatgattgtgcagtgcagggttttgtccttttttgatttgtattatctaaatgactattttttttatggcttgattgtctttttgttctgtttttgttggtttttatatatttttcttttttttttattttcttattctttatttttttttctgttttatttttgtgtatatttttataattatattttttgttattttttttcttttttttttttttattttttatttttttttattttttttttt

SEQ ID NO: 32436 - DNA, 280 bp, Zea mays
  Clone ID: LIB3059-008-Q1-K1-D11
atctaatgccaataagtcatagaacgaggaccgttaaactgatgtgaagattgattggcccgaaaatgccatttaaaaagccaaaatgctcagatggaaggcgcagttcatctatgtcgatatggaaaacgtgagtactagttacgctacaggtatctaggatgtcactgaagcttatgcggcagctatgcgaagtgctttcgtcgacaagcaggactacctgctaaatcagaagtctttacaggagaaggtcaagtgcatatacatacagctcaacttc

SEQ ID NO: 32437 - DNA, 178 bp, Zea mays
  unsure at all n locations
  Clone ID: LIB3059-008-Q1-K1-D12
gcgcgctccagtgccgaagtcatcaccctcaccgaagagaccttctccgacaagataaaggagaaggacacggtgtggtttgtgcaattctgcgtcccctggtgtaaacactgcaagaaccttggaacacttatgggaggactctgggaaagtngttatgtgaaaggttgccggatga

SEQ ID NO: 32438 - DNA, 448 bp, Zea mays
  unsure at all n locations
  Clone ID: LIB3059-008-Q1-K1-D9
agggaatgcaagcatatcctcagcctacatatcagcaacctgtatattcccaacctgcatattcccacccccaacctgtgaaagcttcaaacccttttgatcttgggaatgggccagctccaactcaagctcacatgcccccatctggaccaccaggagtattagcaggcccagctccccaaaccttaattagcaactctagttttggtgttccttcacagcagcctcaccagctctatcaatcagccgcacatccaagccatttcataatgcagcaagttccgaacagcatgcccatgcccgagcaacaacctaatagcatgcttgtaacgcaacaaggtttgtgatacctncagccaaacacctcaccttcatacggctccgttgggggtagtaatccattcgggtaaaagaagtgtgggaatacctgctctttcatctttagact

SEQ ID NO: 32439 - DNA, 297 bp, Zea mays
  Clone ID: LIB3059-008-Q1-K1-E10
acgggccgggctttgcacgattgactctgagggcaaggcaaggaaggttgtaggctgctcctgtgtcgtcgtcaaggactacggtgaataatctgagggccttaacataatgcaggagtatgtcaagtagcactagatgtgtgacatgtaccagtgatactcttgatttggacctgggcttaacattatgcttcagcatctggggctcgaataggcgattagaacatgctactagaatagccgaaccggatatgtatgaacaatgtgaacattagaacagcttttgcttatggtgct

SEQ ID NO: 32440 - DNA, 435 bp, Zea mays
  Clone ID: LIB3059-008-Q1-K1-E11
aatggttcaggatttctttgaggatgttggaccactggttagcttacagctaggtggttccgcgatggatgggcttctgaaaatattcaactcgtatgtaaacttgctcataatggaaactggttgttgtaagtccgcggcaactggccgaatgtaattgaggagcatcatctaagtactcggggaactctcaggtaaacgacatcctggacattggctgctctgttggagtaagcaccagatacctcaccgagaagttcccatcagctcaagctgctgggctcgacctatcaccgtactttcttgttgtggcggcacaaaaggaagaaaaactgtcacggccaaagcctattcgctaggttcatgccaatggtgaagcgaccgagctgtcttcagatttatttaaccttgtcttccttgcttatgtggtctata

SEQ ID NO: 32441 - DNA, 217 bp, Zea mays
  Clone ID: LIB3059-008-Q1-K1-E4
tcgacccagcgttcgtcccgcgtacgtcagtcagcgagggagtgggtggtcgaccacaagcttcgggccgtcaggacgctgtggctcagcggcatcgtcggctccatcgcctacaactggtccaggccgggcatgaagaccagcggcaagatcatccacgccaggctgcatgctcaggctcatacgctggctgccttggctgggtccgcgctggtgg

SEQ ID NO: 32442 - DNA, 304 bp, Zea mays
  Clone ID: LIB3059-008-Q1-K1-E6
cttccagggatgcctgacctgagtagcaaatgtattagcacgactgagaagctgcctgcctgtgataggcgatggcgatggcaatggtgtgtagacagcagctgggtctctagtattgacggcatgtaatcgtgttagaatgaaggatgcaagggtgcgatggagtggaggtcaatcggcgtgtgatgccacgtcactagcttagctgtagatggtttggtggacttttgaggaacagataatgagattgttgcacgggacgcttaaattttactagaacgccgtccgattaaaacaatatcca

SEQ ID NO: 32443 - DNA, 449 bp, Zea mays
  Clone ID: LIB3059-008-Q1-K1-C11
caacaatttctaccagcactgagccaactagctgtggtgaaccctgtcgcctacttgcaacagcagttgcttgcatccaacccacttgctctggcaaacatagttgcataccaacaacaacaacaattgcaacagtttctaccagcgctcagtcaactagccatggtgaaccctgccgcctacctacaacagcaacaactgatttcatctagccctctcgctgtggttaatgcacctacatacctgcaacaacagttgctgcaacagattgtaccagctctgactcagctagctgtggcaaaccctgctgcctacttgcaacagctgctttcattcaaccaactgactgtgtcgaactctgctgcgtacctacaacagcgacaacagttacttaatccactagcggtggctaaaccaatggtcgctgcctttctacagtagtaacaatt

SEQ ID NO: 32444 - DNA, 425 bp, Zea mays
  Clone ID: LIB3059-008-Q1-K1-E8
atgatttgattgttccaacatcctgccaatagcccgtaaaaatgcatgcctgcacacttggccctcactgagcagccttccaagtttgatttttacgatccaaaaacacctttcttcactgcaccccgatgcttgccttcgacgcaattggacaagtgcaagatgaaatatgcatttatctcagatggttgcttactgagagaatgcaacatcgagcattctgtgattggagtcggctcacgtgtcagctttggatgtgaactcaaggactccgtgatgatgggagcggacacctatgaaactgaagaagaagcttcatagctactgttagctgggaaggtcccaggtggaataggaaggaacacaaagataatgaactgtatcattgacatgaatgctaggattgtgaagaacgtggtgatcac

SEQ ID NO: 32445 - DNA, 434 bp, Zea mays
  Clone ID: LIB3059-007-Q1-K1-H9
cccacgcgtccgcttcaacagtggtataaataagatatttgtgatgagtcagttcaattctacttcgcttaaccgccatattcatcgtacataccttgaaggcgggatcaactttgctgatggatctgtacaggtattagcggctacacaaatgcctgaagagccagctggatggttccagggtacagcagactctatcagaaaatttatctgggtactcgaggattattacagtcacaaatccattgacaacattgtaatcttgagtggcgatcagctttatcggatgaattacatggaacttgtgcagaaacatgtcgaggacgatgctgatatcactatatcatgtgctcctgttgatgagagccgagcttctaaaaatgggctagtgaagattgatcatactggacgtgtacttcaatttctttgaaaaa

SEQ ID NO: 32446 - DNA, 452 bp, Zea mays
  unsure at all n locations
  Clone ID: LIB3059-008-Q1-K1-A10
gaccaactagcaacatagaaagcacaatagtgtaccaacaatggcagccaaaatattttgcttccttatgctccttggtctttctgcaagtgttgctaccgcaaccattttcccacaatgctcacaagctcctatagcttcccttcttcccccatacctctcaccagcggtgtcttcaatgtgtgaaaacccaattgttcaaccctacaggatccaacaggcaatcgcaacaggcatcttaccattatcacccttgttcctccaacaaccgtcagccctattacagcagttacctntggtccattttgtggcacaaaacatcagggcacaacaactacaacaacttgtgctagcaaaccttgctgcatactctcagcaacatcaggttcttccattcaaccaactggcttcattgaactctgctgcttatttgcaaccactattaccattta

SEQ ID NO: 32447 - DNA, 212 bp, Zea mays
  Clone ID: LIB3059-008-Q1-K1-A12
aaagaagtagatcatgcacccactagtgatcacttcgtctagtgtcccctgtcgtcgtcgtcgtcgtgtacctcgtacgtgacatgccgtagcacgtacgctagcagagcagcacctcaatgtccttgggtttgctttgctggctctctgttttcgtctctcgtgttgcttttaatctggcacaggtttctaaaaaaaaaatttgattctat

SEQ ID NO: 32448 - DNA, 340 bp, Zea mays
  Clone ID: LIB3059-008-Q1-K1-A8
gagaatgcaacatcgagcattctgtgattggagtctgctcacgtgtcagctctggatgtgaactcaaggactccgtgatgatgggagcggacacctatgaaactgaagaagaagcttcaaagctactgttagctgggaaggtcccagttggaataggaaggaacacatagataaggaactgtatcattgacatgaatgctaggattggggagaacgtggtgatcacaaacagtatgggcatccaagaggctgatcacccggaagaagggtactacataaggtctggaatcgtggtgatcttgaagaatgctccatatacgatgggattgtcatatagatc

SEQ ID NO: 32449 - DNA, 411 bp, Zea mays
  Clone ID: LIB3059-008-Q1-K1-A9
gttgcaatcatagtgtcattactatcgatggaaatactgatattgagttgttctggaatgctaaagatttactcagagtcagtcgtgttgacacaaatgagaacaatggtgttcttagtcgagttgtttaccgggttgaagcgctaaaaaggctatcgttctctgacaaggttactatcgttcttcctgccactggtcaaactgaagaagttgaagtcagctacgatacatgagaggaggcagagtcaccatcatcatggggcctaaccacaactgctgttatgctcacatgcatcattgtgacaatagtcactgttgcacttttcattaagttgctgctgagacctatcagacatgcactatcagggagcatgacagcattcataccatctcgagcactaataatttgat

SEQ ID NO: 32450 - DNA, 452 bp, Zea mays
  Clone ID: LIB3059-008-Q1-K1-B11
gccgtggtgaaccctgtcacctacttgcaacagcagctgcttgcatccaacccacttgctctggcgaacgtagctgcataccagcaacaacaacagctgcaacagtttatgccagtgctcagtcaactagccatggtgaaccctgccgtctacctacaactactttcatctagcccgctcgcggtgggcaatgcacctacgtacctacaacaacagttgctgcaacaaattgtaccagctctgactcagctagctgtggcaaaccctgctgcctacttacaacagttgcttccattcaaccaactggctgtgtcaaactctgctgcgtacctacaacagcgacaacagttacttaatccattggcagtggctaacccattggtcgctaccttcctgcagcagcaacaacaattgctgccatacaaccagttctctttgatgaaccctgcctt

SEQ ID NO: 32451 - DNA, 370 bp, Zea mays
  Clone ID: LIB3059-008-Q1-K1-B12
cccacgcgtccgcccacgcgtccgcggacgcgtggggtggtgtgtggaggatgaagtatcatcctagtattgcagatgttgtattggctgcgtgcatgcacaatgggtttgccattgtaaaagtaggttctggagatgctaccgtaatggaaacatattgcaagcatgagtccttagcatacggtgcagattggcagaaaagtgaagaggtggagcaaaatggaaattcttcagttgttgctacttgtgcgttttatgatcgccttctccgtgtgtggcaaccagagaatctagctgagctttaaagacctaaagctttttttgaattgaattcaagcatgactaggtcttgaatcttattccttgaatg

SEQ ID NO: 32452 - DNA, 62 bp, Zea mays
  Clone ID: LIB3059-008-Q1-K1-B5
gcggcggccaagcgatcactgctaccgataagaccggagatggacgcacagcgaaggacagg

SEQ ID NO: 32453 - DNA, 303 bp, Zea mays
  Clone ID: LIB3059-008-Q1-K1-B7
cccacgcgtccgtggcaactataagccacgcactgatctgccaaatgtggtggagctgtacatgaaaaaggagctggaggtggagaagttcatcacgcacagcgtccctgtcgactagatcaacaaggcgttcgacctgatggccaagggggagggcatccgctgcatcatccgcatggagaactagatttcgctgtctagtttgagatgtggcctgggcttggggttaataaatgaggcaatgctagcctgtattttcgatggggaggtacatacacgctggcaatggaccgggcttgtgtg

SEQ ID NO: 32454 - DNA, 205 bp, Zea mays
  Clone ID: LIB3059-008-Q1-K1-B8
gaaaaactagaacgagagcgccaggacaaagaaaggaagaaaaagagaacaaacatagaggagaactgagagaataggacgaagacaagacaaaggagcagaaaagccagagaggaaacagaaacccaaggggaagggggacacgacataactgaacgacggtaaaggagaaaactagcaagcgaggtagctagacagacggctc

SEQ ID NO: 32455 - DNA, 381 bp, Zea mays
  Clone ID: LIB3059-008-Q1-K1-B9
caggattcaggataaccttgcgctggtatacctgtcaagcatgacacggacacagatcagcatcgccgagaagttgaacactgctgctcaagtgctgtaggtttggcggtgtggcatctggtttggacgtggatggctagatgctatctgggatgcttggcatcagtgtgattggtgacagaattgcatacatgaactcatcattatgattgctcattgagagacctgatggaaagggttagccaacgacgagatcccataatgtagccagaatgccagtggagtgaaggatggcatgatgtctttgtgtggattgttttatgtgttttggttgaatatttttttgttttattatctattttttgagtttttaattttttt

SEQ ID NO: 32456 - DNA, 351 bp, Zea mays
  Clone ID: LIB3059-008-Q1-K1-C10
gagacacatagacatggtgacaaatgcagtgttactcagaacatgattagtttagctacacacaaatggctgtggccaacgatagctggatacattgatcaacagcaggtgcagcagattatgccagagcttactgaagtagcaatggcgtaccgtgtcgagtacctacacctactatcatttagcgcgctcgaggtgggcaatgcacctacgtacgtacaacaacaggtgctgcaacaaattgtaccagctgtgactcatctagctgtggcaaaccctgctgcctacttacaacagttgctgtcattcaaccaactggctgtgtcaaactctgctgcgtacctacaacag

SEQ ID NO: 32457 - DNA, 387 bp, Zea mays
  Clone ID: LIB3059-007-Q1-K1-F9
cccacgcgtacgcccacgcgtccgcaactagcaacatacatagtgaagtacactagcaacatcttagcaccaatgggagccaagatttttgccctccttgccctccttgctctttcagcaagcgctgctacctcgacttttattccacaatgctcacaacaatacctctctccggtgacagccgcgggatttcaatacccaactatacaatcctacatggtacaagaggccatccaagcaagcatcttacggtcattagcattaacccttcaacaaccatatgctctattgcaacagccatccttagtgcatctgtatctccaaagaatcgcggcacaacaactacaacaacagttgctaccaacaatcaatcaagtagttgcagcg

SEQ ID NO: 32458 - DNA, 291 bp, Zea mays
  Clone ID: LIB3059-007-Q1-K1-G1
cggacattgaagattacaagtgctcatggctagttgtgcaagcccttgagcgtgctgatgagagccaaaagcgcatgctatttgaaaattatggcaagaaagatccagcctgtgtggcaaaagtgaagaacctctacaaagaacttgacctagaggcggtatttcaggatttcgagactgagagctacaagaagctgattgcagacatggaagcccagccaagcattgacgttcataaagcgctgaaattctttttgcacatgaattactagaggcagtattagggtactc

SEQ ID NO: 32459 - DNA, 196 bp, Zea mays
  Clone ID: LIB3059-007-Q1-K1-G10
cagacacgtaggtacacacttgaacttataagtcaacagtgtagcatcacaggtgagcgcgatattgttatgctttatgctccttgcgcatgttgtatgtgtctgctaaatcgtcaattatagctcaatgctcacatgcttctattgctttccttcttaccctatacttttcatcaatgatagctttagtatgtga

SEQ ID NO: 32460 - DNA, 56 bp, Zea mays
  Clone ID: LIB3059-007-Q1-K1-G12
aacgactccagggttcatatgtagattttgcaccactggttagcttacaggtagga

SEQ ID NO: 32461 - DNA, 434 bp, Zea mays
  Clone ID: LIB3059-007-Q1-K1-G2
cggacgcgtgggggcggcgcgggcggacaaggagcaggcggaggaggagctgtgccaagccacaatgggtatctcgcgtgactcgatgcacaagcgccgggccaccggtggaaagcagaaggcctggaggaagaagcgaaagtatgagcttggtcgccagccagccaacaccaagttgtcaagcaataagacagtgaggagggtccgtgttcgtggaggtaatgtgaaatggagggctcttcgccttgatactggtaactactcatggggaagtgaagctgttacccgcaagacccgtatcctcgacgtggtctacaatgcatcaaacaatgagcttgtgaggacacaaacccttgtgaagagtgccattgtgcaagttgatgctggctcattcaagcagtggttccttactcactatggagttgacattggta

SEQ ID NO: 32462 - DNA, 410 bp, Zea mays
  Clone ID: LIB3059-007-Q1-K1-G5
cccacgcgtccggaacgagcagttctgggtcatcggaggcgtttcggcgcatctgttcgcggtgttccagggcctgctgaaggtgttcgccggcatcgacacgagcttcaccgtgacgtctaaggccggggacgacgaggagttctcggagctgtacacgttcaagtggaccaccctgctgatacccccgaccacgctcctcctgctgaacttcatcggggtggtggccgggatctcgaacgcgatcaacaacgggtacgagtcgtggggccctctgttcgggaagctcttcttcgcgttctgggtgatcgtccacctgtacccgttcctcaagggtctggtggggaggcagaacaggacgccgaccatcgtcatcggctggtccatcctgctggcctcgatcttctcgc

SEQ ID NO: 32463 - DNA, 294 bp, Zea mays
  Clone ID: LIB3059-007-Q1-K1-G6
acgccaccgtcgtcgtcaccaaggtcggagtgtggggtggagagggagggtcgacgcacgacatcgcgacgactgagccgtcgaggcgtctgcaaagactgaccgttcgcgccggctttaacgcagactgcatggagtacaactacagtgcctacacatgttgtcaaacccgcaaagatcaacttatcaagcagacttaccggcaacaggctgaagcttcatctaggcaacgctaaatgcatggcggtagttcttggtactgacagctacttatgaggtactgatactcttacc

SEQ ID NO: 32464 - DNA, 324 bp, Zea mays
  Clone ID: LIB3059-007-Q1-K1-G7
cccacgcgtccgcccacgcgtccgcccacgcgttcgctcaaggtctggtgatacgagcgagttgtcttcttcccccccggagaaaagtgcttccgagaataaatttttttccatcggaatgtctgaaactatgttgggtgtatcctagtggttggttgagcattaatggctcatattttgtcaggtctatgtgttgccgtgaaacttttaatcaaatcagttcactctatataataatatatattatttttatctattgttttttttttatttctttttttttttgttatttttcttttttatttatatttttttatttttttt

SEQ ID NO: 32465 - DNA, 97 bp, Zea mays
  Clone ID: LIB3059-007-Q1-K1-G8
cccacgcgttcgctgaggtggagtcgtctgactaccaccgtcagcgcctggcggaggggctggcgcgcccatgtgctcgcgctggttcatgctcatt

SEQ ID NO: 32466 - DNA, 403 bp, Zea mays
  Clone ID: LIB3059-007-Q1-K1-G9
gccaactagctgtggtgaaccctgtcgcctacttgcaacagcagttgcttgcatccaacccacttgctctggcaaacatagttgcataccaacaacaacaacaattgcaacagtttctaccagcgctcagtcaactagccatggtgaaccctgccgcctacctacaacagcaacaactgatttcatctagccctatcgctgtggttaatgcacctacatacctgcaacaacagttgctgcaacagattgtaccagctctgactcagctagctgtggcaaaccctgctgcctacttgcaacagctgcttccattcaaccaactgactgtgtcgaactctgctgcgtacctacaacagcgacaacagttacttaatccactagcggtggctaacccattggtcgc

SEQ ID NO: 32467 - DNA, 198 bp, Zea mays
  Clone ID: LIB3059-007-Q1-K1-H1
cccacgcgtccgacttggaggaagctggtctagatcctgttgccttagatctgacatgctctggcatagaccatactgatgcacacagcctagctacttatgctgattacttctcgcctttgattgattaccttgacagacttccagatgttgatatggtctttttatttgtccttttttttttatgttttcgtgttt

SEQ ID NO: 32468 - DNA, 422 bp, Zea mays
  Clone ID: LIB3059-007-Q1-K1-H10
cgctagctcgctcgctctccttgcaactccagtgctgctcactgccactgccagcagatcgagctgctccgtctcacaaaccctcttgctttgctgctgcacctgcaagtctgcaaccgcgcacacagagatgtcgacgacggtgagccgtgcgtccctcgaccagaagctcgccctcgccaagcgttgctcccgagaggcgaccctcgccggagccaaggcggcagcggtggcgactatcgcctccgcgatccccaccctggccagcgtgcggatgctgccatgggccaaggccaacatcaaccccaccggccaggcgctcatcgtctccacggtggctgggatggcctacttcatcgccgccgacaagaagatcctgtcgctggcaaggcgccactcgttcgagcaagcccctgagcacc

SEQ ID NO: 32469 - DNA, 408 bp, Zea mays
  Clone ID: LIB3059-007-Q1-K1-H11
cggacgcgtgggaccagccacaagttccccgtcctcaacctcgtacagatgagcgcggtgcgggtagacctgtaccaggacgccatcatgtcgccgttctggaacttcaacgcccacagcgccatgtacggcatcaggggcagtgcaagggtccaggtcgccagcgacaacgggaccacggtgttcgacgacgtgctccgtgcggggcagctgctcatcgtaccccagggctacctcgtcgccaccaaggcgcagggagaaggcttccagtacatcgccttcgagacgaaccctgacaccatggtcagccacgttgccgggaagaactccgtcctgagcgacttgccggccgtcgtcatcgccagctcgtatgccatcttcatggaggaagctgcaaagcttaagaac

SEQ ID NO: 32470 - DNA, 204 bp, Zea mays
  unsure at all n locations
  Clone ID: LIB3059-007-Q1-K1-H2
gcagcaaggggcagcccacttgccgagaacatnttcaaagggatcgacgcccggtcctgagcgaagccctgggcgtagcatgcacgtcgcgagaagctgcagagccggctgaccagcgaggcgagatcgtccgcgtggagccggagcacggctttcaccagctgaatccgcgccgcgtcgtcgtcgtttcgttcccatcgtcac

SEQ ID NO: 32471 - DNA, 447 bp, Zea mays
  Clone ID: LIB3059-007-Q1-K1-H4
cggacgcgtgggcggacgcgtgggttcagaaacacaccaagcgaagcgcactagcaacgacctaacaacaatggctaccaagatattagccctccttgcgcttcttgccctttttgtgagcgcaacaaatgcgttcattattccacaatgctcacttgctcctagtgccattattccacagttcctcccaccagttacttcaatgggcttcgaacacctagctgtgcaagccaacatgcaacaacaagcgcttgcggcgagcgtcttacaacaaccaattgcccaattgcaacaacaatccttgccacatctaacaatacaagccatcacaacgcaacagcaacaacagttcctaccagcactgagccacctagccatggtgaaccctgccgtctacttgcaagagcagctgcttgcatccaacccacttgctctggcgaacgtagt

SEQ ID NO: 32472 - DNA, 363 bp, Zea mays
  Clone ID: LIB3059-007-Q1-K1-F8
ctgccccttcattacagatggatatgattagtatctacgacacttcagcactagagctctatgatttgttggatgttgtacccactgtatgtacttagtcctgaaacagtggccaatctatattatactctgttctttcttttttatttgtcgcggtctagtttaaaaatgaactagcgggcgacaaatattcaagaacggaggtagtatatgaggtagtatatgacttagacgtaactttagtgcaccgaatgtagtcaacctttgtttgctttggagaatgaggatttgttgttctagtatcagtctctttgatgttcctaatgggctagttggaagatattttgaggattttgaaaggca

SEQ ID NO: 32473 - DNA, 148 bp, Zea mays
  Clone ID: LIB3059-007-Q1-K1-H5
cccacgcgtccgcagtcacgtctcccagatctaactgccccccgactcacgaatcccaaagcctgcatggcgacgcaccgccactgcctcccactcctcctcctcgtggccgtcgccctcgccgccgtccctgctcgcgcggctctgg

SEQ ID NO: 32474 - DNA, 271 bp, Zea mays
  Clone ID: LIB3059-007-Q1-K1-H6
cccacgcgtccgggggatttcgatgaataggaaatgtatgtgaagattccagctgatctcataataagttctgagaaggccaagtcaattgtacaggatattgcaaaggttaggttggagaactcccttgtccaggctattgcgttgcttcggcagaagaagagagatgatgtgctttcatctctgaatgacatgctcgcatgtgatgctgcggtccctgcatcacgacccttgtcatggcccacaccaggagagctagatgatctatttg

SEQ ID NO: 32475 - DNA, 397 bp, Zea mays
  Clone ID: LIB3059-007-Q1-K1-H7
cggacgcgtgggtgaaattgctcaagcttatgaaaagaatggagctgcatgtttgagcattttgacagatgagaagtactttcagggaagctttgataatcttgaaaaggtgcgcagctcaggagtgaagtgccctcttctctgcaaggagtttgtcattgacaagtggcaaatctataatgctcgctctaagggtgctgatgcaattttactaattgctgctgtgctaccagatcttgacatatggaaatttcttcagatttgcgaagagttgggaatgacagctcttattgaggttcatgatgtaagagagattgaacgtgtgctgaaaattaatggagttaagcttattggtataataaccgaagccttgagactattgttgttgatactttta

SEQ ID NO: 32476 - DNA, 423 bp, Zea mays
  Clone ID: LIB3059-007-Q1-K1-E12
cttgctccatacctctcaccagcggtgtcttcaatgtgtgaaaacccaattgttcaacgcctacaggatccaacaggcaatcgcaacaggcattttaccattatcacccttgttcctccaacaaccgtcagccctattacagcagttacctttggtccatttggtggcacaaaacatcaggtcacaacaactacaacaacttgtgctagcaaaccttgctgcatactctcagcaacatcagtttcttccattcaaccaactggctgcattgaactctgctgcttatttgcaacaacaattaccattcagccagctagttgctgcctacccacagcaatttcttccattcaaccaactagcagcattgaactctgctgcttatttacagcagcatcatcttctaccatttattcaggttgctga

SEQ ID NO: 32477 - DNA, 166 bp, Zea mays
  Clone ID: LIB3059-007-Q1-K1-E3
cggcgcgtaggcagacgcgtctacggtacgcatgggttttagcatgtgagcggatcatgtagaggtatctacgaccatcaacatgtgcattacaggtgctacctgtggtgtatttatatgcacataccattacgggacaaccgctatactaacatgcgcctgtaaa

SEQ ID NO: 32478 - DNA, 273 bp, Zea mays
  Clone ID: LIB3059-007-Q1-K1-E4
aacacacgtagcaacagaagatgcacggcgagatgcggaacgactagctttaatgacacatcctacggctgatcctgctaagaaacgcgatgaggagaaagctgccaaggagcaaacgcagtcgtaagcacggaattatctgcaatatcaccgacgatgcgtccactaaagcatgatcagagttagttgtatatcaatagctaatgcatcatatatcttgttataaacctggatcctaatctgtattgccatgacatatgcattgacagtatt

SEQ ID NO: 32479 - DNA, 388 bp, Zea mays
  Clone ID: LIB3059-007-Q1-K1-E5
aaacccaattcttcaaccctataggatccaacaggcaatcgcagctggcatcttacctttatcacccttgttcctccaacaatcatcagccctattacagcagttacctttggtgcatttattggcacaaaacatcagggcacaacaactacaacaacttgtgctagcaaaccttgctgcctactctcagcaacagcagtttcttccattcaaccaactagctgcattgaactctgctgcttatttgcaacaacaactaccattcagccagctagctgctgcctactcccaacaatttcttccattcaaccaactggcattattgaactcttctgcttatttacagcatcaacaactacttccattcagccagctagctggtgtgagc

SEQ ID NO: 32480 - DNA, 444 bp, Zea mays
  Clone ID: LIB3059-007-Q1-K1-E7
cccacgcgtccgcccacgcgtccgcggacgcgtgggcaactagcaacatagaaagcacaatagtgtaccaacaatggtagccaaaatattttgcctccttatgctccttggtctttctgcaagtgctgctacgacgaccattttcccgcaatgctcacaagctcctatagcttctcttcttcccccatacctctcaccagcgttgtcttcagtatgtgaaaacccaattcttcaaccctacaggatccaacaggcaatcacagcaggcatcttacctttatcacccttgttccttcaacaatcatcagccctattacatcaattacctttggtgcatttattggcacaaaacatcaaggcacaacaactacaacaactcgtgctagcaaaccttgctgcctacgctcagcaacagcagttacctttggtgcaattgttggcaca

SEQ ID NO: 32481 - DNA, 246 bp, Zea mays
  Clone ID: LIB3059-007-Q1-K1-E9
gtaaaaccacatgacagtgaaggcaaaccagggccgcagcaagccgggcaagctcaggcatcaagcaacccagcacaagggggcggctatcctgcaccaccgccatactaccatggtcagtatccaccatactatccaccctcaccaccatacggaggctacatgcctacaccgtgcatgctctacctaccgcaatatccgacttaccagccgatgctagctcaaccagcacaggtacaggctagt

SEQ ID NO: 32482 - DNA, 323 bp, Zea mays
  Clone ID: LIB3059-007-Q1-K1-F1
atcgagagctacggcgagcgcgagcaccgcagggccaaggtgcacctgaggtgcgcgcacgggcagtccatctccgcgatcagattcgcgagcttcgggacgcctgtgggcacctgcggcaacttccagcagggaggctgccactcggctagctctcacgctgtgctagagaagagatgcattgggctccagagatgcgtcgtcgccatcttccccgacaacttcggaggagacccctgcccgagcgtgacgaagagggtggcggttgaggctgtgtgcttttctgctgtttaagtttattctgtttttacgtcttattattt

SEQ ID NO: 32483 - DNA, 422 bp, Zea mays
  Clone ID: LIB3059-007-Q1-K1-F10
ggtgagaggtatgggggaagaagggaagctataggagcttgtgagcattgtgggaaaacccaattgttcaaccctacaggatccaacaggcaatcgcaacaggcatcttaccattatcacccttgttcctccaacaaccgtcagccctattacaagagttacctttggtccatttggtggcacaaaacatcagggcacaacaactacaacaacttgtgctagcaaaccttgctgcatactctcagcaacatcagtttcttccattcaaccaactggctgcattgaactctgctgcttatttgcaacaacaactaccattcagccagctagctgctgcctacccccagcaatttcttccatttaaccaactagcatcattgaactctgctgcttatttacagcagcaacaactactaccattc

SEQ ID NO: 32484 - DNA, 382 bp, Zea mays
  Clone ID: LIB3059-007-Q1-K1-F11
ctagcaacatagaaagcacaatagtgtaccaacaatggcagccaaaatattttgcctccttatgctccttggtctttctgcaagtgctgctaccgcgaccattttcccgcaatgctcacaagctcctatagcttcccttcttcccccgtacctctcaccagcggtgtcttcggtatgtgaaaacccaattcttcaaccctataggatccaacaggcaatcgcagctggcatcttacctttatcacccttgttccttcaacaatcatcagccctattacagcagttacctttggtgcatttattggcacaaaacatcaaggcacaacaactacaacaacttgtcctagcaaaccttgctgcctactcttacaacagcagtttc

SEQ ID NO: 32485 - DNA, 383 bp, Zea mays
  Clone ID: LIB3059-007-Q1-K1-F12
ttgccattgctctcctggcgctcgctgcgagcgccgacttcagtacaagcggcggctgtggctgccagacaccaccgtttcatctaccgccttcgttctatatgccgcctccgttctatctgccgccgcagcagcagccgcagccatggcaataccccactcaaccaccgcagctaagcccgtgccagcagttcggatcctgcggcgtcagcagcgtcggcagccccgttccggtgccagtgcgtctagttcctggagcaccagtgcagcccggcggcgactccctacggctcgccacaatgccaggcgctgcagcaacagtgctgccaccagatcaagcaggtggagccattgcaccggttccaggccacatacggtgtggt

SEQ ID NO: 32486 - DNA, 384 bp, Zea mays
  Clone ID: LIB3059-007-Q1-K1-F4
cggacgcgtgggggctaccgccgccgttttacgccaggtgccgaggcctctctgtctgttcgccggcgacgatccaatagccagcagcagcaggaggacactatgaagcttgacgtgaatgcccttcgctacctcgccaaggacgacttccgcgtcctcaccgccgtcgagatgggcatgcgcaaccacgagattgttccagcagaacttgtctacaggatcgccagactgaagcatggaggcacatacaaagtgctgaggaatcttttgaagaacaagctagtgcatcatgatgccactaaatacgatgggtatagactctcctatctagtttatgacttttcttgccattaatattttggttatatttttttgtttttgctt

SEQ ID NO: 32487 - DNA, 471 bp, Zea mays
  Clone ID: LIB3059-007-Q1-K1-F5
cggacgcgtgggttattattgaattacatgtaattagcaatctaaaagaggtcaccatgaacgatatgtcagtggaaggaggctactgagtttgtaacatcatgacgtacaatagggctacaattgaattagcattatgaaggtttcttcttttcgatcatttatctggtgttactgaataatttctttatatatctaaatttgttttttcttttttttttttttcttattttttatgagacttttttcttttttgtttatatattatttttttttttattttttttttatttttttttatttttatttattttattttatttttttatttttatattttttatttttttattattttttttaatattttttattttttatttttttatttgttatattttatttgtttatattattttatatattttatttattattagtttattttttattttattttattattttaat

SEQ ID NO: 32488 - DNA, 122 bp, Zea mays
  Clone ID: LIB3059-007-Q1-K1-F6
cggacgcgttggggctaccgttttcgttttacgccaggtgccgaggcctctaggtctggtttcctgctacgatccattagccagcatctgcaggtggacactattatgcttgacgtgaatgc

SEQ ID NO: 32489 - DNA, 445 bp, Zea mays
  Clone ID: LIB3059-007-Q1-K1-F7
aaagtggaatccagtagcaacaatagagcaacaatggcgaccaagatattttccctccttatgctccttgctctttctgcatgtgttgctaacgcgacaattttccctcaatgctcacaagctcctatagcttcccttcttcccccataccttccatcaatgatagcttcagtatgtgaaaacccagctcttcaaccctataggctccaacaagcaatcgcagcaagcaacatacctttatcacccttgtttcaacaatcgccagccctatctttggtgcagtcattggtacaaaccatcagggcacagcagctgcagcaactcgtgctacctgtgatcaaccaagtagctctggcaaacctttctccctactctcagcaacaacaatttcttccattcaaccaactgtctacattgaaccgtgctgcttatttgcagcaacaac

SEQ ID NO: 32490 - DNA, 254 bp, Zea mays
  Clone ID: LIB3059-007-Q1-K1-E11
aatggttcaggatttctttgaggatgttggactcactggttagcttacacctgggtggttccacgatagatgggcttctgaaaatgttcaacttgtatgtaaacttgcttataatggaaactggttgcatgtagtcctctgcaactggccgaatgtgattgatgtgcatcatttaagatctctgagaactgtcatgtatactacatcttggacatctgctgcattgttgtattatgcactatattccctatcga

SEQ ID NO: 32491 - DNA, 216 bp, Zea mays
  Clone ID: LIB3059-007-Q1-K1-C11
atgcattaattgcatgccacgtatgctttatatcaaagcacatgtagagttgtcaactggttctgctgatgaatctgaactaactcaaaacattaaccgagtttgtcatactcttgaatttcattgctgttgtccttgtcgtagtaagcttttaattctcgacaggctgatgatgatgatgaccttgatctttttggtgatgaatctgatgtggac

SEQ ID NO: 32492 - DNA, 413 bp, Zea mays
  Clone ID: LIB3059-007-Q1-K1-C2
cggacgcgtgggcgccggacctggagctgaagatctcgaccgcccggcagagcgagcaccagcagcaggtccagatggggccatcgctgccgccgccgccgccgccgccgcagaggacgccctttctggggaccatcagggtcacatgacatgaccggcaaagacggcggcggttagtagggaatatcctgctggtaggagaagagcttttgcccatctgaagctggagaaggttgcttcaaaagataggacggggtgggaaaactggatagaaggaagcttttggcagcgtgtgcgtgtgtgtgtgttgctggcacctggcatttgcagccgattacgactattggcttgtgtatcatgtggtttttgtgttatattatattattgttatttttatgttggtatcctttatt

SEQ ID NO: 32493 - DNA, 440 bp, Zea mays
  Clone ID: LIB3059-007-Q1-K1-C3
cccacgcgtccgctcgaatagagtacgttcgacgaggacaaccggatgctggtttccctctttttgagtctgagtccttgaaatggcctggatttgtagagtttgatgatgtcaatggaagggttttgacttactctgctcaagacagcacttacaaggtgtttgatttgaaaaactacacattactgtatttggtgtctgataagaatgttcaagaaataaagatcagccctgggataatgctattgatttatgcaagaacaagcagctcggttcctctgaagattctttccattgatgatggtacagtcttgaagtccttcagccaccttcttcatcgtaacaagaaagtagattttattgagcagttcaatgaaaagcttctggtcaagcatgaaggagagaaccttcaaatccttgatgttaggaactttcaattg

SEQ ID NO: 32494 - DNA, 259 bp, Zea mays
  Clone ID: LIB3059-007-Q1-K1-C4
cccacgcgtccggcaacatacatagtgaagtacactagcaacatcttaacaccaatggcagccaatatatttgccctacttgccctaacttgctctttcagcaaacgttgctactcgcactattattgcacactgctcacaacaatacctctttccggtgacagccgcgagatttgaatacctatctatacaatcctacttgctacaataggccatcgtattaagcatcttacagtcgttagcatagactgtcctatat

SEQ ID NO: 32495 - DNA, 238 bp, Zea mays
  Clone ID: LIB3059-007-Q1-K1-C5
accacgcgttcgctcgaatagagtacgtttgacgttggacaaccggatgctggtttcccgctttgggagtctgagtccttgaaatggcctgtatttgtatagtttgatgatgtcaatggaagggttttgacttactctgcttaagacagcacttacaaggtgtttgatttgtaaaactactcattactgtatttggttgtctgataagaatgtttaataaatatatatcagccttggg

SEQ ID NO: 32496 - DNA, 315 bp, Zea mays
  Clone ID: LIB3059-007-Q1-K1-C6
ccgtggagttctccaccctctaccacggtgttcccgggcacctacccaagcctgacgacgaagcctccgagtccattctcttccgggtgaagatggtctgccggatccacgggtcaggcgacgtggttctcgactacgaggtaaaccccaggagcgacctccctccccttccccgggtgggcgtcgtgttcagcgccgggaggtccctgagccacgtcacgtggtacgggcgcgggcccttcgagtgttacccggaccgcatggcggctgcgcacgtcggcgtgtacgagagcagcgtggaagagctgcacgtgc

SEQ ID NO: 32497 - DNA, 383 bp, Zea mays
  Clone ID: LIB3059-007-Q1-K1-C7
gaatgaagggattgtgccagggttgatgacctacggagcagtggtggatgggctggtgaagtgtgggagagtggaggatgcatggaaggtggctcaggaaatgggggggcagggactagcacccagtgagtttgtgttctccgctgtgatcaccgggttttgcaagtcaggagaggttgacagggcattgatggtgtgggagacaatggtggcagctagggtaaagccgaatgttgttttgtattcagtactgattgatggttttgcacggtctgggaggatgacagaatctgataagttatttgaagaaatggcttatgcgaaatgtatcttagatatttggacattcgttttaatgtgtctgttatttttttacttttttt

SEQ ID NO: 32498 - DNA, 440 bp, Zea mays
  Clone ID: LIB3059-007-Q1-K1-C8
cagacccgtgggcacaagtcatatgcactaaatctcatttgagcgtgcaagctccttcgcctcgaaccctctcgcgcttggcttgctttcactctccagggccccactcccaccttgccgccgcattcatggcgatcacagctccaactttttacattctctgttagcgccttgtcggcctgtacttttttattctttacgtttttttttttttatttgttatatttatttttttttatatttttatttttctatttttatttttgttttttttaaatttaatttttattatttttatttattttttctcttttttttttttttttttttttctttattttttttttctttattttattttttttatttttcattttttattttgttatttattatatttattttttattttctttttttttttcttattttttatttta

SEQ ID NO: 32499 - DNA, 144 bp, Zea mays
  Clone ID: LIB3059-007-Q1-K1-C9
aaaaaaaaaaaaacaaaaaaaaaaaaaaaaaaaaaaaaaaaaaaaaaacaaacaaacagggacattttttccaaataacacaagcgtacgcacacatacatgcaaataaatagcccttctatcacaacacaaaaaactaacaaa

SEQ ID NO: 32500 - DNA, 154 bp, Zea mays
  Clone ID: LIB3059-007-Q1-K1-D11
agcatcctacgaattcaaggatacagacagcatgcagcacccatgtccaaggtcttcacccttgactcggtcaccaagcacaagtgcaagcaggatagctggctcatcatcggcagcaaggagtatgatgtgacgcagacatgggtataccact

SEQ ID NO: 32501 - DNA, 302 bp, Zea mays
  Clone ID: LIB3059-007-Q1-K1-D12
cggacgcgtgggctcgccatacgcatggacaacctgtacctcgtgggcttcaggaccccgggcggggtgtggtgggagttcggcaaggacggcgacacccacctcctcggcgacaaccccaggtggctcggcttcggcggcaggtaccaggacctcatcggcaacaagggtctggagaccgtcaccatgggccgcgccgaaatgaccagggccgtcaacgacctggcgaagaagaagaagatggcgacactggaggaggaggaggtgcagatgcatatgcagatgctctatgcctctgatct

SEQ ID NO: 32502 - DNA, 377 bp, Zea mays
  Clone ID: LIB3059-007-Q1-K1-D3
cccacacagaaaaccctagccgccgccaccgaagcggcctcccaggtaagcaggagcgtccaccccgccgccgtcatgaagcgcaatccccgcgtcacgagctcccgccggaagtgccgcaaggcgcactttacggccccgtcctccgtccgccgcgttctcatgtccgccgggctgtcgacggagctccgccacaagtacaacgtgcgctccatcccgatccgcaaggacgacgaggtgcaggtcgtgcgcggcacctacaagggccgcgaggggaaggtggtgcaggtctaccgccgccgctgggtcatccacgtcgagcggatcacccgctagaaggtgtacggctccaccgtgaacgtgtgcattctcccttt

SEQ ID NO: 32503 - DNA, 463 bp, Zea mays
  Clone ID: LIB3059-007-Q1-K1-D4
ggcaaacgtttggtcacatttttaggcctgctcatattatgcccttgcttgagattgttcggacggagaagacatcaccacaagctatccttgatctcatcaccattgggaagataataaagaaagttcctattgtggtcggcaactgctcaggatttgcagtcaaccgttcatttttttcttacacacagtgttcttattttttagttaggtcttgtaattgattgtttttatatattgtttttttattatcattctttttgattgtcttttgattactttgaaattatttttttttttttttttattagttttgtattttttattttttatattttatattgttattattattttgtttaatatattatgtttttatttatttttatttcttttttttattattgtttatttattgtatttgtttgtattttaatgttattttatattttttttttatatt

SEQ ID NO: 32504 - DNA, 206 bp, Zea mays
  Clone ID: LIB3059-007-Q1-K1-D5
ggcgggagagagccaggaagaggagggctgtcgatttcgtccggctggtgcatcaacgggaactagggccgctgctacgacttctggctggagttcagcgagtgcatgagccgctgtcgtcagcccttcgactgcggccttcttcgcgaggactaccttgagtgcctccaccactcctaggagttccagcgctggtacaggatcta

SEQ ID NO: 32505 - DNA, 412 bp, Zea mays
  Clone ID: LIB3059-007-Q1-K1-D8
cccacgcgtccggtgcagcgagcccaccccgaccagcgaccactgccatgtcgaggcgcggcgactgggtctacgagaacaacggcgggtagacctgcgtggccatcgccggcgccgattactgtgtcgtcgcggcggacacccgcctctctgtcggatacagcatcctcacgcgcgaccactctaagatctgcgacctggctgacaaatgtgtactagcatcttctggctttcagggtgatattaaagctctgcacaagaacctagctgccagagaattgctataccaacaccagcataacaaatggatgagctgccctgccatggcacaacttctctccaataccctgtactacaagcgctttctttccaatattacgccttttaatgtgctcggagggctttgtcagct

SEQ ID NO: 32506 - DNA, 398 bp, Zea mays
  unsure at all n locations
  Clone ID: LIB3059-007-Q1-K1-D9
ccgacaactacatgttgcgtttgttctgcatcggcttcaccaagaggcgcccaaaccaagtcaagagaacctgctatgctcaggcatcccagatccgtcagatccgccgtaagatggttgagattatgatcaaccaggcttctacatgtgacctgaaagaacttgtttcgaagttcattccagaagttattggtaaggagattgagaagtctacctncagcatcttcccacttcaaaacgtcttcatccgcaaggtgaagatactcaaggcccccaagttcgatcttgggaaactcatggaggttcatggcgactacaaagaggatgttggtgtgaagcttgagaggcctgtcgagggagatgaggctgggcaggaagttgctgctgccgagtagttt

SEQ ID NO: 32507 - DNA, 238 bp, Zea mays
  Clone ID: LIB3059-007-Q1-K1-E1
gtcagtgctgtggacaagggttcagggaagaagcaggatatcacaattactggtgctagcactctgccaaaggacgaggtggagaggatggttggcgaagctgataagtttgcaaaggaggacaaggagaagcgagacgccattgacaccaagaaccaagccgagtcggtcatctaccagaccgagaagcaactgaaggaactaggggacaaggtcccaggtgacgtcaaggggaaag

SEQ ID NO: 32508 - DNA, 322 bp, Zea mays
  Clone ID: LIB3059-007-Q1-K1-A4
cccacgcgtccggcaacatagaaagtggaatccagtagcaacaacagagcaacaatggcgaccaagatattttccctccttatgctccttgctctttctgcatgtgttgctaacgcgacaattttccctcaatgctcacaagctcctatagcttcccttcttcccccataccttccatcaatgatagcttcagtatgtgaaaacccagctcttcagccctataggctccaacaagcaatcgcagcaagcaacatacctttatcacccttgttgattcaacaatcgccagccctatctttggtgcagtcattgttacaaacca

SEQ ID NO: 32509 - DNA, 307 bp, Zea mays
  Clone ID: LIB3059-007-Q1-K1-A5
tcgaggcacgcgtccggcgacgcgtgccggctaaccctgctgcttacttgtaacagctgcttccatttaaccaacgtgactgtgtcgaactcttgctgcgtacctacaactgcgacgacaggtacttaatgcactagcagggcctaacccattggtcactggctttctacagcagcaacaattgctatccatacagtcagttctctttgatgaaccctgccttgtcgtggcagcaacccaatcgtggaggtgccattttttagatttcctatttatatgttaatcgataatggtgcccttataccgg

SEQ ID NO: 32510 - DNA, 429 bp, Zea mays
  Clone ID: LIB3059-007-Q1-K1-A6
cccacgcgtccgcccacgcgtccgcccacgcgtccgcccacgcgtccgctggagctgatcctttctactggatgcgtgttatcctcgcatcaaaccgtggcactgtgatggagttgggtattactccaattgtgacctctggtatggtaatgcaacttcttgtcggatcgaagatcattgaagttgacaacagtgtgagagaggatcgtgctctgctgaatggtgcacataagttgcttggtatcttgatcgctattggggaagctgttgtattttttctgactttaatttattgatttttatgttaaattttttatctaatgtttttttctttttattatattttttattttttttcatttttttattttggtttttattttttttcttattattttttttttgttttttttttattttttttttata

SEQ ID NO: 32511 - DNA, 163 bp, Zea mays
  Clone ID: LIB3059-007-Q1-K1-A7
cggacgcgtgggcggacgcgttgacggacgcgtgggcggacacgtgaagttcgtgaggtttttcgaactaatgtgtttatttacaacagatacaaaagttacttaatctactattaatgttttaatcatttttcattttttttctacatcattaataattgct

SEQ ID NO: 32512 - DNA, 417 bp, Zea mays
  Clone ID: LIB3059-007-Q1-K1-A8
attcaaccatataggcttcaacaagcaatcgcagcaagcaacatacctttatcgcccttgttgtttcaacaatcgccagccctatctttggtgcagtcattggtacaaaccatcagggcacaacagctgcagcaactcgtgctacctctgatcaaccaagtagctctggcaaacctttctccctactctcagcaacaacaatttctttcattcaaccaactgtctacactgaaccctgctgcttatttgcagcaacaactattaccatttagccagctagctactgcctactcttagcatcaacaactttttccatttaaccaattgtccgtactgaaccccgctgcttatttgcagcagcaaattctactaccatttaaccagcttgctgcagcaaaccgtgctttctttttgaca

SEQ ID NO: 32513 - DNA, 411 bp, Zea mays
  Clone ID: LIB3059-007-Q1-K1-A9
cccacgcgtccgcggacgcgtgggcaggagacctccatgctcaccttcgagggccagaagttccagggcccctccgccattgccggcaagctcggatctctccctttccaggcctgcgagcatcagatcgtcaccgtagactgccagccatcgggtccccagggaggcatgctcgtcttcgtctccggttccatacgcaccggccccgaggagcaccccatcaagttctcccaggcattccatttgctgccggccgctgggtccttcttcgtgcagaatgacatgttccgcctgaactatggctaaagacacccgatactcttgtgatgaaggaattgattaagggtttcatgttgaaactatgaatacttaatgttgccgctactctggtctcttttgtatcttccttgt

SEQ ID NO: 32514 - DNA, 429 bp, Zea mays
  Clone ID: LIB3059-007-Q1-K1-B1
atcgggatatcaaaggggctaatcttctaataactggtggtaagttgttaaaactcgcagattttggccttgcaaggctgttcactagagacggatctttaacaaatcatgtcatcactttatggtaccgaccttcttagttgctttttggtgccacaagttatgctgaacctgttgatattttggttgttatttgcatattttcagtatttttacttttgattactttttattccttttttttttgtttttgtgctattttttttttttttatattcttatatttattttatatctttgtttttttttttatatattttgttttgtttttttttattttattaattatttttcttttgttttttttttttattttattttttctttttgttatttttttataatttttttttattatttttaattttt

SEQ ID NO: 32515 - DNA, 436 bp, Zea mays
  Clone ID: LIB3059-007-Q1-K1-B10
gaaagaggcaagatgaaggctctgcctgataacaaggatggattcatcagtcacatgttagtaacgggcgactgggtcatcatagtgctgaagaactctaagtgatctggtaattagtcatcttgcaacatttattgcctttctttggtttcacggaattctatcctttgttgaaaaaaactgttatttatgtatggtttgactgatatgttggttatttgtaattgattttattgattatggtattggctttgtattctattttttatgagtttgttttgttaatagtattttttattttattttatttttgtattgttttatttttatttttattttatgattttctcttttattttattttttatttttttttatatttttttttattttatattttatttttgtttattatttttatttttatttttttttt

SEQ ID NO: 32516 - DNA, 411 bp, Zea mays
  Clone ID: LIB3059-007-Q1-K1-B11
cgtgccagctgcagggaacctgcggcgttggcagcaccccgatcctgggccagtgcgtcgagtttctgaggcatcagtgcagcccgacggcgacgccctactgctcgcctcagtgccagtcgttgcggcagcagtgttgccagcagctcaggcaggtggagccgcagcaccggtaccaggcgatcttcggcttggtcctccagtccatcctgcagcagcagccgcaaagcggccaggtcgcggggctgttggcggcgcagatagcgcagcaactgacggcgatgtgcggcctgcagcagccgactccatgcccctacgctgctgccggcggtgtcccccactgaagaaactatgtgctgtagtatagccgctggctagctagctagttgagtcatttagcggcgatgattg

SEQ ID NO: 32517 - DNA, 277 bp, Zea mays
  Clone ID: LIB3059-007-Q1-K1-B12
ctcaagttcatcgacacatcgtccaaatttgggcacggtcgcttccagactaccgatgagaagcagaggttctttggcaagctcaaggcgtaaggtgctgcggtgcagcgaagtcccatttctcaaaatcatcaaactgtgatacttttgtttgtaaccttgctgtaccaagttttgtagccatggtccggtcgtctatggattgttccatgcttcagaactgcactgtctatgttttgtgctattttggttgtttaatgccccaatcattgcatat

SEQ ID NO: 32518 - DNA, 229 bp, Zea mays
  Clone ID: LIB3059-007-Q1-K1-B2
aatttggtgatgagaataatacgtggtgttctgattatgtgggttattaaaaaaaaaagaaaaaaaaaaaaaaaaaaaaaaaaaaataaaaaaaaaaaaaaaaaaaataaaaaagaaataaatatacatataaaaaaatctaaaatttaaaaatttagatattattaatatatataaattatataaagatataaattatattatttattactatttaaatatattatat

SEQ ID NO: 32519 - DNA, 176 bp, Zea mays
  Clone ID: LIB3059-007-Q1-K1-B3
gttggcttatcctccacatacggttcggtttcgggttcgtgaggttctacggggttcgggttcgtgggtgagcggatcgagatagcgacagtaggatgttgagtaccgctgattagtcggcagtctctacagagtcacaaacgactacttacttcataattacttgagtacctaca

SEQ ID NO: 32520 - DNA, 350 bp, Zea mays
  Clone ID: LIB3059-007-Q1-K1-B4
cccacgcgtccggttgacctcaaggcagacaagaaaaagatcaaggctgcggtcaagaagatgtatgacattcaagcaaagaaggtcaacaccctgatcaggcctgatgggaagaagaaggcttatgtgaaactgacacccgactacgatgcccttgatgtggccaacaaaattggcatcatctaagttaataggcaactggattcgacatctgtgtcctactagttctgagcataccaacagatttttctatgttactagtaattttgtttgtcatatttggtttttttgcaactaagtcttgttcgcagttgcagactacatatgcctgtattgagatcctggttgcc

SEQ ID NO: 32521 - DNA, 379 bp, Zea mays
  Clone ID: LIB3059-007-Q1-K1-B6
cccacgcgtccggcaaaacccttcagaaacccatcggagaagaggcggagggcgatcggagagcgggatcatggcggggccagttgcggcggtgacggaggcgtgggacaagctcaccgtgttcctgtactcccagctctacgacgagaggaactgggccaaaaacaagaagttggcgaaggctcttggtgtgttcgctggatccatcctgttcatgcgcacctgtggtgatatggtggccatctagggagccttcaaaagttgcctaccgtgaactagagacacccccttttttgttggcattggatgtgttcttacttcggtcagggacagttgaagcgtatctagactctagagactgtttgtcttgctagaattt

SEQ ID NO: 32522 - DNA, 440 bp, Zea mays
  Clone ID: LIB3059-007-Q1-K1-B7
caacaagcaacatagaaagtggaatccagtagcaacaatagagcaacaatggcgaccaagatattttccctccttatgctccttgctctttctgcatgtgttgctaacgcgacaattttccctcaatgctcacaagctcctatagcttcccttcttcccccataccttccatcaatgatagcttcagtatgtgaaaacccagctcttcaaccctataggctccaacaagcaatcgcagcaagcaacatacctttatcacccttgtttcaacaatcgccagccctatctttggtgcagtcattggtacaaaccatcagggcacagcagctgcagcaactcgtgctacctgtgatcaaccaagtagctctggcaaacctttcttcctactcttagcaacaacaatttcttccattcaaccaactgtctacattgaaccgtgc

SEQ ID NO: 32523 - DNA, 336 bp, Zea mays
  Clone ID: LIB3059-007-Q1-K1-A3
cccacgcgtccgggcaaaccctgctgcctacttgcaacagctgcttccattcaaccaactgactgtgtcgaactctgctgcgtacctacaacagcgacaacagttacttaatccactagcagtgcctaacccattggtcactgccttcctacagcagcaacaattgctaccatacagccagttctctttgatgaaccctgccttgtcgtggcagcaacccatcgttggaggtgccatcttttagattacatatgagatgtaatcgataatggtgccctcataccggcatgtgtttcctagaaataatcaatatattgattgacatttatctcgaat

SEQ ID NO: 32524 - DNA, 449 bp, Zea mays
  Clone ID: LIB3059-007-Q1-K1-B9
cggacgcgtgggtttttttgttttttttgttttgttaaccacaggctgatgcatacccgtgctaaatttgcaaacgtggagaattacatgctgatagttcagcgtatatagactacgggcaaactataatatcaacctcttacagctatcccaaagagtaggttcattcaagctagctaccatccgcggaggtggttaaccagaacgtgataagcaacacggacatccaacatcaactttcatgtcagcaaattgaacgcacgatgtgtcaaccatcacattttacacggtaactcagcgccgcatcatgtcatccaaacatgtcaaagccttccccgtgttggagatgggagaagcttcgggagcttttcaccttccccgggaaatgatcgattcttggatttcgcatgatgtttccgtataaaggcattttgccaggaattttatac

SEQ ID NO: 32525 - DNA, 169 bp, Zea mays
  Clone ID: LIB3059-007-Q1-K1-C1
cgtcgacagcacataaagtttatccttagcaacaattagcacatggcgaccaggatatttcctcttatctcttgtcttctgcatgtgtgctaacgctacaattttcttaagctcacaagctctaagcttcttttttcccatacctttcatcaatgatagcttcagtatg

SEQ ID NO: 32526 - DNA, 410 bp, Zea mays
  Clone ID: LIB3059-006-Q1-K1-G5
cccacgcgtccgcgcaaattgctccaagaaatccatcgagaggccgtcgacaggggaattaatggctgcttcaagtgcggcgagcctggccacatggccagggactgctccagcggcggcggcggctacggcggtggcggcggcggtggtggtggcggctgctacaactgcggccaggccggccacatggccagggactgcccaagcggtggcggcggtggcggagggaggttcggcggcggcgggggtggaggcgaccgctcctgctacaactgcggcgaggccggccacatcgtccgcgactgtaccacgtgaggtgtgtccgcgttcgtacagccagccagatcggatcggatcgtttcaccacctgctggtctgatgtggccatcccgcttctagatcttgcttta

SEQ ID NO: 32527 - DNA, 436 bp, Zea mays
  Clone ID: LIB3059-006-Q1-K1-G8
gtcttcttcgacatgaccgtcggcggcgccccggcgggccggatcgtgatggagctgtacgccaacgaggtgcccaagaccgcggagaacttccgcgcgctgtgcacgggcgagaagggcgtgggcaagtccgggaagccgctccactacaagggctccaccttccaccgcgtcatccccgagttcatgtgccagggcggcgacttcacccgcggcaacggcaccggcggcgagtccatctacggcgagaagttccccggcgagaaggttcgtgccccaggacaacggccccggtgtgctcttcattggccaaggccggcccaaccaccaacggttccaagtcttcatctgcaccggcgcgaccccttggctcgacggcaagcacgttgtcttcggccaagtcgtcgagggcatggacgtcgtcaaagccatcgag

SEQ ID NO: 32528 - DNA, 423 bp, Zea mays
  Clone ID: LIB3059-006-Q1-K1-G9
ggtgggttggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggtgggtacggtggtggccgtggaagccgcggctacggcgggggcgggcgccgtg

SEQ ID NO: 32529 - DNA, 413 bp, Zea mays
  Clone ID: LIB3059-006-Q1-K1-H1
cccaattcttcaaccctacaggatccatcaggcaatcgcagcaggcatcttacctttatcacccttgttcctccaacaaccgtcagccctattacagcagttacctttggtgcatttgttggcacaaaacatcaaggcacaacaactacaacaacttgtgctaggaaaccttgctgcctactctcagcaacagcagtttcttccattcaaccaactggctgcattgaactctgctgcttatttgcaacaacaactaccattcagtcagctagctgctgcctacccccagcaatttcttccattcaaccaactggcagcattgaactctgctgcttatttacaacagcaacaactaccaccattcagccagctagctgatgtgagccctaatgcctttcttgacacagcaacag

SEQ ID NO: 32530 - DNA, 343 bp, Zea mays
  Clone ID: LIB3059-006-Q1-K1-H10
aagaaggcgaacttactttctgctgatgatgttgagccagcacttatcccatccaagaccattcctgaccctgatgacaagaagccggaagactgggatgagagagctaaaattcctgatccagatgcagtaaagcctgatgactgggatgaggatgccccgatggaaattgcggatgaggaagccaccaagcctgagggatggttggatgatgaacctgaggagattgatgatcctgaggcagccaagcctgaggactgggacgatgaggaagatggtgaatgggaggcgccaaagattgacaaccccaagtgtgaagaggcacctggatgtggcgagtgga

SEQ ID NO: 32531 - DNA, 423 bp, Zea mays
  Clone ID: LIB3059-006-Q1-K1-H11
cggacgcgtgggtgccaaggcgacctggcgcgaggccagggagtgcatctacgtcgagcccgaggaccgcaagggcgtcttctggtacaacaagaagttctagccgccgccgctcgcagagctgagaggacgctaccataggaatgggagcaggaaccaggaggaggagacggtactcgccccaaagtctccgtctacctatctaatcgttagtcgtcagtcttttagacgggaagagagatcatttgggcacagagacgaaggcttactgcagtgccatcgctagagctgccatcaagtacaagtaggcaaattcgtcaacttagtgtgtcccatgttgtttttcttagtcgtcgctgctgtaggctttccggcggcggtcgtttgtgtggttggcatccgtggccatgcctgtgcgtgcgt

SEQ ID NO: 32532 - DNA, 367 bp, Zea mays
  Clone ID: LIB3059-006-Q1-K1-H2
aacaatttcttccattcaaccaactgtctacattgaaccgtgctgcttatttgcagcaacaactattaccattcagccagctagctactgcctactctcagcaacaacaacttcttccatttaaccaattggccgcactgaaccccgctgcttatttgcagcagcaaatactactaccatttagccagctagctgcagcaagccgtgcttccttcttgacacagcaacagttgctgcctttctaccagcagtttgcggctaaccccgcaacccttttacaactacaacaattgttgccctttgtccaacttgctttgacaaacccagcagcctcctaccaacaacacatcattggtggtgccctctt

SEQ ID NO: 32533 - DNA, 246 bp, Zea mays
  Clone ID: LIB3059-006-Q1-K1-H3
cttctcgctgtcgcagaacaagagcgttgactgggagtgctggccgctggaggactccgtgccgccggctcctattgtcgtcccctcctcctcctcatcatcatgaaagatctatgaatccatagtacacacatacggtacagaagtgagagaaacaatgttcatggaacaaacgatgaacagcctgttttggtcgtcgtaatctataaaaaaaaaaaaaattaaaataatataaaatagaaaata

SEQ ID NO: 32534 - DNA, 424 bp, Zea mays
  Clone ID: LIB3059-006-Q1-K1-H4
cgacggtgagccgtgcgtccctcgaccagaagctcgccctcgccaagcgttgctcccgagaggcgaccctcgccggagccaaggcggcagcggtggcgactatcgcctccgcgatccccaccctggccagcgtgcggatgctgccatgggccaaggccaacatcaaccccaccggccaggcgctcatcgtctccacggtggctgggatggcctacttcatcgccgccgacaagaagatcctgtcgctggcaaggcgccactcgttcgagcaagcccctgagcacctcaagaacacctccttccagggcaccggccgtccccacccggtcttcttcaggccgtgagaccagaccttcgtccagagctagctacctacctcttttttcagttgccaatgcaagcaccaaatgcccaccgatgcatg

SEQ ID NO: 32535 - DNA, 144 bp, Zea mays
  Clone ID: LIB3059-006-Q1-K1-H7
aaaaaaaaaaaaaaaaaaaaataaaaataaaaaaaaaaaaaaaaaaaaaaaaaagaaaaaaaaaaaaaaaaaaaaaaaaaaaaaaaaaaaaaaaaaaaaaaaaaaaaaaaaaaaaaaaaaaaaaaaattaaaatatttaaaaaa

SEQ ID NO: 32536 - DNA, 416 bp, Zea mays
  Clone ID: LIB3059-006-Q1-K1-H9
cggacgcgtgggctagcaacatagaaagcacaatagtgtaccaacaatggtagccaaaatattttgcctccttatgctccttggtctttctgcaagtgctgctacgacgaccattttcccgcaatgctcacaagctcctatagcttctcttcttcccccatacctctcaccagcgttgtcttcagtatgtgaaaacccaattcttcaaccctacaggatccaacaggcaatcacagcaggcatcttacctttatcacccttgttcctccaacaatcatcagccctattacatcaattacctttggtgcatttattggcacaaaacatcagggcacaacaactacaacaactcgtgctagcaaaccttgctgcctacgctcagcaacagcagttacctttggtgcaattgttggcac

SEQ ID NO: 32537 - DNA, 449 bp, Zea mays
  Clone ID: LIB3059-007-Q1-K1-A1
aagatattagccctccttgcgctccttttcctttcagtgagcgcaacaactgcattcattattccacaatgctcacttgctcctaatgccattattccacagttcctcccatcagttacatcaatgggcatcgaacaccctattgtgcaagcctataggctacaacaagcgcttgctgcgagcgttttacaacatccgtttgcccaattactacatcaattcttgtctacatttaaccatacttacctttttttctcatcttgtagctactgtttttctcctatttttgccatctatctctttggtacatctgtttttttcttttttatcttttgttttttttttatccttttttttttgctttttatttttatttttttttttttattttatttttttatttttttctttatttcttgttttctttattttctttttatttttttttt

SEQ ID NO: 32538 - DNA, 351 bp, Zea mays
  Clone ID: LIB3059-007-Q1-K1-A10
aagggaatcacatcgccatggcagccaagatgtttgcattgtttgcgctcctagctctttgtgcaaccgccactagtgctacccatatcccagggcacttgtcaccactactgatgccattggctaccatgaacccatggatgcagtactgcatgaagcaacagggggttgccaacttgttagcgtggccgaccctgatgctgcagcaactgttggcctcaccgcttcagcagtgccagatgccaatgatgatgccgggtatgatgccaccgatgtctatgatgcctatgccgagtatgatgccttcgatgatggtgcctactttgatgtcccaatgactatggcttgtat

SEQ ID NO: 32539 - DNA, 411 bp, Zea mays
  Clone ID: LIB3059-007-Q1-K1-A11
cgcagatgtatccaccgtgtcgtcccggcaccaccgggccaaggatcggccgcgtgaggcttacgaaggcccgggagtacgccgcggggttgccgatgatgtgccggctgtcggagccccaggagtgcagcatcttctccggcggcgaccagtactagctaccagggttaaaaaaaaaagagtgagtcggcgcgacgtgcaaggcgcagcatgtgtactgtgcgcgtgcaaatccagaatgacgtagctctgacgtgggctcgcaatattctcgcgtgttcgttacaataatgataataactatgaggaataaatatgggaatgttgccagtgccagatagtactggcgccggttcttcgtaatgaaaaattatatttttttattttatattattttttttttttattttt

SEQ ID NO: 32540 - DNA, 348 bp, Zea mays
  Clone ID: LIB3059-007-Q1-K1-A12
cggacgcgtgggtggtcacctctagtcacgttcaaagcgacacgcgcaccggtcctggaggcagcagtgaaccgggcagaggaagagagagagagaagtagggaacgcccaccgcggcgccgacgacgccacacccggccgagccgaaaccgagactgcatccttcttagcggcgcgccgagatgagcggcatgagcctctcccatcgtctccctcccgccgcggcggcggtggacccctactacgtgtatgcggcgcacccggacccacagcggcagggcgtgctcacgctcttcgtcgcggtgctacttgatgacttgaatcctcgcgagatccacaatcttttct

SEQ ID NO: 32541 - DNA, 247 bp, Zea mays
  Clone ID: LIB3059-006-Q1-K1-E8
gcggtgccgtacatgcgaagcccaccgaagccggtgccatgtatgcaaaaatctctataccgagaagctgatgccggcatgtcgccgctccatttttcctgatcccggcgccggaagccttccccttcctcttcctgctgagcgccagcgccggtgctctcagcgaacttgccccaccggcccgcccttcccgggccttacctgattccccgtcctccagcgctgggcgctggctgtgctgcagcgt

SEQ ID NO: 32542 - DNA, 428 bp, Zea mays
  Clone ID: LIB3059-006-Q1-K1-E9
ctcagtctgaagccaagtttttctggaacagaccttggtaagcatgttccacgacgtacagaagaggaaattctcctgtacccgggatttgagaatacccctgtgaagtccggtttttggcctctggtgccatctgatcgtcccgttggtgatgttccggccataccatcctggcagcaggcgtacatggttgacagccaaggcgcattttctggctctccgttcttgcagtcgaacctgttggagaaccgttcgttagcacctatccggcaggtgaatttcttctgacggagacaggattaacagattcatacgattcttgatacgtccagcttctcgctgtatacacactatcttgaataaagtgttgccagtagaggaaatgtatatacagttcgttcgtagctcttgagcttctttctttctag

SEQ ID NO: 32543 - DNA, 212 bp, Zea mays
  Clone ID: LIB3059-006-Q1-K1-F1
aaagaagctctatctttcgcgcaatgttatgtgctacaagtgcaagggcaaggacatgaagtctggcgccttaaagatgtgccgtgagtgccagtgctaaggcatgaatgtcactattggtgagatgaacccttatatgatgcaccagatgcttgaatcttgcgacgagcgcaatgtgactggacagagcatcaatgagaaggaccgctgga

SEQ ID NO: 32544 - DNA, 190 bp, Zea mays
  Clone ID: LIB3059-006-Q1-K1-F10
cggacgcgtgggcggacgctttggcattaaatttgcagtgtttttgcttagctgtacgggcttcccaactctcaacttattccagggccttcaggacatgacgggcatactactgcagacattcatccagagtctccatcaaatgatggaccacgaagcgaggatgctgctgaccactggctattcgcac

SEQ ID NO: 32545 - DNA, 423 bp, Zea mays
  Clone ID: LIB3059-006-Q1-K1-F11
cgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggtgggtacggtggtggccgtggaggcggcggctacggcggtggcgggcgccgtgatggcggcggcggctacggcggtggcggcggctacggtggcggcggcggctacggtggtggtggcggcggctacggcggtggcaaccgtggcggcggctacggcaactccgacgggaactggaggaactgagcggtggggcccgcgcggccaagttatcctgttcgctgccgtgatgtttaccctagtcc

SEQ ID NO: 32546 - DNA, 388 bp, Zea mays
  Clone ID: LIB3059-006-Q1-K1-F12
cggacgcgtgggtatctccaaggatggccagacccgtgagcatgctctccttgctttcacacttggtgtgaagcagatgatttgctgctgcaacaagatggatgctactacacccaagtattcaaaggcccgttatgatgagattgccaaggaagccccccagtacctgaatggggcttgaaccaccaacctggccaggccacctggcacaaccagcgcttgccgcgagcgtcttacaacaaccaattgcccaattgcaacaacaatccttgccacatctaacaatacaagccatcacaacgcaacagcaaccacagttcctaccagcactgagccacctagccatggtgaaccctgccgcctacttgcaagagcagctgcttgcatc

SEQ ID NO: 32547 - DNA, 316 bp, Zea mays
  Clone ID: LIB3059-006-Q1-K1-F3
ctcacgcgtccgagaggatctacgcattaagctagatgaggacctacttctacagcagggaagaacacgctggataaatcggacgagctctcggatgcgatggaatcggtggagaactagaaggcgtaaaaggacatctcaggagcgcttgaatggatgtactagaagaacgcatgctaatgggactactatgaagaaaaatgtacagcgtgaccaatcgcttcgaatggattgaactcatctgggtcatgcggaagaccaactccttcgagaagcacgtgtgagactaccagaaggcatgcgacgtgaacagact

SEQ ID NO: 32548 - DNA, 423 bp, Zea mays
  Clone ID: LIB3059-006-Q1-K1-F5
cccacgcgtccgctttcctattcgcgccgccgccgctgctgcaagcgccagctcgccgtcgtccgaatagtacactctaacgccgccatggggcgtatgcacagccgcgggaagggtatctcgtcgtcggcgctgccgtacaagaggacgcctcctacctggctgaagaccgccgcctccgacgtggaggagatgatcacaaaggcagcgaagaagggacagatgccgtcgcagatcggcgtcctgctccgtgaccagcacggtatcccccttgtcaagagtgtcaccggcagcaaaatcctccgcatcctcaaggcccatgggctggcacccgaaatcccggaggacctgtacttcctcatcaagaaggcggtggcgataaggaagcaccttgagaggaacaggaaggacaaagactcttaa

SEQ ID NO: 32549 - DNA, 424 bp, Zea mays
  Clone ID: LIB3059-006-Q1-K1-F6
caagtagctctggcaaacctttctccctactctcagcaacaacaatttcttccattcaaccaactgtctacactgaaccctgctgcttatttgcagcaacaactattaccattcagccagctagctactgcctactctcagcaacaacaacttcttccatttaaccaattggccgcactgaaccccgctgcttatttgcagcagcaaatactactaccatttaaccagctaggttgaacaaaacggggcttctttttgaacccacaaccggtgctggctttctaacaacaatttgggggttaccccggaacccttttaccactaccacaattggtggcctttggccaacttgctttgaccgacccaacgggcttctaacaacaacacatcattggtggtgcccttttttaaaatggttattaat

SEQ ID NO: 32550 - DNA, 426 bp, Zea mays
  Clone ID: LIB3059-006-Q1-K1-F7
cccacgcgtccggagaaatcaacggaacacaacatatgtggatgctgtgatgacggttccgcttggtgccatgctgcctgtgagcgggataaatgttgcattcaaccgcgatgtgctggggcctgctatgttcccaggcctgcgtctacgaaacgaagggaagcacagatgggatacccttgaagacatatggaatggcttatgtgctaaagtagtctgcgacagcttgggatatggtgtgaagaccggactgccttatgtgatgagaagtgatgcagaagcaggtaaagctctggagagcttgaaagagtgggaaggggtaaaagtcatggatgatgttctcccattcttccagtcgctcaagctatcgaggactgcagttactgttgacgattgtgttaaagagcttgctggaattgtccgtga

SEQ ID NO: 32551 - DNA, 119 bp, Zea mays
  Clone ID: LIB3059-006-Q1-K1-F8
gtgcgctccatcaccacccagttccaggccgtcgtcggcatctcgctgctggagatcctgtccagccactcctccgacgaggtgtacctcggccagcgcgacaccaaagagtggacgtc

SEQ ID NO: 32552 - DNA, 258 bp, Zea mays
  Clone ID: LIB3059-006-Q1-K1-F9
ctcgccggctaggacccacccaagtccaccatgcctgtaagcggcagtcagttccttctgttttttttttgttaagcgcgtgcatactatactatcggtcgcgtcgcaccgatttgtatattttccgtttcctaccgaggaatgcttatctataatgaacaccagaggacaagtattagtgctcaaaaaaaaaaaaaatatttaaacataaaagattaaaacaaaaaaataaaaacaagaaagttaaccttattaagg

SEQ ID NO: 32553 - DNA, 434 bp, Zea mays
  Clone ID: LIB3059-006-Q1-K1-G1
caagcaacatagaaagtggcatccagtttcaacaacagagcagcaatggcgaccaagatattttccctccttacgctccttgctctttctgcatgtgatgctaacgcgacaattttgcctcaatgctcacaagctcctatagcttaccttctttccgcataccttacatcaatgctagctccagactgtgaaaacccagctcttcaatcctatacgctccaacaagcaatcgcagtacgctacatacctttatcacccttgttgtttcaacactgcggcagtcctatctgtggggcaacacattggtacgaaccatcacggcacactaactgcagcgactcgtgctacctgtgattaacacgagttctctgtcaaacctttctccctactctcagcaacaacactatcttccattcaaccaactgtctacactg

SEQ ID NO: 32554 - DNA, 384 bp, Zea mays
  Clone ID: LIB3059-006-Q1-K1-G10
ggaaaaaacaactcaggcgaagaacgaggacgttcttgagctggaggagcggccagagcagatccggtcggtgctggaggctggcaccagggccaggctcagtgatgaggaacacatgccgtccgtgtctgtgcaggctgaagaccaggcctttcccaaaccgaagttggccaaagtacgcgccaccgtcccggtgtgcgtgttcagcagtgtggttggcggccggcataggattcctgtgtggattcaccctaggagagatgaggggattaaggcggacgagggtccacgaacgcacgtgatgccaatgtgcccacatgacatggacagaaaatgtcactgcggtggaccatgcatgcccaatttaaggagcatcagttagaa

SEQ ID NO: 32555 - DNA, 428 bp, Zea mays
  Clone ID: LIB3059-006-Q1-K1-G11
cccacgcgtccgcccacgcgtccgacaaaacatcagggcacaacaactacaacaacttgtgctagcaaaccttgctgcctactctcagcaacagcagtttcttccattcaaccaactaggttcattgaactctgcttcttatttgcaacaacaacaactaccattcagccagctacctgctgcctacccccagcaatttcttccattcaaccaactagcagcattgaactctcctgcttatttacagcagcaacaactactaccattcagccagctagctggtgtgagccctgctaccttcttgacacaaccacagttgttgccgttctaccaacacgttgcgcctaacgctggcaccctcttacaactgcaacaattgctgccattcaaccaacttgctttgacaaacccagcagtgttctaccaac

SEQ ID NO: 32556 - DNA, 428 bp, Zea mays
  Clone ID: LIB3059-006-Q1-K1-G12
caacaagctacatagaaagtggaatccactctcaacaatagagcatctatggcgaccaagatattttccctccttatgctccttgctctttctgcatgtgttgctaacgcgacaattttccctcaatgctcacaagctcctatagcttcccttcttcccccataccttccatcaatgatagcttcagtatgtgaaaacccagctcttcaaccctataggctccaacaagcaatcgcagcaagcaacatacctttatcacccttgtttcaacaatcgccagcctatctttggtgcagtcattggtacaaaccatcagggcacagcagctgcagcaactcgtgctacctgtgatcaaccaagtagctctggcaaacctttctccctactctcagcaacaacaatttcttccattcaaccaactgtctaca

SEQ ID NO: 32557 - DNA, 434 bp, Zea mays
  Clone ID: LIB3059-006-Q1-K1-G3
gggaagtcataaaagctggagctacgtttctcaatatcccggacactgtcggatacaatcttccttatgaatttggaaagttgattgctgatataaaggcaaacactcctggaattgaaaaggctatcatttccactcattgtcagaatgaccttggtcttgcgactgccaacacactagcgggcgctcgtgcaggagcacggcagttagaggttactattaatggtattggtgaaagggctggaaatgcttctttggaggaggttgtcatggcaattaaatgccgcagagaactgttagatggtctctatactggaatcgattcccgccatatcactttgacgagcaaaatggtgcaagaacatagtggacttcacgtgcagccacataaagctattgttggtgccaatgcgttcgctcatgaaagtggaatt

SEQ ID NO: 32558 - DNA, 433 bp, Zea mays
  Clone ID: LIB3059-006-Q1-K1-E7
cccacgcgtccgaatacggaatctttcccgtgtatcccaactctcacccgatctcctcgataggcttttgtctccaaggccgcgctttctaacaagattcctcccctcctctctccgataacgctagcctccgccgccgccggcgacgaatccggcgttttgagtttctgttgccagtgcagccatgtccatgttcaacaggatcttcgggaagcccaaggagcaggccaactccagtgccttggccacactcgacaagttaaatgagactcttgatatgctggagaagaaagagaaggtgctggacaaaaaagcagccgctgagcttgagagagccaaggagttctccaaagctaagaataaaagagcggctatccaatccttgaagaggaaaaaactttatgaacaacaaattgagcaactcggaaatttt

SEQ ID NO: 32559 - DNA, 321 bp, Zea mays
  Clone ID: LIB3059-006-Q1-K1-D11
cccacgcgtccgacctcctcgatccagacagcaggcagcagccatgtccaaggtcttcaccctcgacgcggtcgccaagcacaactccaaggaggattgctggctcatcatcggcggcaaggtgtatgatgtgacgaagtttttggtagaccacccaggaggtgatgatgttctgttgtcctcaactggcaaggatgcgactgatgatttcgaggatgtcggtcacagcaacactgcccgcgcgatgatggatgagtacttggtgggtgaaatcgacgcgtcgacgatcccttccaggacgaagtatgtcccccccgaaac

SEQ ID NO: 32560 - DNA, 396 bp, Zea mays
  unsure at all n locations
  Clone ID: LIB3059-006-Q1-K1-D12
cccacgcgtccgaccacgcgtccggatagctttatttcccttgcccttttccagagcacctccgccgtcggccatgggtcaagcctggggtaatctccaagataggctccaaggtacccgcccctcaactcaatcgtgtggattcccatcttattcgcagcgatcgtacccagtctcgcgaacagtcgaatcggtagagatgaacgacgaatcgattcggtgcaaggcggccgtggaaggagcaccaagtgaggaagatcaccgacaaggtgttcgaccgcctcacggaggacgcccagaagcgcgacaaggaggccctcagattcgaggaggtctacatcgccgtcctctgcgtctacaatgacatcaacaagtacttgccggngccgcaccacg

SEQ ID NO: 32561 - DNA, 349 bp, Zea mays
  Clone ID: LIB3059-006-Q1-K1-D4
gtcaacactaacagtagacgaattctttagtttctttgcaagatatgggactgtggtggaccaccagattatgtttgatcatgaaaccaaacgttcccgaggctttggatttatagtttttgcttctgagcaagttgtagatgatttgttagcaaatggaaatatggttgaccttgctggttcaaaggtggagatcaagaaagcagaaccaaagaaatccttcaatgcaccgtcaccaccagtgcatgttagaaatgctatgtcagcatatgatagcggctctagagaccacccttcagctgacaactatggtggaatggccagtgcttatggaaacttacagggtggt

SEQ ID NO: 32562 - DNA, 426 bp, Zea mays
  Clone ID: LIB3059-006-Q1-K1-D5
cccacgcgtccggcggaggaagactttcctgccatcatgtcgagcttcaagaagttcaacgactcgttcatggaacagtacgagggctactccaggctgtgagcaggaagagaaacaagagattacagatctgaagaagagattattgattggaagcttattagttattgtaactcccttgaaaagcaggttgtgcggggattattgtttattgaataaaaagtccgccatttgattctactgccataccagtatatataattgtgaattggcttgtacttgctgctggtggggagaggtggaaatagctagccctccttgaccgcgcgcgataagaatgtcgcctcttgttctggagattattggagagttgaatagttcataatcagcctacctacaatatattgcagaaaaagtactgatcat

SEQ ID NO: 32563 - DNA, 359 bp, Zea mays
  Clone ID: LIB3059-006-Q1-K1-D6
cccacgcgtccgcccacgcgtccgcctacgcgtccgcttcaaccctacaggatccaacaggcaatcgcagctggcatcttacctttatcacccttgttcctccaacaatcatcagccctattacagcagttacctttggtgcatttattggcacaaaacatcagggcacaacaactacaacaacttgtgctagcaaaccttgctgcctactctcagcaacagcagtttcttccattcaaccaactagctgcattgaactctgcttcttatttgcaacaacaacaactaccattcagccagctacctgttgcctacccccagcaatttcttccattcaaccaactggcagcattgaactc

SEQ ID NO: 32564 - DNA, 433 bp, Zea mays
  Clone ID: LIB3059-006-Q1-K1-D7
cccacgcgtccgattgagaccaactagcaacatagaaagcacaatagtgtaccaacaatggcagccaaaatattttgcctccttatgctccttggtctttctgcaagtgctgctacggcgaccattttcccgcaatgctcgcaagctcctatagcttcccttcttcccccgtacctctcaccagcggtgtcttcggtatgtgaaaacccaattcttcaaccctacaggatccaacaggcaatcacagctggcatcttacctttatcacccttgttcctccaacaatcatcagccctattacatcagttacctttggtgcatttattggcacaaaacatcagggcacaacaactacaacaacttgtgctagcaaaccttgctgcctactctcagcaacagcagtttcttccattcaaccaactaactgcattga

SEQ ID NO: 32565 - DNA, 300 bp, Zea mays
  Clone ID: LIB3059-006-Q1-K1-D8
cctaaacctccagcccaaccttcagcccgggatcgagagcaatggcgctcgccaaggccaaggagatcgttgcctccgctcccctcgtcgtcttcagcaaaacttcctgccctttctgcgtccgtgtgaagcagttgttcgagaagctcggagcaagctacaaggccattgagttggataaggaaagtgatggagctgagctccagaatgccctgaaggagtggactggacagaggactgtcccaaatgtcttcatcaatgggaagcatattggcggctgtgatgatactaatggcactg

SEQ ID NO: 32566 - DNA, 385 bp, Zea mays
  Clone ID: LIB3059-006-Q1-K1-D9
aagaaagggagcgcaagtgggcgcatgcccagaggactctccacgggctccagccgccagaggcatccatcttcgagaacaagacgacattcaatgagctgaaccagctggcggaagaggcccgcaggagagccgagatggcgaggttgcgagaagtgagcaccctgaaggggaggatggagtcagtggtgaagcagaagggtctggacatcgagaccatccagcagtcctacaccgtgtgactggctgaccgacgacgacggggtttatagaggtttcttcttcttatactatacaatctgtactaggtagcaataaggatcaaggaaggaacccctatatattggctggggttcgcgggaaatgaatgatgggcatatttatg

SEQ ID NO: 32567 - DNA, 194 bp, Zea mays
  Clone ID: LIB3059-006-Q1-K1-E11
cgcacgcgtgagacaaccactaccggttcttctgctagctggagtgagccctgctaccgttttgactcaaccacattatgcgccgtactagcagatcgctcatcctaatgctggcacactgctgcaactgcaacaagtgctgcccttgaaccaacttgcttcgacagacccaggagcaatctagcaacaaccca

SEQ ID NO: 32568 - DNA, 157 bp, Zea mays
  Clone ID: LIB3059-006-Q1-K1-E12
ggtcgaccagctccggctgttcacgggccagttgtctatgttgcgactaccaccattgctcggcaacgtgctgggggtcgcgaaatccctgacgtgccgggcctgaaaatggagcacacctctgcgaccgcagtgtctaagcaagggcaggacaaga

SEQ ID NO: 32569 - DNA, 414 bp, Zea mays
  Clone ID: LIB3059-006-Q1-K1-E2
gtcacggcgcgggagatcgaggacgatttccggatgtttggggttctgaggagtgtatgggttgctaggaaaccaccagggtttgccttcattgactttgatgaccgcagggatgcacaagatgccattcgtgaattggatggtaagaatggttggagggttgagctgtcaactaaagttggtggtggccgtggccgagaccgtaacggttctgatatgaagtgctatgagtgtggtgaagctggccactttgcacgtgaatgccgcttacggattggttcaagaggcttgggtagtggaaggcgtcacatccgaagtcctagatatcgcagtcgcagtcgcaaccgcagcccaagatatcgaaggagcccaagctatagcagaagcccgcgagatcggtctcctaggaggcga

SEQ ID NO: 32570 - DNA, 140 bp, Zea mays
  Clone ID: LIB3059-006-Q1-K1-E5
ctataaacatgaaatttgtatggcccatttatgttgtatccgtactggtggtttggtgttacctaaactatagtggtatgtttatggtgccctgtgctacatgattcttgcaaatccagcatggtgtatatttgttggcc

SEQ ID NO: 32571 - DNA, 367 bp, Zea mays
  unsure at all n locations
  Clone ID: LIB3059-006-Q1-K1-E6
ccctgttgatgctgtcttccataaggatgagatgattgacatcattggtgtgaccaaggggaaaggttatgagggtgtggtcactcgttggggtgtcacccggcttccccgtaagacccacaggggtctccgcaaagttgcttgtatcggtgcatggcatccggctagggtctcctatacggttgcccgtgctggtcaaaatgggtaccaccaccgcactgagatgaacaagaaggtttacaagatcggcaaggctggacaagagacccacgatgcctncacagagtttgacaggactgagaaggacatcactcccatgggtggcttcccccattatggtttcgtgaaaggtgactacctgatgatc

SEQ ID NO: 32572 - DNA, 395 bp, Zea mays
  Clone ID: LIB3059-006-Q1-K1-B2
tggcataacgaagctgaagtagttcgctgtgaacccagtatggcaaacgcgccgaggatcctggccctcggactgctagcgctcctgtgcgctgccgccggaccggccgccgcgcagaactgcggctgccagccaaacttctgctgcagcaagttcggctactgcggcacgaccgacgcctactgcggcgacgggtgccagtcgggcccgtgccgctcgggcggcggcggcggcggcggcggcggcagaggcggctgaggcagtggcggtgcgaacgtggctaatgtggtcaccgacgcgttcttcaacggcatcaagaaccaagccgggagcgggtgcgagggcaagaacttctacacccggagcgcgttcctgagcgccgtcaacgcgtaccc

SEQ ID NO: 32573 - DNA, 433 bp, Zea mays
  unsure at all n locations
  Clone ID: LIB3059-006-Q1-K1-B4
ttcaatccatcctggcgtcggtgtcttgccctgccccagcgccgccgctccttcccccaccccgaagcgccgcctcttctgcctccgtcgacggtggtggtgctcctgatccccgccgttgaactggccataggagagcaaagaggaaggggaggccacgagggcgccagtagatatattcatcttcatctcggcttgcgatatttttgaattntctattccgtattgaaggcgtcgatggccttgtccgccctaatcagcaccctcctcgccgccgccatctggtgcgccgcttacctcgccgctgccatctcctccgccttctgattcccactccccactccccaaccctaacctcccccctgtagcacaccccacctccagctttgtaggtcctactatacttgcaacctctcccgccgactcgcttcga

SEQ ID NO: 32574 - DNA, 391 bp, Zea mays
  unsure at all n locations
  Clone ID: LIB3059-006-Q1-K1-B5
cccacgcgtccgcggacgcgtgggggatcacatacacttggaaggtccaggcctgaacggagtggctgggggaaaccagaaacaaaatatactaaaaatggtcctggtgcacctggtgggcaatcatggacagttgaatggctgaggtttgataacagttacttcaaggatatcaaagagaaacgagatcaggatcttctggtcctacctacagatgctgctttatttgaagacccaaagttcaaggtctatgcggagaaatatgcagaggaccaagacgcattcttcagagactacgctgaggctcatgctaaactgagcgaattgngtgcatagttccaaccaccgcagggattctctttggatgattagtgcggcaccagaaccacag

SEQ ID NO: 32575 - DNA, 431 bp, Zea mays
  Clone ID: LIB3059-006-Q1-K1-B7
cccacgcgtccgcaagaacaggggagggaggaagatctggcaggaaatggagaagaggatagggaccataattctatcattccaagccgtgaggagttgactgaagaattaagaaataaagttgcatatagtgaggaagaagcttacaggttgtactgtgactatgggcaccgcatgggctttagtgttcgaaaaggaaagcagtactactttactggaaccaaaaccatccgtactaaagattattactgctcaaaagaaggcttgaaggatgatgaacagcttactgaagcaaactttaataagccggagaccagaactaattgcaaagcgatggtccgttttagggttgattctgaaggtcaatggcgagttattcaaataattcctgaacacaatcatgagctagttcgaccggaaaaaatacactt

SEQ ID NO: 32576 - DNA, 416 bp, Zea mays
  Clone ID: LIB3059-006-Q1-K1-B8
gggcgataaaggtatgttgcttgcccttgttgtttcaacaatcgccagccctatctttggtgcagtcattggtacaaaccatcagggcacaacagctgcagcaactcgtgctacctctgatcaaccaagtagctctggcaaacctttctccctactctcagcaacaacaatttcttccattcaaccaactgtctacactgaaccctgctgcttatttgcagcaacaactattaccatttagccagctagctactgcctactctcagcaacaacaacttcttccatttaaccaattggccgcactgaaccccgctgcttatttgcagcagcaaatactactaccatttagccagctagctgcagcataccgtgcttacttcttgacacagcaacagttgctgcctttctaccagcag

SEQ ID NO: 32577 - DNA, 426 bp, Zea mays
  Clone ID: LIB3059-006-Q1-K1-C1
gtgagaacctggacgtctatgatgagtaagggcagcttgtgaagcgggcagtggccctaaacagcacagaacttgactacgatatatgaggtgcacatatcataccacagctttgatagttgtagtggaaattggtgctctctaccctcagaaatcaattttctccgattgtccatggctttttgggtctagaattgtagatagagaggagattttcctcttgataggtttgctgcttacagtggctgaatgtatctcaccggcgatttactgatttgtccatgaacatttgtaatcgccagaaccttcctggcgaccaaagtatgctgtcaatatattggacacctgaagaactgcttggagtctacacaggacctgatctttaaatatttggccaccgaatttttctaaaaccggattacataa

SEQ ID NO: 32578 - DNA, 411 bp, Zea mays
  Clone ID: LIB3059-006-Q1-K1-C10
cctaaggctggtgcaggggaaaatacttctgttgtctctgctgttgctaatgatgccgctacattgtccaaggcagacaaactaacttctcagcctcaaacagctccatcttccaagccaactgccaatgtaaaggacacagctactgagtttgctacactgtctttatcaaagaaggattctgttgtttcaaatggtgctgtgcttagcattggatgtctcacatccggtgagaaagcaatgaacttatcagaatctgtggatcaagctaatgaaatcacaaaagcacttcctacgagtcagaacaatactgcaccagtaattgctcaagcagattgtggagtagagatcagctctggtgtcatcatgcacgttgctgtgtctgcttcatgcaatggaactacagagaaa

SEQ ID NO: 32579 - DNA, 429 bp, Zea mays
  Clone ID: LIB3059-006-Q1-K1-C11
gtgattaattgcatgccaagtatgctttatatcaatgcttcttttttgttgtcactgtcttctgctgatgaatctgaactaactgaaaacattaaccgagtttgtcatagtcttgaatttcattgctgttgtccttgttgtagtaagcttttaattctcgacaggctgaggatgatgatgaccttgatctttttggtgatgaaactgaggaggacaagaaggcagctgatgagcgtgctgccgctgccaaggcctcttctaaaaagaaagaaagtggtaaatcctccgtccttatggatgtaaaaccatgggacgatgagactgatatgaagaagctggaggaggctgtccgcagtgtccagatggagggtctgacttggggagcatcaaagcttgtgcctgttggatacggcatcaagaagatgacta

SEQ ID NO: 32580 - DNA, 315 bp, Zea mays
  Clone ID: LIB3059-006-Q1-K1-C12
gccacagcgtacggccacgcgtgcgtccactcgtacgaccacgcgtgcggccacgcatacgcatttgttcaggtgaagctggtagccgtgcaacttggagtaccaggacgagttggtgctgtggacggagagcggcgacgtgggcaagggcttcagatgcatgcgcatggtgaacaacatacgactgaacttcgacgccttatacggctacaagggccacagcgggttgctcgacggcaccaccgtggtgctgtgggagtgtgccaaaggcgacaaccagagctggaagatcctggcatggggcgacgaggacta

SEQ ID NO: 32581 - DNA, 420 bp, Zea mays
  Clone ID: LIB3059-006-Q1-K1-C3
cccacgcgtccgcccacgcgtccgcctaaaccctcgctacccggcggcggctacaagctcttcgtcggttcagcaccatgaggccaccggctagaggaggacgtggtgggagggtggcaggttcgatggcggcggccgtgggggcggcggcggcggccgtgggtttggcggtggtagaggcgggagaggggacaggggagggagaggtggcaggacccccagaggcggccgtggcggcggtggcaggggtggccgcggcggtggcatgaagggcgggagcaaggccgtcgtggtggcgcacaagcacgccggtgtcttcatctccaagtccaaggaggatgcgctctgcaccaagaacatggtcccgggagagtccgtgtacggagagaaacgtggctccgttcagaatgaggatggaac

SEQ ID NO: 32582 - DNA, 414 bp, Zea mays
  Clone ID: LIB3059-006-Q1-K1-C4
caagcaaggggcttagtgatggacatttcaagaggtggtattgtgcctcctcaagggttccgtgagtctgttgttaactttttcaaggaggctggtcgacaggaagaaattgagaaagcttttgaagaaaaacctatgccaacacctcagtctagaacagagtatcagcctaggactgagtatcactctcgcaatgcagacggtactgctcaaataaaacaacctggctttagctctgctccagcggtgggacctgaatttcttcactctcagccacaacaatccacacttagtaacactccaaatcagcagcctgagtttggctcatctcgatcatggaattcaggtttcggtgctcctcaagcgcaatctggatatggtgcaccttaacctgtacagacaccacagccacag

SEQ ID NO: 32583 - DNA, 354 bp, Zea mays
  Clone ID: LIB3059-006-Q1-K1-C6
actgatcgtacaactgataggataactaagccgtaaacgatgcaactgtggctagaactgcagctcgctacaaattgcgctaacaatcgtgctgatcatctcattgattgtcacctagaatgcaccctatgtgacaccaaaccagatactaaatgagactattgctgtaaatatgatcattcaagcgatcatgtcatccacataatgattcaaatgaagcatgactcggacaatgacttcgagatggaggacatcattgatgatatccatgatcacacttatgtactcactaatgcaaggaatggatcactgattgagcggccgcatgagcgtgctcatatggttgctattagt

SEQ ID NO: 32584 - DNA, 429 bp, Zea mays
  Clone ID: LIB3059-006-Q1-K1-C7
cccacgcgtccgcggacgcgtggggagttgccaaggttaagattgttgtgtgaatcttacttgtgcaagcatatttctgtaaattccgtggcaactactctagcattggctgatcggcaccatgctatggagcttaaatccgtttgcctcaaatttgctgccgaaaacctgtcagctgtgatccggactgagggtttcgactatctcaaagacaactgcccatctctgcagtcagagatactgcggacagttgccgggtgtgaggagccatgtagcagcggcttgaaaagccagagcgtgtgggcgcagctctctgacggcggcgacaccagcgggcgcagggtgaggccaagggtctgagacgcaaaccccggaagcactgacctttgtaatcaaaagctgttgtggtgtaaatgggacggcttttct

SEQ ID NO: 32585 - DNA, 428 bp, Zea mays
  Clone ID: LIB3059-006-Q1-K1-B12
gtcatctgctccaagtgcaagggcaagggctcgaagtctggtgcctcaatgaggtgccctggttgccagggctcaagcatgaaagtcactattcgtcagctgggcccttccatgatacagcagatgcagcagccttgcaatgagtgcaaggggactggagagagcatcaatgagaaggaccgctgtccagggtgcaagggtgagaaggtcattcaagagaagaaggttctcgaggttcatgttgagaaggggatgcaacacaaccagaagatcaccttccctggtgaagctgatgaagcgcctgatactgtcactggagacattgtattcgtcctccagcagaaggatcactccaaattcaaaagaaagggtgaagatctcttctatgagcacaccttgtctctgaccgaagcactatgggggttcca

SEQ ID NO: 32586 - DNA, 372 bp, Zea mays
  Clone ID: LIB3059-005-Q1-K1-H8
cccacgcgtccgaaaggtcccagctttccgtgttcttctgcttctttccccgcctcgccttccttccccccgtcaccagatctcgaggcagcggagtccggggacgccgttctttccgttgtgcttcctttgcctcttgctgccggtggccggtgattttcccgaggtctgtttgggcggcaggtagaggctattttcttggcggctggtgggatggatagccacgccgacgggtcgagctccggcgggtccggggatggcggcgcgcagcccaggaggagctccaggaaacccacgtattccaagtttactcagcaggagctttcagcttgcaagccgattcttactccaaaatgggttatttcagtattc

SEQ ID NO: 32587 - DNA, 325 bp, Zea mays
  Clone ID: LIB3059-006-Q1-K1-A1
cggacgcgtgggctgaggacaaagcgttaagaaaaaaaaagggaaaaggggctggtgcgcaaaaccctagcgcagtcgcatccatcatggcgatgtccatcttcgtcggcggcgactccggtgcgctcatcgcgccgtccgcgtcctcgctccgcccgccgttccgtcttgccgctggtcccaagggccatttttgtacttttccttatggagcatctagcaatcacagccggctatgtgttgaacatcaaaggtgttcttcgaactccacccagaactatgctctttctaagaaggatttttctcctattacttcagatgtgga

SEQ ID NO: 32588 - DNA, 428 bp, Zea mays
  Clone ID: LIB3059-006-Q1-K1-A10
gttcccgtctctccgccgcttccttggaagacgaagaaaccctcctccaccaccaacccgatccagctacatccgttgaggcccgtgcgtttcttccctgttctcccatcaatcgacctagccttacgccgaccaggggcttcctctaatcgatctggtgtctgttctgtggtcttttggtctgggtgcactccagggccaggagcagctagccgtcttcgttcgatccgttcgcatccccaacgcggttcgatttgaaggagcgtgatggccaagacgagctcgttcaagctggagcaccccctcgagaagaggcaatctgaggctaaccgtatcagagagaagtaccctgacagaattccagtgattgttgagaaggctgagaggagtgatattcctgacatcgacaagaaaaagtacctcgtcct

SEQ ID NO: 32589 - DNA, 413 bp, Zea mays
  Clone ID: LIB3059-006-Q1-K1-A12
atccttagtattttgacacatattctaagtattctgttataagtggcacaaagcgctcttgaaaccggtttaacgaggtttatgcatgaaccatgatatattcttgaatacacagactttttgtgtcctacaaatgacgatagaaatgtacgtgctttgtttgagagggcactgagcttacttgctcgcaaggaatccacagacgtatggagacgatttgcacaatttgaacagaactatggtgatttatcaagcatgcttaaggttgaacatagaaggaaagacgctctatctaagacatctgaagatgccttatctgcatcggaaaacacactttatgacataacttctcgatacagctacatggatctttggccatgctcatcatacgaattggattatctaacgagaca

SEQ ID NO: 32590 - DNA, 565 bp, Zea mays
  unsure at all n locations
  Clone ID: LIB3059-006-Q1-K1-A4
ccgggtcgacnccacgccgnntccgcaaggggtgctcaaccttaagaattggtggtcattttgtagtctgttgcttggctgaaggggtcganntatccgtgcatcctnntggtggtngnngtatgatnnctacacannttttatcaaggggcaccagggnnagtattcnntgttgnngaaaatcntnnctcgtcggaagagggataatnnactcgagccttcgcannnacttctctttannttgagaagggggcgaaggcataaagagggggtttcttcttttttgcgttctccacctggagtatttgtagtatgccggacccacagtttgtcagccccgatgccttgagtaagcaagaaattggtcccttgcnctacttgctatctnnnctgatgactngcgatnngggtcttgggatgttgtgcccttgattgccactcataaacccattctgacgaagccattgtgacactcaccccaagacttggtgtatttggaaccggcgcccatggggaagatgtttgagtttccaccaagttttgcagcttggcacccgaggcgaat

SEQ ID NO: 32591 - DNA, 320 bp, Zea mays
  Clone ID: LIB3059-006-Q1-K1-A5
cggacgcgtgggtgggtctacgacgacgtaccatttccattctttaggctatttattgttttggggtgggagttttagagctaggatgctgctagcacatagcaacatggtatatgggtcgtctgggaaaaaaaaccatattattatgtaactgtattaaccttggttgtctcttctcgccttctgagatacaagtgtctcttggtcaaagagtgggtggcccgtttctatgcctatgcagctatgctccagtattgtcgcatttgcctaggtaaaataactaattacatggcatgcgaattatgttcaaaaaaaaataa

SEQ ID NO: 32592 - DNA, 311 bp, Zea mays
  Clone ID: LIB3059-006-Q1-K1-A6
cccggtcgaccccgcgtccgcccacgcgtgcgcggacgcgtttccgttcgcgtggttggtcatcgattaatgcgagtggtttctcaaaagagatccaacgcatctaaactattggtcttggctgatccgtttgctgatgcttaccctgatatgcatgacaatgtattcatcatgattcacctacttgagttcctcatatctgattacatgcaagtttggctatgctgagaacatattaccacaatacattcttaagaatgctaccatatctattatcaatgcacgcactgatttgctaattctgaacaaca

SEQ ID NO: 32593 - DNA, 393 bp, Zea mays
  Clone ID: LIB3059-006-Q1-K1-A7
tgacccaggcgtccgggctggaggagctggtggcggaggtgtgtccgcctgcaggcggagaacgcggcgacgcaggcccgcaccgcggcgctggagcgcgacctgggcagggtggacggcgacaacgcggtgctgcgcgcccgccacgccgagctggccggccgcctgcagtcgctgggcggcgtcctcgaggggctccaaatggccggcgccgccgtcgacatcccggagatggtcaccgacgaccccatgctccgcccctggcagccggccttccccccgatgcagcccatcgggttctgagaatctgagccttagccggcgggagagagccaatttctgttcgcgtgcccgtggctatctcgtattgggatatctaatcataaatcatcc

SEQ ID NO: 32594 - DNA, 429 bp, Zea mays
  Clone ID: LIB3059-006-Q1-K1-A8
gctccgaagtccgaaccttcatacacatcgtctcgtttccgatttccccaaattcaggccacaggcgctacaggacccaggcaccactcggtcggcggccaccgcgtcgccccgcctgctcgattggggtcgcgtgtgcgataggaagtattgtgttgtgtttgcaacgtgatagcttgtactgggaacaaaggtcaagatgggcgccttggacctacaccttgactttgcttctgctcaacatggacaagccaagttaaaggaatatgccaagagctctttgttgtctgatggaaactacaatacagacaagatcaatggttcaaaccctgatgactatgagaaatttgagaaagggataatgcactatgggtgtccacattatagaaggagatgccgcataagagctccttgctgcaatgaaatttt

SEQ ID NO: 32595 - DNA, 408 bp, Zea mays
  Clone ID: LIB3059-006-Q1-K1-B10
gttggcttctcctccccctccggttcgggttcgggttcgtgaggttctccggggttcgggttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcacaggtcccgctgcttcggcttcgtcaccttctacacggaggaggcgatgcggaacgccatcgagggcatgaacggcaaggagctggacggacgcaacatcaccgtcaacgaggcccagtcccgcggcagccgtggaggcggcggcggtgggtactgcggtggccgtggaggcggcggctacggcggtggc

SEQ ID NO: 32596 - DNA, 432 bp, Zea mays
  Clone ID: LIB3059-006-Q1-K1-B11
gccacgcgttcgtccacgcgtccggcagccatcgctgacctccgccaggagatggcttcggatgacatcgagaagatcaaggccaagcttgaggctgccaacaaggctgtctcgaagattggtcagcacatgtcaggtggtggctctggcggctcgcagtcgggatctggacctcagggtggcggtgaccaggcgccggaggcagagtatgaagaggttaaaaagtgaggctgcgggaagttcaagcgaaattgtagtgacctgtttagaagtagctactcttttttgggaacacagatagtcagatgagatgtaaaacctgtgttgtaataatcgttggatttgcccccacttagtttccttctgcggcgatggaggtaacacgacatttcattgcttttggtgcatatgatgccttgatctggcatggat

SEQ ID NO: 32597 - DNA, 445 bp, Zea mays
  Clone ID: LIB3059-005-Q1-K1-H7
gaaaaatatccccaaaccctagctcccgatctcgatggcgaaccctcgcgtcttcttcgacatgaccgtcggcggcgccccggcgggccggatcgtgatggagctgtacgccaacgaggtgcccaagaccgcggagaacttccgcgcgctgtgcacgggcgagaagggcgtgggcaagtccgggaagccgctccactacaagggctccaccttccaccgcgtcatccccgagttcatgtgccagggcggcgacttcacccgcggcaacggcaccggcggcgagtccatctacggcgagaagttccccgacgagaagttcgtgcgcaagcacaccgcccccggtgtgctctccatggccaacgccgggcccaacaccaacggctcccagttcttcatctgcaccgtcgcgaccccttggctcgacggcaagcacgtcgtcttcggc

SEQ ID NO: 32598 - DNA, 211 bp, Zea mays
  Clone ID: LIB3059-005-Q1-K1-G4
ttcaaagacctggatgcctttctctatcaatgggctcacctctctcagcacaggatgcagaacgtcttatggtactactctcacatcaaggctgaatggaagctatggataccgttttgccttcagtgtgctccaagaagcaactaacaatttcgaccagaactgggtcattggaagtggaggctttggaaaggtctacaagggggtgatg

SEQ ID NO: 32599 - DNA, 443 bp, Zea mays
  Clone ID: LIB3059-005-Q1-K1-G5
gcactatccgacactaggccaccaccagcgggcgggctccagtcgcaactcgcaacacagacgccgccgccgcccaaagaaagacgtcaactccaggagacaagatagtgagaactgaagagaaggatgggcttcgagaagcagatcctgagatccggcaccggccccaagccgataaagggccagaaggtcaccgttcactgcaccggctacgggaaggatcgtgatctgtccaagaaattttggagcaccaaggaccctgtgcagcagccattcagtttcagcattggtcagggttcagtgatcaaaggatgggacgagggagttatgaccatgcaagtgggtgaagttgctcgtatccagtgcacgcctgattatgcttatggagccggcgggttcccagcctggggaattcaaccaaactcagtgcttgtgttcgagat

SEQ ID NO: 32600 - DNA, 421 bp, Zea mays
  Clone ID: LIB3059-005-Q1-K1-G9
ctacgtgctgcatacaataaccccgagagagctatagactacctgtattctggaattcctgagaatgtggaggctcagcctgttgcccgagcacctgctgctggccaacaaacaaatcagcaggccgcatcacccgctcagccagcagttgcattgccagtgcagccatcacctgcctctgcagggcctaatgcaaatcctttgaacctttttcctcagggtgttccaagtggtgggtccaacccaggtgttgttccaggtgcaggatctggtgctcttgatgccttgcgacagcttccacagtttcaagcactccttcagttagtccaggctaatcctcaaatcttgcagccaatgcttcaagagctaggtaaacaaaacccacaaattctgcggttgattcaagaaaatcaagctgagt

SEQ ID NO: 32601 - DNA, 407 bp, Zea mays
  Clone ID: LIB3059-005-Q1-K1-H10
atggaagctgcgggaagaaggaaggctcttggaaattgttgatccagaactggaaaagtacccagaggagcaaatgcttcgtttcattaaagtggcactgctgtgtacgcaagccacgtcccagcagaggccgtccatgaagcaggtcgttaatatgctatctaaccaaacagaaattgatctgcaaaatgtagctccaccaggtgtgctgaaagaacctcggcagcgtaccggtggctttgggggtttgatagcagacacgtcctcaagccaaagcactaaaggcaacccagctgaatcatacagcacacagaccaacatgaacagctctcagtttagcacaactgatgtatcaccacggtgacgttgtcgactattgtttgacgtcttcagaggtgtctcgcgcc

SEQ ID NO: 32602 - DNA, 418 bp, Zea mays
  Clone ID: LIB3059-005-Q1-K1-H11
ccgttacccggcggctttaaaccctagttcccattccatcttcgtttccgctccgccgccgtcgatggagttctggggtctcgaggtcaaacctggatccactgtcaagtgtgagcctggacatggctttatcctgcacgtttcccaggctgcccttggggaatcaaagaaaagtgacagtgccttaatgtatgtcaaagttgatgacaagaagcttgccattggaacgctctctatcgacaaatacccacagatacaattcgatttggttttcaataaagagtttgagctgtcacacacatcgaaaactaccagtgtatttttctctggttacaaggttgagcagccaattgagggagatgaaatggatcttgattctgaggatgaagaggaggagctaaacattccagtaatcaag

SEQ ID NO: 32603 - DNA, 425 bp, Zea mays
  Clone ID: LIB3059-005-Q1-K1-H12
atttagaccaactagcaacatagaaagcacaatagtgtaccaacaatggcagccaaaatattttgcctccttatgctccttggtatttctgcaagtgctgctacggcgaccattttcccgcaatgctcacaagctcctatagcttcccttcttcccccgtacctctcaccagcggtgtcttcggtatgtgaaaacccaattcttcaaccctacaggatccaacaggcaatcgcagctggcatcttacctttatcacccttgttcctccaacaatcatcagccctattacagcagttacctttggtgcatttattggcacaaaacatcagggcacaacaactacaacaacttgtgctagcaaaccttgctgcctactctcagcaacagcagtttcttccattcaaccaactagctgcattgaactc

SEQ ID NO: 32604 - DNA, 446 bp, Zea mays
  Clone ID: LIB3059-005-Q1-K1-H2
caacaagcaacatagaaagtggaatccagtagcaacaacagagcaacaatggcgaccaagatattttccctccttatgctccttgctctttctgcatgtgttgctaacgcgacaattttccctcaatgctcacaagctcctatagcttcccttcttcccccataccttccatcaatgatagcttcagtatgtgaaaacccagctcttcagccctataggctccaacaagcaatcgcagcaagcaacatacctttatcacccttgttgtttcaacaatcgccagccctatctttggtgcagtcattggtacaaaccatcaaggcacagcagctgcagcaactcgtgctacctgtgatcaaccaagtagctctggcaaacctttctccctactctcagcaacaacaatttcttccattcaaccaactgtctacactgaaccctgctgc

SEQ ID NO: 32605 - DNA, 408 bp, Zea mays
  unsure at all n locations
  Clone ID: LIB3059-005-Q1-K1-H4
agaatgacgacctgcaggcaaaggtatcggctgcttctgagaagattaaggaactctcttcccagcttgccaatgcaagagatggcacgatgaatggtaaagccaaggaagaagataatgagaagggcgacaccgaaaaggatgacgaacctgttgtggtagttgccaaagtatgggagaacagcaactttgctgactacgattcatctaaggttaaagagaacgatggcgactcgcaagttgatttggaatcaaacaagggcgacgcaagtgttgacagcaacggccttgctccaactaagcagagcaatggcaggacatcaccaactaaacagcaccagcagcataagaagaagctttctctgaagaaattcggtggtctgctgaagagaanagcgaaattagcat

SEQ ID NO: 32606 - DNA, 406 bp, Zea mays
  Clone ID: LIB3059-005-Q1-K1-H5
atactaacgaggaggaaattaaaaggaagagaaagaagcgaaagagagttgttgtattagctgtgtctattatggctataattgcaaatcggtatcaacggaggagacctagacacatcatagatgctaacgaagttcaagagagaaatgtcgagtgcagaaaacaaatgctatgtaatatgtaccagggttcaaatgtctattgctatgacagtttgcgcctaactaagagatcttttagtgacttgagtgccatcttacgggaaaagagtggcctacaggataccctaaatgtgtcggtagaagaaaagcttacaatttttctgcttatagtaggtcataacaccaaaaatgaggttgatccgtagcacttaatgggtggtcccttgaaccaatcagtcgacac

SEQ ID NO: 32607 - DNA, 447 bp, Zea mays
  Clone ID: LIB3059-005-Q1-K1-G2
cctgaacggcgtcaatttgccatcaaagtactccttcaaccaagcgacgatctggtcagcctcaacgtgaacccgagcgggaaggtgacatcctacgacagcggcaggacggcggacgacatcgtcgacttcatcaagaagagcaaggagaccgcaggcgccgccaccaccaccaccacccaggcgccaccggcatccgagaaggcagccgccgccgagcccgtcaaggacgagctgtgagcatccaaggtgtggacggctgtggctgcgtaagcatgggaggaaaacctggcgctaacgtgcctacaacgcctagtttttgcgggaccatgaggagagagagagagggacggagttagagagagaggggatctgcgacgtgttttgctctgcggcggcatgtctgtgtatcccattgaggttatgtacacaattacaccgcggtcg

SEQ ID NO: 32608 - DNA, 270 bp, Zea mays
  Clone ID: LIB3059-005-Q1-K1-E9
gttttccaccttgagcactgatgctcagtgtcaatcgtgttgcatccccgtcacttctctactctgcacattttaagaaccatgtttaccatggctgaaaaggggtgatctctcagtactgaatttgcttctgtaagtggtttctgatagcgtgctagctgttactgcgcctatgggttgttcgtatggtggcccttcgtgccagaggcgcattgaaatgcgtcacactttgtcattactctggaccttaaccagggaagtcttgattgc

SEQ ID NO: 32609 - DNA, 407 bp, Zea mays
  unsure at all n locations
  Clone ID: LIB3059-005-Q1-K1-F1
tgattcgtattctatctcttaaaaaagtaaggcagaagatagctagattcatgatttggccaatacaacctcaaattaacttgcctattcatcgattatgttcaggaaataatgtatcaattaattgaaggaagtaatagtagtggctcatctagaactcattcgattcctagttctaactatgaccactaacttttgccttgctagctggctatgtacaagcctgcaacacattcttatgataccatcatgtcattaaatgtcaagggctgagtatccccggacagcagggcctcgactacgcagttcgtaatcgtgacccatcttctnncgcgagattatgcccctcaancacaagttttgttggtgaagtgagaggagagattagagagaataaactttgctta

SEQ ID NO: 32610 - DNA, 424 bp, Zea mays
  Clone ID: LIB3059-005-Q1-K1-F10
ggaggatgcgtgtgctgaggcgccttctccgcaagtatcgtgaggccaagaagattgacaagcacatgtatcatgacatgtacatgaaggtcaaaggtaacgccttcaagaacaagagggtgcttatggagagtatccacaagtccaaggctgagaaggccagagagaagacactttctgaccagtttgaggccaagcgcgccaagagcaaggcgagccgtgagaggaagatcgctaggagggaggagaggttggcccagggtccacgagaaataacaccacctgtctcatccacagctccagctactggggcaccgaagaaagcaaagaagtgaagtattgaaataaagctgtagctttctagtccagtactgcactttcttttataagctctagtcaaattttggagcgcctgaactgtttt

SEQ ID NO: 32611 - DNA, 403 bp, Zea mays
  Clone ID: LIB3059-005-Q1-K1-F11
cccacgcgtccgggcgatgcggcgcgactcctatttcgtctatgatgactgtgaagcgatggtcgcgtggcccttcagccacccaaattggaaagcccgctgttcacatggctagcgttgacttgaaaggaaaagcatacgatgtgttgagacagaattcttccagctttttgttggaagatgtctacagaaacccaggcccgctccagtttgaaggaccaggtgccgattcaaagcctatttcattgtgcgttgaggatcaagactatatgggcagaataaaaaagttgcaggaatacttggagaaggtgaagaggattgtgaagcctgggtgctcgcaggatgttcttaaagcggcgctgagtgccatgtcttctgtgccggaaacactgaacatcatgac

SEQ ID NO: 32612 - DNA, 424 bp, Zea mays
  Clone ID: LIB3059-005-Q1-K1-F12
cactttggtgaaccctgctccaccgttccggtacttccgaaagctaaaggagacgagcagcctaaaaaccctagcccccgaatcagatcccaccgcccgccggaacgcggaaccctgcccacggccgccatggagatgagcgatgcggagcggatgatcttcttcgagatggcctgcaacaactccgaggtcgcgtacgagcagaaccccaacgacgccgacaacttgacgcgatggggcggagcgctgctggagctatcacagatgcgtaacggccccgacagcctcaagctcctccaagatgcggaagccaagctggaggaggcactgcaaattgatcccaacaagtctgatgcactctggtgctcgggaaatgctcagacttctcatggattcttcactccagacactgcaatggcaaatg

SEQ ID NO: 32613 - DNA, 447 bp, Zea mays
  Clone ID: LIB3059-005-Q1-K1-F2
ggtgggttggcttctcctccccctccggttcgggttcgggttcgtgaggttctccggggttcgggttcgtgggtgagcggatcgagatggcggcgtcggatgttgagtaccgctgcttcgtcggcggcctcgcctgggccacggtcgaccactcccttcacaacgccttcagcacctacggcgaggtcctcgagtccaagatcatcctcgatcgggagacgcagaggtcccgcggcttcggcttcgtcaccttctccacggaggaggcgatgcggaacgccatctagggcatgaacggcaaggagctggacggccgcaacatcaccgtcaacgaggcccagtcccgcggcggccgtggaggcggcggcggtgggtacagtggtggccgtggaggcggcggctacagcggtggcgggcgccgtgatggcggtggcggctacggcggtg

SEQ ID NO: 32614 - DNA, 303 bp, Zea mays
  Clone ID: LIB3059-005-Q1-K1-F4
gcgtctttacaacaaccaatttcccagttgcaacaacaatccttggcacatctaacaatacaaaccatcgcaacgcatcagcaacaacaattgctaccaacactgggccacctagccatggtgaacccttgcgactacttgcaacagcagttgcttgcatcatacccacttgctctggcatacgtaattgcaaaccatccacacaaacagctgcaacagtttctggcagcgctcagtcaactagccatggtgaaccctgccgactacctacatcagcatcaactgcttgtatttagcccgctc

SEQ ID NO: 32615 - DNA, 436 bp, Zea mays
  Clone ID: LIB3059-005-Q1-K1-F5
cggacgcgtgggctgaggacaaagcgaaaagaaaaaaaaagggaaaaggggctggtgcgcaaaaccctagcgcagtcgcatccatcatggcgatgtccatcttcgtcggcggcgactccggtgcgctcatcgcgccgtccgcgtcctcgctccgcccgccgttccgtcttgccgctggtcccaagggccatttttgtacttttcctcatggagcatctagcaatcacagccggctatgtgttgaacatcaaaggtgttctcgcagctccacccagaactatgctctttctaggaaggatttttctcctataactcaagatgtggaaggcttccttcacaatgttgttaacatgggttttcttgaccgtctgaaattagcgtggaagataatgttttctgcaccaaccacaaaggatacctccaatgcaaacatcgc

SEQ ID NO: 32616 - DNA, 411 bp, Zea mays
  unsure at all n locations
  Clone ID: LIB3059-005-Q1-K1-F6
ccgacaccgccagccacgtcaaggactacgcgcgcgagtacggcggatacctgcgcacccgcgccaaggacgccgcgcccggcgcgtaggcgcgcgccgtccggcgtgcatgtgctgcaacccccgtccgtggtgccgctagctataggtcatcattgctgtcgtcgtcgtcgtcttagttcctcttgcattgcgtgtgcgtactctgctccaatcatcccccgcccgtgttgtcaagcaatttctggtcctcttgcttgctttctctaggagatgctgttcatttcgatctcttggcgcaatttgatctttcgcttggtgtaattaggtcattagttaaatcataagagactcgtgttcatggtctntctcacaaccttaaaaaaaaatgtaaaatggaaaaaccacaaa

SEQ ID NO: 32617 - DNA, 351 bp, Zea mays
  Clone ID: LIB3059-005-Q1-K1-F7
ccgcgaagaaatctatgctagaggagctcgaagcaatgctggaggttgtggaccctcagcccccagggaagcagcgatcactgagccgcaggaaatttgatctcccagagggtggagccatccccgatgagaaaaccgctgctgtgaacaaagccatcaggatcatcgaggaaggcaagtgaagtgatgcaccaccaccttgttactggcaggattgaatcctgatgaaagctccatatctatccgtgtatcgtctaggagaagtttatatccgtgtgctttgctgacactcgagggaggagaactaatatctgcactttattgtaccttaaatgatagccatgtttttat

SEQ ID NO: 32618 - DNA, 374 bp, Zea mays
  Clone ID: LIB3059-005-Q1-K1-F8
cgcaagtaaatctatgctagaggagctcgatgcactgctggagtggcggaccctgatcctgcatagaagcagcttatcactgatccgtaggatgatccatcgtcgaccagttggtgcacatccccgatgagaactcacggtgctgtgaccatagccatcatgatcatcgatgaaggcgacgcgaagtgatgcaccgataccgttttactggcatgatcgaatgctggcaatgctgcatatctatccgtgtatcaactgggaggaactgatctgccggtgctttgccgacacctcgggccagaaaagctgtagtcgcacattattctgccctaaatgctgtccatggcgttattgacgtgggtacagtagggctg

SEQ ID NO: 32619 - DNA, 327 bp, Zea mays
  Clone ID: LIB3059-005-Q1-K1-F9
ggtggccatccagcccaagcaggtgtggaactggtttcagaacagacggtactcacaccgggccaaaactcccagggccgcgtcgtcaccgccggctaagatgacgccctcgggagctgatcaccaccagcatgccgctaacgcctccgccttcagggctgctcagctctcttctgttgctgctgcgcaccacggttcctcctctacagggaagaatcctgtggaaagtgtctcagttgagtttgaggccaagtcagctcgtgatggtgcatggaggtgcgggttcgtttttctggatttggggcagaggaggatgaatggatcaat

SEQ ID NO: 32620 - DNA, 445 bp, Zea mays
  unsure at all n locations
  Clone ID: LIB3059-005-Q1-K1-G1
agaaaaatgtcccactgatgacgcgggacgccggagcggaagggagggcccaccatgtcagcgccgccgccgccgccgccgtttctgtcctattctgctcttcctgccgatctgtgcgccccctcttcttcatcccgtccctagcagccgatcccaactcccgatcttcgtttcctttgaggtatgactctgttttagcctgttggggtatataatcaatttgggtgctggctcctttttttaagcgtttctgatagagatgacggaggtgaaaaaatactccagcataattggttccttgcttatggagtatttgttaattttgtactatctaagcatcgaattccaggctgtaacttttgctgcatcgggcaaatggttttgatttgctcgatagaactgtcagtttaggaaccactangcgtcgttacatactgtacgctcg

SEQ ID NO: 32621 - DNA, 438 bp, Zea mays
  Clone ID: LIB3059-005-Q1-K1-D2
ggagaactcgacaccatgaaggtgctgatcgttgcccttgctctcctggcgctcgctgcgagcgccgcctccagtacaagcggcggctgtggctgccagacaccaccgtttcatctaccgcctccgttctatatgccgcctccgttctatctgccgccgcagcagcagccgcagccatggcaataccccactcaaccaccgcagctaagcccgtgccagcagttcggatcctgcggcgtcggcagcgtcggcagcccgttcctgggccagtgcgtcgagttcctgaggcaccagtgcagcccggcggcgacgccctacggctcgccacagtgccaggcgctgcagcagcagtgctgccaccagatcaggcaggtggagccgctgcaccggtaccaggcgacatacggtgtggtcctgcagtcctttctgcagcagcag

SEQ ID NO: 32622 - DNA, 420 bp, Zea mays
  Clone ID: LIB3059-005-Q1-K1-D5
ctccctgctacgcgtagccaaggtcaccggcggggctcccaacaagctctccaagatcaaggttgtgcgcacctccatcgcgcgcgtgctgaccgtcatctcgcagaagcagaagtcggcgctgcgtgaggcgtacaagaagaagaagctgctcccgctcgacctccgccccaagaagacccgcgccatccgcaggcgcctcaccaagcaccagctctccttgaagaccgagagggaaaagaagcgtgagaagtatttccccatgaggaagtacgctatcaaggcctagatcagtgaaagaacatttatcctgtcaagttttgctcagaagttacttgaatttgagacaaatctatctccatccaagtactatgtagctgatcaactgcatgatgaaaaacgagtactttttgcttgttt

SEQ ID NO: 32623 - DNA, 440 bp, Zea mays
  unsure at all n locations
  Clone ID: LIB3059-005-Q1-K1-D6
gctgctcaagaacctgatggagtcgcagaaggttgactacgattttgagtactacaagctggaaatggcagctgatgtgcagctactcactctctctgaggggaaatcaaacatccttccttcagatttggtagtgcctttccggccatcctctgttcccacaattaatgcaggtgctgaggaaactgagagctggaggtggtttttgaccacagtaaggtctcttcctcagtccactgaacctgaaacttaccagatgattcaggatgaaatggtcagtgccatgcgtgatgataggagcttgggttgttctgaacttagcagatggctaacaatggcacanataatggcctncagctntggcgagaagagtctttctttggagcactggcagatggtgaaggagcttgagaggcttagaaagcagaggatgcaatgag

SEQ ID NO: 32624 - DNA, 415 bp, Zea mays
  unsure at all n locations
  Clone ID: LIB3059-005-Q1-K1-D7
gaaggattgaagcatgctggtttgttttggtttggtttgtatgttccattccagtgcagcgcggtggcgcagaacgagtgcaacaacggctgcgccggcgggctgatgacgaacgcgtactcgtacctgatggagtccggcggcctgatggagcagagcgcgtacccgtacacgggcgcggcggggccctgccgcttcgacccgacccaggtcgccgtccgcgtggccaacttcaccgccgtgccggccggcgacgaggcccagatccgcgcggcgctcgtccgccgcgggcccctcgcggtggggctcaacgcggcgttcatgcagacgtacgtgggcggngtgtcgtgccctctcatctgcccgcgcgcatgggtcaaccacggcgtgctcctcgtcggctacggcgcgcgcg

SEQ ID NO: 32625 - DNA, 439 bp, Zea mays
  Clone ID: LIB3059-005-Q1-K1-D8
cagacacgtaaggacgcggtgaaccctggcacctacttgcaacagcaattgcttgcatgcaacccacttgctatggcgaacgtaactggataccagcaacaacaacagatgaaacagttcatgccagtgctcagacaactagccatggtgaaccctgacgtctacctacaactactttcatctagcccgctcgcggtgggcaatgcacctacgtacctacaacaacagctgctgcaacaaattgtaccagctctgactcagctagctgcggcaaaccctgctgcctacttacaacagttgcttgcattcaaccaactggctgagtcaaactctgctgcgtacctacaacagcgacaacagttacttaatccattggcagtggctaacccattggtcgctaccttcctgcagcagcaacaacaattgctgccatacaacc

SEQ ID NO: 32626 - DNA, 411 bp, Zea mays
  Clone ID: LIB3059-005-Q1-K1-D9
ctgcagccctccatccacgaactcccgttctccatttacacccatggcggtgtcgatcgagctcaccaaggagtacggctacgtcgtgctggtgctggtggcctatgtcttcctcaacctttggatgggcttccaggtcggcaaggcccgcagaaactacaaggtgttctaccccaccatgtacgccatcgagtcggagaacaaggacgccaagctcttcaactgcgtgcagagggggcaccagaactctctagagtggatgcccgttttcttcgtcatactgctgctgggcggtctgcagcacccgaccatcgccgccggtctgggcggcatctacatcgtcgcgaggttcttctacttcaagggatacgccaccggcgttccggacaaccgtctcaagattggggggct

SEQ ID NO: 32627 - DNA, 418 bp, Zea mays
  Clone ID: LIB3059-005-Q1-K1-E10
gtcgaccagcacattcgctacttcctgcacgctgttgggcaatgttagaacaacgcaggcctcccagacagcggtgaagagcccttcgtctctaagcttcttcagccaagttacgaaggttccaagcctgaagacctccaagaaactggatgtctccgccatggctgtatacaaggtgaagcttgtcgggcctgaaggtgaagagcacgagtttgatgctccagacgacgcctacatccttgacgcagccgagactgccggtgtggagttgccatactcgtgccgtgctggggcttgctccacctgtgccggcaaaatcgagtctggttcggttgaccagtcggatgggtccttccttgatgacgggcagcaggaggaaggttatgtgctgacatgcgtctcctacccaaagtccgac

SEQ ID NO: 32628 - DNA, 297 bp, Zea mays
  Clone ID: LIB3059-005-Q1-K1-E11
cggacgcgtgggacaactactaccattcagccagctagctggtgtgagccctgctaccttcttgacacaaccacagttgttgccgttctaccagcacgctgcgcctaacgctggcaccctcttacaactgcaacaattgctgccattcaaccaacttgctttgacaaacccagcagcattctaccaacaacccatcattggtggtgccctcttttagatttcttatgagttatagttcaataataaagttttttgtctgatgtttgtggcttcccagaaataagaaagtacatttct

SEQ ID NO: 32629 - DNA, 375 bp, Zea mays
  Clone ID: LIB3059-005-Q1-K1-E12
cccacgcgtccgcgcaaattgcaccaagaaatccatcgagaggccgtcgacaggggaattaatggcgtcgtcgtctagcagcagccaccgccgcctcatcctcgcagccgccgtcctgctctccgtgctcgcggctgccagcgccagcgccgggacctcctgcgtgccggggtgggccatcccgcacaacccgctcccgagctgccgctggtacgtgaccagccggacctgcggcatcgggccgcgcctcccgtggccggagctgaagaggagatgctgccgggagctggcggacatcccggcgtactgccggtgcacggcgctgagcatcctcatggacggcgcgatcccggcgggcccggacgcgcagctgga

SEQ ID NO: 32630 - DNA, 447 bp, Zea mays
  Clone ID: LIB3059-005-Q1-K1-E2
atcgttctcgtcgtgtgcctggctctgtcagctgccagcgcctctgcaatgcagatgccctgcccctgcgcggggctgcagggcttgtacggcgctggcgccggcctgacgacgatgatgggcgccggcgggctgtacccctacgcggagtacctgaggcagccgcagtgcagcccgctggcggcggcgccctactacgccgggtgtgggcagccgagcgccatgttccagccgctccggcaacagtgctgccagcagcagatgaggatgatggacgtgcagtccgtcgcgcagcagctgcagatgatgatgcagcttgagcgtgccgctgccgccagcagcagcctgtacgagccagctctgatgcagcagcagcagcagctgctggcagcccaaggtctcaaccccatggccatgatgatggcgcagaacatgccggccatgggt

SEQ ID NO: 32631 - DNA, 443 bp, Zea mays
  unsure at all n locations
  Clone ID: LIB3059-005-Q1-K1-E5
gtgctacctctgatcaaccaagtagctctggcaaacctttctccctactctcagcaacaacaatttcttccattcaaccaactgtctacactgaaccctgctgcttatttgcagcaacaactattaccatttagccagctagctactgcctactctcagcaacaacaacttcttccatttaaccaattggccgcactgaaccccgctgcttatttgcagcagcaaatactactaccatttagccagctagctgcagcaaaccgtgcttccttcttgacacagcaacagttgctgcctttctaccagcagtttgcggctaaccccgcaaccctcttacaactacaacaattgttgccctttgtccaacttgctttgacagacccagcggcctnctaccaacaacacatcattggtggtgccctcttttagattgcttattagtt

SEQ ID NO: 32632 - DNA, 444 bp, Zea mays
  Clone ID: LIB3059-005-Q1-K1-E6
cccacgcgtccggccatcttcttcgtcgacaagcaggggagttaggtctcacatgcatgcttcatcacattgttgactgcataacgaaacacatcgtcgtcggatcggagatgatgagttccgtcgtcgtggatgctgctgctaccagcagcagcgagaagaagacgtcgtggccggaggtggtgggcatgtccatcaaggaggcgacggagactattctcaaggacatgcccaacgcgtacatccaggtgctgcctgttgggtcgcccgtgacgctggaccttcgccccgaccgcgtccgtatcttcgttgacaccgtcgccatgactccgacagttgggtgatacataccaaatgcaataaacaaaccctactttatattttatgtttccagttaataataaaccaggccttagcttcttggttgtccttgcttggttggtg

SEQ ID NO: 32633 - DNA, 425 bp, Zea mays
  Clone ID: LIB3059-005-Q1-K1-E7
catagaaagtggaatacagtagcaacaatagagcaacaatggcggcaaagatattttccatccttatgctccttgctctttcttcatgtgttcctaacgcgaccatttttcctccatactcacaagctcctatagctgcccttcttcctccataccttccataactgaccgcttcagtatgtgaaaacccagcccttcaaccctataggctccaacaagcaatcgcaacaaacaacttacctttatcacacctgttctttcaacaatcgccagccctatctttggtgcagtcattggtacaaaccatcagggcacaacagctgcaacaactcgtgctaccagtgatcagctaagtagctctagcaaacctttctccctactctcagcaacaacaatttcttccattcaaccaactgtctacactg

SEQ ID NO: 32634 - DNA, 412 bp, Zea mays
  Clone ID: LIB3059-005-Q1-K1-D12
agtggctccaacaatccaccggctccttcccagcgcggcgccaccggcgacccgtacccccttccccggagagcgatggcgacggatctgacggctgctcatctgcgcgcgtacgacggtaccgaccctttcaagcgcatctacgtcttcgtccggcgcatggtctacgacgtcacctacggccgcggcttctacggccccggcggcgcctacgccgtcttcgcggacctggaggccagccgcgccctcggcaagatgtccaatgacgaagccgacgtctccggggacctctgcgggctcaccgtcaatgagctcggcgtgctcgtcgactgggagatcaagttccaggccaagtaccccgtatgtttccgactctccgtcgactcctgaactcgtcggtctagggctaaat

SEQ ID NO: 32635 - DNA, 353 bp, Zea mays
  unsure at all n locations
  Clone ID: LIB3059-005-Q1-K1-B8
gccattctgggaatggatgagctcagtgaagatgacaagttgacagttgctcgtgctaggaagattcagcggttccttagccagcctttccatgttgctgaagttttcacgggtgcacctggaaagtacgttgagctgaaggagagtgttaaaagtttccagggcgttttggatggcaagtatgatgaccttccagaacagtcattctacatggttggaggaatagaggaggtcatcgccaaggcagagaagattgccaaggaatctgcatcataaggggtctacaggcaacgcanaattaacttttggaggtcaacgtgatgtgctttttatcctgtgttatcaagaactta

SEQ ID NO: 32636 - DNA, 356 bp, Zea mays
  Clone ID: LIB3059-005-Q1-K1-B9
caagaagaacgtggtcgagatgcccggcaatggcgacgtgcccttcacccacgccaacatcaccctcgccaggcagcagctcgggtacaagcccaccaccaacctcgatgtcggcctcaagaagttcgtcaagtggtaccagtcctactacggctacaccaggggatccaagaactcgcgacaatgatccatgctaattcttccttcttcctttctcgctttggcccggccgcggccacccactctcggatcaaacattgacattcttatcaggatttttttggtggaaatatgttatgttaaggtgttcctttattaagtagagaaataccggggacaaattctttgcttgggga

SEQ ID NO: 32637 - DNA, 391 bp, Zea mays
  unsure at all n locations
  Clone ID: LIB3059-005-Q1-K1-C1
tacaacagcaacaactgctttcatctagcccgctcgctgtggccaatgcacctacatacctgcaacaagaattggtgcaacagattgtaccagctctaaactaactagctgtggcaaaccctggttgctacttgcaacaactggtttcatttaaccaactaactatgtgaaacttgtgggtcctacacaaggccacagtactaaatcatggcagtggctaacccattggtcgctgccttnctacagcagcaacaattgctgccatacaaccggttctctttgatgaatcctgtcttgtcgaggcagcaacccatcgttggaggtgccatcttttagattacatatgagatgtactcgataatggtgccctcataccggcatgtgtttccta

SEQ ID NO: 32638 - DNA, 421 bp, Zea mays
  Clone ID: LIB3059-005-Q1-K1-C10
cggacgcgtgggtttcacctattatattccatgaaagcgtcatgattgcagttgctcgtggtgataacactggggaatcaattcctatgctcctaaggataccccgcttctttgatccatggggtggttatgatatgataggctttggtgacattatcttccctggattgcttgttggattcagctatagatttgacagagcaaacagaaagggtgtcttgagtggatattgtctctggctaattgtgggatatgcagttggccttttcattacgtatcttgcgctgttcttgatggacgggcatggtcaacctgcgttgttgtaccttgtgccatgtacattgggggttattggtattcttggttggttaagaggtgagctttatgaattatggaacttcggaaaaagtccaggagaaaa

SEQ ID NO: 32639 - DNA, 441 bp, Zea mays
  Clone ID: LIB3059-005-Q1-K1-C2
gtcgtctccatgagctttcaaacaagcgaaggatctctattgctggtgcttccaaactgttggctaacatcctttattcatatcgtgggatgggactgtcgattggtacaatgatcgctggatgggatgagaagggtcctggcttgtactatgttgacagtgagggtgcgcggctcgtggggaacaggttctctgttggctctggttcactgtatgcttatggtatcttggatgatggttaccgcttcagcatgtcagttgaggaagcagccgaattagcgcgacgggctatttatggggcaacattccgtgatgcagcaagtggtggttgtgttagtgtttaccacgttggccctgatggttggacgaagctttctggggatgatgtcggagagctgcactaccactactacccggttcagaaaactccggttgaacagg

SEQ ID NO: 32640 - DNA, 442 bp, Zea mays
  Clone ID: LIB3059-005-Q1-K1-C5
cccacgcgtccgcccacgcgtccggcacctacagcaaagtgctttttgaggagatttgctcgtgctgcacaagcgtgtgatgaggatcctgctttgcatctggagttcctcgccaattacatcgctgagctatcactactggagtacagtctactctcttaccctccatcactaatagctgcatcggctattttcttggcgagatttatactacagccaacaaagtatccttggaattccacactcgctcattacacacagtacaaaccgtccaaactgagcgaatgtgtaaaggcattgcatcgcctttgcagcgttggttctggtagcaaccttccagcaatcagagaaaagtacagtcaacataagtacaaatttgttgcaaagaagcagtgtccaccgcagatccctactgaattctttcgggacgcgacatgctaga

SEQ ID NO: 32641 - DNA, 443 bp, Zea mays
  Clone ID: LIB3059-005-Q1-K1-C6
cggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggcggctacggtggtggccgtggaggcggcggctacggcggtggcgggcgccgtgatggcggcggcggctacggcggtggcggcggcggctacggtggcggcggtggctacggtggtggtggtggcggctacggcggtggcaaccgtggcgg

SEQ ID NO: 32642 - DNA, 441 bp, Zea mays
  Clone ID: LIB3059-005-Q1-K1-C7
cggacgcgtgggcgactcacaagcacatcaaggctcgctcgctcgcacacaccaagcaagcaggccgcagcccgcaggcgtctcacaggctctccgccgttccccaacgcgctttccccggcgccatggccaggctggcgctagcgctcctcctgctgctggccgtggcggcatccgcgtgggccggcgccggcgcgagccacctcgatctgggcctgggcttcctctcctccggggaccgccggcgggaatgccgcggcacggtggccgagtgcctggacgaggaggagggcctggacctgggggcggggcccgcgtccgtggagtcccaccgccgcgcgctctacggcggcggcggcggcggcgggtacatcagctacggcgcgctgcggcgggacaacgtgccctgctaccgccgcggtgccagctactacaactgcc

SEQ ID NO: 32643 - DNA, 418 bp, Zea mays
  Clone ID: LIB3059-005-Q1-K1-C9
ggcttatctgtatgatggttactgggaagatatcggtaccattgcggcattttataatgcaaacttgggaataaccaagaagccaatgccagatttcagcttctatgaccgttttgctccaatttatacacaacctcgacacctgccaccttcaaaggttcttgatgctgatgtgacagacagtgttattggtgaaggatgtgttattaaaaactgcaagataaaccattctgtagttggactccgatcttgcatatctgaaggtgctatcatagaggacagtttactaatgggtgcggactactatgagacagaagctgataaaaaactccttgccgaaaaaggtggcattcctattggtattgggaaaaattcatgcatcaggagagcaatcattgacaagaatgctcgaattgga

SEQ ID NO: 32644 - DNA, 420 bp, Zea mays
  Clone ID: LIB3059-005-Q1-K1-D10
cggacgcgtgggcgcaaattgcaccaagaaatccatcgagaggccgtcgacaggggaattaatggcgtcgtcgtctagcagcagccaccgccgcctcatcctcgcagccgccgtcctgctctccgtgctcgcggctgccagcgccagcgccgggacctcctgcgtgccggggtgggccatcccgcacaacccgctcccgagctgccgctggtacgtgaccagccggacctgcggcatcgggccgcgcctcccgtggccggagctgaagaggagatgctgccgggagctggcggacatcccggcgtactgccggtgcacggcgctgagcatcctcatggacggcgcgatcccgccgggcccggacgcgcagctggagggccgtctagaggacctgccgggctgcccgcgggaggtgcagag

SEQ ID NO: 32645 - DNA, 363 bp, Zea mays
  Clone ID: LIB3059-005-Q1-K1-D11
agtggctccaacaatccaccggcaccaacccagcgcggcgccaccggcgacccgtaccccctcccccggagagcgatggcgacggagctgacggcggctcatctgcgcgcgtacgacggcaccgacccgttcaagcccatctacgtctccgtccggggcaaggtctacgacgtcacctgcggccgcgggttctacggccccggcggcgcctacgccgtcttcgcgggccgcgaggccagccgcgccctcggcaagatgtccaaggacgaagccgacgtctccggggacctgtccgggctcaccgacaaggagctcggcgttctcgccgactgggagatcaagttccaggccaagttccccgtc

SEQ ID NO: 32646 - DNA, 441 bp, Zea mays
  Clone ID: LIB3059-005-Q1-K1-B7
accaattgcaacaacaatccttggcacatctaaccatacaaaccatcgcaacacaacagcaacaacagttcctaccagcactgagccaactagatgtggtgaaccctgtcgcctacttgcaacagcaggtgcttgcatccaacccacttgctctggcaaacgtagctgcataccaacaacaacaacaattgcaacagtttctgccagcgctcagtcaactagccatggtgaaccctgccgcctacctacaacagcaacaactgctttcatctagccctctcgttgtgggtaatgcacctacatacctgcaacaacaattgctgcaacagattgtaccagctctgactcagctagctgtggcaaaccctgctgcctacttgcaacagctgcttccattcaaccaactgactgtgtcgaactctgctgcgtacctacaacagc

SEQ ID NO: 32647 - DNA, 435 bp, Zea mays
  unsure at all n locations
  Clone ID: LIB3059-004-Q1-K1-H7
atccagatcagcaaagcggcagtgcgtagagaggatcgtcgaacagaacagcatgaagatggtcatcgttctcgtcgtgtgcctggctctgtcagctgccagcgcctctgcaatgcagatgccctgcccctgcgcggggctgcagggcttgtacggcgctggcgccggcctgacgacgatgatgggcgccggcgggctgtacccctacgcggagtacctgaggcagccgcagtgcagcccgctggcggcggcgccctactacgccgggtgtgggcagccgagcgccatgttccagccgctccggcaacagtgctgccagcagcagatgaggatgatggacgtgcagtccgtcgcgcagcagctgcagatgatgatgcagctngagcgtgccgctgccgncagcagcagcctgtacgagccagctctgatgcagca

SEQ ID NO: 32648 - DNA, 282 bp, Zea mays
  Clone ID: LIB3059-004-Q1-K1-H9
cggacgcgtgggaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggaaaaaataataaagtagaaaaaaaaaagaatagaaggaagaaaaataaattagtattgaattaaagatattaaaaagaaaattaagagtaaatgattaaaaaaagtgaaggaatgaaaaa

SEQ ID NO: 32649 - DNA, 387 bp, Zea mays
  Clone ID: LIB3059-005-Q1-K1-A10
cggacgcgtgggcggacgcgtgggcggacgcgtgggcggacgcgtgggctcagttttcatgaaaggttctatggatcacgcggaagggacgagagcagatcaaacaatgatggattccgtgctaggagcagaagtcctggcaagcctgtggaagtttccaactggtgattgcatccactaggtgcaatccaatttttgcgatggtgacgaaaccaagtaaaagatggtacctcgacaagttatattttcctcttatcctgcttaaatctaaggatgtcctggaacatcactaacttaggatatgggtgatggtctgatcccaatggacaatggtctcctactttcttgatttgacgcctgagagacgcctgattccataccatatgc

SEQ ID NO: 32650 - DNA, 276 bp, Zea mays
  Clone ID: LIB3059-005-Q1-K1-A12
cccgatcgacaccatgagggtgttgctcgttgccctcgctctcctggctctcgctgcgagcgccacctacacgcatacaagcggcggctgcggctgtcagccaccgccgccggttcatataccgacgccggcgcatctgccacctgcggttcacctgccacctacggtgcatctaccaccgccggtccacctgccgccgccggtccacctgccaccgacggtcgcatgtgccgccgccggttcatatgccgacgacaccatgccactaccctactc

SEQ ID NO: 32651 - DNA, 436 bp, Zea mays
  Clone ID: LIB3059-005-Q1-K1-A5
gggcacaacaactacaacaacttgtgctagcaaaccttgctgcatactctcagcaacatcagtttcttccattcaaccaactggctgcattgaactctgctgcttatttgcaacaacaattaccattcagccagctagttgctgcctacccccagcaatttcttccattcaaccaactagcagcattgaactctgctgcttatttacagcagcaacaactactaccattcagccagctagctgatgtgagccctgctgccttcttgacacaacaacagttgttgccgttctacctgcacgctatgcctaacgctggcaccctcttacaactgcaacaattgctgccattcaaccaacttgctttgacaaactcaacagtgttctaccaacaacccatcattggtggtgccctcttttagattgcttatgagttata

SEQ ID NO: 32652 - DNA, 418 bp, Zea mays
  unsure at all n locations
  Clone ID: LIB3059-005-Q1-K1-A9
cagcagcgagtgcaaccgcgagagcgatcagcgatgggctccttcttctcgaccttagtgacgccccctccggccgccgacgacccgaactgcgccgtggtggccgcgcactccaaggccacctacgacgagcagtgggcggcccacaagagcagcagcaagctgatggtgatcgacttctcggcgtcctggtgcgggccctgccgcttcatcgagccggccttcaaggagctggccttccgcttcaccgatgccatcttcgtcaaggttgacgtcgacgagctcgcggaggtcgcaaggacatggaaggtagaggcgatgccaacgttcgtgctggtcaaggatgggaaggaggtaggccgtgtgattggngctaagaaggacgagcttgagaggaagatcaggatgttcgtcacgt

SEQ ID NO: 32653 - DNA, 375 bp, Zea mays
  Clone ID: LIB3059-005-Q1-K1-B12
caactagcaacatagaaagcacaatagtgtaccaacaatggcagccaaaatattttgcctccttatagctccttggtctttctgcaagtgctgctacggcgaccattttcccacaatgctcacaagctcctatagcttcccttcttcccccgtacctgtcaccagcggtgtcttctgtatgtgaaaacccaattcttcaaccctataggatccaacaggcaatcgcagctgccatcttacctttatcacccttgttcctccaacaatcatcagccctattacagcagttacctttggcgcatctattggcacaaaacatcagggcacaacaactacaacaactcgtgctagcaaaccttgctgcctactctcagc

SEQ ID NO: 32654 - DNA, 405 bp, Zea mays
  Clone ID: LIB3059-004-Q1-K1-H6
cccacgcgtccgcccacgcgtccgcagctagctctagcaaagcacttgccatctaccgaccgccgcattccaaacagcccgacgagctagcagagcggcaggcacctccctcctcaaggaacatggcccgcatgcagcagttggcagtggcgacggcggccgtggtggccttggtgctgctggcggcggcgacctcggaggcggccatcagctgcgggcaggtggcgtcggccatcgcgccctgcatctgctacgcgcgcggccagggctcggggccctccgccggctgctgcagcggcgtcaggagcctcaacaacgccgcccgcaccaccgccgaccgccgcgccgtctgtaactgcctcaagaacgccgtcgccggcgtcagcgggctcaacgccggcaacg

SEQ ID NO: 32655 - DNA, 248 bp, Zea mays
  Clone ID: LIB3059-005-Q1-K1-B5
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggcttttaaaaggaaaaaagtttaaataggaattaatggaaagtaaaaaatttttaatggggttaaaaaaaatcaatttaagggccgttgtttaaaaaagttttaaatggaaaaaacttggggtt

SEQ ID NO: 32656 - DNA, 192 bp, Zea mays
  Clone ID: LIB3059-004-Q1-K1-G12
tcccggtcgaccagcgttcgttctgcgttcgagagaactattctgtgtgttgagcgaatcatgtgaaatggaaagtattgaactatagaagagccagcatgcatttatgaggagtatgatgacatctataatcttgcgttgcttcaagtatcatcatgatggattactgctagtttgctattgttgcattta

SEQ ID NO: 32657 - DNA, 346 bp, Zea mays
  Clone ID: LIB3059-004-Q1-K1-G2
atcttgagcaaaaatatgaattcatgacatctgatcaccagtatatttcccggaaacatgaggaggataaggtgattgtgttcgaaaagggagatttggtatttgtgttcaacttccactgcaacaacagctattttgactaccgtattggttgtcgaaagcctggggtgtataaagtggtcttggactccgacgctggactatttggtggatttagcaggatccatcacgcatccgagcacttcatcgtcgactgttcgcatgataataggccatattcattcttggtttatacaccaagctgaacatgtgtcggctattctccagttgagtgatagcggtgtac

SEQ ID NO: 32658 - DNA, 428 bp, Zea mays
  Clone ID: LIB3059-004-Q1-K1-G3
gaggagactacctacggccatggcgaggagaaggcttctcgcgctcgccttccggctctactggaggccttacgcgacgcatccgtggcggcgacccccgccccggtttctgtcctcagctgcgtccggcaccctcgatcacctgaagtcgccgcctttcgcgcgtccggctgcccggaaccccgcctgctatccatgggatcgattctgaggacggcagaagaggaccatgttcatgcagacacagtcgaccccgaacccgcagtcactcatgttctatcctggaaagccagttatggagattgggagctctgatttccctaatgctcggactgcgatgacatccgctatggctaagtcgctttctgctattgatggagtaaccagtgtattctctggatctgattttgtaactgttacagaatcag

SEQ ID NO: 32659 - DNA, 362 bp, Zea mays
  Clone ID: LIB3059-004-Q1-K1-G4
gtggagactacctacggccatggcgaggtatattgcttctggcgctcgcctaccggctctactggaggccttacgcgacgcatccgtcgcggcgacccccgccccggtttctctcctcagctgtgtccggcaccctggatcacctgaagtcgccacctttcgcgcgtcctgctgcccggaaccctgcctactatccatggtatcgatcctgaggacggcataagaggaccctgttcatccatacacacttgaccacgcacccgctttcactcatgttctatcccggatagccagctatggagattggtagctctgatttccctaatgctcggactgcagggacatctgcttcggctaagtct

SEQ ID NO: 32660 - DNA, 438 bp, Zea mays
  unsure at all n locations
  Clone ID: LIB3059-004-Q1-K1-G5
gcaggatttgactgtgactataatttgtacccagataaagatgcccagtatcacttcttcaggaattatctgcaccctgatagacctagtgaggtatgtgaaacaaaaccaattgaaatctattcttggaattcaagttctttctgaagtaaatgaagctttctgttagtacctactctatgtaatatatatttgacgctatgagtagttccatctttgcttgttttttatgaagttagtaatacctccatatgtgccacatgtgtttgacattttgagcgttgttaagctttttttctgaacaaacataggaggtctgcgtgccatttcattaacgccccgtttggatcactggaattgaattccattctaataataataatttaagcatatatcaattaagctaattcattnttatacaaaatatatttgtatact

SEQ ID NO: 32661 - DNA, 387 bp, Zea mays
  Clone ID: LIB3059-004-Q1-K1-G6
cccacgcgtccgagaaagggtagcacgaacatgggggacaactgcacctggattaccttatgtcgaggaggcaattaccaatgctggtgactggttggttggtggggacttggaggttatagaaccaatcaagtacaatgatggtctagatcagtatcgcctgtctccagcacagctgcgtgaagagtttgccaggcgcaatgctgatgcagtatttgcctttcagcttcgcaatcctgtacacaatgggcatgctcttcttatgaccgacacacgcaaacgtctccttgagatgggttataaaaaccctgttcttctgctccatccactgggaagattcacaaaagcagatgatgtgcctcttagttggagaatgaaacaacatga

SEQ ID NO: 32662 - DNA, 425 bp, Zea mays
  unsure at all n locations
  Clone ID: LIB3059-004-Q1-K1-G7
cggtagccggcggcggcggaggaggaaagcaggcaggccatggcgtcgtcgtcgtcgaccccggcggccgtccgcgagatgcagaaggatctcgaggtccaggccaacgccctcagcaagatccagaaagacatcgccaagaaccaccaggtccgcaagcagtacaccatccaggtcggcgagaacgagctcgtcctcaaggagctggagctgctcagcgatggggccaacgtgtacaagctcatcggaccggtgctggtcaagcaggacctcgcggaggccaaggccaacgtcaagaagcgcatcgagtacatctccgcagagctgaagcggatggatcgggcgctcaaagacttggaggaaaagcaaaacagcaagaaggaatcgatattcaagttgcagcagaggatgcangctgtacaagc

SEQ ID NO: 32663 - DNA, 441 bp, Zea mays
  Clone ID: LIB3059-004-Q1-K1-G8
ctgcgcctctacatttcttctctctctgctcctccgcctccgcctgatccatccaagacagggatcgccatgtcggactcggaggagcaccacttcgaatcgaaggccgacgctggggcgtccaagacctacccgcagcaggctggcaccgtccgtaagaacggcttcatcgtcatcaagaaccgtccctgcaaggttgtggaggtttctacctccaagactggtaagcatggccacgccaaatgccactttgtcgccatagacatattcaatgggaaaaagcttgaagatattgttccttcatcacacaactgtgacattccgcatgtgaaccgtactgagtatcagctgattgatatttctgaggatggatttgtgagccttcttacttcagatggcaacactaaggatgatcttagactcccaactgatgagactctt

SEQ ID NO: 32664 - DNA, 276 bp, Zea mays
  Clone ID: LIB3059-004-Q1-K1-G9
cccacgcgttcgccagaatctgagctcctacaaggataagaaatttgtggacattagcagggaagatttggacttaggtgatagcaatgaggaaagagaggagataaagcagcagttcagccaaacctgtgattggataaagaatcgcttgggtgacaaggttgcacgtgttggcatatctaatcgtctgaggtcatcgccatgtggttcagttgcagcgaagattggttggatagcctatattgaaaggctaatgagagcacagactatgtgtga

SEQ ID NO: 32665 - DNA, 414 bp, Zea mays
  Clone ID: LIB3059-004-Q1-K1-H1
cccacgcgtccgcggacgcgtgggcaccaacgacaagggccgtctctccaaggaggagatcgagaagatggttcaggacgctgagaagtacaagtctgaggatgaggagcacaagaagaaggtggaggccaagaactcgctggagaactactcctacaacatgcgcaacacgatcaaggacgagaagattgcgtccaagctgccggccgatgacaagaagaagatcgaggacgccatcgacgcggccatcagctggctggacgccaaccagctcgccgaggcggacgagttcgaggacaagatgaaggagctggagagcctctgcaaccccatcatcgccaagatgtaccagggcgcgggtgaagacatgggcggcgctggcggcatggacgaggacgcccctgccggcagcgg

SEQ ID NO: 32666 - DNA, 390 bp, Zea mays
  unsure at all n locations
  Clone ID: LIB3059-004-Q1-K1-H11
ctcattttaactccaccactccattgtccattctccctggctgcctctcgttgctgttgttgttgctgctcttctctagcttgctttcccccaattggcctctctgcactcttgagcttctttgccttgttggacttggtagctgtggcgttgccgaaatgggcgctccctaccacctncaatcaccaagaaccatcataaccaaggtaatgagcatgaagcagctgccaccggccctgccacagctgccgtcgtcgccggtggatcagtccgaggtgaccgagcagacatccgtgctgccacggtcgcagccggtggatccacccacgataaccaggcagccacaggcgccccggcagccagcgcggtcgccttccaaggtaatcctgc

SEQ ID NO: 32667 - DNA, 340 bp, Zea mays
  Clone ID: LIB3059-004-Q1-K1-H12
ttcctgcaagtgctgctacggccaccattttcccgcaatgctcacaagctcctatagcttcccttcttcccccgtacctctcaccagcggtgtcttcggtatgtgaaaacccaattcttcaaccctacaggatccaacaggcaatcgcagctggcatcttacctttatcacccttgttcctccaacaatcatcagccctattacagcagttacctttggtgcatttattggcacaaaacatcagggcacatcaactacaacaacttgtgctagcaaaccttgctgcctactctcagcaacagcagtttcttccattcaaccaactagctgcattgaactc

SEQ ID NO: 32668 - DNA, 442 bp, Zea mays
  Clone ID: LIB3059-004-Q1-K1-H3
aacatacctttatcacccttgttgtttcaacaatcgccagccctatctttggtgcagtcattggtacaaaccatcagggcacagcagctgcagcaactcgtgctacctgtgatcaaccaagtagctctggcaaacctttctccctactctcagcaacaacaatttcttccattcaaccaactgtctacactgaaccctgctgcttatttgcagcaacaactattaccattcagccagctagctactgcctactctcagcaacaacaacttcttccatttaaccaattggccgcactgaaccccgctgcttatttgcagcagcaaatactactaccatttagccagctagctgcagcaaaccgtgcttccttcttgacacagcaacagttgctgcctttctaccagcagtttgcggctaaccccgcaaccctcttacaactac

SEQ ID NO: 32669 - DNA, 406 bp, Zea mays
  Clone ID: LIB3059-004-Q1-K1-G11
cttacgctcttgccacgcacctttcaccagtgttgacttcagtatgtgaaaacccaattcttcaaccctacaggatccaacatgctattgcatcaggcatcttacctttatcacccttgttcctccaacaatcatcatccctattacagcagttacctttggtgcatttattggcacaaaacatcacggctcaacatctcgtgctagcaaaccttgctgcctactctcagctacaacagttacctttggtgcatttgttggcacaaaacatcagggcacaacatctacaacatctcgtgctagcaaaccttgctgcctactctcagcaacatcagtttctgccattcaaccaactagctgcattgaactctgctgcttatttgcaacatcaactagtactaccatt

SEQ ID NO: 32670 - DNA, 432 bp, Zea mays
  Clone ID: LIB3059-004-Q1-K1-E3
cccacgcgttcgctggccatcgcaatccccagcatctggacgctcttcgagtactccgggtccacgttcgcggtcaccatctcgttgatcttccctggcgccatagttctcagggatgttcatggaatagcgaagcgcaaggacaaggcattggcggcaacgatgatcgttctggcagtggtcacgagcagcatcgccattgcctcgaacatcatgagctccatcagtgacgaagacagaagaggtcatgtagctggtagacgataatggctcaaatcgaatcaaattaaaatgtggtttccaggccaaccgcgcgtgaagattgctgctcgtgtcatgcgttcctactgggtattctttctttgcagcgagattgctttggcccctgagatgcaagtttagtctgtgccccctcatggtgtagatgtttgt

SEQ ID NO: 32671 - DNA, 401 bp, Zea mays
  Clone ID: LIB3059-004-Q1-K1-E5
cccacgcgtccgattgaaccgtgctgcttacttgcagcagctactattaccattcagacagatagctactgcctactctcaacaacaacaacttattacatttaaccaattggccgcactgaaccccgctgattatttgcagcaacagatactactaccatgtagccagctagctgcatcaagccgcgcttccttcttgacacaggagcagacgctgcctttctaccagcaggttgcggctaacctcacgaccattttacaactactacaatagctgccctgtgtccaacttgctttgacaaaccgagtagcctgctaccaacagcacatcattggtggtgccctattgaagactgcttattagatgtaactcactactcaagtctttgggatgatgtatg

SEQ ID NO: 32672 - DNA, 411 bp, Zea mays
  Clone ID: LIB3059-004-Q1-K1-E8
cgcaaattgcaccaagaaatccatcgagaggccgtcgacaggggaattaatggcgtcgtcgtctagcagcagccaccgccgcctcatcctcgcagccgccgtcctgctctccgtgctcgcggctgccagcgccagcgccgggacctcctgcgtgccggggtgggccatcccgcacaacccgctcccgagctgccgctggtacgtgaccagccggacctgcggcatcgggccgcgcctcccgtggccggagctgaagaggagatgctgccgggagctggcggacatcccggcgtactgccggtgcacggcgctgagcatcctcatggacggcgcgatcccgccgggcccggacgcgcagctggagggccgtctagaggacctgccgggctgcccgcgggaggtgcagagggg

SEQ ID NO: 32673 - DNA, 345 bp, Zea mays
  Clone ID: LIB3059-004-Q1-K1-E9
gaccgctcctgagtacgttcacgaggaagaagctcaacaaatagcacctgaagtacatgatgtggtcgaaaactatacttattctgagccacaacagcaagtagtgtcggacaactggggagaggagcctcttcctgaagaaccgccttctttctcaaatgaaatggcagtcgctcctgaggagccagtgcaagctccacctgtgccacttcctcacgtggatgagcctgtttgtgaaccagtaaagaagacttatgcttccatcctaaaaaccgcaaaggctcctgcattcccagtagcccagcaagtacctgtgagtaagccttctcaccctacaacagagtc

SEQ ID NO: 32674 - DNA, 435 bp, Zea mays
  Clone ID: LIB3059-004-Q1-K1-F1
cccacgcgtccgggctggggtacacatgggcattctgtaccagcggtggaaggcgccggcgacgatgacgaaccagtgtgtgttattattattagaagacaacgttgtatttctgtagctgaattgttgagttgcggatatcattgtgctgctaaggttaatgtgacgataaagttaatgtcaagagttaccttccttcgcgtgtatgtactctgattattcaggctgtttttggctgggattaatctggtcttatctgaattccctatctgaaatagagaattgttcggtgtgcattttgtgaccaataaatatttttaatattttatttttttatttaatatttaaaaaagggcggtcgtttttgaggttccaagctttctttctctttcatgctacttattagctcttttttagtggtacttaaatttaatt

SEQ ID NO: 32675 - DNA, 198 bp, Zea mays
  Clone ID: LIB3059-004-Q1-K1-F10
acacacaatttctaagtcccatgtgttcttttggcgcttattggattagtgaatgctttccgtcaaggtttgagaatcgattcagtgtcctgcacatattcatatgatacttgctattgggagtatgattttcatgccaccttgcaacttgtcctacaacagagtgcgtgactccaatggtctgggagatcctcttta

SEQ ID NO: 32676 - DNA, 417 bp, Zea mays
  Clone ID: LIB3059-004-Q1-K1-F11
attggccgaacctgaaaggcgaacgggttcgattggcatcttattggtgaagactatgcagcgggggtcgggttggccttgagcctcccaaattggaaagcccgctgtttacatggctagcgttgacattgaaaggaaaagcatacgatgctccgacacaaaaactgcatcagctttgtgttggaagatgtctacagaaacccatgcccgctgcatgtagaaggaccaggtgccgattcaaagcctatttcattgggcgtttgagatcaagactatatgggcagaataaaaaagtttgcagaatacttggagaaggtgaaaaggattgtgaagcctgtgtgctcgcaggatgttcttaaaactgcgctgaatgccatggcttctgtgacggaaacactggacatcatggacttcatc

SEQ ID NO: 32677 - DNA, 72 bp, Zea mays
  Clone ID: LIB3059-004-Q1-K1-F12
ctgaggaggagctggaccgagccacaatttgtttcgcgcgtgactagatacagaagcacaggggcacagatg

SEQ ID NO: 32678 - DNA, 256 bp, Zea mays
  Clone ID: LIB3059-004-Q1-K1-F3
cccacgcgtccgcccacgcgtacggattgtgcttgtgggctagctttgcttctgataatcatagctttctgcaaaaaaaaaaaaaatataaaaacaaaataacaaaataaaaaaaaaaaaacaaaaaataaaaaaaaaaaaaaaaagaaacaaaaaaagataatatgctaaaaacacaaaaacataaaaatagaagatgcaaaaaaaagggggcccaacaaaagaaacgcaggatttaaaccagttcatacccaac

SEQ ID NO: 32679 - DNA, 435 bp, Zea mays
  Clone ID: LIB3059-004-Q1-K1-F5
cccacgcgtccggaattatgcttgaggatcaggtggcacctaaagcatgtggacatactgaaggaaggaaagtcatatcaagggaggaagctgtcatgcacataaaagctgctgtagatgctaggaaagagagtggctctgacattgttattgtagcaaggacagattctcgccaagctatttctcatgatgaagcattatggagggtgaaagcatttgctgatgctggagcagatgttctatttattgatgcccttgcttcagtagaagagatgaaagcattttgtgcggttgcaccagaagttccaaagatggcaaacatgttagaaggtggtggtaaaactcccatattgagccctgctgaacttgaagaaattggtttcaggcttgtagtatatcctttatccttagttggggtatcaatgcgtgcaatgc

SEQ ID NO: 32680 - DNA, 393 bp, Zea mays
  Clone ID: LIB3059-004-Q1-K1-F6
cccacgcgtccggtgcaaatctaaagagcttgcactgactgactaaaacatgaacataatatgatccgacatctgctatacaaggctctatgctaatgctctcaaaagctgtagcagtcagatgattctcactgccaaaagggacctatatacctatcaactcaaacctaaactatggctattataacaagtctaccggttgaatatccaaagcctataaaaagctatcgttggatctactgacaactgacaccgacatagtaggtaatttctcaaactaaatgtaatacactaggtaccacattatagaacatcaatgcactgcttgttgtcatctagatctacggtcagagctgacgactgatgactgaaacctgtgatcatgcattacgt

SEQ ID NO: 32681 - DNA, 438 bp, Zea mays
  unsure at all n locations
  Clone ID: LIB3059-004-Q1-K1-F7
ggatattcatgttgaatgcgaaattagcaccagtagagagcatggcgcccatatggggttcgagatatgcttggggttaaaataaacatgacaacttggacgctgtagactgaccctagagcatctatcaaaggaaccagacagcgatcatgagtttaggaggcaacggagggcaataacaaggactcatctgacacacaaggattctgggagttgaggagagtgcttcacaacaagagatagagaaggcgtatcacaaattggctctgcgcctccacccggatacgaatcctgngaacgagccaaagagaagtttcagtagttgcagaaggttatatccattcttggagatacagagaaaagagctttatatgatgagactgacatcagtgatgacgatacaatcttcaggagtacttncgaacaatgtacaaaaag

SEQ ID NO: 32682 - DNA, 299 bp, Zea mays
  Clone ID: LIB3059-004-Q1-K1-F8
cccacgcgttcggcattgggacctacttttgagcacagagtatggggcccatatgaggcaatcgatgtccttgtacttccatggactataacggcaccggcgctggagactgggcgtagagcatctatcaaaggaaccagacagggatcatgagtgtaggaggcatcggagggcaatatcatggactcatttgactcacaaggattctggaagttgaggagagtgcttgacaacttgagatatagaaggcttatcacaatttggctctgctcttttatccttattctattcctgtgaac

SEQ ID NO: 32683 - DNA, 340 bp, Zea mays
  Clone ID: LIB3059-004-Q1-K1-F9
acaacacaatttctaatgtcccatgtgttcttttggcgcttattggattagtgaatgctttccgccaaggttttgagaagcgattcagtgtcctgcacatatccaatatgatacttgctattgggagtatgatttttcatgccaccttgcaacttgtcctacaacagagtgactagactccaatggtctgggagatccttctttatatgtatgtcctttattcgccggactggcattacaggagcacaatgccaaccttccttttcctatatggtgctgcctttgctgtagttcatttctttgccctgttccaattcgtattcaagcttcattacattgg

SEQ ID NO: 32684 - DNA, 428 bp, Zea mays
  unsure at all n locations
  Clone ID: LIB3059-004-Q1-K1-E2
gttaggcgctagccaggtgttaggctactgaccagcgtctaggaagtttaaacgtagattaagcatgcttaatcattcttttgtagattttgtgctgctgagagcaaggtcagtagtaagtactaagtaataataacacaactcttgctgttgctgcacacttgtttttgacataagttgctttcctccttggcttcttgcatccaacagcagctgatcatctatgagggatatctcaatattgtacatgcacagcgaagcttccaaacaacagggcagcatcacaaggcaaaggatcacaagaaaatatacacaaaaaaacactcacagttcatcacatgccttaatggtttaagttattccaaagaataggtctatagatcctngtcccttgtatgggagaagagttctttgatgattggtgggag

SEQ ID NO: 32685 - DNA, 434 bp, Zea mays
  Clone ID: LIB3059-004-Q1-K1-C6
ccgcgacaaggtgcagcagttcatgaccattaccggcgccagtgagaaggttgcccttcaggcactgaaagctagtgattggcacttggaaggagcttttgacttcttctatagccaacctcaggtttctgtggtcaatactcggcatcttgaagatattttcaacagatataaagaacctgatgctgatatgataatggtggaaggaatatctcaattttgcaatgatctgcaggttgatcctcaggatattgtcatgcttgtcatatcatggcacatgaaagccgccacaatgtgtgaatttactcgtcaggaattcattggtggactgcagtcaattggggtagattcaatcgagaagtttcgtggaaaattaccatcattacgagctgagctaaaagatgacaataaattccgtgatatatacaactttg

SEQ ID NO: 32686 - DNA, 437 bp, Zea mays
  Clone ID: LIB3059-004-Q1-K1-C7
ggaggctaccctgagggattggagaggcccaaggatccaggactgaactccttgcggaccacaagagaactgaaagaaggaatggttatcacagtggagccaggctgctatttcattgatgctttgctaactaaaacaagggatgatccaatttcctcaaagttcttcaactggcaagaggttgaaaagtataaaagctttggtggcgttcgcattgaaagtgatgtgtatgtgacggctcaaggatgccggaacctcacaaactgcccgagagagacctgggagatcgaggctgtaatggctggcgcaccatggcctctgccggcttcaagttctatggtggtagcagcagagaatagcaatgacatatctaaagcgtcgtaattttctctatgctcaatccatatcccgagttgaaacaaattcgacctggattc

SEQ ID NO: 32687 - DNA, 431 bp, Zea mays
  Clone ID: LIB3059-004-Q1-K1-C8
ccgaactccaaaccctagcttcgctcgttgcggcggcgagccggcgatggcgaagtctctgcgatccaaacgcgagaagcggcttcggacgttgcgccgggagatagcagagccgttctacgacaagaaggaggccgccaagctcgccgcgcaggccgcagccctagctgctgccccgctcccggtccgcgggcccccgccgtcccaggatgccggcaccccccgcgccgctagctcggcctcggctatggatgtggagatgtctggtgcagggaacagcaggtctaagaccatcttgaggccacttggcagcattagcaagaagaaggtgcagcttcatttgaagatcaagaaagacaagagaaaagctaggaagaagggaaagttttcttttaagaagtagacgagtgtatgataaatcatgcaggttt

SEQ ID NO: 32688 - DNA, 316 bp, Zea mays
  Clone ID: LIB3059-004-Q1-K1-C9
atcacatgtgatcgccacgaacgtccgcatgctgggaatgggcactgatcagcctgacagtcgagagagctctcgaatcgcgcctaggtatgccagataggaggccctgtgagccgcatttgccatggacgcgttctttgcttcagcctggaatgattccttccaggaggcttgccacaacggcatccgcatcatcgcccaacctggacgcagtatgaatgacgaggacgccgtcgcgtgctgcaacaagtattgtgtgtcactcggtctctacggcattaggcactttatgcattatccgtcatgccccatggct

SEQ ID NO: 32689 - DNA, 442 bp, Zea mays
  Clone ID: LIB3059-004-Q1-K1-D1
catccccatcctcttcctttcttagtatgtgctatactagctcgctgctgccttttgttacaatgtttgtacggtcgcaataaatgtatggtcgtgtattctcgagagctacttatgttttttttttcttatatttcttattcattttttatattttttgtgatttgtttttttttttatttttatttgttttttatcatatatttttttgttgttatttatcatattttatatattttatattttatttattttttttttttttattttattttttttatttttattttttgtatatttattttatttttcttttatattatttttttttattgtttttattttttttttatttgttttttgatttattttttttttaaatattttttttttttattttatttttattttatttatttttttttttattttattttttttt

SEQ ID NO: 32690 - DNA, 167 bp, Zea mays
  Clone ID: LIB3059-004-Q1-K1-D12
gtcctagaaagcgtgctgtccaaagtcttgaagtattttccaagttacgatctaggaaaactagctcatgggatattgtacgtcattacttcgaagagaaatcctagctcaagaagttgttcatagattcttgtctgagagtgtgcctgacaacagatgctcgtact

SEQ ID NO: 32691 - DNA, 171 bp, Zea mays
  Clone ID: LIB3059-004-Q1-K1-D2
atcaatcacccttgaggtggagtctttttatttcattgacaatgtcaaggccaacatccaggacacggagggcatcctaaaggacctgcagcacgctgatctttgagatcacgcagccggtctacgaccgtaatgtggccggcaagttcgtctagcatgccggaactctag

SEQ ID NO: 32692 - DNA, 216 bp, Zea mays
  Clone ID: LIB3059-004-Q1-K1-D4
gatcaccctgacaaggagggggctatctataccttacatgtcatcatcatgaaccaccctggccagattggcaatggctatgccccagttctggactgccacaccttacacattgctgtcaagttagctgaactcgttaccaagattgataggctatccttctaggagctggagaaggagcccaaaattctaagaactgtgatgctggtatggtga

SEQ ID NO: 32693 - DNA, 390 bp, Zea mays
  Clone ID: LIB3059-004-Q1-K1-D6
gaaggatctgaagcgtgggtatgtggcctccaactccaaggatgaccctgccaaggaggctgctagctttacctcccaggtcatcatcatgaaccaccctggccagattggcaatggctatgccccagttctggactgccacacctcacacattgctgtcaagtttgctgagctcgttaccaagattgataggcgatccggcaaggagctggagaaggagcccaaatttctcaagaacggtgatgctggtatggtgaagatggttcccactaagcccatggtggtggagaccttttctcagtatcctcctcttggtcgatttgctgtccgtgacatgaggcaaacggtggctgtcggagtcatcaagagtgtggagaagaaagaccccaa

SEQ ID NO: 32694 - DNA, 406 bp, Zea mays
  Clone ID: LIB3059-004-Q1-K1-D8
attttgagcattcagaaacacaccaagcgaagcgcactagcaacgacctaacaacaatggctaccaagatattagccctccttgcgcttcttgccctttttgtgagcgcaacaaatgcgttcattattccacaatgctcacttgctcctagtgccattattccacagttcctcccaccagttacttcaatgggcttcgaacacctagctgtgcaagccaacatgcaacaacaagcgcttgcggcgagcgtcttacaacaaccaattgcccaattgcaacaacaatccttgccacatctaacaatacaagccatcacaacgcaacagcaacaacagttcctaccagcactgagccacctagccatggtgaaccctgccgtctacttgcaagagcagctgcttgcatt

SEQ ID NO: 32695 - DNA, 415 bp, Zea mays
  Clone ID: LIB3059-004-Q1-K1-E1
ctaaactggcactcttgaagcgagccatgggttttgttatacagcatcttggcccatcggatcgcctttcagtcatcgctttctcttcaaccgccagaaggttgttccatctccaacggatgtcacactctggccggcagcaggccctgcagactgtgaactcgcttgttgctagtggtggcacaaacattgctgatgcactgaagaaagctgcaaaggttattgaggaccgaagccatcaaaatccagtatgcagcatcattctcttgtctgatggccaagatacgtacaatattccctcaaatattaggggtgcccggccagaatacagttcactagttccatcctccattctaaaccacacatttggcttagtgccggtgcatgggtttggttttggagtagaccatgattc

SEQ ID NO: 32696 - DNA, 418 bp, Zea mays
  Clone ID: LIB3059-004-Q1-K1-E10
gagggaggcttcatgaaaggctaaagggtagattgggtgaggagataccgggtagcagtgcaaaaggtttggcagtgaaggcaagtagcagtgaggatactgaatcactgaactttgctggtccaaagagccttgcagagttgaaggcaaagaaaggtgtcggcaggtcaggagaagatgccgtcgtcaagggcttaggttcttctcgtatgacttcagaaatagtttggagcaaggaggctgtttggttgaaaggcccaaagcccctaagtgccatactgaagagaaaaagagagccagcttctgaaatccccgctgcccagcctggcatcacacaggaagcagataactacgccgcatgagctgaagaagaaatccaaaccctatcaaatgacacggttggggagaacatggaggg

SEQ ID NO: 32697 - DNA, 241 bp, Zea mays
  Clone ID: LIB3059-004-Q1-K1-E11
cgccgcctccagtccagagccaccgtgagatctgcccgattccgccgcccggacccggtgactccctcccctcctcgatccgttcgggcggccagcctacctagcttctaatgcctggatggtctataatctttacgaagttctaggctttaaccggcttgctttggccatcacaacatgattgtatcaacaacttatgtttgttggtgatctcttttaaaatagttatgagctataactc

SEQ ID NO: 32698 - DNA, 269 bp, Zea mays
  Clone ID: LIB3059-004-Q1-K1-C4
ctgccatccgtgctgatccttctgtggtcaagtcaaccaagcagccaccaaaggagcacaagaggtacaaccccaagaaactgacatacgagcagaggaaggccagtctcattgaaaggctcaaccaactcaactcctcgggcggcgcatatgacgacgacgaggatgacgagtaaagtttcgtcccatcgaagtagtgctatcttatgcggcgatcagtattcgtgctatggcatttatcgctacctgtagtctttcaacatgcattt

SEQ ID NO: 32699 - DNA, 290 bp, Zea mays
  Clone ID: LIB3059-004-Q1-K1-A10
ccaagaagacgtactgcaagaacaaagagtgcaagaagcacacactccacaaggtgactcattataagaagggcaaggatagcctgtctgcccagggaaagcgcctttatgaccgcatgcagtcaggatatggtggtcagacctagcctgtcttccacaagatggccatgtccaccaagaactttgttctgaagctcctattccagagctgctagcaatatttacagcatgccacctacagatgcatattttcctcttatgctggttacatctaaggcaggcacgcatct

SEQ ID NO: 32700 - DNA, 235 bp, Zea mays
  Clone ID: LIB3059-004-Q1-K1-A11
ggctttcacaaagtatgctctcaaatatgaaaatgatgctggcaagaaggaaattcagctgcagcttgagaagatgaagaaatatgcttctgttatccgtgtcattgctcatacccagattaggaagatgaagggtttgaagcagaagaaggctcacctgatggagattcaggtcaatggtggtaccattgctgacaaggtggactatggctacaaattctttgagaaagaggtc

SEQ ID NO: 32701 - DNA, 411 bp, Zea mays
  Clone ID: LIB3059-004-Q1-K1-A12
cgtcagcgagcgaccgcaccggcacggcgcccatccatccatcgccatcctctagcccagtccaaaggaaccctagccatgagcgccgcctccaagaagctcttccaggccgccaggtccctcgtcctctccgcttctcaccgctccgtcctcgccgccgagggccgcaccgccgcgctcgccacgctcaccaactttggcaggaagaccctccccaccgcctacttatcctaccacaagcagggatcccaccatgccgcgtcggggtggggagccatcgccgccgcagtcccagctgcagtttacatgctccaggaccaggaggctcatgctgcagagatggagcgcaccttcattgccatcaagcctgatggcgtccaaagaggccctgattctgaagatatgagccga

SEQ ID NO: 32702 - DNA, 372 bp, Zea mays
  Clone ID: LIB3059-004-Q1-K1-A4
ggctggtggagccatgctgctctggacctactccggatggaccctcatctaaagaccggaggggtggaagggctgctagtttcaacatcattcgccagcagcactggagctgctaaggctgttggcaaagtgcttcctgtcctcaatggaaaattgactggaatgtctttccgtgtcccaactgtcgatgtttctgttgttgatctgactgttaggcttgagaagtctgccacctatgatgagatcaaggctgcggtcaaggccgatgcagagggtagcctcaagggcattctgggttatgtcgaggaggaccttgtttccaccgattttcagggtgacagcaggtctagcatctttgatgcgaaagctggc

SEQ ID NO: 32703 - DNA, 438 bp, Zea mays
  Clone ID: LIB3059-004-Q1-K1-A7
cggacgcgtgggttttttttttagggaaaatccatgcttcgcaagatccaggaaattacatgaaggtagttacaacaaaaaaaaacatggtaaacaacagctttccctgcttttgtctggtagaagatatgttcaattcatcgaagtggcttgtcaaacagagaaacaatcttctatggtctatcaccaagttcagctctcaagctgtcgtacgggtagactttgggagtatatggtatcttggaggccttatcgttcaccaccgcagccacaccgagggcagcgaagaaccccagccctccgcacagccacgccaacgcctcgtacttgccgatgtgcggggcaaggcggtcgatgcagggctccgggaagggcgtgccgttgtcccacaccagctcgtcgttcacgggcaggggtttgtctgggacgatgtggcgg

SEQ ID NO: 32704 - DNA, 435 bp, Zea mays
  Clone ID: LIB3059-004-Q1-K1-A8
cttgagaaagacgaatcattgaagtctaaagatgaagagtttaaagatatgaaggataaggtcctacgcagctatgctgagatggagaatgtccttgccagaacaaagcgtgagtcagagaacaccaagaagtatgccatacagagcttctccaagagcttgttagatgttgcagacaatttgtctcgggcatcatctgttgtcaaggcaagtttctcaaagatagattcatctaacgattctgatgaagctgtaacactactgaaaaccctactagagggtgttgagatgactgagaagcaacttggagaggtcttcaagaagtttggagttgaaaagtttgatcctttgaatgagaagtttgatccaaataggcactatgccattttccaaattcctgatccttcaaaaccatcaggaactgttgcttgctgt

SEQ ID NO: 32705 - DNA, 237 bp, Zea mays
  Clone ID: LIB3059-004-Q1-K1-A9
ccgagcgcgactcgttcaccgccaaggactgggagatcctcaccgcgctctggaggaagcagcgcgagagcggcctggtggacccggccaaagcgacgcatcaggggacctacgagtcgctgtgccgcgtctccacgatcctgttcggcacgtgggagttcgaccccactgagatcgagaacccgtttcccgactgtgatggctgcgtttgcttttttctgtggctctctgtactat

SEQ ID NO: 32706 - DNA, 60 bp, Zea mays
  Clone ID: LIB3059-004-Q1-K1-B2
cggtacgcgtgggcccgaagcaaactttttttctttggcaactagggcgatggatgtatc

SEQ ID NO: 32707 - DNA, 269 bp, Zea mays
  Clone ID: LIB3059-004-Q1-K1-B5
ccagctagctgcagcaaaccgtgcttccttcttgacacagcaacagttgctgcctttctaccagcagtttgcggctaaccccgcaaccctcttacaactacaacaattgttgccctttgtccaacttgctttgacagacccagcggcctcctaccaacaacacatcattggtggtgccctcttttagattgcttattagttgtaattcaataataaagttttttggatgatgtatgtggccaaccagaaataagaagttacatttccag

SEQ ID NO: 32708 - DNA, 439 bp, Zea mays
  Clone ID: LIB3059-004-Q1-K1-B7
cccacgcgtccgcccacgcgtccgcggacgcgtgggcaactagcaacatagaaagcacaatagtgtaccaacaatggcagccaaaatattttgcttccttatgctccttggtctttctgcaagtgttgctaccgcaaccattttcccacaatgctcacaagctcctatagcttcccttcttcccccatacctctcaccagcggtgtcttcaatgtgtgaaaacccaattgttcaaccctacaggatccaacaggcaatcgcaacaggcatcttaccattatcacccttgttcctccaacaaccgtcagccctattacagcagttacctttggtccatttggtggcacaaaacatcagggcacaacaactacaacaacttgtgctagcaaaccttgctgcatactctcagcaacatcagtttcttccattcaaccaactg

SEQ ID NO: 32709 - DNA, 113 bp, Zea mays
  Clone ID: LIB3059-004-Q1-K1-B9
cccacgcgtccgcccacgcgtccgggcggcctgtaccgaggtctcggccctagctgcatcaagctcatgcccgccgccggcatctccttcatgtgctacgaggcgtgcaagat

SEQ ID NO: 32710 - DNA, 197 bp, Zea mays
  Clone ID: LIB3059-004-Q1-K1-C1
cccacgcgtccgcggacgcgtgggaaagcggcagtgcgtagagaggatcgtcgaacagaacagcatgaagatggtcatcgttctcgtcgtgtgcctggctctgtcagctgccagcgcctctgcaatgcagatgccctgcccctgcgcggggctgcagggcttgtacggcgctggctccggcctgacgactatgatgg

SEQ ID NO: 32711 - DNA, 415 bp, Zea mays
  Clone ID: LIB3059-004-Q1-K1-C12
ctcctctggtcttccgccatggcccagcccgtattcctctcctctctccgctcccgcctctgctccgcgccgccgtcgccgcaccatcacctccagcccagccgcggctaccacgtcgagctcggcgctcgcgagaaaacgcttttggaggaggatgttgctttgaagaggttcaaatcatacaagaacagtgtgaaacaggtctccaagattgggaatgttctcactttagctgttgtatttggttgtagctacgagcttggtttgttggcggcaagcatgaagtgaaggaaaacacagtcattattccgggaagtgatccatcagcgtagactgtcattctatcagctcgtgtttttagcctgtctgtctcttttattttgtcgtgcaccatgtataaaataaaactaaacta

SEQ ID NO: 32712 - DNA, 206 bp, Zea mays
  Clone ID: LIB3059-003-Q1-K1-G11
ctatcaaaccttgttgcctactttcagcaacagcagattcttccattcaaccaactaggttcattgaactctgcttcttatttgcaacatcaacatctaccatttaatcagttacctgctatctacctccaataatatcttactattcaccaactatcaatcattgaactatactttatcatataccgcatctacaactactacca

SEQ ID NO: 32713 - DNA, 365 bp, Zea mays
  Clone ID: LIB3059-003-Q1-K1-G12
ctagactagataaaaagttcccatttccctcaattccccaacttccctcgccgcaatctctcgccgcctccagtccagagccaccgtgagatctgcccgattccgccgcccggacccggggactccctcccctcctcgatccgttcgggcggccggccggcctagcttcaagtgcggggatggtgttctacttcaaggcgcggcccgaggccggcgactataccatcttcatgggtcttgacaagtacgagaacgaggacctcatcaaatacggcttccccgaggacatctggttccatgtagataagatgtcctctgcacatgtgtatgtgagattgattaaaggtcaatcaatggatgacatg

SEQ ID NO: 32714 - DNA, 436 bp, Zea mays
  Clone ID: LIB3059-003-Q1-K1-G2
cgcgagcggcggtcggcgggtctgactcgcacggcgcacgcgctgcgtctggtgtcccctcccctggtgtggctggtggtggaggcggcccgggaggctggtcccacggcacagctgctgcggcgcacgggggtggtgtaccggcacctgacctacgcggagaacttcacatcggaggcctgggaggaggagcggcaccaccagaggaaccaggcgctagcgcacatcgagcggcaccgtctgcgcggcgtcgtcctcttcgcggggctcgccgacgtgtacgactgccgtctactggagcagctcaggcggcacatcaggacaaggagtgtgggcgcgtgggcagtggcgacagtatgggagcaggaaaagagggtggccgttgaaaggcccgtcgtcgtttgcaacaccaacaccaccaacatcaccagcgcag

SEQ ID NO: 32715 - DNA, 458 bp, Zea mays
  unsure at all n locations
  Clone ID: LIB3059-003-Q1-K1-G3
cgtccgaattccggtcgaccacgcgttcgccagcgtncgccagcgtncgacgcagaattcggccaagatgcaaaagccgcacagggggcatcagagaaagcagtggacaagttggcagccacataccaaaggccagcatcctcgtcgagaaagagccgaggctttcctcttttggtccaagccagagagatgggaagtcagcggtgaggaaagtgtccggggcaaccgtcgcgtgcatcccgctccgagttgttttcagcaggatcaacgaggcgctgagcttctcagttaatgagaatgccctagctgggtgtgggactgcttcccggctgaggaatacttggtagctaggttttgctgtttgttgttcaccgcttgctttttttgtagccatgccataatagcattggtaaatgtttagtgtggcctatcacttggagcatggtaataggtgatga

SEQ ID NO: 32716 - DNA, 305 bp, Zea mays
  unsure at all n locations
  Clone ID: LIB3059-003-Q1-K1-G4
nctgctgctggtgtagagacagtggctgtcttgccacaacatgctggcacaattgtactagcaggtgaagaaactggattactagtgtgggctgcaaaatgacggcgaatcaattgtgaatgttgctggtgttcattcaactcttcatcttccttacgaccacactatgtatggtcagaaccttactgttcagaatttcttcaattcatgagttcctgttgctgtgcaagcagccttccactacaagtacgctgggagcaagtacttgcagcctgcagcttatgacctggccgtttacatattga

SEQ ID NO: 32717 - DNA, 421 bp, Zea mays
  Clone ID: LIB3059-003-Q1-K1-G5
acgcgatcaaggcgcagctggagagggcgtgcccgggcgtggtgtcgtgcgccgacatcgtggcgctggcggcgcgcgacgccgtgtcgtaccagttcaaggcgtcgctgtggcaggtggagacggggcggcgcgacggcacggtgtcgctggcgtccaacacgggggcgctgccgtcgcccttcgcgggcttcgcgggcctgctgcagagcttctcggaccgggggctgaacctgacggacctcgtggcgctgtcgggggcgcacaccatcggcgtggcaagctgctccagcgtcaccccgcgcctgtaccaggggaacgccagcagcgtggacccgctgctggactcggcctacgcgcggacgctcatgtcgtcgtgccccaacccgtcgccggcgttggccaccgtggcgcttgacgg

SEQ ID NO: 32718 - DNA, 435 bp, Zea mays
  Clone ID: LIB3059-003-Q1-K1-G6
cccacgcgtccggaaagcacaatagtgtaccaacaatggtagccaaaatattttgcctccttatgctccttggtctttctgcaagtgctgctacgacgaccattttcccgcaatgctcacaagctcctatagcttctcttcttcccccatacctctcaccagcgttgtcttcagtatgtgaaaacccaattcttcaaccctacaggatccaacaggcaatcacagcaggcatcttacctttatcacccttgttcctccaacaatcatcagccctattacatcaattacctttggtgcatttattggcacaaaacatcagggcacaacaactacaacaactcgtgctagcaaaccttgctgcctacgctcagcaacagcagttacctttggtgcaattgttggcacaaaacatcagggcacaacaactacaacaac

SEQ ID NO: 32719 - DNA, 442 bp, Zea mays
  unsure at all n locations
  Clone ID: LIB3059-003-Q1-K1-G7
cggacgcgtgggttagaagaggtgaaacaccccctcgaggtacacagcacccagagcgaaaaaactgtggccctgccggggggaacaccaccttgcacggagagccgaaacctcctccatgcagggatctggatgcctgctaggtttgcttcggagcattacgagcacgcgcataacttggctcgtactgtaaggtgtgcaaactgcacacagcggaggctgtgttatttgtattctgaagctttcttgtgtttcgtcaagaaagcttctctaacttttatcctgcactatcagataaacggtaaattgatagagaataagatgttttcgagctcatgtttagtggcaaacgctntatatttttggcaagctgtgaaggagctgaaccagtgacaactcgaagaattcattntgttgtattaagtcttcttgttagcccatt

SEQ ID NO: 32720 - DNA, 340 bp, Zea mays
  Clone ID: LIB3059-003-Q1-K1-G8
cggacgcgtgggccagatttcagcttctatgaccgttttgctccaatttatacacaagctcgacacctgccaccttcaaaggttcttgatgctgatgtgacagacagtgttattggtgaaggatgtgttattaaaaactgcaagataaaccattctgtagttggactccgatcttgcatatctgaaggtgctatcatagaggacagtttactaatgggtgcggactactatgagacagaagctgattaaaaacttcttgccgaaaaaggtggcattcctattggtattgggaaaaattcatgcatcaagaaagcaatcattgacaagaatgcttcaattg

SEQ ID NO: 32721 - DNA, 315 bp, Zea mays
  Clone ID: LIB3059-003-Q1-K1-G9
cccacgcgtccgcccacgcgtccgcccacgcgtccgaaaaaaaaaaaaaaagatacagatgaaacaacatatacaaggaagaagaaaagacgaaaaaacatcaagggcatgagcgggacggtagctggacggccgcaacatgaccgtcaactatggcccagtccagctgtcgctcgaggaggcggcagaggcgggtacggtggcggccgtggacgcggcggctacggcggaggcgggcgccgtgatggcggtagcggctacggcggaggcggcggctacggtggcggcggctgttacggtggtggtggcggcgga

SEQ ID NO: 32722 - DNA, 186 bp, Zea mays
  Clone ID: LIB3059-003-Q1-K1-H10
aggcgtcagcaaaccaaaccgctctcgagtcttcatccattctctacgctcatccgcagctctctagtctccagctctagctagccttagcctcgtccaagggacgaaggggccaccatgagcgtggtgatcctggacggctccacggtgcgcggcttcgtggcggacgaggcggccttcgcgcgc

SEQ ID NO: 32723 - DNA, 386 bp, Zea mays
  Clone ID: LIB3059-003-Q1-K1-H4
aagcacaatagtgtaccaacaatggcagccaaaatattgtgcttccttatgctccttggtctttctgcaagtgttgctaccgcaaccattttcccacaatgctcacaagctcctatagcttcccttcttcccccatacctctcaccagcggtgtcttcaatgtgtgaaaacccaattgttcaaccctacaggatccaacaggcaatcgcaacaggcatcttaccattatcacccttgttcctccaacaaccgtcagccctattacagcagttacctttggtccatttggtggcacacaacatcagggcacaacaactaccacaacttgtgctagcaaaccttgctgcatactctcagcaccatcagtttcttccattcaaccaact

SEQ ID NO: 32724 - DNA, 399 bp, Zea mays
  Clone ID: LIB3059-003-Q1-K1-H7
cggacgcgtgggcggacgcgtgggtgctgggcaagaaaagttcggtggccttagggatggctactacattcatggtcagtgtgccatcattatgtttgatgtcacttctaggctgacatacaagaatgttccgacatggcacagggacctgtgcagggtctgtgagaacatccccattgttctttgtggtaacaaggttgatgtcaagaacaggcaagtcaaggccaagcaagttacattccaccggaagaagaacttgcagtactatgagatttctgccaagagcaattacaactttgagatgcccttcctttacctcgctaggaagctggcatgggatcagaaccttcactttgttgaaactgttgctctgaaaccaccaaaagtgcagattgatat

SEQ ID NO: 32725 - DNA, 270 bp, Zea mays
  unsure at all n locations
  Clone ID: LIB3059-003-Q1-K1-G10
cagaaacacaccaagcgaagcgcactagcaacgacctaacaacaatggctaccaagatattagccctccttgcgcttcttgccctttttgtgagcgcaacaaatgcgttcattattccacaatgctcacttgctcctagtgccattattccacagttcctcccaccagttacttcaatgggcttcgaacacctagctgtgcaagccaacatgcaacaacaagcgcttgcngcgagcgtcttacaacaaccaattgcccaattgcaacaac

SEQ ID NO: 32726 - DNA, 435 bp, Zea mays
  Clone ID: LIB3059-003-Q1-K1-E6
ggcagccacaagaaaccacccccttccggcacacgggctcgaccacctgactgcatgaccgtgcctgtctgtgttctagggacaagcagagcagagagatccaggagcgagcagaggcggcgagaagaggatgagcaccacaacggcgtcgtcgctgaaccccaacgcgccgctcttcatgccggcggcgtaccggcaggtggaggacttctcgcccgagtggtgggagctcgtcaacaccaccggctggttccgggaccactgcttccggcagcgccagctccacgaggccgtctgcgacgacgtcgccgcgctcctccccgacgacctcctcgacaccaacgacctcttctacgcgcccgacgtcgttcaccaccaaccagcgacggcgctgctgcccgggtacgatgtactcgacgtgctcgcggcgctgag

SEQ ID NO: 32727 - DNA, 432 bp, Zea mays
  Clone ID: LIB3059-003-Q1-K1-E9
cccacgcgtccgcccacgcgtccgcggacgcgtgggggaccaactagcaacatagaaagcacaatagtgtaccaacaatggcagccaaaatattttgcctccttatgctccttggtctttctgcaagtgctgctacggcgaccattttcccgcaatgctcacaagctcctatagcttcccttcttcccccgtacctctcaccagtgttgtcttcagtatgtgaaaacccaattcttcaaccctacaggatccaacatgcaattgcatcaggcatcttacctttatcacccttgttccttcaacaatcatcagccctattacagcagttacctttggtgcatttattggcacaaaacatcagggcacaacaactcgtgctagcaaaccttgctgcctactctcagcaacaacagttacctttggtgcatttgt

SEQ ID NO: 32728 - DNA, 427 bp, Zea mays
  Clone ID: LIB3059-003-Q1-K1-F10
gccatatctgacgatccactcgagcaccaagccggaggaaggcgaggaccgactgcacctctacaggctgcccaaggctgaatacattccagtgtataaagaatatgattcctttactgttaagagaatctctgatccacaggctttaaaggaaagtccagcaagggctgttgctagcgataagggtacccctataccctcaagttctaaccaggagaaggattcagtggctaagactataccgaatagggtgaaggaaaaaagtgatgacgaaggtagacacttgcccgctgaatttgatggaaaagaaaacctggtggtgaactcaaaaattgagaagtctgattctggtgttgactggagtcgagaaagagaaagagaaagagagagatcaagagggcgggaacgtgatgctaggggtagggat

SEQ ID NO: 32729 - DNA, 294 bp, Zea mays
  Clone ID: LIB3059-003-Q1-K1-F12
tgctgtccttggtttcagacttggtgggaaacagatgatttggtggtgcaacaagatggatgctactacacccaagtattcaaaggcccgttatgatgagattgtgaaggaagtctcttcctacctgaagaaggttggatacaaccctgataagatccacttcgttccaatctctggttttgaaggtgacaacatgattgagaggtccaccaaccttgactggtacaagggcccaaccctacttgaggctctggacttgatcaatgagccaaagaggccttcagacaagcccct

SEQ ID NO: 32730 - DNA, 416 bp, Zea mays
  Clone ID: LIB3059-003-Q1-K1-F2
ctgaagctgggctatgcgaagtttggatttgattttatacaacagagcaaccaaattggcccactcttccataacattgccctgcaacaatacatcctactttgttctcaggtgaggtaactttgaatacaatattattttcatatgcagagttttatcactagaatgtgaaattctgcaatgccgtcttattatagttgttaccaccctctatcccgaaattataagttgttttagcttttctaggttacataacttttgatatgcacctagatatacaatgtctacatacatagcaaaagttatgtgccgaaaaatgccgaaacaacctataaattggaacggaaggagtatttattgagaaaatgagatctcagataagttaagattacaatcgcttctgtaactcaagtact

SEQ ID NO: 32731 - DNA, 408 bp, Zea mays
  Clone ID: LIB3059-003-Q1-K1-F4
ctgcctcctctacgagcttctccgcaacaagctcgacgaggcccgcgtccgcgagatcgtcgccgacgctgtcgacatcgagcgcgagttcgtctgcgacgccctccctgtcgcgctcgtcggcatgaacggggatctcatgagccagtacattgaattcgtggccgaccgcctgctcatggcgctcgggtgcaagaagatgtacaacgtgaccaatcccttcgactggatggagctcatctcgctgatggggaagaccaacttcttcgagaagcgcgtgggtgactaccagaaggcatccgtcatgaacagcctcaacggcggcggcgctgccgaccacgtcttcagcatcgatgaggacttctgagttggcacgcgtaatctatggtgtcggtttaatgttagtat

SEQ ID NO: 32732 - DNA, 441 bp, Zea mays
  Clone ID: LIB3059-003-Q1-K1-F7
cggacgcgtgggccgtctccacagcaaccagcacacatttccctttggcggatcgaaggaaggaaggaaggaggagatgggtggcggcatggaggtgcacaaaaaccggtggatcgaagagtggaacgccggccgcgagaacctcgagttcaatttccgctggacccgccgcagcctcgccgtcgtcggcctcttcggcctcgctgtccccatcctcgtctacaagggcatcgtccgcgaattccatatgcaggacgaggatgcaggccggccatacaggaagttcctgtaagcggcgtccagggccgcaggagacgtcgatccctcgaccggggctgcgaggaggggagtttccattcagtttgtgtcggtattgttttagtctgaatctgatggagcagtttggaatgctgaactattgtgcctgatccaaatgaataa

SEQ ID NO: 32733 - DNA, 431 bp, Zea mays
  Clone ID: LIB3059-003-Q1-K1-F8
cggacgcgtgggcggacgcgtgggagatacaagaaactataccaacagttgttttttcagaagaaagactataccaattagatcgccaaaggtagttcttttgtgctcccgctgaaatctggatagatctcttgcccttgaactactttggaatcaaactgtaaaaatgaaaatatagtgattgagcccttgtttgtatcagagaagcaatatagctgactagctcatccattatcttactgctatggtctactgctaggcatcatgttggatttggggtatttggcagaactttgtctcatgtttgatggaagtagaccagggactaaattgattggggtcagctaaaccattctgtgaatgaaggtgcatcatctgcagctgactgtggaagtaatatgttgaccaaactgagcaacaacattcttatt

SEQ ID NO: 32734 - DNA, 437 bp, Zea mays
  Clone ID: LIB3059-003-Q1-K1-F9
ccaacaagcaacatagaaagtggaatacagtagcaacaatagagcaacaatggcggccaagatattttccatccttatgctccttgctctttctgcatgtgttgctaacgcgaccatttttcctcaatactcacaagctcctatagctgcccttcttcccccataccttccatcaatgaccgcttcagtatgtgaaaacccagcccttcaaccctacaggctccaacaagcaatcgcaacaagcaacttacctttatcacccctgttctttcaacaatcgccagccctatctttggtgcaatcattggtacaaaccatcagggcacaacagctgcagcaactcgtgctaccagtgatcagccaagtagctctggcaaaacctttctcctactctcagcaacaacaatttcttccattcaaccaactgtctacactga

SEQ ID NO: 32735 - DNA, 438 bp, Zea mays
  Clone ID: LIB3059-003-Q1-K1-E5
cgtgagggtccccatcaccatcgcggggaatagtgccttgttgcagacgacagcgagcgcgaacgcgccgccacttgacgccacgagctccatcgtcctgttgcggggctgccgctctcgctccgtctcttcttgcagtacctcgtgagggtccccatcaccatcgcgctcacgccgcccgtcgccagggccctaagccgctggaggctcgtcaagagctgatctgtgtttttttcgtcacaactgctctgggatatagggtgcatccacatccaggaaatccagagagaaaattcgccgcggtttgttttttgtggtcatggatgaaagctgaaatccctggagcgaagtctcatgttgaactcccctttgttcatcagtgagtgagcaatcctaagaggagtgcacctacattgaatgagacatttttgggtcttc

SEQ ID NO: 32736 - DNA, 442 bp, Zea mays
  Clone ID: LIB3059-003-Q1-K1-D2
gtcgaccagcaggggagtcagggctcacatgcatgcttaatcacattgttgactgcataacggaacacatcgtcgccggatcggagatgatgagttccgtcgtcgtggatgctgctgctaccagcagcatcgagaagaaaacgtcgtggtcggaggtggtgggcatgtccatcaaggaggcgaccgagactattctcaaggacatgcccaacgcgtacatgcaggtgctgcctgttgggtcgcccgtgacgctggaccttcgccccgaccgcgtacgtatcttcgatgacaccgtcgtcatgactccgacagttgggtgatacataccaaatgcaattaacagaccctactttgtattttatgtttccagataataataaaccatgccttagctctttgggtgtccttccttggctggtgctagcttctaagctactagtac

SEQ ID NO: 32737 - DNA, 204 bp, Zea mays
  Clone ID: LIB3059-003-Q1-K1-D3
gcgacagcatgggagtcaggtctcatagcttgcttcattacattgcagactgcataacggaacacatcgtttcctgatcggagacgatgtgttacgacagcattgatgctgctgctagcagcagcatcgactagaaaacgtcgtgcgcataggtggcgggcatgtgcatcatggataggacagagactatgtgttaaggacatg

SEQ ID NO: 32738 - DNA, 409 bp, Zea mays
  Clone ID: LIB3059-003-Q1-K1-D4
cccacgcgtccgggccaagatgatgctgttgtggccatatctcgtgcagtgaagagagcacgtgttggccttaacgatcctgatagacctattgctacgctgcttttctgtggtccaacaggagttggtaaaacagagctcaccaaagctctagcagctagttattttggatcggaatctgctatgcttaggttagacatgagcgagtatatggagaggcacactgtgagcaagctcataggctctcctccagggtacattgggtatggtgaaactggtactttgacagaagcagtcaggagaaaaccatttactgtggtattgttggatgagatagagaaagctcaccctgatattttcaacatccttctccaaatattggaggatggacatttgacagactcacagg

SEQ ID NO: 32739 - DNA, 372 bp, Zea mays
  Clone ID: LIB3059-003-Q1-K1-D5
aactctgcttcttatttgcaacaacaacaactaccattcagccagctacctgctgcctacccccagcaatttcttccattcaaccaactggcagcattgaactctcctgcttatttacagcagcaacaactactaccattcagccagctagctggtgtgagccctgctaccttcttgatacaaccacagttgttgccgttctaccagcacgctgcgcctaacgctggcaccctcttacaactgcaacaattgctgccattcaaccaacttgctttgacaaacccagcagcgttctaccaacaacccatcattggtggtgccctcttttagatttcttatgagttatagttcaataataaagttttttgtctg

SEQ ID NO: 32740 - DNA, 440 bp, Zea mays
  Clone ID: LIB3059-003-Q1-K1-D6
ggcagccaaaatattttgcttccttatgctccttggtctttctgcaagtgttgctaccgcaaccattttcccacaatgctcacaagctcctatagcttcccttcttcccccatacctctcaccagcggtgtcttcaatgtgtgaaaacccaattgttcaaccctacaggatccaacaggcaatcgcaacaggcatcttaccattatcacccttgttcctccaacaaccgtcagccctattacagcagttacctttggtccatttggtggcacaaaacatcagggcacaacaactacaacaacttgtgctagcaaaccttgctgcatactctcagcaacatcagtttcttccattcaaccaactggctgcattgaactctgctgcttatttgcaacaacaattaccattcagccagctagttgctgcctacccccagcaat

SEQ ID NO: 32741 - DNA, 314 bp, Zea mays
  Clone ID: LIB3059-003-Q1-K1-D7
gtccaaggtccagtatgcgcatcagtattctgctcatccttagtctgaaccatgacttgggaagggactcagctgaatgattatggcctgggacaggttacagtctttatcatctagtgtagactacagagtgtgttagttgttgtgcaagtacgtgcaggcgatgtgcttatgagtcagtgtttagagttattcatgtctgcttgccggactagccctggtcctgctggagcggagctgattgccccaatgcgccagttctgcaagctgctgagcacattaaagctgccgccgactgatgacgctatgctctc

SEQ ID NO: 32742 - DNA, 414 bp, Zea mays
  Clone ID: LIB3059-003-Q1-K1-D8
ggacgaagagctggaagaggaagaagcagatgtctccaacaagaggcagtgtgttagagttgaaaacggggaagctggggatgccaccgtagcagaggtggaaccaaacaacggcggcggcggcgggggcggggaccgctgaacagtgaacagcaccaccacgtttgtcgctaactcgctattttcacaacagcatcggtattggatttttgagcgttgtctctggcatttttcatgtattttagggctagtttggcaaattcatttttccaagtgattccgattttcctaaggtaaaatgaactaatttccttggaaaaatgaataaaaaaaatcactagtaaaaatgggattgccaaactgtcctttattagacaatttctgccgtactctactcggtactgattaactgac

SEQ ID NO: 32743 - DNA, 336 bp, Zea mays
  Clone ID: LIB3059-003-Q1-K1-D9
accattgcaacgcaacaacaacaacaacagtttctgccatcactgagccacctagccgtggtgaaccctgtcacctacttgcaacagcagctgcttgcatccaacccacttgctctggcgaacgtagctgcataccagcaacaacaacagctgcaacagtttatgccagtgctcagtcaactagccatggtgaaccctgccgtctacctacaactactttcatctagcccgctcgcggtgggcaaatgcacctacgtacctacaacaacagttgctgcaacaaattgtaccagctttgactcaactagctgtggcaaaccctgctggctacttaca

SEQ ID NO: 32744 - DNA, 417 bp, Zea mays
  Clone ID: LIB3059-003-Q1-K1-E10
cccacgcgtccgacgcaaattgcaccatgaaatccatcgagaggccgtcgacaggggaattaatggcgtcgtcgtctagcagcagccaccgtcgcctcatcctcgcagccgccgtcctgctctccgtgctcgcggctgccagcgccagcgccgggaccttctgcgtgccggggtgggccatcccgcacaacccgcttccgagctgccgctggtacgtgaccagccggacctgcggcatcgggccgcgcctcccgtggccggagctgaagaggagatgctgccgggagctggcggacatcccggcgtactgccggtgcacggcgctgagcatcctcatggacggcgcgatcccgccgggcccggacgcgcagctggagggccgtctagaggacctgccgggctgcccgcgggaggtgc

SEQ ID NO: 32745 - DNA, 432 bp, Zea mays
  unsure at all n locations
  Clone ID: LIB3059-003-Q1-K1-E11
gagaaccctncgagcatcctagtgactcccatggctccggccatgtcggcgcagttcacaagaataaccttcagcaacctgtttgtccgtcgggctggcccatgcagcacggagctgaccgtggagggaaggccatccgaccagctgggcaggagaaacctcactgacagccccgtatttgacggccgtggccctgacgccagcctcgtggctcgcgtacagggagtcgctacccagatgggcgacgtgcgccagttgtacaccgtcgtgttccaggagaggccgctcaagggctccacgctcgtcaccgaaggcgcgatgacagaagggtcagacgagtgggcgatctacggtggaactggagtgttcgcgatggcgagaggcgtcataaggagaacgtttcttgccgacacgagcggcgggaactccgac

SEQ ID NO: 32746 - DNA, 172 bp, Zea mays
  Clone ID: LIB3059-003-Q1-K1-E12
gcatgtacacgggccagttcgtctactgcggtcgccgcgccaccctctccatcggcaacgtgctgcccctccgcgggatccctgaaggtgccgtcgtctgcaacgtctagcaccacgtctgtgaccgcggagacttcgccagcgcctgtgtggactacgccattgagatcag

SEQ ID NO: 32747 - DNA, 119 bp, Zea mays
  Clone ID: LIB3059-003-Q1-K1-E2
gctatatatatatagccatggctaataaataggagtataatcgtcatatcgatcggttgcgtgtggaatgccaatcatgtgtgtaatctgttggcaaataacaaacctctgttcctccc

SEQ ID NO: 32748 - DNA, 416 bp, Zea mays
  Clone ID: LIB3059-003-Q1-K1-E3
cgtcctatgcgggtacgacaggatcctgaggtagctagcctggctgagaagcgtgtggcctgcagcggcgaccgaagcgccccccgggaagaatactattgttgtaggggtccaccagagccagcacatgttctaccctctccagtggcactgcatcacttattcccgtcaggccagccgtagcaataccgcctagtcgtcgtaaccgccaagcccaccgccgtcttcgccgtcggcctcaccggcccaagcgcctcggatgtgctgccgtacgtggaagccgatcttaagcgcctccgcctgctcgtttttgaaaaagccaaaggcctttgcacacaggcgaacgacgctttatttgaagcgctggaaggggacgcttggaacgtcctttgctaagctttcaagaggcacggggc

SEQ ID NO: 32749 - DNA, 439 bp, Zea mays
  Clone ID: LIB3059-003-Q1-K1-E4
cccaaatgatgacagaggtattgccattagatttatatgacatgacgccgtcaagtaatggtcgggtgttaccagtttctgttgtttttgtgccgcgcaggtctatgcaaacgtctcaggagaggcgccgctggatgagcctatgatcgacgtgagttcgagtcagttctacggtgaaggatacgatgacagtgataagagaattcctgacatgactataatcaacaagcagctaggttggaacccaaagacacctctcaaggatctgctggagacaacattgacgtaccagcacaagacatacaaagaagctgtgaagaggcaaatgtcgcaggcttcagcaacaagttaagttggcgctggctggggacggctcctcgtttagagccctagtcgcagcagctgtttcgcaagtcagaatacatatacgccggtaatc

SEQ ID NO: 32750 - DNA, 318 bp, Zea mays
  Clone ID: LIB3059-003-Q1-K1-D1
gaaagacgccctggagatcaagggggatgccggacaaggacctagagggcgacgacgacaagggcccagagcgggacagttgccgtataggactctcttgccaggctttcaagatggaccagatcaaggctgacatgaataacggcgtgctaagggtcaccgatctgaatagcaaagacgaggaacaccatgacgtattcgagatcaagatcgactatggggtgtgcatcggatggggcctactaggtgtcctatttgcaatccatatatgtccatatccgtaatgcagtgcatattcatatcggaaatgccatgagc

SEQ ID NO: 32751 - DNA, 315 bp, Zea mays
  Clone ID: LIB3059-003-Q1-K1-B11
ccggtcgaccacgcgtccgcccacgcgtccgccttttaactccctttcttaggagatactctggcaagagtcgtcattcaagggaaagccactctcatagccgcagttcgtactccaggtctgtgtccagggagcgctcagcttgatctgcgaggtgtgtcgtcctaggtggttataagatatgcgctgtatttgcatctatcagaacttgtgtacttcgtatattacgaacttgagaactgtatggatgtgtgcattgtgccaaaaaaaaaataaataatgaagtttaaaaaaaaaaaaagcttatatatatag

SEQ ID NO: 32752 - DNA, 282 bp, Zea mays
  Clone ID: LIB3059-003-Q1-K1-B12
tgtcacatgcatgcttcatgacattgctgactgcataacgaaacagatcgtcgccagatctgagatgatgagtgccgtcgacgtggatgctgctgctaacagctgcaatgtgcagaagacgtacaggacgcaggtgggtgctcatgctgatagggtggcgactgaaactatgggcacggacatgcagcacgagtacatccaggctctggctgacattgcgcacgtgacgctggatgttcgatgcaagggcatcagtgttgtacatgacactgaagctatgac

SEQ ID NO: 32753 - DNA, 319 bp, Zea mays
  Clone ID: LIB3059-003-Q1-K1-B3
gttgtaggaaaaaagcccagattgaagatagaatctgatgctattgatgcttcagatgggctggacacgcttgcaaaccttgcaattcttggtgaaggtgaagcgctcccttcgcagccaacaacaaaacatccccgccaccgtcccggctgctcatgcatcgtctgcatccaaccaccaagtgggaagggtccaaagcacaagcagacatgcacctgtaacgtttgtatgacggttcgccgtcgttttaggacactcatgcttcgacgcgagaagaaggtgacaagagattcctctcgcaagaaagagacgggccaat

SEQ ID NO: 32754 - DNA, 181 bp, Zea mays
  Clone ID: LIB3059-003-Q1-K1-B5
cggacgcgtgggcggacgcgtgggcggacgcgtggggttggacaaacccagcagcctcctaccaacaacacatcattggtggtgccctcttttagattgcttattagttgtaattcaataataaagttttttggatgatgtatgtggccaaccagaaataagaagttacatttccagattc

SEQ ID NO: 32755 - DNA, 436 bp, Zea mays
  Clone ID: LIB3059-003-Q1-K1-B6
cccacgcgtccgcccacgcgtccgatcgccatggcagccaagatgtttgcattgtttgcgctcctagctctttgtgcaaccgccactagtgctacccatatcccagggcacttgtcaccactactgatgccattggctaccatgaacccatggatgcagtactgcatgaagcaacagggggttgccaacttgctagcgtggccgaccctgatgctgcagcaactgttggcctcaccgcttcagccgtgccagatgccaatgatgatgccaggtatgatgccaccgatgacaatgatgccgatgccgaatatgatgccatcgatgatggtgccgactatgatgtcaccaataacgatagctagtatgatgccaccgatgatgatgccaaacatggtttcaccaatgatgatgccgagtatgatgccttcgacgatga

SEQ ID NO: 32756 - DNA, 297 bp, Zea mays
  Clone ID: LIB3059-003-Q1-K1-B7
cccacgcgtccgcccacgcgtacgaggtacgattgtacgtacgactattgggcagcaggagatgatagttataagatctagaggcataagcaatatgaattgctgatggatcaagatgctaatacatatgcctgtacctagctagaataaaaggattcatcagcagataaacattcagatgtaaacgagaagactagagtgtgaaattaaccaggagcaatatatagtgattaaaccgatgcactcgagcataatacacatgagaagaccagatctatgttaacctataataagaaa

SEQ ID NO: 32757 - DNA, 130 bp, Zea mays
  Clone ID: LIB3059-003-Q1-K1-B9
cgattcgtcgaccacgcgtcgcacctctacctcgcacctcgtttggacttatggcatgagaatgttgaatatcgcttacagagaggactttacgttcggcttatatcattaccagagtatgcggatattt

SEQ ID NO: 32758 - DNA, 417 bp, Zea mays
  Clone ID: LIB3059-003-Q1-K1-C1
agctgagaggctgagagataatgatcttgttcttgagcaatatctcttagctaattcacctggaatagctggattccggcttgattctttcagtgttataagacctcgtgtgacccattcaccttcttcatcagagttggacatgagggagttttcattgacacgaatggaagatagatttataaacccagcaattctgtatatacaggtcacagttgttaaggagtccggcaagttggttgtagaggaataccgtttaccagaagtaaaagcaaacacgccactatattttgatttcccagatctacaacaggatgcgcgctgtgttatctttagattgcttggtgacgtcactgcctttgtcgacgacatttctgagcttgagaacttaaacttgcggaatcttcctttggcgtc

SEQ ID NO: 32759 - DNA, 201 bp, Zea mays
  Clone ID: LIB3059-003-Q1-K1-C11
ctgaagagaaaattgaagaggacatgtcagacagactggcacgagaaagggctgaggaacaagctaggcatgaggcattgctcagaaagagatccaaagtgttgcataggagtctgcctaggccaccggctgtttcagtagagattatccggcaatctcttattagaagttgtgatagcatattcagaagcacctttatgc

SEQ ID NO: 32760 - DNA, 237 bp, Zea mays
  Clone ID: LIB3059-003-Q1-K1-C2
cggacgcgtgggcggacgcgtgggcggacgcgtgggttaggatagtacacctcgctagatttgcagatgtaaaacattgttgtgtaagctctcatatatatatatacacacttttgccctgaggcaatgagctgtatgtcatgttttaagagtaaaatgtgatttttgaggggtttccatctaggaacattaacatttaaactgtatttttttggcctataaactttcactggagat

SEQ ID NO: 32761 - DNA, 398 bp, Zea mays
  Clone ID: LIB3059-003-Q1-K1-C3
cccacgcgtgcgcaaccctgttatggtggccatcaacggagtatgcacaacggcgacagtcgcacagcatgaaagtgtctctgataccaattgtcgtgcccgtggccgcggtgatcgccgacgacgtgagaaacggtggatcggggacacacaagcacaatgagcttgcgagtgctggctgaagaaacataaggatgtcatggcccctgctgttattgcaaagggggaggacgtcatgtggacttctggtctaatctttggaaaatgaaaggggattgtggggcttgaaacaaatttaaggacacttcatattcaattgctgcctggttgcccgccccgttcagtggaccacttcattgagctcctgggcttgcgcaactgtgctggatgcagatttt

SEQ ID NO: 32762 - DNA, 445 bp, Zea mays
  Clone ID: LIB3059-003-Q1-K1-C4
cggacgcgtgggcggacgcgtgggtagaaagtggaatccagtagcaacaatagagcaacaatggcgaccaagatattttccctccttatgctccttgctctttctgcatgtgttgctaacgcgacaattttccctcaatgctcacaagctcctatagcttcccttcttcccccataccttccatcaatgatagcttcagtatgtgaaaacccagctcttcaaccctataggctccaacaagcaatcgcagcaagcaacatacctttatcacccttgtttcaacaatcgccagccctatctttggtgcagtcattggtacaaaccatcagggcacagcagctgcagcaactcgtgctacctgtgatcaaccaagtagctctggcaaacctttctccctactctcagcaacaacaatttcttccattcaaccaactgtctacattga

SEQ ID NO: 32763 - DNA, 437 bp, Zea mays
  Clone ID: LIB3059-003-Q1-K1-C6
cccacgcgtccgaccaactagcaacatagaaagcacaatagtgtaccaacaatggcagccaaaatattttgcctccttatgctccttggtctttctgcaagtgctgctacggcgaccattttcccgcaatgctcgcaagctcctatagcttcccttcttcccccgtacctctcaccagcggtgtcttcggtatgtgaaaacccaattcttcaaccctacaggatccaacaggcaatcacagctggcatcttacctttatcacccttgttcctccaacaatcatcagccctattacatcagttacctttggtgcatttattggcacaaaacatcagggcacaacaactacaacaacttgtgctagcaaaccttgctgcctactctcagcaacagcagtttcttccattcaaccaactagctgcattgaactctggttc

SEQ ID NO: 32764 - DNA, 435 bp, Zea mays
  Clone ID: LIB3059-003-Q1-K1-C8
cggacgcgtgggtgctgctcgacgcgagcagacgacggagaacaaccggaggtggcagtagcagcacggaggagcacaagctgcctcctggctccctgggtctgccgttcctcggcgagactctccagctctactcccagaacccgaaggtcttcttcgcctccaggctgaagaggtacggcgaggtgttcaagacacacgtgctgggttgcccctgcgtgatcttggcgagcccggaggcggcgcggatggtgctggtgtctcaggcgcacctgttcaaaccgacgtacccaccgagcaaggagcgcatgattggcgcgcaggccctcttcttccaccagggcgactaccacctccgcctgcgccgcctcgtgaagggctggcttggcccggacgcgctccgcggcctcgtgcccgacgtcgaggccgccgtgg

SEQ ID NO: 32765 - DNA, 195 bp, Zea mays
  Clone ID: LIB3059-003-Q1-K1-C9
cccacgcgtccgccctcttcgagagggatgtacatacctggaggtactggattacggaggactcgattgattcgttcacacatacctgcagatgtacgaacccgcatatatttagatcgaacttctataaaaacttctgtccaaacaccgaatgaaaatccatgatatagcttcttattcacataaagtgagaaa

SEQ ID NO: 32766 - DNA, 432 bp, Zea mays
  Clone ID: LIB3059-003-Q1-K1-B10
agaagctgtggcttaaggttgctaaacatgtcatcgagcaagagaaaggtgtcaagagagagaatataaagaaagcaatagaattcctttcggagaccaataacttgttaaagattgaggatatcttaccattcttcccagacttcgtattgattgacgatttcaaagaggaaatatgcaaatctctgaaggactacaacagccagattgagcagctcaagcaggagatggatgatgccacacgtggggcagataatatcagaagtgatattggtgccctcgctcagagatatacagtaattgaccgtgagcaggattgtggggtttgccggcgcaaaatattgactgttggagggttgcaccaggtagggagaagctatacatctgttggacacatggcccccttttatgtgtttccctgtggacatgcct

SEQ ID NO: 32767 - DNA, 380 bp, Zea mays
  Clone ID: LIB3059-002-Q1-K2-H3
gttcgaggcgttaccctcctacacgcaaccttctaccctccagatccaggattgccgggctacttgactcgttaccttgcgcgccctcggtgagctactttgtttcgatttagcgacaaatcagtttgcttcatgttgcgcaggcttagatctgaatgccggattcttcgtcttacggcttgaatcgagctgggaggctgtggatctgatcacgggaggtacaacatatccgcgtgtatgacgagttggatcggcaccggatagtctctgaccgcaagactatgttgatgcgttgggctgatctgccgcgttgttctgcttcaggttctagagctagcgaaatcgcaaggctattatggttcctttcggagcgcgtctga

SEQ ID NO: 32768 - DNA, 319 bp, Zea mays
  Clone ID: LIB3059-002-Q1-K2-H4
cccactcgtccgcggacgcgtgggataagattgcatttgttcccatctctggttttgagggtgacaacatgattgagaggtccaccaaccttgactggtacaaaggcccaaccctgcttgaggctcttgatcagatcaccgagcccaagagaccctcagacaagcccctgcgtctccccctccaggatgtgtacaagattggtggtattggaactgtgccagttggtcgtgtggagactggtgtcatcaagcctggtatggttgtcacctttggtccaactggcctgactactgaggtgaagtctgttgagatgcacca

SEQ ID NO: 32769 - DNA, 376 bp, Zea mays
  Clone ID: LIB3059-002-Q1-K2-H5
cattaactatctctgagtaagagtggcccttatagctgagagataatcaacgagagcctgatcgagtgcgtggactagttgaaccagttcatgcatgctcgcattgtggccttcatggtcgacaactgctccacaactggttgttcgggatctaggaaatggtctccacgcttggattacatcttgacccaccaggcgtctgtgactgctgacaagactgcaccgatcaaccaagacctcatcagcaacttcatgtgtgaccctgtgcacggcgccatcgaagtctgcgctcagctgaggcctaccgttgacatctcagtgaccgttgatgcagatttcgtgcgcccagagcttcgacagtatttataagcgtgta

SEQ ID NO: 32770 - DNA, 351 bp, Zea mays
  unsure at all n locations
  Clone ID: LIB3059-002-Q1-K2-H6
cccacgcgtccggtactgggacgtncgctgcacctgaagaggcagtcggctgaccgggctcacatgggaggggcgcgctcactgcgggctcgacgacgcccgcaacaccggtcgcctgctggcacttctgatgcaccggggcttcaagttctccatcaccaacttactggtgtggcaacctgccgacagtccgcagtcaaccgacgtcacctgccacttctccccggaccgctctacggacccagtcgtcgttcagctccagcaccagcagcagcagcacaagccgaaggaggcgctggggtctcccgcgtcgcatgtgaacccgtcggacgccaacccacggggagggaa

SEQ ID NO: 32771 - DNA, 430 bp, Zea mays
  Clone ID: LIB3059-002-Q1-K2-H7
cccacgcgtccggtgcaagaagggcacatgacgccaagcaaaagggacgccggtcaggatatggtaagcgtaggggtaccagggaggctaggctacccaccaaggttctgtggatgaggaggatgcgtgtgctgaggcgccttctccgcaagtatcgtgaggccaagaagattgacaagcacatgtatcatgacatgtacatgaaggtcaaaggtaacgccttcaagaacaagagggtgcttatggagagtatccacaagtccaaggctgagaaggccagagagaagacactttctgaccagtttgaggccaagcgcgccaagagcaaggcgagccgtgagaggaagatcgctaggagggaggagaggttggcccagggtccacgagaaataacaccacctgtctcattcacagctccagctactggggc

SEQ ID NO: 32772 - DNA, 337 bp, Zea mays
  Clone ID: LIB3059-002-Q1-K2-H8
agctcatacgtatatcacttgccatgccagcctagcttcttccgtgtctgtctttctcaataaatacatgccactcacatggtgctcctccatcttccaagtcaccaacgcaaattgcaccaagaaatccatcgagaggccgtcgacaggggaattaatggcgtcgtcgtctagcagcagccaccgccgcctcatcctcgcagccgccgtcctgctctccgtgctcgcggctgccagcgccagcgccgggacctcctgcgtgccggggtgggccatcccgcacaacccgctcccgagctgccgctggtacgtgaccagccggacctgcggcatcggg

SEQ ID NO: 32773 - DNA, 136 bp, Zea mays
  Clone ID: LIB3059-003-Q1-K1-A1
cccacgcgtccgcggacgcgtgggggccactgaagcgaagtcgaagagccatgagtctgattcgttggctttgagggaggagatcagattactgactgataacctggagtctattataagtgaagctctgtcacgt

SEQ ID NO: 32774 - DNA, 290 bp, Zea mays
  Clone ID: LIB3059-003-Q1-K1-A11
ggtggagcctcattgaagcctgaattcgtggacatcatcaagtctgccactgtcaagtcttcatctgcctagtgttttgactttcaatgcacctggatgcttgtcgtactgaatgctgttgatcttttaaagctattgccattttaccatctcgttttggtattctagctccagtgcatcgtttgtatatcatcatctcctgcgtatgtgcacagagtagtcatttacctgaatcatccttgtgtaccctttggaactgcataattgaactgcgctattctagatctgtc

SEQ ID NO: 32775 - DNA, 441 bp, Zea mays
  Clone ID: LIB3059-003-Q1-K1-A2
gtaaatggattgttgttccagctacctttatcagtgctgcatcgctattctgcattgaggaagtgggtgttctaatcgaagagccgttccccatgctagctcttgatgccctgtgcaagcagctccacgacggtattaaggatgtgatggagatgcagaactcggttcactcgcgactagttgccaagactgctacggaccacaggggcagtaggcgcgagaacaatggttggcctagctccaaaagagaaggagccaagattgattgagcacgcaaggtcggtcgggtcgttgtgaatttatttgaagatagcattgcaagcaatctgtggcaaccagatatccatgaacgaactggagaacttgtggaccccatttccttctgcaatggtatgtacctgtcctatgtaaaatgcactcgctactgcttggatagctact

SEQ ID NO: 32776 - DNA, 224 bp, Zea mays
  Clone ID: LIB3059-003-Q1-K1-A4
cgcaaatgatgatgccacaatgtcactgcgacgccgtctcgcagattatgctgcaacagcagttaccattcatgttcaacccaatggccatgacgattccacccatgttcttacagcaaccctttgttggtgctgcattctagatagaaatatttgtgttgtaccgaataatgagttgacatgccatcgcgtgtgactcattattaacaataaaacaagtttcc

SEQ ID NO: 32777 - DNA, 413 bp, Zea mays
  unsure at all n locations
  Clone ID: LIB3059-003-Q1-K1-A5
agacaaagagggcaaacccatatatgaaaggagtgaccgtaatgatcaaattgctgaacccgtttcttatggcaaaatcatgaatggcttggtgccatatttcagcgtccaagtgcatgccaccctgctgctgttctctccccagccggacatgatcctggaagggatggttgaaatgattgggaaggagtcaattcatgccattgtattaggggttttctcagtggcaattatgtctgaagatattaagttcaaattcaaatggaaaagtgatggaaggaaatttgtgagcctcacagataaaaaacatgtgattgaaagaggaacaatgataaagttttctgtcaaaagggtggatacagaaatgagtngtcatattactggatctttaatcccaccttacactggatgca

SEQ ID NO: 32778 - DNA, 373 bp, Zea mays
  Clone ID: LIB3059-003-Q1-K1-A7
caaacataaaggttcggtaaatgctgttactctcaaggttgctgacccatgcacgactagaattctcaatgatgactgccctgattgtgatgagtttcttgctgccgatactttggagggtgatgttctggaggaaggtaaaggccatttggatacttatggatcttgtgcatccataaaggatcaaatttcaaaactgggtaatcaaagtactggctgtgccataggtggcacaccctcaacttggcataatagaaattccgagaagaaaagcataacgtctgtcaacttgattcctaaagagagccacaagagggataaaaattcactgttgcaatgtgaagggattataaaatcggaaggtactatcctt

SEQ ID NO: 32779 - DNA, 325 bp, Zea mays
  Clone ID: LIB3059-003-Q1-K1-A8
ggcattttaaggccctatggatacacttactctcatcgttgctgatgcatacgctgattgcattgttggtgatgactgtggttatgactatgagtttcttgatatcaatgctattgatgatgatggtcatgatgaaggtgacgaccttaaggatccttatctatatgctgcatatctaactgttcagcagttagcactgcttatttaaaaagctgaatatgccatacactaccaacactttatgtgtgatactggagaccatgctactactggcgtatctggtgaccattggtttgaacccgagagatacgcgatgtgtagactg

SEQ ID NO: 32780 - DNA, 399 bp, Zea mays
  Clone ID: LIB3059-002-Q1-K2-H12
cgtatgcgtccgcccacgcgtccgcaatgaatgaaatacctaatgttaggccttcatagtcaatggagcagcttggataaagaaattttacatgtgcaaacgggcgctagtaacagtgcatgcattccaaaccaggtcctttgagcaatctgagtaactgtagttacagagtacaatacatccaaagcacactatccttgaattacagagctcaaaccacctgaacttgttattgtggacttttttcatctcatcgctggttctccctcctgcgtgcgtagcgggtcctgtcattgtacctaggcctgtctgcagccctctgtggcacgggctcgacccttctctgcctctcaggaggcctctgaacaatctcaccgttgacaagcagttcagctccgt

SEQ ID NO: 32781 - DNA, 329 bp, Zea mays
  Clone ID: LIB3059-002-Q1-K2-F8
gccacgcgtacgcccacgcgtacgctctggtcttcattgttgacctcaaggcagactagaagaagatcaaggctgtcgtcaagaagatgtatgacatccaggcaaagaaggtcaacaccttgatcaggcctgatgggaagaagaaggcttacgtgaagctgactcccgactatgatgctcttgatgtggccaacaaaatcggaatcatctaagtgctgcattaggcatctgttgattactagctcaatctgttgtgtgctagttctatgtgaaaccagagttttggagctatggatctcaatcgttccattaccatgtgttatgcacac

SEQ ID NO: 32782 - DNA, 288 bp, Zea mays
  Clone ID: LIB3059-002-Q1-K2-G1
gcgccagcggcgtcgcaacccgcagaccagcacgcgaccctcatgttccggttaggggctaaagcagaggcaccatcttctggagagattaaaaattaccgctttagatctgatgtgccttgtccaccttctcatactgctgtaggaggtccagcttcactccttcctaagcgcaaacccctgactgaagaagagattgaggctattatgctggggggctccatttgatatcacctcatatgaattggaaattctaggaacatcaataagattgtatacccgaactta

SEQ ID NO: 32783 - DNA, 435 bp, Zea mays
  unsure at all n locations
  Clone ID: LIB3059-002-Q1-K2-G10
gcttcgtcgccgtctcctcagctcgacgcggctatagctgcactgaccgcaccgcgaccgcgtgcccaccggcaccgctcagtgctagcgcgcgctcatggcgtcgcttggccagctcctcctcgtcgccggcctggccttcctggtgctgctgctgggtgcccaggatcacgggcgtggagagcaagcgaccggcggcggcccggccgttggagcagcagccgccgccgctgctcctcccgcgcgggaggctgtaatcatcagccggcaccagcattcgcagccgtcggccgcggcgatggcggagagcaagcggctccccatccctccgtccgggccgtccactaagtggaactacgaggcgaatcacgagaagccgtcgtcgtcggagtcgggctcgggccgncgncgnctcgggtggtggtggtccccgtg

SEQ ID NO: 32784 - DNA, 444 bp, Zea mays
  Clone ID: LIB3059-002-Q1-K2-G11
gagctagttcagaagtatgttggagaaggtgctcggatggtcagggaactgttccagatggccggctcaaagagaggcatgcattgtattctttgatgaagttgatgcaattggtggtgctcgttttgatgatggggttggtggtgacaatgaggtgcagcgtacaatgttggaaatagtaaaccaacttgatgggtttgatgcaagagggaacatcaaagttctcatggccactaataggcctgataccttggatcctgcacttctgcgccctggtcgcttggacagaaaggtggaattcgggctacctgacttggagggccgtacccaaattttcaagatccatacacgtaccatgaactgtgagcgagatattcgtttcgagcttctggcacggctctgccccaactctactggagctgatataaggagcgtttgcacaga

SEQ ID NO: 32785 - DNA, 435 bp, Zea mays
  Clone ID: LIB3059-002-Q1-K2-G12
ctttatcgcccttgttgtgtcaacaatcgccagccctatctttggtgcagtcagtggtacagggcatcagggcacaacagctgcagcaactcgtgctacctgtgatcaaccaagtagctctggcaaacctttctccctactctccgcaacaacaatttcttccattcaaccaactgtctacactgaaccctgctgcttatttgcagcaacaactattaccatttagccagctagctactgcctactctcaacaacaacaacttcttccatttaaccaattggccgcactgaaccccgctgcttatttgcagcagcaaatactactaccatttagccagctagctacagcaagccgtgcttccttcttgacacaacaacagttgctgccgttctaccagcagtttgcggctaaccccgcaaccctcttacaactac

SEQ ID NO: 32786 - DNA, 263 bp, Zea mays
  Clone ID: LIB3059-002-Q1-K2-G2
aattccggtcgacccactcgttcgatcgtacagtcaatacttacactgcagttcagaataggaaatacctcgaatccatctggataagtgacacattcgatattttactgtagcatctatatcatcaccaaccgtgtctatacaatacatacagatctcatccctgatgttcaagatagctactgaatcgcattctcaaatattatgaacagattaataatatcgctacttagatatgcagtcacatgtccatgttctcatac

SEQ ID NO: 32787 - DNA, 460 bp, Zea mays
  unsure at all n locations
  Clone ID: LIB3059-002-Q1-K2-G5
gcgaatcgtgttatgtcgataccgtgatggggtctcttaattagcgcatcgagtcagactcgtttgggcaatctgaagatgtttagggatcaacattacctttgtgtacctttgtggcctatggttcgtggatgcacagggatcaatataagtacctttgtgccccatggttcgtggatcactgtgcatgtgttcttccgcgtctttgttgttattttggctccatctgtatgatttaacaaaggaaggttcattagatgggccacatttacacactgtttatccacacgggtccactgatactcttccttttgccaccatgggctctggttctcttgctgcaatgtcagtgtttgaatcgaagtacaaagaaggccttactagggaggagggaatacagattgtgtgcgaagcaatctgtgctggtattttcaatgacttgngtagtgggagcaacgtg

SEQ ID NO: 32788 - DNA, 346 bp, Zea mays
  Clone ID: LIB3059-002-Q1-K2-G6
gtaattgacatagaatgtggcacaccagttgaagttggtggatttgatttgtcaaagtgaaaaaataagatggtatgctctagcatggatagcatcatggaccctggcgatggaatacatacggatgttattcctgttgttcaagatggctacagccttgcattttcagattttctcagttctgatataccatgctacccgtcaatgcaatcagatcttcatgctggaataagtgccaacgactcagagggtattaccgttatggatgatcctatatatgggtctctcgctgatattggtttcatggacatgtgggggcagcccactcaagactacgacaaattct

SEQ ID NO: 32789 - DNA, 318 bp, Zea mays
  Clone ID: LIB3059-002-Q1-K2-G8
gttaatgactacccgtgtgttaacaaagtctcgtgctgtcagtactttggacatctgggcttggaagtacttggttccatggatgatggaagatctgtttgctaggagagatgccagtggtgtttacatagttcatagtagtaagaaggtcaatgcatatgatgtggacgatatggatatgccattacatcggtacatcaatgatccagttgcccatgagactattcatactggctctacctttcagattactggtgtaaccaacaactgatattttgatagagcacatgatgttcgacactgagtcaggatgcatgc

SEQ ID NO: 32790 - DNA, 390 bp, Zea mays
  Clone ID: LIB3059-002-Q1-K2-G9
cccacgcgtccgggccccatggtagtgattgtggtatagtgaatgtgaacatacctactaatggtgctgaaaggggtggagcatttggtggagaaaaagcaactggtggtggacgagaagcagggagtgattcctggaagcagtacatgaggagggcgacttgtacaatcaactatgggagcgagctacctctagcccagggaatcaattttggttaatcctgcagaaatgttgcgcgtggatctcagtgttttctgcagacgtggatgccgtatggaaagaactgatgcaaccgcatttgagatctcagcagacttgagcagcatttattggcgtcagttgtgaaacttaaactgcaggagcatcttgtacataaataaaataagatgt

SEQ ID NO: 32791 - DNA, 432 bp, Zea mays
  Clone ID: LIB3059-002-Q1-K2-H1
gtcagtgaagcaaagtctgtcgctgcagttcagacgaggagatgccgcggatccctctgatcaggttaccgcaagcgggtaatcatgacaagtcccacatgcatacatgccgctgccagcaggacgtcgcaaccgcgcagaccatcacgcgaccctcatgatccgggtaggggctaaagcagaggcaccatgttctggagagattaaatgttaccgattgagatctgatgagccttgtccaccttctcatactgctgtaggaggtccagcttcactccttcctaagcgcaaacccctgactgaagaagagattgaggctattatgctggagggctccatttgatatcacctcatatgaatcggaaattctaggaacatcacttagattgtgtacccggacctattgactttgacctctgaaagagtgttatt

SEQ ID NO: 32792 - DNA, 434 bp, Zea mays
  Clone ID: LIB3059-002-Q1-K2-H10
cacatagaccatacatctcacttcgccaaaaaaattccgtcaacagttgaagtgatacccatggcaaaactactcttgggtttgctccttgcccttgctattctagggacaacatcggctgctggttgtgtacaagacgcggaagacatgaaacgagagtgcaagcagtttgagctattcccagcgaacccaaagttgccaccgtcggcagcatgttgtgctgtgtggaagagggcagatgttccatgcctatgcaaatatgttaacaaggaagtagagaaggtatggtgcatggagaaggttgtgtacgtcgccaactattgtaagaggccgtttcaacctggctacaagtgccggagttatacagttcctcttagtatgtaaaaaggagtggttgggacatgtggtactctctcctagaactttaatttgag

SEQ ID NO: 32793 - DNA, 445 bp, Zea mays
  Clone ID: LIB3059-002-Q1-K2-H11
caatcgccagccctatctttggtgcagtcattggtacaaaccatcagggcacagcagctgcagcaactcgtgctacctgtgatcaaccaagtagctctggcaaacctttctccctactctcagcaacaacaatttcttccattcaaccaactgtctacattgaaccgtgctgcttatttgcagcaacaactattaccattcagccagctagctactgcctactctcagcaacaacaacttcttccatttaaccaattggccgcactgaaccccgctgcttatttgcagcagcaaatactactaccatttagccagctagctgcagcaagccgtgcttccttcttgacacagcaacagttgctgcctttctaccagcagtttgcggctaaccccgcaaccctcttacaactacaacaattgttgccctttgtccaacttgctttga

SEQ ID NO: 32794 - DNA, 367 bp, Zea mays
  Clone ID: LIB3059-002-Q1-K2-F7
gactccccgagtcgacaggccacaaatcccaattccaaaaccttttctccgtcccatcgccggcgatcttctccttcgccgccaatggatctctccgctgtccaggctgccctctccgacaagtcctactccaccctcgcctccctctgcgacgaacttctcctccaggccgcgtcccagggattcaccaccgacgaatggccctactctgtccacctgcttgcccacctctacatcaatgacctgaacagcgcgcggttcttctggaagtcgttgccgcaggaggtcaaggacacgcggccggagctcgccgctgtctggaggattggtcagtgcctctggaaaagagattatgctggcgtcaaca

SEQ ID NO: 32795 - DNA, 104 bp, Zea mays
  Clone ID: LIB3059-002-Q1-K2-E1
aattcacttgtttatattatgtcagaatggtcacaactacaaggtgaaattcagggagggtaccagataaaggttacaacgactgcattagctcttctcatatc

SEQ ID NO: 32796 - DNA, 433 bp, Zea mays
  Clone ID: LIB3059-002-Q1-K2-E10
gatggatgatgtctctgcgctgataattattggatcaatttcgataattattagtagatctatgagatatgccgcctggaagaggcgaggtaagctgcagcatgtaaaagtctgcgtgcgtcgacagcaaaaaagagaaaaaaagatgtgacatcctagaggaggcctttgccatgatgggtgcgctcgcatggcaagccaggtattaataaaaagatgattattgtgtgccggggggagagatcgcacggggggtgatgtttttggccccggggtctcctccctcatcttgttccgtgttcctgtatccgttgtttccgcgcctgttggtccgctgcgcacgccggatttttgcatcgagcacggagatctacaacaaaaacatggagctacgacgcgactcccaaggtacaatcggtaattatgttcaaac

SEQ ID NO: 32797 - DNA, 438 bp, Zea mays
  Clone ID: LIB3059-002-Q1-K2-E12
gattggagaactcgacaccatgaaggtgctgatcgttgcccttgctctcctggcgctcgctgcgagcgccgcctccagtacaagcggcggctgtggctgccagacaccaccgtttcatctaccgcctccgttctatatgccgcctccgttctatctgccgccgcagcagcagccgcagccatggcaataccccactcaaccaccgcagctaagcccgtgccagcagttcggatcctgcggcgtcggcagcgtcggcagcccgttcctgggccagtgcgtcgagttcctgaggcaccagtgcagcccggcggcgacgccctacggctcgccacagtgccaggcgctgcagcagcagtgctgccaccagatcaggcaggtggagccgctgcaccggtaccaggcgacatacggtgtggtcctgcagtccttcctgcagca

SEQ ID NO: 32798 - DNA, 365 bp, Zea mays
  Clone ID: LIB3059-002-Q1-K2-E2
cggacgcgtgggttcagcctcaccaaccaaggcatcagctgctatcgttctccaggccgagaaggacttgcagccttggattgctagagatgacgaacaaggtcagaagatgtggagagtcaaccagcgtatagtgaagcttatagctgagcttatgaggaaccatgacagccctgaagcgttggtgatactcgctagtgccttcgaccttctacttcgtgctaccgatggaatgctcgtcgatggtgaagcttgtactttgccacagcttgagcttctggaagtgaccgctcgggctgtccatcttatcatcgaatggcgagattcaggtttatcagttgcagatggtctttcaaatctgctga

SEQ ID NO: 32799 - DNA, 369 bp, Zea mays
  Clone ID: LIB3059-002-Q1-K2-E4
aaccaattgcccaattacaacaacaatccttggcacatctaaccatacaaaccatcgcagcgcagcagcaacaagcactgagccacctagccgtggtgaaccctatcgcctacttgcaacaacagctgcttgcatccaacccacttgctttggcaaacgtagctgcataccaacaacaacaacagttgcaacagtttctgccagcgctcagtcaactagccatggtgaaccctatcgcctacctacaacagcaacaacttctttcatctagcccgctcgctatgggcaatgcacctacatacctgcaacatcagttgttgcaacaacagttgctgcaacatattgtaccagctcttactcagctagctg

SEQ ID NO: 32800 - DNA, 386 bp, Zea mays
  unsure at all n locations
  Clone ID: LIB3059-002-Q1-K2-E5
atttgtcttgatatattgaagaatgcatggagccctgcatggacccttcagtctgtttgtagagcgataattgctctgatggcccatcctgaaccagacagcccacttaactgtgattcaggcaatctcctgcggtcgggtgacatcagaggctatcaatcaatggcccgcatgtatacaaggctggctgccatgccaaagaaaggttagatgtagaacatgtgccaagccaagagcctatgtcagtccatatgttgtcaggtttgctgtgtgctgtctgtctgtgaacttggtggttcttgtttcctaataagtcctaaccattcatgtgtgtgtattctgtattctgtatcccggattcccgatgctnggtctgtgatgtaata

SEQ ID NO: 32801 - DNA, 391 bp, Zea mays
  Clone ID: LIB3059-002-Q1-K2-E7
cctcatcctccacatctccaccgcatcggaactaggaaggcgaagccgaaggcgcggcgcggcgcggcacggatcgagcgatggcggtggcccctcctacggcggcggcgctggagcagctaagcagcagcaagatgttcgacggcttcaatctccgcttccgccaccagagcgccacccttggctgcgccatgactttctccatctacctgcccccgtccccggcgtccaaccttcccgtgctgtactggctctcgggtctcacctgcaccgacgagaatttcatcataaagtccggcgcccagcgcgccgccgctgcccacggcatcgccctcgtggcacctgacaccttcccacgtgggttaaatattgaaagagagtcagacagcta

SEQ ID NO: 32802 - DNA, 320 bp, Zea mays
  Clone ID: LIB3059-002-Q1-K2-E8
cagctagctagcgttccctcttcttcacctcactaacaccagcagctcgatcgctctgtcctgcaataatggccgctcgctcctcctcccagcagctggtcgcggcggcggcggcggcggtcctggcagcggcgctgctgctgctggcggcgggggccgggacggcgtcggcggcggtgagctgcggcgaggtgacgtcgtcggtggcgccgtgcctcgggtacgcgatgggcagcgcggcgtcgccctccgcggcgtgctgcagcggggtgcgctcgctcaacagccgcgcgtcgtcgacggcggaccggcaggccacc

SEQ ID NO: 32803 - DNA, 418 bp, Zea mays
  unsure at all n locations
  Clone ID: LIB3059-002-Q1-K2-E9
ggaatccagtagcaacaatagagcaacaatggagaccaagatattttccctccttatgctccgtgctctntctacatgtgttgctaacgcgacaattttccctcaatgctcacaagctcctatagcttccctttttcccccataccttccatcaattatagcttcagtatgtgaaaacccagctcttcaaccatataggcttcaacaagcaatcgcagcaagcaacatacctttatcgcccttgttgtgtcaacaatcgccagccctatctttggtgcagtcattggtacaaaccatcagggcacaacagctgcagcaactcgtgctacctggatcaaccaagtagctctggcaaacctttctccctactctccgcaacaccaatttcttccattcaaccaactgtctacactgaacc

SEQ ID NO: 32804 - DNA, 188 bp, Zea mays
  Clone ID: LIB3059-002-Q1-K2-F1
agaagatcaagaactgaagcttgccaaatcggttccttgcatggtttgcgtcaacaagacgtagaagtttcaaagcttttgtagctgccataggctgctgcaacgtttttaagtcggaactcttgtgttcctgttcagggtcttcagcatgacataaatcgtttcagaagtctagtaatattattatt

SEQ ID NO: 32805 - DNA, 435 bp, Zea mays
  Clone ID: LIB3059-002-Q1-K2-F10
cgttctcgtcgtgtgcctggctctgtcagctgccagcgcctctgcaatgcaggggccctgcccctgcgcggggctgcagggcttgtacggcgctggcgccggcctgacgacgatgatgggcgccggcgggctgtacccctacgcggagtacctgaggcagccgcagtgcagcccgctggcggcggcgccctactacgccgggtgtgggcagacgagcgccatgtaccagccgctccggcaacagtgctgccagcagcagatgaggatgatggacgtgcagtccgtcgcgcagcagctgcagatgatgatgcagcttgagcgtgccgctgccgccagcagcagcctgtacgagccagctctgatgcagcagcagcagcagctgttggcagctcagggtctcaaccccatggccatgatgatggcccagaacatgcc

SEQ ID NO: 32806 - DNA, 438 bp, Zea mays
  Clone ID: LIB3059-002-Q1-K2-F12
cccacgcgtccgcccacgcgttcgcccacgcgtccgcccacgcgttcgcccacgcgtccgcccacgcgtccgcggacgcgtgggccggcggacgtcaagaaggtggccaccaccttgcagcgcgccatcaaggtggtcggcacgccggcgtacgaggagatggtgaggaactgcatgatccaggatctctcctggaagggccctgccaagaactgggagaacgtgctgctcagcctcggggtcgccggcggcgagccaggggttgaaggcgaggagatcgcgccgctcgccaaggagaacgtggccgcgccctgaagagttcggcctgcagggcccctgatctcgcgcgtggtgcaaagatgttgggacatcttcttatatatgctgattcgtttatgtgatatggacaagtatgtgtagatgcttgcttgtgctagt

SEQ ID NO: 32807 - DNA, 302 bp, Zea mays
  Clone ID: LIB3059-002-Q1-K2-F2
cccacgcgtccggctgcttccattcaaccaactgactctgtcgaactctgctgcgtacctacaacagcgacaacagttacttaatccattggtagtggctaacccattggtcgccgccttcctacagcagcaacaattgctgccatacaaccagttctctttgatgaatcctgtcttgtcgaggcagcaacccatcgttggaggtgccatcttttagattacatatgagatgtactcgataatggtgccctcataccgacgtgtgtttcctagaaataatcaatatattgattgagatttac

SEQ ID NO: 32808 - DNA, 145 bp, Zea mays
  Clone ID: LIB3059-002-Q1-K2-F5
cccactcgttcggacgccttcacttccaagttctccctcgattctaagcagctgattgtaattagggtggtgaaatgtaccattttttactagatgatggcaattgttgttgaacatacatatagtggatgcactggtggggttt

SEQ ID NO: 32809 - DNA, 336 bp, Zea mays
  Clone ID: LIB3059-002-Q1-K2-F6
gtgaaaaggtgggctcgtccgagtctgccctgctcgccaagctgggtatccgccccttctcgtacggcctccaggtcaccagtgtctacgaggatgggtccgtgttcagccctgaggtgcttgacctttccgaggaggacctgattgagaagtttgccactggtgtctccatggttgcctccctgtcactggcgatctcgtacccgacccttgctgctgtgccccacatgttcatcaatgggtacaagaatgtgcttgctgttgctgtcgagacagactactcgtacccacatgctgacaagatcaaggagtaccttaaggacccaagcaagtttg

SEQ ID NO: 32810 - DNA, 331 bp, Zea mays
  Clone ID: LIB3059-002-Q1-K2-D9
cccacgcgtccgagaaagcacaatagtgtaccaacaatggcagccaaaatattgggcttccttatgctccttggtctttctgcaagtgctgctaccgcaaccattttcccacaatgctcacaagctcctatagcttcctttcttcccccatacctctcaccagcggtgtcttcagtatgtgaaaacccaattcttcaaccctacaggatccaacaggcaatcgcagcaggcatcttacctttatcacccttggtccttcaacaaccgtcagccctattacagcagttacccttggtgcatttgttggcacaaaacatcaaggcacaacaac

SEQ ID NO: 32811 - DNA, 237 bp, Zea mays
  Clone ID: LIB3059-002-Q1-K2-B5
tcgaaaaaacaaaaacacaaaaaaaacaaaaaaaaaacaaaaaaagaacaaaaacagaaaaaaggaaagacaaaaacatataacaacaaacacaagacaactaatactaaaaggcggcgtcctgttttgcggtgcccagctgttgtcaccctcagctccgagaccttctgcctgccatggtggcccataattcaaatccacttcccgagctttcacatgctcgtgaccggaaaaacc

SEQ ID NO: 32812 - DNA, 137 bp, Zea mays
  Clone ID: LIB3059-002-Q1-K2-B6
gataaatgtattaggatcataccatcatctcaagcactaatgcagattcctgtttttcgctctcagtttcatcaatcaccatatacgaaataatgtccatgctgatgttaaccattgttaaaatgcctttacctaac

SEQ ID NO: 32813 - DNA, 377 bp, Zea mays
  Clone ID: LIB3059-002-Q1-K2-C1
gggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggtgggtacggtggtggccgtggaggcggcggctacggcggtggcgggcgccgtgatggcggcggcggctacggcggtggcggcggctacggtggcggcggcggctacggtggtggtggcggcggctacggcggtggcaaccgtggcggcggctacggcaactccgacgggaactggaggaactgagcggtggggcccgcgcggccaagttatcctgttcgc

SEQ ID NO: 32814 - DNA, 434 bp, Zea mays
  Clone ID: LIB3059-002-Q1-K2-C12
cccaacttgttgtggcaaatgctggtgattcccgatgtgttatttcaaggggtgggaaggcatacaatttatcgagggaccacaaaccagagcttgcagctgagagagaaaggataatgaaagcagggggcttcatccatatgggacgagtaaatggaagtttaaacttgtcaagggcaattggagacgtggaattgaaacagaacaaattcctgcctcccgagaagcaaattgtgacggccaatcctgatatcaatgtcgtggagctctgcgatgatgacgactttgttgttgtagcatgtgatggcatttgggactgcatgtcaagccaacagctggtggattttatccacgagcgtataaacacggagagcagcctgtctgccgtgtgcgaaagagtgctggacagatgcctggctccatcaacgatcgct

SEQ ID NO: 32815 - DNA, 429 bp, Zea mays
  Clone ID: LIB3059-002-Q1-K2-C3
cccacgcgtccgcccacgcgtccgatcttcgttcagcccactgggagtggagtgactcactcgggtccattctataaaacctctgcccgggggctagggtttcctcccagccgtcatcgtttcgcgtccgcctcagcccgccgcagggagaggtaagttcaggagacatcttcgagaagctgaaatggctcctaaagctgctcctgccaagaagggtgatgccaagacccaggccttgaaggttgccaaggctgtgaagtctggggcagccaagaagaagaccaagaagatccgcacgtctgtgacatttcaccgccccacgaccctgaagaaggctagggaccccaagtacccacgaatcagcactaccggaaggaacaagcttgatcagtaccaaattctcaagtacccccttaccacagaatcagc

SEQ ID NO: 32816 - DNA, 413 bp, Zea mays
  Clone ID: LIB3059-002-Q1-K2-C7
ccctgctacgcgtagccaaagtcaacggcggcgctgccaacacgctctccaagatcaacgctgtgcgcactttgatcgcgcgcgtgctgaccgacatctagcagaagcagaagtcggtgctgcatgaggcgtacaagaagaagaagctgatgacgctcgacctccgacacaggaagacccgagccatcctcaggcgcctcaccaagcaccagctatgcttgaagaccgatagggaaaagaagcgtgagaagtatttacccatgaggaagtacgctatcaaggcctagatcagtgaaagaacattcatgctgtcaagctttgctcagaaggtacttgaatttgagacaaatgtatctgcatccaagttctatgcatctgatcaactgcatgatgaaaaactagtactttttgct

SEQ ID NO: 32817 - DNA, 372 bp, Zea mays
  Clone ID: LIB3059-002-Q1-K2-C8
ccctgctactcgtagccaaagtcaacggcgacgctcccaacacgctctccgggatcaaggctgtgcgcaccttcatctcgcgcgtgctgaccgacatctagcacaagcacaagtcggctgctgcatgaggcgtacaagaagaagaagctgctcacgctcgacctccgccccaggaagacccgatccatcctcatgcgcctcaccaagcaccagctatgcttgctgaccgataggtaaaagaagcatgagaagtatttacccatgaggaagtacgctatcaaagcctagatcagtgaaagaacattcatcctgtccagctgtgctcagaaggtacttgaatttgacacaaatttatctgcatccaaattctat

SEQ ID NO: 32818 - DNA, 74 bp, Zea mays
  Clone ID: LIB3059-002-Q1-K2-D12
attcccttatccacccactcgtccacacacactctataactccatttctatctcattttcaatcaacctatcct

SEQ ID NO: 32819 - DNA, 223 bp, Zea mays
  Clone ID: LIB3059-002-Q1-K2-D5
cccactcgttcgcccactcgttcgcggacgcgtgggaccgtagtatttgcatggcatgctggtgatggtatttgtgcaattactgcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaataaaaaaaaaaaaaaaaataaataaaataaaaaagacgacaagg

SEQ ID NO: 32820 - DNA, 312 bp, Zea mays
  unsure at all n locations
  Clone ID: LIB3059-002-Q1-K2-D6
gcatcccagcgaacaacaaggggaggaacagcattggatgcctgttctggcttttggccaggatggttctgcagatgaagggcactatcctncctgggcacaagtgggaggtcatggtggatttgttcttctacagggacccataggaagcaaaggagcaggaggaggaagctgctgttgcccctgagtttgccgcaatcactgattaccaaggacctgaccatgggggtgttgaccagtgaacctttgatgtgactgccccgcctgtggctcctactgttcctgatgggggtgctgttcaagttccggttc

SEQ ID NO: 32821 - DNA, 322 bp, Zea mays
  Clone ID: LIB3059-002-Q1-K2-D8
cccacgcgtccgcccaggcaggcaggtcggcgaggagggcaggaagaccgaagaccgagccgtgcgggggctcgggacgggaacgggacaggaccccaaaatctcagatccttcctgcccgcccgcccgtgcccgtcgacgcgtcgttcttgccggccgcgccccaccttcgccctctcctcctccaggggaatcggatacgccacaggctgcgcgatggtgctgtgggtcttcggctacggctccctcatctggaaccccggcttcgacttcgacgacaaaatcctcggcttcatcaagggctacaagcgcacctttaatc

SEQ ID NO: 32822 - DNA, 432 bp, Zea mays
  Clone ID: LIB3059-001-Q1-K2-H6
cccacgcgtccggttggtctggatcagttcatcacgaagaacgctacactcgactaatgagaaggaggctgatgcatgcccaatcagggcaatgaagttctctgtctcccctgttgtgcgtgttgctgttcagtgcaaggttgcttccgaccttcccaagctagtagaaggtttgaagcgtctggcgaagtccgatcctatggttctgtgtacaatggaagaatctggtgagcatatcattgctggagctggtgagcttcatcttgagatttgcctgaaggatctgcaagaggacttcatgggaggtgctgaaattattgtttctcctcctgttgtgtccttccgtgaaaccgttcttgagaagtcctgccgcactgtcatgagcaagtcacctaacaagcacaaccgtctgtacatggaagcgcgccccct

SEQ ID NO: 32823 - DNA, 365 bp, Zea mays
  Clone ID: LIB3059-001-Q1-K2-H7
cggacgcgtgcggagcgaggcgacgccttaggcacctaatctccgtcgaatggatatggggaccgttccaggggatctgatcttgcagattgtgaggaagaataactcctttctggtgaatcatgttgttaactgcaaggctactttccaccttaccaagctactctacagcttgaacagtatacacaagtacaatcctattgttttatctaccatggaacaatctcgttacaatatcattgttgaaactactgagctttatctttagatttgactgatagatctgcaagaggacttcatgggaggtgctgaacttattgtttatcctcctgttgtgtccttccatgaaaccgttcttgagaagt

SEQ ID NO: 32824 - DNA, 411 bp, Zea mays
  Clone ID: LIB3059-001-Q1-K2-H8
catgcgggaagatgttcaatttgtcatgcttggatctggtgacccagagcttgaagagtggatgagatctacagagtcgatcttcaaggataaatttcgtggatgggttggatttagtgttccagtttcccaccgaataactgccggttgcgatatattgttaatgccatccagattcgaaccttgtggtctcaatcagctatatgctatgcagtatggcacagttcctgttgtccatgcaactgggggccttagagataccgtggagaacttcaaccctttcggtgagaatggagagcagggtacagggtgggcattcgcacccctaaccacaggaaaacatgttgtggacattgcgaactgcaatatctacatacagggaacacaagtcctcctgggaagggctaatga

SEQ ID NO: 32825 - DNA, 441 bp, Zea mays
  Clone ID: LIB3059-002-Q1-K2-A12
gcactcttacactagcagacttagcacacttgaactgatgcttggttatcttacttattctggggaagctacggtcgaagtgcgagtcatttgcgggacatggccagctgatggttttcgtttcatctttgaggccaatgccggtataggacaatggattgtgttgcttgagactgcatagactgcagatgttggtgataagatcagccttgcacggcaggttgtttctgttgactatcatagagatagagagctgaaagttgtggccaccattacgaatggttctgctacctatacagatgaaaagggcttcaaacctctgaaaatgggtgcaagctccaaggaacttagtatcggtggcttagggttgcaagtcactgtttattggtcctgcttcccatttgcaccggtttagttagtttaaatattttttatttattc

SEQ ID NO: 32826 - DNA, 323 bp, Zea mays
  unsure at all n locations
  Clone ID: LIB3059-002-Q1-K2-A4
gatggactttcaatgactattcgacttctggacccttcccttcacgagttccttccagaagggaacgtcgaggaaatcgtgcgtgaactgtgttctgagacgggagccaaccaggaggatgccctcgcacggatcgaaaagctttcggaagtaaacccgatgcttggcttccgtggctgcaagcttggtatatcgtaccctgagctaacagaaatgcaagcccgtgccatctttgaagctgctatagcgatgaccaaccaaggcgttcaagtctttccagagataatggttcctcttgttggaacaccgcangaattgggaca

SEQ ID NO: 32827 - DNA, 260 bp, Zea mays
  Clone ID: LIB3059-002-Q1-K2-A5
cggacgcgtgggccgacgcgtgcgttcttggatgatgtatgtcgtcaaccagaaaactgggttatggaattaccactatgaagcggtatgcgtacgtcgacgagcacctgttgtgcgatatcgaaagacagcatgtcagcgtcgacgacatcgtctgtcacgacggcagcgtttgagcgcattccgagagcttccccgagttaaagcctgacgaggatgctggtatcataaaggactttgatgaacctgatactcttgca

SEQ ID NO: 32828 - DNA, 459 bp, Zea mays
  Clone ID: LIB3059-002-Q1-K2-A6
ctatgctaagatgactgaagaaattggagagcaagtgcagattgttggtgatgaccttgtcgtcaccaaccccactagggttgctaaggctatcaaggagaaatcatgcaatgcccttctgctcaaggttaaccaaatcggatctgtgactgagagtattgaggctgtgaagatgtcaaagcgtgcgggctggggtgtgatgactagtcataggagtggtgagactgaggacactttcattgctgatctggcagttggtttgtccacgggtcagattaagactggagcaccctgcaaatcagagcgtcttgccaaatacaaccagcttcttaggattgaagaagagcttggcgctattgctgtctacgcaggtgccatattccgtgcacctgtggagccctactaaacgggcgggatgcaagtgcttttatgtctgcacaagtcctgtgaaactgttta

SEQ ID NO: 32829 - DNA, 404 bp, Zea mays
  Clone ID: LIB3059-002-Q1-K2-B1
aatttttcttccctttggctccgtgaggttccggtgctcgctcgctcgcctgagcttcgatcgagcccggtcggcgaggcaggcgcccgatcgccgctctccgggagcttccggggggccgtcggatggagccgtacgcggcggcgaagagcggcggggccgacgccggcaccggcaccggactggaagactcgatgcggaggctggggctcggcgacgacggggaagcaggggaggagaagcttccggagcggccgggcgaggcggactgcgcctactacctccgcacgggcgcctgcggctacggtgagcgctgccgctacaaccacccccgcgatcggccggccccggttaatggagttggaaagaccgcagttacagtggagtacccagagcgttctgga

SEQ ID NO: 32830 - DNA, 443 bp, Zea mays
  Clone ID: LIB3059-002-Q1-K2-B10
agaaccgtctccgcaatctccccgcctccctcccgcctccacccaatggcgtctctccctaacggtggcggcgccgacgcctctggctcatgcggcgcgcgccctgtggacaaggaggtggacttcgccaactacttctgcacgtacgcctacctttaccaccagaaggagatgctctgcgaccgcgtccgcatggacgcgtaccactccgccgtcttccgcaacgcgccccacttccagggcaaggtggtccttgacgtgggcaccgggagcggcatccttgctatctggagcgcgcatgccggggccaggaaggtgtacgccgtcgaggcgactaacatggcggagcacgcgcgcgagcttgctcgcgccaacggcgtcacggatatcgttgaggtgatacagggcaccgtggaagacgttgaccttccggagaaagtgat

SEQ ID NO: 32831 - DNA, 265 bp, Zea mays
  Clone ID: LIB3059-002-Q1-K2-B11
cggcgaccaaccctctcccaacccgactagtcggactcgcagctccgccccaagtccaggtccaagcatggaagtcgcggcggcgtcggcgaggcccgtcctgcgcgtggctgccatctgcggctccctacgcaaggcctgcttcaaccgcggccttctccgcgccgacgcggaggtgtgcgaggactccatcccggggctccgcatcgacgagctcgacatctgcgacctgcccatcatcaacaccgaccttgagaccggcagc

SEQ ID NO: 32832 - DNA, 416 bp, Zea mays
  unsure at all n locations
  Clone ID: LIB3059-001-Q1-K2-H5
cgcgagcgccgcatggacttcgtgccggagaagtccgcgctcgaggtcgaagagatccgggtcgacaaggagaccatggagatgctcgctgccctcggcatggccgacctgcccggcgttgagcgccaggctgaggtctccaacgcccccgcctacggccgcccgcagtacggtggcccccgccgtgaccgcgtttagacttcgcggtggttgcctcttgatcgcactgctattcgtagttgttgtcctactatgctaaacttcttttagatctttggttgcatctgtggcggttaagttttgaacttgcctgntatggtataaattctgaagtgtttgggtctgcgtgtgatgaacatgatatgtatattcttgcgctttataaggtactatgagatgctcatatttttttgact

SEQ ID NO: 32833 - DNA, 433 bp, Zea mays
  unsure at all n locations
  Clone ID: LIB3059-001-Q1-K2-G12
cccacgcgtccgcggacgcgtgggctaccattgggggcagttgtgacaactcctgagattgcgagtgtgttagctcaaaaaatccaatttaacacatttggtggaaatccagtttgttctgctggtgggttagctgtgcttaaggttcttgacaaggagaaacgccaggcacattgtgctgatgttggatctcacttgttggagcgtctaaaatcgcttcaggagaagcacgaaatcataggtgatgttagaggaaggggactgatgcttggggtggaactcgttacggacagaaaggagaagacccctgccaagtcagaaaccattgaactgtttgagaagctcagagatctcggngtactagttggaaagggcggtctgcatggtaacgtcttcagaataaaaccaccgatgtgcttttcgaaggacgatg

SEQ ID NO: 32834 - DNA, 446 bp, Zea mays
  unsure at all n locations
  Clone ID: LIB3059-001-Q1-K2-G3
cggacgcgtgggtccagatcagcaaagcggcagtgcgtagagaggatcgtcgaacagagcagcatgaagatggtcatcgttctcgtcgtgtgcctggctctgtcagctgccagcgcctctgcaatgcagatgccctgcccctgcgcggggctgcagggcttgtacggcgctggcgccggcctgacgacgatgatgggcgccggcgggctgtacccctacgcggagtacctgaggcagccgcagtgcagcccgctggcggcggcgccctactacgccgggtgtgggcagccgagcgccatgttccagccgctccggcaacagtgctgccagcagcagatgaggatgatggacgtgcagtccgtcgcgcagcagctgcagatgatgatgcagctngagcgtgccgctgccgncagcagcagcctgtacgagccagctctgatgcagca

SEQ ID NO: 32835 - DNA, 333 bp, Zea mays
  Clone ID: LIB3059-001-Q1-K2-G4
cttcaaggtcattcctgggcccggtgagaagccaatgatagttgttcagcacaaggggggggaggaacagtttgcagccgaagagatctcctctatggttctcatcaagatgcgtgagatcgctgaagcttaccttggcagcacgatcaagaatgctgttgtcacggtccctgcctatttcaacgactcgcagaggcaggccacaaaggatgctggggtgattgctggcctcaatgtgctgcgtatcatcaatgagccaaccgctgctgctattgcctatggtcttgaccagaaggcaaccagtgtccgtgagaagaatgtcctcatttttga

SEQ ID NO: 32836 - DNA, 383 bp, Zea mays
  Clone ID: LIB3059-001-Q1-K2-G5
cccacgcgtccgctcagcattccaagtacttttgcgagttctgtgggaagtttgctgtgaagaggaaagcagttggaatttgggggtgcaaggactgtgggaaggtgaaggctggtggtgcttacaccatgaacactgctagtgcggtcaccgtcaggagcacgatccgccgcctgagggagcagactgaagcatgatatagctctttatattattggggtttcctgtagttgctcttgtcaggcatgttgtgggggccttctctagtggaaatgtggaatcactgtactggctgttttgccgagacaatgctccttatatttggtttatgctctaggatctcaaagttgtggtgttaagatttgccctcggttaccgttctg

SEQ ID NO: 32837 - DNA, 369 bp, Zea mays
  Clone ID: LIB3059-001-Q1-K2-G6
gttgcaacaacagttgctgcaacaaattgtaccagctcttactcagctagctgtggcggaccctgctgcctacttgcaacaactacttccattcaaccaactgactgtgtcgaactctgctgcgtacctacaacagcgacaacagttacttaatccactagcggtggctaacccattggtcgctgccttcctacagcagcaacaattgctgccatacaaccagttctctttgatgaaccctgccttgtcgtggcagcaacccatcgttggtggtgccatcttttagattacatatgagatgtactcgataatggtgccctcatagcggcatgtgtttcctaaaaataatcaatatattgattgagattt

SEQ ID NO: 32838 - DNA, 446 bp, Zea mays
  Clone ID: LIB3059-001-Q1-K2-G7
cacgaacaaccacatcaatgtgcaggccaacaacaacattactaacaatgacaaggccgggtgcaacaacacgaacagagccatgagcaacactaaggacagagccatgagcaacaacatcaacaacaattcaagggtcatgacaagcagtaactaccataacagtctcagcaatatcagcaggtccaggaaataatcgacaacagcaacaatgtcattgccaggagcagcaacagactacaaggtgcaggtataactactatagcagtagctcaaatctaataaattgtcatgaatatctaatgcagcagtgcagccctttggtaatgccttttctccaatcacgtttgatacaaccaagtagctggcaagtattgcagcaacaatgttgtcatgatcttatgcagattgagccacaatacattcaccaagcaatctacaacatg

SEQ ID NO: 32839 - DNA, 423 bp, Zea mays
  Clone ID: LIB3059-001-Q1-K2-G8
cggacgcgtgcgttccagcttctgatcttgatcctgcactcggagccgtacacaagaggtagtcggtagaacttgcaggagcggagcagaactaagtgcagagaacaggacatatggctacgcatgcggtgaaggtttacgggtgggctatctggccgttcgtatcgcgggctctgctggccctggaggaggccggcgtcgactacgagctcgtcgccatgagccgccaggaccgccaccaccgacgatcggagcacctagccaggaaccctatcaggaaggtgccagtgctcgaggatggcgacctgacgcgcttcgaatcacgcgcgatcgcaaggcatgttgttcggaagcacaagccgtagctgatgggcggcgccatgctggaacaaactgtgatggtggacgtgtggctggaggtgg

SEQ ID NO: 32840 - DNA, 438 bp, Zea mays
  Clone ID: LIB3059-001-Q1-K2-G9
gcattcagaaacacacctagcgaagcgcactagcaacgacctaacaacaatggcttccaagacattatccctccttgcgcttcttgccctttttgtgagtgcaacaaatgcgttcattattccacaatgctcacttgctccgagtgccattattccacagttcctccctccagttacttcaatgggcttcgaacacccagctgtgcaagcctataggctacaacaagcgcttgcggcgagcgtcttagaacaaccaattgcccaattacaacaacaatccttagcacatctaaccatacaaaccatcgcaacgcagcagcaacaagcactgagccacctagccgtggtgaaccctatcgcctacttgcaacaacagctgcttgcatccaacccacttgctttggcaaacgtagctgcataccaacaacaacaacagtt

SEQ ID NO: 32841 - DNA, 418 bp, Zea mays
  unsure at all n locations
  Clone ID: LIB3059-001-Q1-K2-H1
gagaccaacaagcaacatagaaagtggaatccagtagcaacaatagagcaacaatggagaccaagatattttccctccttatgctccttgctctttctacatgtgttgctaacgcgacaattttccctcaatgctcacaagctcctatagcttccctttttcccccataccttccatcaattatagcttcagtatgtgaaaacccagctcttcaaccatataggcttcaacaagcaatcgcagcaagcaacatacctttatcgcccttgttgtgtcaacaatcgccagccctatctttggtgcagtcattggtacaaaccatcagggcacaacagctgcagcaactcgtgctacctgtgatcaaccaagtagctctggcaaacctttctccctactctncgcaacaacaatttctttc

SEQ ID NO: 32842 - DNA, 447 bp, Zea mays
  Clone ID: LIB3059-001-Q1-K2-H10
cgtccggccacgcgtccggctatggcttccgcggcgcacgcccgcgcccccaccgacccgcttcccaagggtgctgatggatttttccgggcagtaatctcgaacatggaaaaggtttatttgagcaggaatcctacagccaaaaccattctggagcttgtacgatcttatgatggtgatcatatttgctatgatcactttgctttccggacatttggggtcaatggttatggtataaactcactttctgactttttcactgattttggttatttacctcgcgaagaactcagatttccagctaaaaagcttagggcactatggttttccccgcccactaatgatggctactctggaactggtacatatggacctttgccaaggatattcatttcagaacttcttgtggatgagttgactactcaaagccaggaaattatacataaa

SEQ ID NO: 32843 - DNA, 372 bp, Zea mays
  Clone ID: LIB3059-001-Q1-K2-H11
gttcgacgacgtgctccgtgcggggcagctgctcatcgtaccccagggctacctcgtcgccacgcaaggcgcacggagaaggcttccagtacatcgccttcgagacgaaccctgacaccatggtcagccacgttgccgggaagaactccgtcctgagcgacttgccggccgccgtcatcgccagctcgtatgccatctgcatggaggaagctgcagagctcaagaacggtaggaagcatgagctggctgcgcttactcctgctggcagtggcagctaccaacaaggtcaagctggcagcgcccaacagtaggcacaacctcagagtgatctgcctgaataagtactcgtagactggtataattaaacaaagc

SEQ ID NO: 32844 - DNA, 396 bp, Zea mays
  Clone ID: LIB3059-001-Q1-K2-H12
cgtctgcttcgttcaccatcttctctcctactagaaagaaatttgcgcagatctcatggagtagtggcagtattgctgctctgattagtttcttgtcgagtgtgcatgaaatggctgtgagatctgctgatgtttctttccggtgtagaatggaatcgtctcccctaataataacaataataatacattctgaaaaaaaaaaaaaaaaaaaaaaaaaaaaaaaaaaaaaaaaaaaaaaaaaaaaaaaaaaaaaaaaaaaaaaaaaaaaaccaaatctaaaagacacaaaacatacaaagaaatacaataaacataatagacaccaaaaaaaaatacactgaacaaaattaaaaaaaactaaggggggcggcgttttaaggggtcacactttttaat

SEQ ID NO: 32845 - DNA, 345 bp, Zea mays
  Clone ID: LIB3059-001-Q1-K2-H3
gtcagtaaagtaaattctgtcgctccaattcggacgaggagatgccgcggatccctctgatcaggttccccaagcggaatctcaaagccccatctccatccgcgccagcggcgtcgcaacccgcagaccagcacgcgaccctcatgttccggttaggggctaaagcagaggcaccatcttctggagagattaaaaattaccgctttagatctgatgtgccttgtccaccttctcatactgctgtaggagggccagcttcactccttcctaagcgcaaacccctgactgaaggagagattgaggctattatgctgggggggctccatttgatatcacctcatatga

SEQ ID NO: 32846 - DNA, 435 bp, Zea mays
  Clone ID: LIB3059-001-Q1-K2-H4
ctgcttagatattctgtatgactcgtggtcaccagcgatgaccgtgagctctgtctggatcaggatcctgtctatgttgtctagttcgccagcaaagcaacgcccggcggacaatgaccgctatgttaggaactgccgcaacgggaggtcgccaaaggagactagatggtggttccatgacgacacggtgtaatgatctctgtggcattgcctgtcagccttctgtactgtgatatatctcttcaagggggagatgagatgatttaggcctatttctaagcaaccctctattggattgcgaagcttaccttgctgtggtggtatgtaaatgagttgctcacgtgtcagtctgggaatatgtgttatcaccatcaatgatataatatagcatgaagcatgattggaccctgcctaagtcactgaaacgagctcaaa

SEQ ID NO: 32847 - DNA, 253 bp, Zea mays
  Clone ID: LIB3059-001-Q1-K2-G11
cccacgcgtccgtctactcgtccgcccactcgtacgaaaaaaataaaaaaaaaaaaaaaaaaaggaaaaaaaaaaaaaaaaaaaaaataaaacacactaataaaaaaaaaaaaaaaaaataataataaaaaaaaaaagtgggctccatttaaatgatccaagtttacttaccattacttgcaacgatataaatctactatatggtgacctaaatttaatatcatgaccctccttttaaaatattacaactcta

SEQ ID NO: 32848 - DNA, 423 bp, Zea mays
  Clone ID: LIB3059-001-Q1-K2-E11
cggacgcgtaaggtcatccacactaacgaacgaactcttgctccgatcacgagctagctgagggcgaccatcgcggctgtgctgaacagcatgaagactccgcaagtggtgtccgtgctgctaatggctgcgctgctggcttcgtccgcgtcggcggcgatcacctgcgggcaggtggggtcgtcgctggcgccgtgcattccttacgcgacggggagggccagcgcgctcccctcgtcgtgctgcaacggcgtcaagagcctcaacagctcggcgcggaccatctcggaccgtcaagcggcgtgccgatgcctcaagagcctcggcaacagcgttaagagcgtcaacatgggcaccgtcgccaccatccccggcaagtgcggcgtctacgtcgtattccccatcagcatgttcaccgactgc

SEQ ID NO: 32849 - DNA, 400 bp, Zea mays
  Clone ID: LIB3059-001-Q1-K2-E12
agattcgtgagttcaaccaaattcggtttcgtatgtaaacgcatcgacattgcaatcctccaagatcgagtacgcgattcttacgtcaacaaactcgcctacaccacacacaaccactcccttcacaacgccttcaccacctacaacgaaaaccacgcttccaataccaacctcgatcacaatacacataagaacctaggctatctatcagacacctattccactctatataccatacttaacaccatcgaattcataaactgcattatcacatactaacctatcaacaacgttaaccaggcccagatctatcacaagcaaagattccacgaccttgtgtaccctctagctcctcttatcgtgaaatacgtcaagaacccacgaagtgctgtatgcaaaa

SEQ ID NO: 32850 - DNA, 423 bp, Zea mays
  Clone ID: LIB3059-001-Q1-K2-E5
aattgccgtcacgactccctcatcagggtgacaatcagctgccctgagaacgggaggagcgccgcagggaagctcgtgcgcctaccgaggtcgatggccgagcttctcggactaggtgcaaagaagttcggcatcaagcctgccaaggtcctgacagttgatggtgctgagattgatgaggtggagcttatcagagacagtgatcatattcttctcgtcagtgatgaatgggtgccagatgttgcacaaattatgcctaaacaataagtgagccagctgtagagctcttattgcaatttgacatgatatgggaaaacatgcccctgtgaccctgtgtgcatgtccacatttaaactgaagtgtagcttatgatggttttgaagctttatgatgcattcagcttggaaatgaattcgtactcac

SEQ ID NO: 32851 - DNA, 83 bp, Zea mays
  Clone ID: LIB3059-001-Q1-K2-E6
atttcactttgaaagatatttaatgattttcgaaccatgtctactgattactgcttgagcaagattacaatgttcttttgcct

SEQ ID NO: 32852 - DNA, 433 bp, Zea mays
  Clone ID: LIB3059-001-Q1-K2-E7
ctactttggaacaggagtacaagagtgatatctttggagagcgaggcatcttgctggagcctgtccatggtatcgtggaggctctgtttaggaggtacacagaacaaggaatggatgaagagtcggcctacaaaaacactgtcgagggcataactgggatcatctcgaaaaccatctcaaagaaagggatgcttgaagtgtacaactctttgagcgaggaaggcaaaaaggagttcaacaaggcttatagcgcatcgttttacccatgcatggatatactctacgaatgctatgaagatgtggcctctggaagtgaaatccggagcgtggtgttggctgggcggaagttttatgagaaagagggcctcccagcttttccgatgggcaacatcgaccaaactcgcatgtggaaggttggtgaaaaggtgcgctc

SEQ ID NO: 32853 - DNA, 328 bp, Zea mays
  Clone ID: LIB3059-001-Q1-K2-E8
gtgcgacgaggaggaagttgagaaagatgtgaaagctcggacaaaaggggaactcggggctgcgaaaacattgtgtactccatttgagcagccagaacttccagaaggtaccctgtgctttgcatctggaaagccagcaaagaagtggtcgttttggggccgcagctactgattgcctttgctgggagtccttttggattcagtagtgaaccatgtaacttcgagattttggatacaaatcggaaaatccatttacattgtctttacatcgacttgcagttctgatgtcatcacagctgaaaaaaagccattgattccagtggacaaa

SEQ ID NO: 32854 - DNA, 121 bp, Zea mays
  Clone ID: LIB3059-001-Q1-K2-F1
accacgcgtacgccaacacattggcgtttacattttccgtaacatttatgccatccaggggttcggtaaacttttatataataacatcaagcagatcattctgcaacaactacaaatcatc

SEQ ID NO: 32855 - DNA, 446 bp, Zea mays
  Clone ID: LIB3059-001-Q1-K2-F12
cccacgcgtccgattcttcaaccctacaggatccaacaggcaatcgcagcaggcatcttacctgtatcacccttgttcctccaacaaccgtcagccctattacagcagttacctttggtgcatttgttggcacaaaacatcaaggcacaacaactacaacaacttgtgctaggaaaccttgctgcctactctcagcaacagcagtttcttccattcaaccaactggctgcattgaactctgctgcttatttgcaacaacaactaccattcagtcagctagctgctgcctacccccagcaatttcttccattcaaccaactggcagcattgaactctgctgcttatttacaacagcaacaactaccaccattcagccagctagctgatgtgagccctattgccttcttgacacagcaacagttgttgccgttctacctgcacgctgc

SEQ ID NO: 32856 - DNA, 365 bp, Zea mays
  Clone ID: LIB3059-001-Q1-K2-F2
gttcaaaacagcccaagaaaagagagatgcctgtgttcatgtcgtgaacacttgggatgaattcggaactgctctgaataacaaaaagttgatcttggctccatggtgtgatgaggaggaaattgagaaagatgtaaaaactcggacaaaaggggaacttggagctgcgaaaacattgtgtactccatttgagcagccagaactttcagaaggtaccctgtgctttgcatctggaaagccagcgaagaagtggtcgttctggggccgcagctactgattgcctgtgctgggattatttctggattcagttctagggagttatgtaactttgaagtgtcggatacaaattcaaaaattcatttaca

SEQ ID NO: 32857 - DNA, 418 bp, Zea mays
  Clone ID: LIB3059-001-Q1-K2-F3
cccacgcgttcgggcacacgcactacacgcacggcacgcagatacatatagagagagggtagctgtagcttgcacatctatttaactaactaactaactggctagctagctcgatccgcagagcaaagcgaaagcagcaagaagcaaagcaatggagaaccctgcgagtgtgctagttctaccagcgcagttcaccaaactcaccttcggaaacctgtacatccgccgggccgggccgggcagcagggagataaccgaggagggcaggtgcgacctggacaagagatacgtgagtgacttccccgtctacgacggccgcggccccgacgccagccttgtggcccgcgtgcaggggatcaccagcgaaatcgggaacgcgcaccaactgttcgtcgttgttttcgacaccgacaggctc

SEQ ID NO: 32858 - DNA, 464 bp, Zea mays
  Clone ID: LIB3059-001-Q1-K2-F4
ccggaatcgaccgcatgcactccacagcgtccgttctagctgccagttcggctggggatgatcctaatttggctgatcaaggtggtagcggatagtctgatactggcatgtccaaaggaagctctcactccttactaaagcgctctacaaaccaacatactactacatctcagtctgttcccacagatctgtcagcaatcaggctgaagaaagcaggacttgcgttctctgatggtatgtttttgcaaactgtggttaatgttactttgaagttctatgtaaaagtcagcttaattcgcttcacttaaaacaaagctgtcaattgctaaagtaatactgtctagatcacaaacctgaagtgtgagtggcttatacgtatgtcctgtggtagtttgaacgagcacaatgttagtgcgcaacttgttgcacaataacaggcaacctgaagtatttcttttgttact

SEQ ID NO: 32859 - DNA, 321 bp, Zea mays
  Clone ID: LIB3059-001-Q1-K2-F6
gctctactgtcttgaccgctctgcactaatctatcatcatcaggcggagggggtaccgtgatgattcagaactttgtacatgcgtcggtggatgatggtataacataatgtctatgcacaagtaatactactacaaaccgatcaatgtatctatgtatcatctatctcaaatgctagctagtatagcactacaaacatgtctatatatatatagcatcatgctaataaataggaatataagcatgatatctaacggctgcgtaattaattccaatcatgtgtgtaatatgtgggcaaatagcaaaactttatagattccaa

SEQ ID NO: 32860 - DNA, 320 bp, Zea mays
  Clone ID: LIB3059-001-Q1-K2-F7
actacacgtccgcgcacgcgttcgagtccagatgagaagtgacctggaatcttgctggggtaccgctacatactcgtactagatagtcatacgcgctgctaaactgttaggattacgcaaacgcatcactacaacgccaacatccgagcttcttatcactagccgccgaatacgcattcgtatctgccttagtactgattcatctagataggacacagctccagctgctagagatcgaatggaccacgcagaaggactattacatcatgaacaatcttgtcaacaagatccgatctgtgatatacgtcttccatgttcac

SEQ ID NO: 32861 - DNA, 430 bp, Zea mays
  Clone ID: LIB3059-001-Q1-K2-F9
ctgttctacccatggcttgatagtaaatggatgcctcagcctctaattctccgcgctgaagtgtacaaggttggtgtcacacactacttttcgttcttgaaagctagagaggagctcggctacgtgcccattgtgaggccccacgaaggcttggccgcaacgatctcgtactggcaagagcggaagagaatggagctggatggcccgaccatatttacttggctggccgtaacgatcgggatgctggccgtgttttctgccgcctgcctcccgccagtcggcccgttgaaatgggtgctcgacgtccacatgtttgttttccgctcgatgctcgtgatccggctggtcttggcggtagcgatcgcactgcatgctggcgaagccgtgtacgcctggttcttggcgagaagggttgacccgaggaacgctg

SEQ ID NO: 32862 - DNA, 442 bp, Zea mays
  Clone ID: LIB3059-001-Q1-K2-G10
cggacgcgtgggggagaactcgacaccctgaacgtgctgatcgttgcccttgctctcctggcggtcgctgctgacgcctcctccagtacaagcggcggctgtggctgccagacaccaccgtttcatctaccgcctccgttctatatgccgcctccggtctatctgccgccgcagcagcagccgcagccatggcaataccccactcaaccaccgcagctaagcccgtgccagcagttcggatcctgcggcgtccgcagcgtcggcagcccgttcctgggccagtgcgtcgagttcctgaggcaccagtgcagcccggcggcgacgccctacggctcgccacagtgccaggcgctgcatcagcagtgctgccaccagatcaggcaggtggagccgctgcaccggtaccaggcgacatacggtgtggtcctgcagtccttcctgc

SEQ ID NO: 32863 - DNA, 436 bp, Zea mays
  Clone ID: LIB3059-001-Q1-K2-E10
atttcactgaatgctgctgatggtcgactaaagcagacaagagaatagagggaccagtttcagggagcaatcgatcatatgatatttactttacaagcaaaggacaatgacctgtcaaaatctattgactcatgtaacatggaggccagtgtagtcaagacttgcgtaaatatcctcgaggatacatggcaacttcagttgtcatacaatgaacagaatgaaactaaaacgaatgacgagctggaaagatgcacaagcagttttctgaagttgaccaagcatcatctttcctatatcaaggaagttcttagcccatcaattgagcggatacgcacatacgtggataattcggcagtcttaaactctagggaggagtcaatagaacatggacgggatgatgagatttctgagcagacaagtccacaaaagtcccttg

SEQ ID NO: 32864 - DNA, 280 bp, Zea mays
  Clone ID: LIB3059-001-Q1-K2-C4
cccacgcgttcgaaaaaaaatacaagttttaattttaaaaaaaacaaaatacacaaagggaattggaaaaaatatatataacaatataaaaaaaaactaaattaaaaaaaaaaataggcccatcattctaaagatccaaattttcgtacacgttcattcaatgtcataacttttttataatttgacttaaattaaattaactggacctctatttacaacttctaaccttttaaaaccctgtcttctcccaacttaattaccttacaatatattccccttt

SEQ ID NO: 32865 - DNA, 437 bp, Zea mays
  Clone ID: LIB3059-001-Q1-K2-C5
gcatccaacatcgcaatagtgtccaccggtgatgacaaagcaaaggctgttcacataggagtttctgacatggccgaaggtcttgatgctcctacatcgctgcctgctagaatggtccagccaacggacgggaagctggtatggtttctggacaaggcggcggcatcattccttgactccaagaacgacgatgacgacgcttgctacgagcgtcatgagtgactaactccgaggatccttggtcgttttgaagcgaatgaacggaggtgtgtgtaagtaggtggttgcgtatgatggaagacgcgctgttccccttttagctcgatgcatgggttaattttgttctgagggtttttagctccggaaatctgaaattgctctcggtccttttgcagtgaggtgatttaaagcgatgaaatgtgtatgcgatgttgagt

SEQ ID NO: 32866 - DNA, 213 bp, Zea mays
  Clone ID: LIB3059-001-Q1-K2-C6
gatacgcgtaccgattgcacgtggataggaactcctatctgaacagactgacgaccgtgaacgtcttgtgaatgtgactagttatgtgatctatcatcgacggttcgatacagatgcacagcgtgtgcatattgctgcaaacattatcccactctctcgccatgctgaagacaatgatccacgacgcatgactatgccaactaccaggagtta

SEQ ID NO: 32867 - DNA, 408 bp, Zea mays
  Clone ID: LIB3059-001-Q1-K2-C7
gctgaacggtagtactagttgttgatgcaaataagcagccagctgctgtctggcccgggcaatttcttccattcaaccaactagcatcattgaactctcctgcctatgtacagcagcaacaactactaccattcatccagctagctgctgtgagccctgctgccttcttgacacagcaacaattgttgtcgttctacctgcacgctgcgcctaacgttggcaccctcttacaactgcaacaattgctgccattcaaccaacttgctttgacaaacccagcagcgttctaccaacaacccatcattggtggtgccctcttttagattgcttatgagttatagttcaataataaagtttttttgatgatgtttgcggcttcccagagataagaaagtacatttctagatt

SEQ ID NO: 32868 - DNA, 433 bp, Zea mays
  Clone ID: LIB3059-001-Q1-K2-C8
agctgatgcaggggtagcaagggaagaaatcaactacgtgaatgcccatgcaacttgggcacaagcaggtgacctgaaggagtatgaggctattgtgcgctgttttcgtcagaaccctcaactgacggtgaactcgaccaaatcaatgactgggcatcttatacgagcagctggtggaatagaagcagttgcttctatacaagctataagaactggttgggtccatccaaatttgaatttagaaaatcctgaggacactgtggatgtgggcatcttggtaggatcacagaaggagagatgtgaggtgaacgtggcgttaatccaactcattcgccttcggtgggcacaactcatcaattctgtttgccacctttaaggaactgccatcttcctcatcgtccaaatagattcatatatctggatctccacatag

SEQ ID NO: 32869 - DNA, 427 bp, Zea mays
  Clone ID: LIB3059-001-Q1-K2-D1
acccaatgtttctcaatcaaaagacgtggagaatggaaatgacaattctgtgaaatcctgcattagcaagcctgtgttgaatggcaacaaatgtgccaacaaggaacaaaatgttccgtcttgttgccctggcgctgtgacaaatggaaacgaggctggaaatgcagacgtggagtacattgattctgagaatctagtggatctaccagatgttgatgcagctctatgtaccttagttaaaaggttggattcaaaggactgggttatgacatgtgaagctctcaacaatgttcgtcagttggcgatgtatcacaaggaaagattgcaggagctgctggagcctctagttcctcttatcgtgaaatctgtgaagaacccaagaagtgctgtatgcaaaacagcactgatgacttgtgctgacatcttt

SEQ ID NO: 32870 - DNA, 446 bp, Zea mays
  Clone ID: LIB3059-001-Q1-K2-D10
attgcgggaaaatggtcacaagctcctatagcttatcttcttcccccatacctctcaccagcggtgtcttcaggatgtgaaaacccaattcttcaaccctacaggatccaacaggcaatcacagcaggcatcttacctttatcacccttgttcctccaacaatcatcaaccctattacatcaattaccttcggtgcatttattggcacaaaacattaaggcacatcaactactacaactcttgctagcaaaccttgctgcctacgctcatcaacatcagttacctttggtgcaatttgtggcacaaaacatcagggctcaacatctactacaactcgtgctagcaaaccttgctggctactcttaacatcagcagtttctgccattcaaccaactagctgcattgaactctgatgcttatttgcaacaacaacaactactaccatt

SEQ ID NO: 32871 - DNA, 312 bp, Zea mays
  Clone ID: LIB3059-001-Q1-K2-D11
ctgatagtctgagactgagagagatagaggtgatgatggcggtgcatgcgcaggggacgcgggtgccgctggtcctggcgctcttcctcctcctggccggttgcggcagcgaggcgcagccgctggtgccggcgctgtttacgttcggtgactcgtcggtggacgtcgggaacaacgactaccttcacaccatcatcaaggccaacttcccgccatacggcagggacttcgccaaccacgtcgccaccgggaggttctgcaatggcaagctggcgaccgacatcaccgtcgacacgctggggttcactacct

SEQ ID NO: 32872 - DNA, 434 bp, Zea mays
  unsure at all n locations
  Clone ID: LIB3059-001-Q1-K2-D12
nccacgcgtncgcagcaacagcagtttcttccattcaaccaactagctgcattgaactctgctggttatttgcaacaacaacaactaccattcagccagctacctgttgcctacccccagcaatttcttccattcaaccaactggcagcattgaactctcctgcttatttacagcagcaacaactactaccattcagccagctagctggtgtgagccctgctaccttcttgacacaaccacagttgttgccgttctaccagcacgctgcgcctaacgctggcaccctcttacaactgcaacaattgctgccattcaaccaacttgctttgacaaacctagcagtgttctaccaacaacccatcattggtggtgccctcttttagatttcttatgagttatagttcaataataaaagtttttgtctgatgtttgt

SEQ ID NO: 32873 - DNA, 75 bp, Zea mays
  Clone ID: LIB3059-001-Q1-K2-D2
gaatcgagaggccgaccacggagggttacaagtgcagtgcccatacagcagtcacgggatcgtatccgtcgcagc

SEQ ID NO: 32874 - DNA, 383 bp, Zea mays
  Clone ID: LIB3059-001-Q1-K2-D3
cggaattccggtcgaccacgctcgggcgccttttaccagctttcgtggtcactttcctgctccgttgctacaccgagacgcaagcacgtccggtgactatgggcgtcagcgaggaagtgcgagtcgcagagcttccgcttcaagggaccttgctcgagggacgccaactgcacaaacgtatgcctgacctaaggtttcacggacggtgcgtgcataggcctactacaccggtgcttctgcaccaaggactgctagtactgcctggcctcgccttgtgacctgcgtgtgcatagccgtagcggatcactgaaacatgcatgcatgcgttactgaatatttggcagtaccagcaagttaatgaattaaataatatgtaatggaac

SEQ ID NO: 32875 - DNA, 235 bp, Zea mays
  Clone ID: LIB3059-001-Q1-K2-D4
tcccgaattcgacggcacgcactcacgcgacccgtatcagcaaagcgtcagtgcgtacagaggatcgtcgaacagaacagcatgaggatggtgatcgctctcgtcgtgtgcctggctctgtcagctgccagcgcctatgcaatgcagatgccctgcccctgctcgaggctgcaaggcttgtacggcgctagctcacacctgacgactatgatgggcgccggcctactcgacccat

SEQ ID NO: 32876 - DNA, 439 bp, Zea mays
  Clone ID: LIB3059-001-Q1-K2-D5
cccacgcgtccgccaacaagcaacatagaaagtggaatccagtagcaacaacagagcagcaatggcgaccaagatattttccctccttatgctccttgctctttctgcatgtgttgctaacgcgacaattttccctcaatgctcacaagctcctatagcttcccttcttcccccataccttccatcaatgatagcttcagtatgtgaaaacccagctcttcagccctataggctccaacaagcaatcgcagcaagcaacatacctttatcacccttgttgtttcaacaatcgccagccctatctttggtgcagtcattggtacaaaccatcagggcacagcagctgcagcaactcgtgctacctgtgatcaaccaagtagctctggcaaacctttctccctactctcagcaacaacaatttcttccattcaaccaactg

SEQ ID NO: 32877 - DNA, 425 bp, Zea mays
  Clone ID: LIB3059-001-Q1-K2-D6
gatcagcaaagcggcagtgcgtagagaggatcgtcgaacagaacagcatgaagatggtcatcgttctcgtcgtgtgcctggctctgtcagctgccagcgcctctgcaatgcagatgccctgcccctgcgcggggctgcagggcttgtacggcgctggcgccggcctgacgacgatgatgggcgccggcgggctgtacccctacgcggagtacctgaggcagccgcagtgcagcccgctggcggcggcgccctactacgccgggtgtgggcagacgagcgccatgtaccagccgctccggcaacagtgctgccagcagcagatgaggatgatggacgtgcagtccgtcgcgcagcagctgcagatgatgatgcagcttgagcgtgccgctgccgccagcagcagcctgtacgagccagctctgatg

SEQ ID NO: 32878 - DNA, 403 bp, Zea mays
  Clone ID: LIB3059-001-Q1-K2-D7
cagacgcgtcgttgcactactgtgagtgattatatgattagtataggatgcttgtggggggctttctagcagttcaagctgatgcatcctgtaaatactaatgcggtatgctagagactatgggatgtctagaccctgaactgtaaggtgattccattgcttcgtacccgtttacagataatctacgtctagtatgtctctatcaactgatagtttgactggtgagagtagtgcggtagaccacctgaattgtatggtatcattattgattgacatatgtgagcctactctgcagcctgctggtccagagtgctcaattgcagcagagagtacaggccgtgcactcacacgctactaagagttagatagtttcaacaaagttagatctgcaaatcaggtacgc

SEQ ID NO: 32879 - DNA, 142 bp, Zea mays
  Clone ID: LIB3059-001-Q1-K2-D8
cactaacgctacttctacttcggaaccgccgacgctaccggcgcctcatattatcaggtaccgcacgaggtcgcggcctccctatcggtggtccatcgtgcgatggcgtgcgcacctaccgcgctgtgctacggtccagcgt

SEQ ID NO: 32880 - DNA, 217 bp, Zea mays
  Clone ID: LIB3059-001-Q1-K2-E1
cccacgcgtccgggtcgtgcgcggcacctacaagggccgcgaggggaaggtggtgcaggtctacggacgacgctgggtcatccacgtcgagcggatcacccgcgagaaggtgaacggctccaccgtgaacgtgggcattcaccccttcaaggggatcgtcactaagctgaagctcgacaaggaaccgaaggcgctcctggaccgcaaggtccggggc

SEQ ID NO: 32881 - DNA, 332 bp, Zea mays
  Clone ID: LIB3059-001-Q1-K2-C2
cccacgcgtacgttctccgtcccgcctcggcactcgacggccgccggcacacaccgcgcggtcgggagacaggaaccggaggaacgaggatggaggatgactcgccgctgacgaagacgatgaagggtgcggtgacaggactcgccgcggggaccatctggggcaccgtcgtcgccacctggtacgacgtgccccgtgtggagcgccacgtcgcgcttcctggccttatccggacgctcaagatgtgcggcacctacggggccaccttcgtcaccatcgggggcctctacatcggcgttgagcagcttgtgcagagccagcgcaagaagcgc

SEQ ID NO: 32882 - DNA, 431 bp, Zea mays
  Clone ID: LIB3059-001-Q1-K2-A8
cccacgcgtccgcccacgcgtccggagggaacgtgacgagatggaggcgaggatgatggaggagcgggaggcggagcgggaggctcgcctggcagatcatcagaggatggcggagatgttccagtacatgcagagccttggcgccgcacagggcttcgctccgccacctccattgttccctgcagttgaccctgctatcttccatactcctggccaatctggggcgacatgcaacaaccctcatgaagggttcagcccaacgcagcaccagtcgaactcgccacctccatgagagttatgtttctagtgtttagacttcagaacttgcgttcaatacttatgttcttgatacttatgagacttatgaacttgtgttgaatagttatgtcagagctcgagacttatgagacttatggtctttatacttatgt

SEQ ID NO: 32883 - DNA, 368 bp, Zea mays
  Clone ID: LIB3059-001-Q1-K2-A9
caacaagcaacatagaaagtggaatccagtagcaacaatagagcaacaatggagaccaagatggtttccctccttatgctccttgctctttctacatgtgttgctaacgcgacaattttccctcaatgctcacaagctcctatagcttccctttttcccccataccttccatcaattatagcttcagtatgtgaaaacccagctcttcaaccatataggcttcaacaagcaatcgcagcaagcaacatacctttatcgcccttgttgtgtcaacaatcgccagccctatctttggtgcagtcattggtacaaaccatcagggcacaacagctgcagcaactcgtgctacctgtgatcaaccaagtagc

SEQ ID NO: 32884 - DNA, 439 bp, Zea mays
  Clone ID: LIB3059-001-Q1-K2-B1
gcaacatagaaagcacaatagtgtaccaacaatggcagccaaaatattttgcctcctgatgctcgttggtctttctgcaagtgctgctacggcgaccattttcccgcaatgctcgcaagctcctatagcttcccttcttcccccgtacctctcaccagcggtgtcttcggtatgtgaaaacccaattcttcaaccctacaggatccaacaggcaatcacagctggcatcttacctttatcacccttgttcctccaacaatcatcagccctattacatcagttacctttggtgcatttattggcacaaaacatcaaggcacaacaactacaacaacttgtgctagcaaaccttgctgcctactctcagcaacagcagtttcttccattcaaccaactagctgcattgaacctctgttcttatttgcaacaacaacaacta

SEQ ID NO: 32885 - DNA, 428 bp, Zea mays
  unsure at all n locations
  Clone ID: LIB3059-001-Q1-K2-B10
ccttgacgaaggaaaaggcagccttctcaccgtcggacccggcgatgcagcggcacgtcgcctgcggccggccgtcgggcacggacggctccgacttttcttaccgcatggtcgtcgaatcccggtaccagagggtcgccgagggcagatcccgcctcgcgcgcctcatcctcgtgcaggcgctgcacctagtggccggaggcttgcttctattgctgtcgttgtccaagggggcggcggtgaacaagttcgccgtgctgtccatggccgcgggattcctggctatagtggtgggggaattagggcgaatgcggaccatggcagtgctgcttcggctttacacaagcttgtcatcaattgcggttgcattctctgtgacgtgcattatccggtcagaggtgttcttgaggttatgaagcanaacacag

SEQ ID NO: 32886 - DNA, 337 bp, Zea mays
  Clone ID: LIB3059-001-Q1-K2-B11
acgcgtccggccaagcgtctcgcctcgtcagatcgaccgggaagaagggagcagaagccaaccggctcgtccggccgttgccgatcgtcgctatggccgccgtggaggtgtgcgtgaaggccgccgcggggaaccccgacacgctcggcgattgcccgttctcgcagagggtgctgctcacgctggaggagaagaaggtcccgtacgaggtgaagctcgtcgacctcggcaacaagcccgaatggtttctgaacattatcccagatggtaaggtgcctttgttcaacggtggagatggcaaatgcattgctgattctgatgtaatcacccaagtcat

SEQ ID NO: 32887 - DNA, 419 bp, Zea mays
  Clone ID: LIB3059-001-Q1-K2-B12
gaacgagcaagcaagccaccaaggaaggttgctagggccggggcggatggggtgcatactgcgggtgaggctcgcctccttcttcgccggcgcggctgccgccgccacgggcgggggctacttcctctacaaggactacaagctcgccaacgattctatggccctcaaggtgaaatgtctccaggactcaactgacactcgctacgaagcccttgaaaagcgactcgctgctttggaaggtcagcaaagcactgaggctgcaccggatgtggatacgccatcagattagtctgttcgctacgagactttgatttacgtctgttttcgtttaccccagttgtcttctcctttgaaagcaagtacctgaccaacaacataataatctaggatgcttctttggactgcaagtctgcaaatgt

SEQ ID NO: 32888 - DNA, 315 bp, Zea mays
  Clone ID: LIB3059-001-Q1-K2-B2
gtcaacaatacccttaatatctcccgtgagactcttcagcagaacaagatcctgaaggtgatccggaagaaccttgtgaagaagtgtgttgagctcttctttgagattgctgaaaacaaggaggactacaacaagttttatgaggctttctccaagaacctcaagcttggcatccatgaagactcgcagaacaggggcaagattgctgagcttctgagataccactccacgaagagcggtgatgagctgaccagccttaaagattatgtgacgaggatgaaggaggacagaacgacatctactatatcactggtg

SEQ ID NO: 32889 - DNA, 328 bp, Zea mays
  Clone ID: LIB3059-001-Q1-K2-B3
aggacgcatggctgacgacgagcatgctgcacatgaagtagagggcattgcacaagcgggttcagaccataccgagtataggactatgacctgcgcagttgaacaagagcgatatgtccaggtcagctactgaccatatacatacggataggttgagcagatacagaatcgaattggcactactgatgatacattagcaggaacattactgcgcctaggtgacagggctgctgtgttacataatccgagcacactaatctctcacgagactagcaaaggatagaggactaaggttgacataggcacgagctcgatacatcctctggga

SEQ ID NO: 32890 - DNA, 344 bp, Zea mays
  Clone ID: LIB3059-001-Q1-K2-B4
cgaaggcaatggtcgaggagttattgaaggagtatgagaacgtctgcactctgcgagggcggatgccgatatcctctgacctcagcaacccgcggaacttcgtgacaaagatcagccgttacaacaaggtggtgaacatccccaacagcatgacgatattggacgaactcctgcccatctcagtggagatggcgaagaggaacctgcggggcatctataacttcaccaaccccggcgtcgtcagccacaacgagatcctagagatgtacaagcagtacatcgaccctagcttcaagtggacaaacttcaccctcgaggagcaggcgaaggtcatcgttgctccg

SEQ ID NO: 32891 - DNA, 373 bp, Zea mays
  Clone ID: LIB3059-001-Q1-K2-B5
gagcattcagaaacacaccaagcgaagcgcactagcaacaacctaacaacaatggctaccaagatattatccctccttgcgcttcttgcgctttttgcgagcgcaacaaatgcgtccattattccacaatgctcacttgctcctagttccattattccacagttcctcccaccagttacttcaatggccttcgaacacccagctgtgcaagcctataggctacaacaagcgattgcggcgagcgtcttacaacaaccaattgcccaattgcaacaacaatccttggcacatctaacaatacaaaccatcgcaacgcaacaagcacaacagttactaccagcactgagcccactagccatggtgaacccctgtc

SEQ ID NO: 32892 - DNA, 365 bp, Zea mays
  Clone ID: LIB3059-001-Q1-K2-B6
cagaccattagctctatctactccagagcgcataacaacccgatcgacaccatgagggggttgctcgatgccctcgctctcctggctctcgctgcgagcgccacctacacgcatacaagcggcagctgcggctgccagccaccgacgccggttcatctaccggcgtcggtgcatctgccaccttcgggtcacctgccacctactgtgcatctcccaccgccagtccacctgacggcgccgggccacctgccaccgccggtccatgtgccgccgccggttcatctgccgcctgcaccatgccactaccctactcaaccgcaccggcctcagcctgatccacagccacacccatgctcgtgccaaca

SEQ ID NO: 32893 - DNA, 398 bp, Zea mays
  Clone ID: LIB3059-001-Q1-K2-B7
caaattgcaccaagaaatccatcgagaggccgtcgacaggggaattaatggcgtcgtggtctagcagcagccaccgccgcctcatcctcgcagccgccgtcctgctctccgtgctcgcggctgccagcgccagcgccgggacctcctgcgtgccggggtgggccatcccgcacaacccgctcccgagctgccgctggtacgtgaccagccggacctgcggcatcgggccgcgcctcccgtggccggagctgaagaggagatgctgccgggagctggcggacatcccggcgtactgccggtgcacggcgctgagcatcctcatggacggcgcgatcccgccgggcccggacgcgcagctggagggccgtctagaggacctgccgggctgcccgcgggag

SEQ ID NO: 32894 - DNA, 366 bp, Zea mays
  Clone ID: LIB3059-001-Q1-K2-B8
cggacgcgtgggcgcaaattgcaccaagaaatccatcgagaggccgtcgacaggggaagtaatggcgtcgtcgtctagcagcagccaccgccgcctcatcctcgcagccgccgtcctgctctccgtgctcgcggctgccagcgccagcgccgggacctcctgcgtgccggggtgggccatcccgcacaacccgctcccgagctgccgctggtacgtgaccagccggacctgcggcatcgggccgcgcctcccgtggccggagctgaagaggagatgctgccgggagctggcggacatcccggcgtactgccggtgcacggcgctgagcatcctcatggacggcgcgatcccggcgggcccggacgc

SEQ ID NO: 32895 - DNA, 417 bp, Zea mays
  Clone ID: LIB3059-001-Q1-K2-C1
gcaacatataaagcacaatagtgtaccaacaatggcagccaaaatattttgcctactgatgctcggtggtctttctgcaagtgctgctacggcgaccattttgccgcaatgctcgcaagctcctatagcttcccttcttaccccgtacctctcaccagcggtgtcttcggtatgcgaaaacccaattcttcaaccctacaggatccaacaggcaatcacagctggcatcttacctgtatcacccttgttcctacaacaatcatcagacctattacatcagttacctttggtgcatttattggcacataacatcagggcacaacaactacgacaacttgtgctagcaaaccttgctgactactcttagcaacagcaagtgcttacattcaaccaactagctgcattgaactctgcttc

SEQ ID NO: 32896 - DNA, 267 bp, Zea mays
  Clone ID: LIB3059-001-Q1-K2-C10
ccacccactcgtccaaaaaaacatatataaaaataataaataatatttattataaattataaaaaaaaaaaaaaaaaaaagaaaaatttgaaaaatttaaaaaataaaataaaataataatataaataaaaataaaataatataatataattatatataaaaaaataaaaaaaaaaaaaatccccccctcttataaaatcccaacataattatcctcctcattcctattttataatttttttaaatatcccccaaaataaaattaac

SEQ ID NO: 32897 - DNA, 252 bp, Zea mays
  unsure at all n locations
  Clone ID: LIB3059-001-Q1-K2-C11
agaagcgtgctcctgggaaggctttcctcgatgccgttgcttaagtgcggatgcgaatccttgggttttgctgtagcgtatcttactttgcttcgtggaacatgaatttcaagtgttttgagggtattacagtgccttatgtgaacttgcctatcttgtgctgaacatcggaatgtatcctccgagtatgtttaatcgcattaattntaaaaaaaaaaaannaataataaatataaaaaaaaatattatatt

SEQ ID NO: 32898 - DNA, 444 bp, Zea mays
  unsure at all n locations
  Clone ID: LIB3059-001-Q1-K2-C12
gatcgcgtcctcatttcccaccgnccttctgatgccagcggtcaagggattgttctgtcacttgaacatccaagatcaggagatgaagtagggtatctatttattgatggccaactacaagagatcaactggtttaaggagcgttatggtgcttggttcttgggagattatgtttgtgaagatggtggcctttattattgcacccctgttgatcccatcttcattttcctaccaacttttgaagctgcacgtatgtcgaacgataaggatccaggaaaattcagacaattggatgaaatattgtatgttgagggatatcctggttatcagcagctaatgaatgtagctaaccaccatatggaattggtttgtgaagtaaaagaagtatctaacatgaagttctttaggctggacaactccaaggtcttatcttggttgtgctgc

SEQ ID NO: 32899 - DNA, 410 bp, Zea mays
  Clone ID: LIB3059-001-Q1-K2-A7
caagaacccatggccaaatgttgatgctcacagtggagttttgctgaaccactttggagtatctgaagcacggtattacactgtcttgttcggtgtttcaagaagcatggggataggatctcagctcatctgggaccgtgcccttggcctgccacttgagaggccgaagagtgttaccatggagtggctggagaactactgcaagaacaaggctgcttgaagcttttcacaaatgctgctttttcccaaccttggctgttaataatttaaacgcgagttatagaaatagtcattttccctttggccgttgaataacgcaagagcaatatgctcaggcggaagaattttgtatcttccgtaacttggtgaacatccagatacttgatctgcggcaacaatgggcagaagag

SEQ ID NO: 32900 - DNA, 255 bp, Zea mays
  Clone ID: LIB3059-001-Q1-K1-F2
ggtcaaaacagcctaagaaaagagattcgcatttgttcatgtcgtgaacacttggggtgaatgcacaactgctctgaataacaaaaagttgatcttggctccatggtgtgatgaggaggaaattgagaaagatgtaaaaactcggacaaaaggggaacttggagctgctaatacattgtgtactccatttgagcagccagaacttccagaatgtaccctgtgcattgcatatggaaagccagcgaagaagtggtc

SEQ ID NO: 32901 - DNA, 146 bp, Zea mays
  unsure at all n locations
  Clone ID: LIB3059-001-Q1-K1-F3
gtccgcgcactcgtcctgtcacacgcactattcacactccacacacatacatatagagagagggnatgtanatcttaaacgtgccttgaacttactaactaactggctaactagctcgaaccgcatagcaaatctaaagctgcaat

SEQ ID NO: 32902 - DNA, 373 bp, Zea mays
  Clone ID: LIB3059-001-Q1-K1-F4
aggcagggttctagtgcgagtatggtcggggttgatcctaatttggctgatgaaggtgttagtaaatggtctgattctggcatgtccaaaggaagctctcactccttactaaagcgctctacaaaccaacatactactacatctcagtctgttcccacagatctgtcagcaatcaggctgaagaaagcaggacttgcgtcctctgatggtatgtttttgcaaactgtggttaatgttactttgaagttttatgtaaaagtcagctgaatttgcttcacttaaaacaaagctgtcaattgctaaagtaatactgtctagatcacaaacctgaagtgtgagtggcttataggtatgtcctgtggtagtttgaacg

SEQ ID NO: 32903 - DNA, 199 bp, Zea mays
  Clone ID: LIB3059-001-Q1-K1-F7
ggcactcgtccgcttacgttaacggttccagatcaggagggacctcgcagcctccggcactttcgcaaggtcctctgcctctgcagtcgacgcgctccggggctggtgggatgacgtcaactgagtcgccccattgccaggacgcggccttcttatccctctccgacgtctactcatttgactcctccgtagcactgat

SEQ ID NO: 32904 - DNA, 236 bp, Zea mays
  Clone ID: LIB3059-001-Q1-K1-G10
cgatatcctaaagtgttttgttttcttatcatcaccatgtctttactttcaggccgcatcaaactcaatctctcagaacccacataaaagatcattgctgagtacatatgggttggtggatctggtatggacctcagaagcaaagccaggactctacctgggccattgagtgaccctgcaaaactttcgaagtggaactatgatgggtctagctatttatcaagctctaatggatg

SEQ ID NO: 32905 - DNA, 393 bp, Zea mays
  unsure at all n locations
  Clone ID: LIB3059-001-Q1-K1-G11
ccgcacgcgtccggtccccatggtagngttagtggcatagtgaatgtgaacatacctgctgatggtgcatgaaattggtggagcatttggtggagaaaaagcaactggtggtggacgagaagcagggagtgattcctggaagcagtacatgaggagggcgacttgtacaatcaactatgggagcgagctacctctagcccagggaatcaattttggttaatcctgcagaaatgttgcgcgtggatctcaaagttttctgcagacgtggatgccgtatggaaagaactgatgcaaccgcatatgagatcttagcaaaactgagcagcatttattggcgtcagttgtgaaacttaaactgcaggaacatcttgtacataaataaaataagatgtt

SEQ ID NO: 32906 - DNA, 126 bp, Zea mays
  Clone ID: LIB3059-001-Q1-K1-G6
caacattgctttaacactagtaccagctcttactcagctggctgaagcaaacttttaatggctacttgcacctactatttccattcaaccaactgactgtgtccaactctgctgcgtacctacaac

SEQ ID NO: 32907 - DNA, 54 bp, Zea mays
  Clone ID: LIB3059-001-Q1-K1-G8
cggactcgtgcgttcaagctgaagctccaaaacctgcaccccgagccgggcaca

SEQ ID NO: 32908 - DNA, 209 bp, Zea mays
  Clone ID: LIB3059-001-Q1-K1-H10
cgcacgcgttcgattagaactatattttctggggatacaaattttagccggggtatgggttcaagtaaggattctgatccttttgatggactctatgttggtgcatttggcccttatggcatggaaatagtgcatttgaggctaaaattttgacattggaatgaattggacaatgaaaacaaaacttcttatgtgggattctttgaata

SEQ ID NO: 32909 - DNA, 196 bp, Zea mays
  unsure at all n locations
  Clone ID: LIB3059-001-Q1-K1-H4
ctgcttagagattctgtatgactcattgnaacttccgatgaccgagagctctgacgaaatcggtaacctgtaaatgacctctacatcgccagcaaagcaacgcccggcggacaatgaccgctatgttaggaactgccgcaacgggaggtcgccaaacgagactagatggtggatccatgactacacgacgaaaaga

SEQ ID NO: 32910 - DNA, 175 bp, Zea mays
  Clone ID: LIB3059-001-Q1-K1-H6
cccactcgtccggttggttttggacttatcatcacgaagaacgctacactcactagtgagattgaagctgatgcatgcccaatcagggcaatgaagttctctgtctcccctgttgtgcgtgttgctgttcattgcaatgttgcttacgaccttcccaagctagtacaatgtttga

SEQ ID NO: 32911 - DNA, 171 bp, Zea mays
  Clone ID: LIB3059-001-Q1-K1-H8
cgtgctgaagatgtcatttagcctgcaaggatctggtgacccagaggtagaagataattttaaagcgacagagaccatccccaaggatgaatttcgtggatgggttaggatataagagctccagaaacccacccaacaactgccgattgcaagatatagctaaagccaacc

SEQ ID NO: 32912 - DNA, 428 bp, Zea mays
  Clone ID: LIB3059-001-Q1-K2-A1
gatggtgttttggaactaatgaaacatgcaaccgagtgtggtttggaaacaaataagggtatctcacttgatgtgtcaacaaggtggaattcaacttttctgatgttgagggatgctttatactataaggatgcttttactcaactcaagcttgctgatcggcgtaagtatgaacacatatctccaactcctgaggagtgggacaaggccaaaatgttgtttcatgccttgaaaaaattttatgatctgactgagcttctgtccggtactttatatccaactggcaacttggtctacaaaagcttttgtgagattagaagtttgcttggtgactggtctactagtgaagatatcaatattcgtgaaatggctatttccatgagcaaaaaatttgagaaatattggaacaaaagcaatgttgctcttgc

SEQ ID NO: 32913 - DNA, 235 bp, Zea mays
  Clone ID: LIB3059-001-Q1-K1-F11
agggctttcagtcttatggagtgccccttaacacgcacgctatgaagaaagctgaagctgctttcaatgataactgacctgcgaatattaagctagtcgctcctccactttatgttttgaccacacagacccttgacaaggatcaaggcatttcagttctcactactgcaatcaaggcatggacagcatagattgaaaagtgctaagtgaaagtatgtatgaatgaacaaccaag

SEQ ID NO: 32914 - DNA, 429 bp, Zea mays
  unsure at all n locations
  Clone ID: LIB3059-001-Q1-K2-A11
ccgatggctcatcgcgttctcctcctgctctctctcgcgttggccgcacagggctaggcacaagggtcgacgcggaggacccggtgatccggcaggtggttcctggtggagatgacaacgatctggagctgaacgcggagtcccacttcctgagcttcgtgcagcggttcggcaagtcctacaaggacgccgacgagcacgcgtaccggctgtccgttttcaaggccaacctgcgccgcgcgcgccggcaccagctgctggacccgtcggcggagcacggcgtcactaagttctccgacctcacgccggcagagttccgccggacctacctcggcctccgcaagtcccggcgcgctctcctcagagaactcggggagtcggcgcacgaggcgcccgtgcttcccaccgatggtctncccgacgatttcg

SEQ ID NO: 32915 - DNA, 451 bp, Zea mays
  Clone ID: LIB3059-001-Q1-K2-A12
attccccgtccagccactcgtccatcacattaccaacatacccactttgctaaaccaccttaaaagatatcttaggctcatcaaagaacttttgcatgcactggactcatttgctcaaagtacaacttggttatcacacctataaacttgaaccttttcaatgttaaccttgcaatggcttttacaggcctgtatcatctttcactgaagatcatgcaacattacttatcccatgataaagatgctgcttcacaactgtaatcatatataatgacaacaatcaaagaataactgattgtaaatcctgcatcctatgagtctactcttgattttttttttctgtgcaagcaaacaataacttatctttcatgtttgttttcctgttattctgaaatcttgagcattctaattttaaaatctttccccaaaaataaaaaccaattaaatcatt

SEQ ID NO: 32916 - DNA, 421 bp, Zea mays
  Clone ID: LIB3059-001-Q1-K2-A3
gcgtcagcggacgcgtggaaaaaaaaaaaaaaaaaataaaaaaaaaaaaaaaagaaaaaagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggccctttttaaagtttcaaagtttaattacccttaatttcaaattaaaagttttttaataggtccacttaaataaaattcattggccacgtttttaaaaatttttaattggaaaaaccttgggttaaccaaattaaatccttttgaaaaaaatccccttttcccaaattgggttaataccaaaaaggccaaaaaaaatggccttttcaaaaatttgcaaatctttaatggcaaatggaacccccctt

SEQ ID NO: 32917 - DNA, 434 bp, Zea mays
  Clone ID: LIB3059-001-Q1-K2-A5
cccacgcgtccgagggcatgtggcgttagagggatctgaaccctagcggtcgtccgtgggtccagatctgtgacccgaccttctcgacgcttcggtgacatgagtgcctggaaatctagggaggcgaaaaggtcagagttcagtcatgtcatgcttgatttgagttctgtgccagatcaaagcaagtagtagtacgtgagaagttaaccatgaacagacaccctttttctctttgtgtatcacagattttgaaacttgctgagagggaaaaacaaatttatggggaaaaaatgtgacactgaaagccatttgcttccagcagcttaagaattgttgcggtagatgcaactgaagagggtcttcaagtaagtaaatcaactactacaatggctcactaaaaatggtcgacaggacagttttaggaccttattggt

SEQ ID NO: 32918 - DNA, 259 bp, Zea mays
  Clone ID: LIB3059-001-Q1-K1-A1
gatggtgttttggttactaatgaaacatgcaacctagtgtggtttggaaacaaataggtgtatttcaattgatgtgtgaacaaggttgaattcaacttttctgatgttgagggatgctttatactataaggatgcttttactcttctcaagcttgctgatctgcgtatgtatgaacacatatctacaactcctgatgagtttgacaatgcctaaattttgttttattcctagaaaataagatatgttctaacttaactt

SEQ ID NO: 32919 - DNA, 177 bp, Zea mays
  unsure at all n locations
  Clone ID: LIB3059-001-Q1-K1-A10
ccggctccacccacgcgtccgcagtcgccagccctatctttggtgcagtcaangctacaaaccatcagggcacagcaagtacattataatgaagctaagtctgctcaatcaaggggcgtctgcaaacctttctccctactctcagcaactacaatttcttccattcaaccaactgtc

SEQ ID NO: 32920 - DNA, 157 bp, Zea mays
  Clone ID: LIB3059-001-Q1-K1-A11
cccggctcgcacccacgcgtccgcggatggctcatcgcgttctccgccttcctctctcgcgtcggccgccgcggtctggacgatcgaaaacacggaggacccgcccatccagcgggggggccccggaggagatgacaacgagctggagcggaacgcg

SEQ ID NO: 32921 - DNA, 384 bp, Zea mays
  Clone ID: LIB3059-001-Q1-K1-A3
ggaaccaaaaattaaaaaaaaaaaaaaaaaaaaaagaaaaaagaaaaaaaaaaaaaaaaaaaaaaaaaacaaaaaaaaaaaaaaaaaaaaaaaaaaaaaaaaaaaaaaaaaaaaaaaaaaaaaaaaaaaaaaaaaaaaaaaaaaaaaaaaaaaaagcaataaaaaaaaaaaaaacaaaaaaaaaataaaaaacaaaaaaaaactaaaaaacaaaaaaaaacaaaacaaacaaaaaaaaacaaaaacaacaaaaataacaaaaaaaaaaaaaaataaaaaataaaaacaaaacaaaaaataaaaacaaaacaacacaaacaaaaaaaaaaaacaaaacacacaacaaaaaaaaaacaaaaaaaaacaaacacaaaagacaacaac

SEQ ID NO: 32922 - DNA, 185 bp, Zea mays
  Clone ID: LIB3059-001-Q1-K1-A5
ggcactcgtccgatggcatttggcactagagggatctgaaccctaccgggcgcccggccattctgaactgagaccggaccttctatactctgcggagacatgagtgcctggaaaactatagaggcgaaaaggtcacagtacattcatgtaatgctcaatttgagtactgtgccatatcaaagcaa

SEQ ID NO: 32923 - DNA, 120 bp, Zea mays
  Clone ID: LIB3059-001-Q1-K1-A6
ggttgaacaatggcataaatatgaactctaaaccaaaaaaaaaaaaaagggaaaaggtaaaattaaaaaggacaaaaacccaaccaaaaaacagaaaacaaacaaggcccccccccctaa

SEQ ID NO: 32924 - DNA, 225 bp, Zea mays
  Clone ID: LIB3059-001-Q1-K1-A7
gaccctcgcgtccgcgagatcccatggtcaaattttgacttccacagcggagttttgctgagcgactttggactatttgaagcgacggtattacactgtcttgttcggtgtttcaagaagcatggggataggatctcagctcatctgggaccgtgcccttggcctgccacttgagaggccgaatagtgctaccatggagtggctggagaactacttcaagaacaa

SEQ ID NO: 32925 - DNA, 51 bp, Zea mays
  unsure at all n locations
  Clone ID: LIB3059-001-Q1-K1-B10
gcgctcttacactatcatacttagcactcaagacactgatgctnggatatc

SEQ ID NO: 32926 - DNA, 164 bp, Zea mays
  Clone ID: LIB3059-001-Q1-K1-B12
agaaccctctccgtaatctccccgccatcccccgcctccacccaatggcgtctctgccgaattgtaacagcgccgacgcctctatctcatgcggcacacgccctgtggactatgatgtggacttctccaactacatttttcacgtacacctacctttaccacca

SEQ ID NO: 32927 - DNA, 369 bp, Zea mays
  Clone ID: LIB3059-001-Q1-K1-B5
gagcattcagaatcacactaagcgattcgcactatcaacaacctaacagcgaatggcgaccaatatattatccctccttgctcttcttgctctttttgcgagcgcaacaaatgcgtccattattccacaatgctcacttgctcctagttccattattccacagttcctcccaccagttacttcaatggccttcgaacacccagctgtgcaagcctataggctacaacaagcgattgcggcgagcgtcttacaacaaccaattgcccaattgcaacaacaatccttggcacatctaacaatacaaaccatcgcaacgcaacagcaacaacagttcctaccagcactgagccacctatccatggtgaaccc

SEQ ID NO: 32928 - DNA, 283 bp, Zea mays
  Clone ID: LIB3059-001-Q1-K1-B7
caaattgcaccaagtaaattcatcgattggccgtcgacaggggaattaatggcgtggtcgtctagcagcagccaccgccgcctcatcctcgcagccgccgtcctgctctccgtgctcgcggctgccagcgccagctccgggacctcctgcgtgccggggtgggccatcccgcacaacccgctcccgagctgccgctggtacgtgaccagccggacctgctgcatctggccgcgcctcccatggccggagctgaagaggagatgctgccgggagctggctgaca

SEQ ID NO: 32929 - DNA, 195 bp, Zea mays
  Clone ID: LIB3059-001-Q1-K1-B8
gggactcgtgggctcaaattgcaccatgaaatccatcgagaggccgtcggcaggagaataaatggaaagggcctcgagcagcacccaccgccgcctcatcctcgcagccgccgtcctgctctccgtgctcgcggctgccagcgccagcgccaggacctcctgcgtgccagggtgggccatcccgcacaacccgct

SEQ ID NO: 32930 - DNA, 456 bp, Zea mays
  Clone ID: LIB3059-001-Q1-K1-C11
agaagcgtgctccttggtaagctcaactcaatgccgcagctaaagtgcggatacagatggtttacaaaaaactttagacaatcctaattaacgggcgagaacatgaataacaagatgaaagaaggaataacaatgccaaaagtaaacttaaccaaataataacaaaacaaaaaaaaagtataaaaaaaaattaaataaataatgtaagaaaacttaaaaaaaaaagaaataaaaaataatataaatacaaataataatgataaatataataaaaaaaaagaaaatataaataaaaaaataaaataaaacaataataaaaataattaaaaaataatatatataaacataaaaataaataaaaaaataaaacaaaaataaaaaatataataatatatataaaataataataatataaaaaaaaaaaataaaaaaaataagaaatacaataaataataa

SEQ ID NO: 32931 - DNA, 63 bp, Zea mays
  Clone ID: LIB3059-001-Q1-K1-C6
ggcactcaaaccgtacagctcaaagagtcgaaccccgcacagaacagacggacaacgagcaac

SEQ ID NO: 32932 - DNA, 55 bp, Zea mays
  Clone ID: LIB3059-001-Q1-K1-D1
ccaacaaagaacaaaacgcgccaccaagaagcccaagcacaaaaacaaaaggaaa

SEQ ID NO: 32933 - DNA, 51 bp, Zea mays
  unsure at all n locations
  Clone ID: LIB3059-001-Q1-K1-D10
cccacgcgtccggctaatggcacattanaatcacccatagtttgtntgatg

SEQ ID NO: 32934 - DNA, 52 bp, Zea mays
  Clone ID: LIB3059-001-Q1-K1-D11
gtgcgttgcgtcgtgagtgcccggaatcaacaccgacagtctgagactgaga

SEQ ID NO: 32935 - DNA, 346 bp, Zea mays
  Clone ID: LIB3059-001-Q1-K1-D6
gatcatcaaagctgcagtttgtagtttggatcgccgaacagaacagcatgaagatggtcatcgttctcgtcgtgtgcctggctctgtcagctgccagcgcctctgcaatgcagatgccctgcccctgcgcggggctgcagggcttgtacggcgctggcgccggcctgacgacgatgatgggcgccggcgggctgtacccctacgcggagtacctgaggcagccgcagtgcagcccgctggcggcggcgccctactacgcctggtgtgggcagacgagcgccatgtaccatccgctccggctacagtgctgccagcagcagatgatgatgatggacgtgcaatcctg

SEQ ID NO: 32936 - DNA, 160 bp, Zea mays
  Clone ID: LIB3059-001-Q1-K1-D7
cggatctacccttcacattcaaaactcaaaacccgaacagcacaccaggccagtgtcaaacttaaaaggaccccaacctaaaccaacccgcgcataccaatgccatatcagcctacactacgacgaccaaccccacaaacaaaagaacccaccacagaaa

SEQ ID NO: 32937 - DNA, 113 bp, Zea mays
  Clone ID: LIB3059-001-Q1-K1-E11
cggacgcgtggggttattcacactaactaacgacctcctgctccgatcacgagcgggcggatttcaacgatggcggctgtgcttaacatcaggaagacgccgcaggtggtggc

SEQ ID NO: 32938 - DNA, 375 bp, Zea mays
  Clone ID: LIB3059-017-Q1-K1-B4
tgcttacctcgatgggctagaggcttctggcttgagtgacttatcccgagttactagcgttgcgtccttctttgtcagccgagtggacacccttattgacaaaatgcttgacaagattggaacacctgaggcccttgccttgagaggaaaggctgcagtagcacaggccaaactagcaaatcggctctaccagaagaaattctctggcccaaggtgggaggcgttggccaagaaaggtgccaagaaacaaaggttgttgtgggcatccaccggtgtcaagaacccagcttatcctgacactctggatgtggacagtctcatctgacctgacacgttcaacacgatgcccgaccaagctttgcaagcatttcatag

SEQ ID NO: 32939 - DNA, 146 bp, Zea mays
  Clone ID: LIB3059-001-Q1-K1-A2
cgtcctagcaatcatcatttatctaactaacttaagcattaaatcaaaactgcaacatcaatgatctagctaaatttaccatgactctagcgcttgtagttcttgctttcattgctttaatatcaagtgtttcttgtacacataca

SEQ ID NO: 32940 - DNA, 178 bp, Zea mays
  unsure at all n locations
  Clone ID: LIB3059-001-Q1-K1-B11
cccgggtccacccacgcgtccgcgcaagacctcgcttcgtcagatcgtccttgaacaacggagcagaagccaaccnncgcnttttcacagagcctgggggcgctatagccgccgtggaggtgtgcgtgaaggccgccgcggggaaccccgacactctcggcgatagtccgatctcgca

SEQ ID NO: 32941 - DNA, 152 bp, Zea mays
  Clone ID: LIB3059-001-Q1-K1-C2
tgcacgcgtgcgttttccgtctccgcttcagcattcgacggccgccggcacacaccagagcagtggtaaattctagaacgcggaagagactaggatgtgatgatgactcgctcgctgactgaagactgatgaatggtgcgtgtgacattgac

SEQ ID NO: 32942 - DNA, 245 bp, Zea mays
  Clone ID: LIB3059-001-Q1-K1-D5
tgcactcttccgccaacattcaagcttgaaagcggaatccagtagcaacggcagaggaacaattgcaaccaacatatgccccctccttatgctccttgctctttctgcatgtgttgctaacgcgacaattttccctcaatgctcacaatctcctatagcttaccttcttcccccataccttccatcaatgatagcttctttatgtgaaaacccatctcttcttccctattagctccaacaagcaa

SEQ ID NO: 32943 - DNA, 139 bp, Zea mays
  unsure at all n locations
  Clone ID: LIB3059-001-Q1-K1-E12
aataccggcgtcgacccacgcgtgcgggagaatccaatttgtgacacgaatgacaaacttcctatgactgcgcagacccaagangttcttaaaacgctgaacggcccacaataggggagccatgatgataaaccagccc

SEQ ID NO: 32944 - DNA, 190 bp, Zea mays
  Clone ID: LIB3059-001-Q1-K1-E4
ccggtcgactcacgcgtccgagagagccgagatgatcaccctacgattacaaatgatcagccagagccccggaagcgagctaggcaaaacccaaagggccaggagcccacagcggatacgagcaatatcaacaaagagacatagaaaaagtaaagcgatgaaccccagccaagagaggcgaaagaaggaa

SEQ ID NO: 32945 - DNA, 226 bp, Zea mays
  Clone ID: LIB3059-001-Q1-K1-G1
gtccgcgaggatctacctttcttcatagagttgctggttgagtacgcgaaagcgatggaagagctggggtaaattctgctggagcttatctcccggagcctgaagctgaggcccgaccggctgcacagcttcttcaaggaccatacgaccttcatccggctgaaccactacccttcttgccctagcccctacctggccctcggcgtgtggcggcacataggactcc

SEQ ID NO: 32946 - DNA, 202 bp, Zea mays
  Clone ID: LIB3059-001-Q1-K1-G12
ccggctcgacccacgcgtgcgcccacgcgttcgatctccttctcaataactatattattcttccattcccgtctggatttaatcatacataacccgtccattcacatgcgaggatgaaatcaactcccctgtgtctcctgctactctttacaaggccctaattacagatacctacaacttcatcccaaaagcacttgattcc

SEQ ID NO: 32947 - DNA, 261 bp, Zea mays
  Clone ID: LIB3059-001-Q1-K1-H1
cctgagaccaacaagctacatataaagattaaaacttgatcaacaatagagcaacaatggagaccgtgatattttaactacttatgctccttgctctttctacatgtgttgctaacgctacaattttccctcaatgctcacaagctcctatagcttccctttttcccccataccttccatcaattataacttcattatgtgaaaacccatctcttcaaccatataagcttcaacaaacaatcacaactaaacaacatacct

SEQ ID NO: 32948 - DNA, 101 bp, Zea mays
  Clone ID: LIB3059-001-Q1-K1-H11
cccgctccacagctcactatcggcggccgctctaagatccaagctacgtcacctgcatcgactctaggtgggtttaaaaactaaaccaaccactgccggcg

SEQ ID NO: 32949 - DNA, 382 bp, Zea mays
  Clone ID: LIB3059-001-Q1-K2-A10
gctgagtgattctacggatccatttaaccgctcccacctgactcaagacatgggaataccaaacacggagctcaagttgcagatcgaggaatttgtccagtcccagcagttgagaaagcgaactgctgcggtgtcagagattggccaagcggatggtgctgatgatatggccgaatgaattgtgcgagcagcagggatggacattttcttttgtggtggggaaagacggatgctaatttacgcgaaatttaccagttcatcggtccgtataaaatcggtttgccagcttgtgtcaccatttgtctccattctttgtaaatgttgtaagtgcacggttgtaattttaagtccctgtttgtttacctttgaaaaaaagtattct

SEQ ID NO: 32950 - DNA, 278 bp, Zea mays
  Clone ID: LIB3059-001-Q1-K2-A2
cccgggtcgacccacgcgttcgatcaatcatcattcatcttagtagtctaggcaccaaatgaaatctgcaacctcaattgtgtaactgcaaaaaccatgaagctggtgcttgtggatcttgctttcattggtttaatatcaagtggtttttggacacagacaggcggctgcagctgtgggcaacaaccaaggcatgagccataacttcatccacaacagcatgattcacggaaacaacgacatttaacaccatcacaacattatctgcagtagctaca

SEQ ID NO: 32951 - DNA, 305 bp, Zea mays
  Clone ID: LIB3059-001-Q1-K2-C3
ggccaaatcaagacgggagctccttgccggtctgagcgcctggccaaatacaaccaggtgctcaggatcgaggaagagctcggtgatgccgcggtctacgccggagcaaagttcagggcaccagtggagccctactaagaaaggaagaggatggggatgttttcttgtggagctatactagctcgctgctgccttttgttacaatgtttgtacggtcgcaataaatgtatggtcgtgtttgctcgagagctactcaggtgattttgtcgtgggagcaccaaaagcagaaaagaactgttttttta

SEQ ID NO: 32952 - DNA, 344 bp, Zea mays
  Clone ID: LIB3059-001-Q1-K2-F5
gcgccggcctctccggcgtcgtctacgagcacctcgtcgccggcccggccgccgaggaggaggagcccgcgccgagctgcggcgaccgccgtcgtgcgtagaggactacatgcatgcaggagcagcaggacgtcgtcgtcgtccccgctcctcggaatcttctgaataaaaaaaacagcttgcatgcgtgctcaattgttgtgtgtcgtggtcgatcatgagtagaattaatgtttcatgcatgcactcttaccgtcttctacttatgtccttgtttgcttcaataatctggcttgtgcgctgggtgtaaaaaaaaaaataacaaaaaaaaaaaaaaagaaagc

SEQ ID NO: 32953 - DNA, 205 bp, Zea mays
  Clone ID: LIB3059-001-Q1-K2-G2
tgcgttgcttctcgtcaggactcgggaacttttccaactccgatgctaagcgtgtagcttgcttggtcagtcgatgtaccatgttaatcaagtgctagccctttctctgctctgtcgtcgaagttcttcggtcttcacttcttgatctgcagatgatatatgaaaacgttatacgaaatggaatataatattctatcttgttgac

SEQ ID NO: 32954 - DNA, 451 bp, Zea mays
  unsure at all n locations
  Clone ID: LIB3059-001-Q1-K2-H2
tgctcgtaccggtccggaattcgacgccacgcgtcaggcttcgtcagagaatgcagtcgatcttgcagaggccatcctagagaaatcggaaggcaaggtgcggctgaccggcttgggcgcccgtgacagtctccgactggaggcaggcctgtgcctgtacggcaacgacatggagcagcacatcacgccggtggaagccggcctctcatgggcgatcggcaagaggaggagggcagagggcggtttcctgggcgcagacgtgatcctgaagcagcttcaggaaggcccaaagatcaagcgcgtgggcatggtcacgcaagggccgtccgcgcggagccacagcgagctggtgaaccgctcgggggaaaggatcggcgaggtgaccagccggaggttcagcccgtgcctgaagaagaacatcngctatggctacgtgaagtcgggaatgcac

SEQ ID NO: 32955 - DNA, 342 bp, Zea mays
  Clone ID: LIB3059-001-Q1-K2-H9
ggtccggaatcccgggtcgacccacgcgttctccacgcgttcgccacgcgttcgccacgcgttcgtcacgcgttcgcccacgcgttcggacgaactagcaacatagaaagcacaatagtgtaccaacaatggcagccaaaatattttgcttccttatgctccttggtctttctgcaagtgttgctaccgcaaccattttcccacaatgctcacaagctcctatagcttcccttcttcccccatacctctcaccagcggtgtcttcaatgtgtgaaaacccaattgttcaaccctacaggatccaacaggcaatcgcaacaggcatcttaccattatcaccct

SEQ ID NO: 32956 - DNA, 433 bp, Zea mays
  unsure at all n locations
  Clone ID: LIB3059-002-Q1-K2-A10
cccgggtcgacgccacgcgtccgnccacgcgtncgcaccatcacagatttttgagctgcttgctcaagcgtagagagggaggnggagaaagagaagaggtgtccagtccgctgactcccggtttgcttgcgatgttcaggggcggtgggtggcgccacggtgctcgagctgaggcaccacagcttcagccctgcgccggccaacagcagggaggaggaggcggacgctctcctgtccgccgacgccgcgcgcgtctcgtcgctgcaagggcgcatagagcactaccggctgacgacgaccagctcgtcggccgaagtggcggtgacggcgtccaaggcgcaggtgcccgtcagcttgggcgcgaggcttcggacgctgaactacgtggccaccgtggggcttggcggcggcgaagccaccgtgatcgtggaca

SEQ ID NO: 32957 - DNA, 411 bp, Zea mays
  Clone ID: LIB3059-002-Q1-K2-A11
tcagcattgccaacatagccgactttgctaaaccacctgaaaagatatcttaccctcagcaagttgctgttgcatgcactggactcatttggtcaaggtacagcttggttatcacaccgagaaactggaaccttttcagtgttaacgttgcaatggcgggtacaggcctgtatcagctttcacggaagatcaggcaagattacttatccgatgagaaagatgctgcttaacacctggaggcttaattaatgacaacaggcaaagattaccggatgggaaagcctgcatcctaggagtctactctggatttttttttcctggccagccaaggattaccgattggtcaaggttggtttcccggtaatcctaaattcggaaccagcctaattggaaaatcttccgccaaaaagg

SEQ ID NO: 32958 - DNA, 407 bp, Zea mays
  unsure at all n locations
  Clone ID: LIB3059-002-Q1-K2-A3
tccttaccgacccaaggactgaccatcagccaattaaggagtctgctctggggaacatgcccaccattgccttctgtgatactgactctcccatgcggtatgtcgatatcggcatcccagcgaacaacaaggggaggaacagcattggatgcctgttctggcttttggccaggatggttctgcagatgaggggcactatcctccctgggcacaagtgggaggtcatggtggatttgttcttctacagggacccagaggaagcaaaggagcaggaggaggaagctgctgttgcccctgagtttgccgcaatcactgattaccaaggagctgatcagtggggtggtgaccagtggacctctgatgtgactgcgccgnctgttgctcctactggtgctgattggggtgct

SEQ ID NO: 32959 - DNA, 158 bp, Zea mays
  Clone ID: LIB3059-002-Q1-K2-A8
tgataactcaagagagagtccaccctagaacaactttttctccttggacttggtgcaacttttgagtgtggaaatggattggaatagtcgccatgaatttgctggctactttatacatgtctttgttcataaaccttgttttaagatgaagttgtggc

SEQ ID NO: 32960 - DNA, 345 bp, Zea mays
  Clone ID: LIB3059-002-Q1-K2-B4
ggaattcccgggtcgacccacgcgttcgctcttcggcttctttctggagcaactaggggtccgttcttgatccgatccggccagtggacaacaacttttcccaattcgatcgaattgattggccgccaaggccaaaaggagatgattacccctaaaagcctcgattgccaagaattcgaagtggaaaaagccgtggcgatggaatcgcagaccattcggcacatgatccaagatgactggtccgacaacggtatccctctttctaacgtcaacttcaagatcctatccaaggtaatcgagtacttgaacaagcacgtacatgccgtcgtcggcgtcgtcgtcgtc

SEQ ID NO: 32961 - DNA, 106 bp, Zea mays
  Clone ID: LIB3059-002-Q1-K2-C11
agtgtgttgtgttgtgtgggtgccgcacgctagcaggctagccatgtgccctgctgtgttgtgtcaccatccatctataatcttatccataccccaccttttgtgt

SEQ ID NO: 32962 - DNA, 146 bp, Zea mays
  Clone ID: LIB3059-002-Q1-K2-C4
ggattcccggtcgacccacgcgttcggtactgctcatattgtgcgaaaaaaaaaaaattcatccgactgataataaaatgactcgggataggacaaaatataaaaaaaagtgaaaccattctaaagactcatgcttacctaaatac

SEQ ID NO: 32963 - DNA, 283 bp, Zea mays
  Clone ID: LIB3059-002-Q1-K2-C5
gaattaccgatcgacccactcgtcctaccgacacacctacaacattttaagattccaactacactaaagcgactgaggcttatagactctctaaaaacctcaataactatctcaccattcatcaccacccatataaaaaccctcaacttattaacaactctccataatatataacttcacatcacatactacaaaacattaaaatactaccaattactattctaccaccaataataactcatagactccatcctcaaatgtatccaaatcattcaaatcacac

SEQ ID NO: 32964 - DNA, 153 bp, Zea mays
  Clone ID: LIB3059-002-Q1-K2-C9
gtcatgtttagattttaagcttgttttatgttggaaagtactggaaagactgctacttgtctttatatttggtaattcagccgtagattgctatgctggttgggatttactcgtgaaccagagtttttctgtcttatatatcctgaattggtt

SEQ ID NO: 32965 - DNA, 443 bp, Zea mays
  unsure at all n locations
  Clone ID: LIB3059-002-Q1-K2-D2
cccggaattcccgggtcgacccacgcgttcgcgctgatgaatgcatggttcttggccacgaaacactttatggcattgctttccgaaactctgaaagctgacgacccctagctttggagacttgaaccacttgatcagtgcaacgatgagtggtgtcacttgctgcctncgcttcccaggacagcttaactctgacctgcgcaagcttgcagtcaacctgatcccgttccctcggctccacttcttcatggttggctttgcgccactcacctcgcgtggctcgcagcagtaccgtgcgctcaccgtccctgagctaacccagcagatgtgggatgccaagaacatgatgtgtgctgctgacccacgccatggtcgctatctcacagcctctgccatgttccgtggcaagatgagcactaaggaggtgatgagcaaatgattaa

SEQ ID NO: 32966 - DNA, 323 bp, Zea mays
  Clone ID: LIB3059-002-Q1-K2-D4
tcccgggtcgacccacgcgttcgcgcatggccgccctttttttttcgttttttcgtgttccatccgtttatgtttttgttggggatttggctttttatacagggcagtcaatcatattggtgtaagtggcaattaaacgatctagtgcgtttaatcaaaatccaatggcgaccggtatttacatttactggaacctagtactattttatgttaaagctcctccatatgaaattgctagaactagattgaatgctttgctttcaccaaatgagtgattgcacatgattcaccttccaccttaaggggcacattcatgatcaacc

SEQ ID NO: 32967 - DNA, 380 bp, Zea mays
  Clone ID: LIB3059-002-Q1-K2-D7
tggacgcgtgggcttagaggctagacccagtatccgggctctcaagcgggctcttttggtggcactgaggtgtgttgatcctgactctgaaaagagacctaagatgggccaggttgttaggatgcttgagtcagaagaagtaccataccgggaggatcggagaaatcgtagaagtcgcactggaagcatggatattgagtccattgcagagggttccaactctgcggagtttggaaagaaggtagaaaggactggaagctctatatctgacagatctcaaccatgaggcctggaaatctaagctatatcaggaactgtctcagaaacgatgttaatcaccaaggtgattgctgtcctgataggggatgctggtaggtgac

SEQ ID NO: 32968 - DNA, 104 bp, Zea mays
  Clone ID: LIB3059-002-Q1-K2-E11
gcaaatgttagttacatgttgaatcgacattgggggcctggatttggggatacatcatgctgtaaattgatcagtttaattaccatactgtgctgctttgagcg

SEQ ID NO: 32969 - DNA, 384 bp, Zea mays
  Clone ID: LIB3059-002-Q1-K2-E3
atcttcctggctgctgctgctgctactgctacctgtctgtttggtgttctaaaagactctgatgagtggttctgaatgtctgcatttcaaaaaaaaaaaaaaaaaaaaaaaaaaaaagggcaaccggtctacaggactcaagcttacatactcacgcacgcgaccatgcaactccataatagtgccacctagacacatataactaaccgactgtccacaacgttacaactgggaaaaccctaaaaccacgcaactacaaaacttaacagcacatccccacatccccatctggccagctagcgaataggcccagaccgatcgccctatcgaacattcgaacaggtctgcatggctaaatggacaacgccacgtagccctgcatta

SEQ ID NO: 32970 - DNA, 207 bp, Zea mays
  Clone ID: LIB3059-002-Q1-K2-F4
gaattcccgggtcgacccactcgttcgcggactcgtgggaaaaaaaaaaaaaaaataaactacaatgataataaaaataaaaataggaaaaaaggaaaaaacaaaataactataatcaaataaaagggcgacctttttgtgggaccctattttagttcacgtgctttcgatgtcatacttcttgtatggtgtcacctaatttctatt

SEQ ID NO: 32971 - DNA, 430 bp, Zea mays
  Clone ID: LIB3059-002-Q1-K2-G4
ggaattcccgggtcgacccactcgtccggcacaggaagcatcttgacagcagtatcgatttcgttgggaggctcgtcttcggatttgagaaagggccttcgatgcttgaggctgttagaacctctggtcaaccattagtcgatgactgggactgtttgaagaggatggtgcggattttcgagtcccagtgtggttcacttactcagtacggcatgaagtacatgagagcgtttgcaaacatctgcaacagtggtatatctgagatgaaaatgagggagtcgagcatcagcgcttgcagcagctacaactcggcgaggtggagcccgatggctcggggacacagtgcttgatggtaaagatcaaatagcaaagccccccgaggtctgctgccccatgtccctgtgagcgagctcgtatcatctggggactg

SEQ ID NO: 32972 - DNA, 340 bp, Zea mays
  Clone ID: LIB3059-002-Q1-K2-H2
aattcccgggtcgacccactcgtccgaaatttccatgcctattatggtggctcccactgctttgcacaaactagcccaccaagaaggagaggttgcttatgcccatgcagcagctgctgcaggaactataatgacgttgtcttcatggtcatcttgcagcattgaggaagttagctcaattgcaccaggactccgtttcttacaactttcagtattcaaggatagggatatcgtgcaacagcttgtcagaagggctgaaaatgctggctataaggcaatcgccgtcactgtcgacgctacacgccttggtcgcagggaagccgatgtcaggaacagattc

SEQ ID NO: 32973 - DNA, 368 bp, Zea mays
  Clone ID: LIB3059-003-Q1-K1-A10
cgggtggacccacgcgtcccgtgacgcgtgggtgccaaggttacctgttgcgaggccagggagtgcatctacgtcgggggcgaggaccgcatgggcttattctggtacaacaagaagttctagccgccgtcgttcgcatagctgagaggacgctaccatatgaatgggatcaagaaccaggaggacgagacggtactcgccctaaagtctccgtctacctatctaatcgttagtcgtcagtcttttaaacggtaagagagatcatttgggctcatagacgaaggcttactgcatagccatcgcttgagctgccatcaagtacatgtaggcaaattcgtcaacttagtgtgtcccatgtcgtaattctt

SEQ ID NO: 32974 - DNA, 428 bp, Zea mays
  unsure at all n locations
  Clone ID: LIB3059-003-Q1-K1-A12
tgctatgtttggatatgttcaattctgttgcaattttatgtaaaggctgataataccacaagataaaatggaccatccatgacacagagtcagcacagggaactctgcgtcagatcacacagctaagcactcatcattcgaacaagttcaagaaaactagataatattattatattgggtaacgctacttgtccatcctcactcctcatcctcatcgccagcatcgccgccaccgcttgccttcttctgattctttctcttcacccttcctgcggggcctncaccgaatgggcttgacagtgaaaagtcaatgtgcttctcagactccaccctcaccatgaatgatgggcgccggcgggctgtacccctacgcggagtacctgaggcagccgcagtgcagcccgctggcggcggcgccctactacgcc

SEQ ID NO: 32975 - DNA, 86 bp, Zea mays
  Clone ID: LIB3059-003-Q1-K1-A6
cgttgagctgtgtgtattacacacatttatttaatttatgtagcaacgccatttgttggtgattaacgagtgatcgagcaagctta

SEQ ID NO: 32976 - DNA, 408 bp, Zea mays
  Clone ID: LIB3059-003-Q1-K1-B1
ttcccgggtcgacgccacgcgtccgggaggaatacgtcactgccatcaaggaggaaatcaacaaggtcgttaagcttcaagaagagcttgacattgatgtgcttgtgcatggcgagcctgagagaaacgatatggttgagtacttcggtgagcagctctccggttttgcgttcactgccaatggctgggtgcagtcttatgggtcaaggtgcgtcaagcctccgatcatctacggtgacgtgagccgtcccaaccccatgaccgttttctggtcgaagacggcacagagcatgacgtctcgcccaatgaaggggatgctgactggcccagtcacaatcctcaactggtcctttgtccggaatgaccagccgagggttgagacttgctacccagatcgtcttgcgatca

SEQ ID NO: 32977 - DNA, 347 bp, Zea mays
  Clone ID: LIB3059-003-Q1-K1-B2
gaagaggaaggagaaggccaaggttgcctacgagaggaagaagcaattggccaagctgcgtgtcaaggccgagaaggcagccgaggagaagttggggtctcagttggagattcttgcccctatcaagtactgaggagctgtgctttgtcatcagttttggggaacatctagtctttgttttaagtgttcggtaacagtttgtgacagtataatctggtaaaccgtgttatttttctgccactcctatttgaacacattttctagctggtgaatgaactgtttggtcgatcttgttcagatgtctggttcgcattcgcattctgagagatttcatgtctcgtgctaaa

SEQ ID NO: 32978 - DNA, 402 bp, Zea mays
  Clone ID: LIB3059-003-Q1-K1-B8
tggacctctgacatctcggaggaccctgctgaagagattagggaggcgcccaagcgggactcgagtgaggggcagtaaagccggctttatgtgcctagaaactagtagctagtgtttgctgctgtcgaatgacactatgcaatgtgatctggaacctggtttcttgggtgcgacgcttgtagccgtgttatgactgtcgtccgtaaaatttgggggctccccgtaagggatgctgcctggcaaggcctcggtgtcccacctcgtctgtggcgtggggcgctggagcccggtctggttgggttgggaagccctttaaactgttgtcacttgcattttaccttttccatcgctgtttattgtgagtggtcctatatcaatggctggtctcagtggtctatacgt

SEQ ID NO: 32979 - DNA, 80 bp, Zea mays
  Clone ID: LIB3059-003-Q1-K1-C5
aaaaaaaaaaaaaaaaaaaaaaaaaaataaaaaaaaaaaaaaaaaaaaaaaaaaaaaaaaaaaaaaaaaaaaaaaaaaaa

SEQ ID NO: 32980 - DNA, 405 bp, Zea mays
  Clone ID: LIB3059-003-Q1-K1-C7
tgaaaacgtacgtgcctgaaattattggatctggggaggctattgatgccgcagaagcggagacttgtgggaagaagattgacaagaatggggatgctggtgcccgtggaagagaggtatctgccaatgtgagtgccaagaggaagaggaataagaatgggcaggttgaggatgatgttgcgatgcaggaagaagttcatgtggagatagagaaagagaagaggaaaagcattgtgatttctgctaatgacagccatatggctggcgagaatggtgaacagatgggcaaacgtagtttggaaaataaggtgaacgaagccagtttggacaacgtgaacgttaagatggtgaagactgagcagaggaagatgaagagcatgaacggtgatggtgaaatcagtactg

SEQ ID NO: 32981 - DNA, 447 bp, Zea mays
  Clone ID: LIB3059-003-Q1-K1-D10
attcccggtcgaccaacgcgtccgctttggtgcatttgttggcacaaaacatcagggcacaacaactacaacaactcgtgctagcaaaccttgctgcctactctcagcaacaacagtttctgccattcaaccaactagctgcattgaactctgctgcttatttgcaacaacaactagtactaccattcagccagccagctgctgcctaccctcagcaattacttccattcaaccaactagcagcattgaactctcctgactatgtacagcagcagcaactactaccattcagccagctagctgctgtgagcactactgccttcttgacacagcaacaattgttgtcgttctacctgcacgctgcgcctaacgttggcaccctcttacaactgcaacaattgctgccattcaaccaacttgctttgacaaacccagcagcgttttacc

SEQ ID NO: 32982 - DNA, 305 bp, Zea mays
  Clone ID: LIB3059-003-Q1-K1-D11
ttaagcgcatgggccaactcacaacatatagagtccacaagtacaacaactattgctggcaaaagatgctgcctactcacagaaccaagagtttctgccagttctgctactagctgcattgaactatgatgcttataagcaacaacaactaggactaccattcaagcagtcatatgatgtctaccctcagtaatttgttacattcaaccaactaccagcatggaactatcaggtctatgtacaggcgtaacaactactaccattcaggcagctaaatgatgggagccctgatgccttcttgacac

SEQ ID NO: 32983 - DNA, 207 bp, Zea mays
  Clone ID: LIB3059-003-Q1-K1-D12
cacgcgtgcggaccaagctgatactatggattgtgtgatgaaagttgaaaaggcacctttggagtcttatgctgacattggtggcttggatgctcaaattcaagaaatcaaagaagcagttgaacttcccttaacacatgctgagctatctgacgacattgggatcaggccatcgaacggaggtatactatatcgggaacctggaac

SEQ ID NO: 32984 - DNA, 340 bp, Zea mays
  Clone ID: LIB3059-003-Q1-K1-E1
tggaaagctaaggtggcaccggtgtttccaagaatactagggcatgaggcgtacggggtagtggagagcgtgggggagcacgtggagggcttcgcggcgggggacaccgtggtgccgacgttcctggggcagtgcgagcgctgcgccagctgcgcgtcggagcacagcaacgtgtgcgacgcggtgccgttcgtcatcggccccgggatgccgcgcgacggcaccacccggtttcgggacgcgcgggggagcccgctgcacgacctcctcgtcgtcttcagcttcagcgagtacaccgtcgtggacgtgaaccaggtggtcaaggtcgaccccgtcgtgc

SEQ ID NO: 32985 - DNA, 192 bp, Zea mays
  Clone ID: LIB3059-003-Q1-K1-E7
ctgtgttttgtgtcttagtgtccagagagataaaggtttttgcctctgcaagctttgctgccccgtggactgatgatatttttggatgatggtattgtattgcaaacccttgactttggtcctactagttatgagaaggctgctgtgttaaaaatataccatataaaaaaaagaaaaaataaataaactaac

SEQ ID NO: 32986 - DNA, 330 bp, Zea mays
  Clone ID: LIB3059-003-Q1-K1-E8
cgaaggcaaacgagggcatgccgccgaggcaccaacggtggctagggttggatggaacagcgcgtggggactgaagtcagatggagaggctggctgagtgctgtggctccgccggccaatgcggaaggaggcgtagcgtcgggtgtgggccgaaatttactgggcgggaggggaccaatggattggatacggaaggaggcgtagcgtcgggtgcgtgcttggatggacatggactatgcacccatctctgccccatgaaccgttggtgtgctttttcgtggacaagcactgtagaaatattgcagaacagaagtgataatataatacctg

SEQ ID NO: 32987 - DNA, 278 bp, Zea mays
  Clone ID: LIB3059-003-Q1-K1-F11
cggacgcgtgggctgaatttcgacaaggacgcgaggaaaagacgaggaacttgccggcggcgcgagtacgaactgataaagggtggcttgccaagaacatgcagcggtcggttgaagcagggcggcgagcgtctttaggcttgtttatgtgtgtgagaaggacttcttctttttcgtgggtttaggcgtggggaaagagctccttttattaagctcctttaaccacctttttttttgggtgttcagattttctatcttttcagttcgacgctttttgt

SEQ ID NO: 32988 - DNA, 457 bp, Zea mays
  Clone ID: LIB3059-003-Q1-K1-F3
cccgggtcgacccacgcgtacgcggacgcgtgggctgaactgtccgtcggcgtctaggcggccccgcgcgtcggacatccactcgctcctgaggtcgatgagcctctggccggcgtcgttgacggtgccgtcggcgttgacgagcgcggcgtcctgcctacacatgtggccctgcatgaacccccagagcacgacgccctgcaccgccgggtgcgcgaacgcctcgcgcaggaccacctctaggtcgtcggcgcggagcgcgtcatcgggctcgcagacgtcgacctccgtgaaccagacgggcaagccggtggcggcgtagaccgtgtcgagcgcgtcgcagatgacctcggcgacggggtgggtgacgtggccctgcatcccgacgccgtcgacccgggcgccgtcccgctgcagggctcggacgaggtcgacgtaccgctgcggcgtggtggac

SEQ ID NO: 32989 - DNA, 432 bp, Zea mays
  Clone ID: LIB3059-003-Q1-K1-F6
gctgcgaagactatatttccgatctctgtttcgtgcatactaggctgcaggggcaagatttttctccttcaaagttcatgcttctaaggagaactcttgagaagcacttcaactcatccacttttagagtcgggagctctaatgcaacgggtcatgcttctgattcgctggttccttcaagcacgaaagttgaagatttaacctccagtcggcaggacatatttcttcttcccctgagagggcacgacgactcgacaaagtttgagtatggaacgtactcgtgcatgctaggcatgatccgtgatcagatcctgtcatggccggcgaggtcattctcgaagaacctctcggagcgtgactggctgaggagctcagcgaggatctgggacatggtgaagaagtcccccgtcatctcggagtactgcaaggcgc

SEQ ID NO: 32990 - DNA, 364 bp, Zea mays
  Clone ID: LIB3059-003-Q1-K1-G1
ccgtacccggtccggaattcccggtcgcccacgcgtccgaccatacttcattgcaacgacatttatcagatagcacggtggggaaaaaaaaaaaggtcagaaacacaaaacgagaagaatagaaaaaactgctatcgcccctacgaacatggattaccacttgccaaaatggggcgtccactttataagatccaatgcttagcacactctcatgcaagatggctgctttcctatagagccccctaaattaaggatactggcctgtgcatgtcaccacagagacttgggaaaccatggcctttcccaatttaacccctttgctgaaaagcctcgttttgacagctaccgttaaactgataaggcc

SEQ ID NO: 32991 - DNA, 471 bp, Zea mays
  Clone ID: LIB3059-003-Q1-K1-H1
taccgtccggattcccggtcgcccacgcgtccgcccacgcgtccggcggcggctgcggctgccagccaccgccgccggttcatctaccggcgccggtgcatctgccacctccggttcacctgccacctcctgtgcatctcccaccgccggtccacctgccgccgccggtccacctgccaccgccggtccatgtgccgccgccggttcatctgccgccgccaccatgccactaccctactcaaccgccccggcctcagcctcatccccagccacacccatgcccgtgccaacagccgcatccaagcccgtgccagctgcagggaacctgcggcgttggcagcaccccgatcctgggccagtgcgtcgagttcctgaggcatcagtgcagcccgacggcgacgccctactgctcgcctcagtgccagtcgttgcggcagcagtgttgccagcagctcaggcaggtggagccgc

SEQ ID NO: 32992 - DNA, 212 bp, Zea mays
  Clone ID: LIB3059-003-Q1-K1-H12
gtttgcttctgtgcagttgcctaataagcccattcgttgtaaactagctagttctaacttaagaaagctccctcagggcctatgcatgagtctctgattattgtgcagatgaactgttctggacattttgaacatgcaaatgtggaagcgtcactgtcagttgaattatgtttcagccgaattgagaagcgctaaaaaaaaaaagaaaaatt

SEQ ID NO: 32993 - DNA, 440 bp, Zea mays
  Clone ID: LIB3059-003-Q1-K1-H2
cggaattccggtcgacccatgcatccaggcacgcgtgcacgcacgcgtgagatttcagcttttatgaccgcatggctccaatttatacacgggaccacaacatggcaccttcgaaggttcttgatgctgatgtgacagctaatagtttaacataccgtaatgttactacgtgatacacgagtaagaataatgaaggtgaactccgatcttgcatatctgaaggtaacaaggttgatgtcaagaacatgctgaggaaggtcaagtgagtgacattacatcagaataagaacctggcctaatatgggatgctggctattagcattgggaaatattcatgcattatgatagccatcattgacaagaatgctcgaattggagacaatgttaagatactcaatgctgacaatgtgcaagaagctgcaatggagacagactggtac

SEQ ID NO: 32994 - DNA, 276 bp, Zea mays
  Clone ID: LIB3059-003-Q1-K1-H6
taccggtccggaattcgaggcacgagccacgcgtccgcggacgcgtgggcggacgcgtgggtgctgggcaagaaaagttcggtggccttagggatggctactacattcatggtcagtgtgccatcattatgtttgatgtcacttctaggctgacatacaagaatgttccgacatggcacagggacctgtgcagggtctgtgagaacatccccattgttctttgtggtaacaaggttgatgtcaagaacaggcaagtcaaagccaagcaagttacat

SEQ ID NO: 32995 - DNA, 184 bp, Zea mays
  Clone ID: LIB3059-003-Q1-K1-H9
cccacgcgtccgcttacctacttatctttgtagcttacgtttctattttattctgtcatgaaaactaaagtcttatgtatggtcattatgtactattttggttctgaaaatatttgtttatgttatgaaaactattggttgaaagaatggtgattacggttttggcttgaaggttcagaagtga

SEQ ID NO: 32996 - DNA, 295 bp, Zea mays
  Clone ID: LIB3059-004-Q1-K1-A2
tcggttcagattcccgggccgacccacgcgtacgatccatatcagcatatcggcaattctcttagaggatcgtcgaacagaacaccatgaagggggacattgatctcgtcgtgtgcctggctctgtcagctgccagcgcctctgcaatgcagatgccctgcccctgcgcgttgcttcagggctagtacggcgctggcgccggcctgacgacgatgatgggcgccggcggactgcacccctacgctgagtacctgaggcagccttaatgcagcccgctagctgcgacgccctacta

SEQ ID NO: 32997 - DNA, 468 bp, Zea mays
  Clone ID: LIB3059-004-Q1-K1-B4
accggtccggaattccagtcccgactcaagccacgcctacgtgggaaggtccttgaacttaggttttcatgccactcaaccgcttgaatgctgctcgtaggcgggcattcactcaatacagaatgtctgcgctttagttgggttgggctccaaagtttcaatgttccagcattcctcagtcgaaatttacaatgcctgcaaaccacatcctactcttgagattcacaacgcccgatatgcacaaagatgccccaaaggttgctgtcctcgtgtttcgtgctctgattgttgagtcttcaatgagagctgattccagatatatagaggtgaacaagcttatgattattacctttggtaatttggtgcaacataatagaggtgaacaagcttattaaaagaagatccttgtacaaatcaagagttcaatccaatagatgaaacgatattgtgattctctcaatggtggct

SEQ ID NO: 32998 - DNA, 438 bp, Zea mays
  Clone ID: LIB3059-004-Q1-K1-B8
tgggaagttccttgaacttagtttttcaagccactcaaccgctagaaggctgccaatatgcgggcattcactcaatacggattgtctgcgctttttttgggttgggctccaaagttgcaatgttccagtattcctcagtcgaaatttacaatgcctgcaaaccacagcctactcttgagattcacaaccccgatatgcacaaagatgccccaaggttgctgccctcgtgtttcgtgctctgattgttgagtcttcaatgagagctgattccagttatatagaggtgaacaagcttttgattatttcttttgttaatttggtgcaacatatagaggtgaacaagcttattaaaggaagatccttgtacaatcaagagttcatacaatagatgaaacgatattgtgattctctcaatggtggcttcatgagcaagcaatc

SEQ ID NO: 32999 - DNA, 284 bp, Zea mays
  Clone ID: LIB3059-004-Q1-K1-C2
taatattttcagcattcaaaaacacaccttgctattcgcactagcaacgacctaacaccaatggctaccaagtatattagctcttcttgctctgattgcccttttagtgagctcaacagatgcattcattattttatagtgaatacttgtttacattgcctgtttaccacaatatattcttgagattaataacatagttttgcacaatgatgccctactgttgcttacattgtgtttcttgctcttattgatgattcttcaatgatagctgattccagttatat

SEQ ID NO: 33000 - DNA, 115 bp, Zea mays
  Clone ID: LIB3059-004-Q1-K1-D11
tcgaaagcttgtccttgattccaagttccatctatgagaacttggacataggatattggacgtcattactttgaagaaaaagccaagctctagaagtttgccaaagattcttgcc

SEQ ID NO: 33001 - DNA, 438 bp, Zea mays
  Clone ID: LIB3059-004-Q1-K1-D5
tgaacacaccacccctcgtctccgcacggaggccgtcctctcctctcctctgcgtccgccactgccgcccaccgctcgcccacgcgcgctccattacctcggcgggcgatggccgacctatccaacaccggctccacctaacacgagcagcgcccccgcctaggcggctggctggtcggtcgtcgagcagctagcggcggcagcgcccggaggccgtctcactctcctcgtcggggcggcaggagatggaggccatcgtgggcgtccgcgcgccgccgcgtggccgtgcctgggccggcctcgagaagccgccgcgcgccgcttgctgcgccagagtcccgacggcgaggctcgcggtcgcggcggacaggccgcggaggctggtgctgctgggcgccgatacgcggagggccgcggattatcctgccctccgttgcg

SEQ ID NO: 33002 - DNA, 477 bp, Zea mays
  Clone ID: LIB3059-004-Q1-K1-D7
taccggtccggaattcccggggcgatagatgcgtagcggcacgctttcggagaccaacaagcaacatagaaagtggaatccagtagcatcaatagagcatcaatggcgaccaagatttgtccctacttatgctccttgctctttctgcatgtgttgctaacgcgacggttttccctcaatgctcacaagctcctatagcttgccttgttacgccataccttacatcaatgatagctggactatgtgaaaacccagctcttcaaccctataggctccaacaagcaatcgcagcaagcaacatacctttatcacccttgtttcaacaatcgccagccctatctttggtgcagtcattggtacaaaccatcagggcacagcagctgcagcaactcgtgctacctgtgatcaaccaagtagctctggcaaacctttctccctactctcagcaacaacaatttcttccattcaaccaactgt

SEQ ID NO: 33003 - DNA, 211 bp, Zea mays
  Clone ID: LIB3059-004-Q1-K1-E12
tacggtccggattccgggtcgacccagcgtccggtacgaggctaaatgaaaggcttagggttatattgcgcaaggagataccggggaccatggaagggattcagacagtgattacaagtagcaacgacgatacttaatcactgaaatttgcctagtgtaagagctttgataaagttgaaggcagagaatggtatgagatggttatgagaag

SEQ ID NO: 33004 - DNA, 66 bp, Zea mays
  Clone ID: LIB3059-004-Q1-K1-E4
cggacgcgtgggaaaaaaaaaaaaaacattaataagacaaaaaaaaaaaaaaaaaaaaaagaaaag

SEQ ID NO: 33005 - DNA, 414 bp, Zea mays
  Clone ID: LIB3059-004-Q1-K1-E6
aagaaatctaaaagagggcaccaccaatgatgggttatagttcaataataaagttttttgtctgatgtttgtggcttcccagaaataataaagtccatttctaaaaaaaaaaaaaaaaaaaaaaaaaaaaaaaaaaaaaaaaaaaataaaaaaaaaaaagaaaaaaaaaaaaaaaaaaaaaaaaaaaaaaaaaaaaaaaaaaaaaaaaaaaaaaaaaaaaaaaagggccgcccgttttaaaggatccaagcttacttacccttccatccaacgtaataccttttctatagggccccctaaatcaaattcactgcccgtcttttaacaacttcgaaactggaaaacccttggctttcccaaactaaatccctttgcagaaaatccccttttcgcaagttgcctaattaccaaaaa

SEQ ID NO: 33006 - DNA, 378 bp, Zea mays
  Clone ID: LIB3059-004-Q1-K1-F2
tttgaaacaaatggatctttgctctccaaactgagtaccaaaataaaggttaaataccaggtatcaccattttcctgaatgcctcgtaacgagttcatatgctataacacaaggacatcccattgttgctgcagccacaagagtccagaacaacagaaaggcaagatttaatccaactcatacccaaccgtgcagtttcttttattacaaaaagggaaggagcagcattcataggtgtggagcaccgatcaacttgaaaccaaaaccagaggtgcgttgggcctcaaagattatcgtcgatcaggcctacaggaagtttctgatgtccaatttcctgacatcaggcatctcctcatcttgaaactcctccctcttgag

SEQ ID NO: 33007 - DNA, 407 bp, Zea mays
  Clone ID: LIB3059-004-Q1-K1-G10
aattcccgggtcgacccactcgtccgcccactcgtccgggggacactatcctgggttatagagcggttcaggttaattggaaagatctggactattgcaatgtttgtgatatggatgaggagtatgaagacaacttattcttgcaatgtgacaagtgtcgtatgatggttcatgctagatgttatggtgaacttaaacaattggatggaggactttggctttgcaacttgtgtcgaccaggtgcacctcgtgtgtctccaaaatgctgtctatgtccagtcacaggtggtgcaatgaatcctacaacagatggccgttgggctcatctcgcatgtgctatatggatccctgaaacatgcttaaaggatgtaaagagaatggaacctattgatggactgagcataatc

SEQ ID NO: 33008 - DNA, 297 bp, Zea mays
  Clone ID: LIB3059-004-Q1-K1-H10
ataaaataaaaaaatatataaaaataaaaaaaaaaaagaaaaaaatatataaaagagaaagggtagataaacatatagggttgatgagttgaatattagatagttataatgagtgagatctgagatttgaaggcatattcgattacacttttttgaaggctatcaacactgggaatagggctggccgttctataggatatatgcttacgttcgcttgcatgttacgttatatctcttttatagtgttacgtaaattccattcactgttgcgctttttacaacttcctgactgggaaa

SEQ ID NO: 33009 - DNA, 400 bp, Zea mays
  Clone ID: LIB3059-004-Q1-K1-H2
tgctgctggcataacattacgacaatagttcatccgttcgacaacaaattttggcacaacttccacaggttcagcacttgaacaatctaagttaccaacacaaggcattttaagttcagagaaaagtgagaaataaacacatggccatttctagtccatctttactccaacaaaaccttagatgctgctcgggtacatgaacactctgaccttgcgccccatggactcatgcgggaggttggacttgaacttggcacggacgacgcccgagtttacgtgcggacgggtgaccttgccccagatgcacctgtagcgggtctcatagctcttggtcttggccttgtagatgtacgccatgctcttgccagcgtaccacgcgacatccatattggtgttcacc

SEQ ID NO: 33010 - DNA, 378 bp, Zea mays
  Clone ID: LIB3059-004-Q1-K1-H4
gtcacgcgtccggaaccccgctgcttatttgcagcagcatatactactaccatttagccagctagctgcagcaaaccgtgcttccttcttgacacagcaacagttgctgcctttttaccagcagtttgcggctaactccgcaaccctcttacaactacaacaattgttgccctctgtccaacttgctttgacagacccagcggcctgctaccaacaacacatcattggtggtgccctcttttagattgcttattagctgtaattcaataatatagttttttggatgatgtatgtggccaaccagaagtacgatgttacatttccagattctaatgtgatattggtctccaagggagtccgattaaagaagccgaaatc

SEQ ID NO: 33011 - DNA, 428 bp, Zea mays
  unsure at all n locations
  Clone ID: LIB3059-004-Q1-K1-H5
tggctacttcaacgaggccaatttcatcggagaaggtggattcgggaaggtgtacaagggcaagatcaacggacagatggtggcagtgaagcagctcgctcgagacggcgtgcaggggaggaacgagttcttggtcgaggtgctcatgcttacagtgctcaaccatcgcaaccttgtcagcttggtcgggttctgcgcgcagggggacgagaggctgctggtctacgagtacatgccgttcggaagcctggagagccatctgtttgacgtgcctctcggcaagaaaccactcgactggaacacgcgcgtgaggatagccgtgggagtcgcggaaggggtttcctacctgcacaacgtagccgacccgcctgtgatctaccgcgacatgaaggccgncaacattctgctgggcgaggacttcagcccga

SEQ ID NO: 33012 - DNA, 317 bp, Zea mays
  Clone ID: LIB3059-005-Q1-K1-A1
ccgggtcgacccaagccttccggtgaaacccgcggcggttgaatggtcattagcccccgcaggaacataagaggggggttttgtcaagacccacaagagcaatgcatacttcaagcgtttccaggtgaagttcaagagaaagcgcgctggcaagacagactacagggccaggataaggctgattaaccaagacaaaaacaagttcaatacacccaaatacagatttgttgtgcgatttaccaacaaggacatcacagcacaaatcatatctgctagtatagcaagtgatatggttcttgcttctgcttactcgcatg

SEQ ID NO: 33013 - DNA, 415 bp, Zea mays
  unsure at all n locations
  Clone ID: LIB3059-005-Q1-K1-A11
ttccttattggtgacatcgaagccagccagggtgccttccagtactttggcctgaaagaggaccagacaccccttatcctcatccaggatggtgactccaagaagttcttgaaggttcacgttgaggctgaccagatcgtcgcttggttgaaggagtactttgacggcaaattgacgccgttcaggaagtctgagcctattcctgaggtcaacaatgagcctgttaaggtggttgtcgctgacaacgtccacgacttcgtcttcaaatctggcaaanatgtccttattgaattctatgcccactggtgcggacactgcaagaagctggcgcccatcttggacgatgcagccaccactctccagagcgacgaggaagtcgtgattgctaagatggacgcgactgccaatgacgttc

SEQ ID NO: 33014 - DNA, 434 bp, Zea mays
  Clone ID: LIB3059-005-Q1-K1-A3
tcgacccacgcgtacgcgtacgcgttcggaccaacatgcaacatagaaagtggaatccagtagcaacaatagagcatcaatggcgaccaagatattttccctccttatgctccttgctctttctacatgtgttgctaacgcgacaattttccctcaatgctcacaagctcctatagcttcccttcttcccccataccttccatcaattatagcttcaatatgtgaaaacccagctcttcaaccatataggcttcaacaagcaatcgcagcaagcaacatacctttatcgcccttgttgtttcaacaatcgccagccctatctttggtgcagtcattggtacaaaccatcagggcacaacagctgcagcaactcgtgctacctctgatcaaccaagtagctctggcaaacctttcttcctactctcagcaacaac

SEQ ID NO: 33015 - DNA, 430 bp, Zea mays
  Clone ID: LIB3059-005-Q1-K1-A4
cgcgttcgcggacgcgtgggtcttgctgggcttgctgcaggcatggccattggcatcgttggtgatgctggtgtcaaggcgaacgctcagcagccaaagttgtttgtgggcatgatcctcatccttatttttgctgaagcgcttgccctctacggtctcatcgtcggcattatcctctcgtcccgtgccggccagtcccgcgcagattataggcacgtttcagatgtcaacaccgtgccgtcgacagttgcctggtcgtagctgggtcatgttctatatccatgagacacgaagctggagcactttgagaggcttacttttatgctgtctagttctccatcttctgttgagtcgagaaaacaagaaaggctgtgtaatcaagggatgacttttacccttgtgccattcttttccctgtcgaggtgggggg

SEQ ID NO: 33016 - DNA, 334 bp, Zea mays
  Clone ID: LIB3059-005-Q1-K1-A8
aaacagtcacgtctcccagatctaactccccccgactcacgaatcccagagagcctccatggcgacgcaccgccactgcctcccactcctcctcgtggccgccgccctcgccctcgccgccggccctgctcgcgccgcgcttggccggcggcccgggccggctgtgggccggttggaaccggatccttgcctgaaccaattggaccttccagaacctagccggtgggcccctgggccagccaagcccccaaagcctggccgccaccggctggcggttccgcgggttgtgccccgctaaccacaagtcctgttccggatgaactaccggctttta

SEQ ID NO: 33017 - DNA, 155 bp, Zea mays
  Clone ID: LIB3059-005-Q1-K1-B3
cgggtcggacccacgcgttcggccacgcgttccgcttggaggtcctgcacaacgtgcttcgacctcaagcccgacatccaggtctccaagaaccagatcctgtactgtacaagcttgagctggagtgcggacggaagcaccatctagcctgcgta

SEQ ID NO: 33018 - DNA, 315 bp, Zea mays
  Clone ID: LIB3059-005-Q1-K1-B6
aagcgcaagcgcgaggcgcgcgacgtgcacaggcactcgaacgacgcccgcaatgtgattggtgctaagggcaatacgttcgccaagaaacgctatgctgagaacgctcatatgaagaagaccctgaaaatgcacgatgaatcacataatcgacagaaggttgatgatgatgtccaagagggtgctcttcctgcgtatctactggatcgtgatcagactcagcgtgctacggtactcagtaacgcactcaagcacacgatgaaggaaaaggctggcgaatgggatgttccgctgccaaaggtcatacctgttgct

SEQ ID NO: 33019 - DNA, 282 bp, Zea mays
  Clone ID: LIB3059-005-Q1-K1-C11
aaaaaaaaagaaaaaaaaaaaaaaaaatataaaagaaagaaaaaagattgcaaaaggaacggggtgataaaaactgtgcgtgcgaattcctatgctccattatgatgccccgtttatttgatccatggggcgaagttttacatctacgcgacggggaaaaccgtggcgttgcccaacttattcgcctcgcagatcatgcccgtttcgcaagctggagtaatatctaataggcctcgtccgttggcctttgccaacagtagcgcagtctgattggcgtttggg

SEQ ID NO: 33020 - DNA, 417 bp, Zea mays
  Clone ID: LIB3059-005-Q1-K1-C12
tgaaaacccagctcttcaaccatataggcttcaacaagcaatcgcagcaagcaacatacctttatcgcccttgttgtgtcaacaatcgccagccctatctttggtgcagtcattggtacaaaccatcagggcacaacagctgcagcaactcgtgctacctgtgatcaaccaagtagctctggcaaacctttctccctactctccgcaacaacaatttcttccattcaaccaactgtctacactgaaccctgctgcttatttgcagcaacaactattaccatttagccagctagctactgcctactctcaacaacaacaacttcttccatttaaccaattggccgcactgaaccccgctgcttatttgcagcagcaaatactactaccatttagccagctagctacagcaagccgtgc

SEQ ID NO: 33021 - DNA, 332 bp, Zea mays
  Clone ID: LIB3059-005-Q1-K1-C3
cacgcgtccggccctccaagtaactgcgaagagcatagtgcatgaggaatgagcttgtagctagctcatatgtctgaataataagcacagcaagaagatgaatgcatttctcggatcgttcatccggaacaataattaaaggggatccggatttgttcttgtgatataattaacgattcctgttatacttggaagtagctaggctcgtccccatccaatgcaagcaaagatctgatctcccaacgtgcatgagaaaatgtgagcgatttacttcaccggtccttcctctaattaaatggaaatgtgaagtggaacataagaaattaaggtga

SEQ ID NO: 33022 - DNA, 291 bp, Zea mays
  Clone ID: LIB3059-005-Q1-K1-C4
tccgggtcgacccaagccttcggccaagccttccaaaggccaggtaaccccggatctggcggacaatttgggcttcagtcgcaaatgttggcgcaggctaggcaaaaggtcatggcacaaaacacccaattgaataatgctaatacagctcaagtgctgcaagggatgcaacccatgggtgtcatgggtgctatggggatgaaccagacgagaccgaatgtaactatttcctatggtgctcaacaaaaggttgcccaagcacaaatgaaggcacaagcattttaacaacct

SEQ ID NO: 33023 - DNA, 355 bp, Zea mays
  Clone ID: LIB3059-005-Q1-K1-E1
ccgggtcgacccacgcgttcggccctttgcaagtatagtctctctgctaagcgaagcgaagcttcaagctagtctcggcggctctagaagacgatgggcaaggacgacgtgatcgagagcggcgctggcggcggcgagttcgctgccaaggactacacggacccttccccggcgccgctgatcgacgcggcggagctggggtcctggtcgctgtaccgcgccgtgatcgccgagttcatcgccacgctgctgttcctgtacatcacggtggccaccgtgatcgggtacaagcaccagacggacgcgtcggcgtcgggcgccgacgcggcgtgcggcggcgtgggcgtgctgggca

SEQ ID NO: 33024 - DNA, 465 bp, Zea mays
  Clone ID: LIB3059-005-Q1-K1-E4
ccgggtcgacccaagccttccgtgaaggtcctccggggttcggttccttggttaaccggatcaagatggcggcgtcggatgttgagtcccgctgcttcgtcggcgggctcgcctgggccacggacgaccacttccttcacaacgccttcagcacctacggcgaagtcctcgagtccaagatcattctcgatcgggagaaccataagttccgccggttccggttcgtcaaccttttcaacgaagaagccattccgaaccgccttcaaggccttgaccgcaaaggagctgaacggccgcaccataaccgtcaacgaggcccaatcccgcggcggccgtgaaggcggcggcggtgggtacggtggtggccgtggaggcggcggctacggcggtggcgggcgccgtgatggcggcggcggctacagcggtggcggcggctacggtggcggcggcggctacggtggtggt

SEQ ID NO: 33025 - DNA, 262 bp, Zea mays
  Clone ID: LIB3059-005-Q1-K1-F3
gaggtttttctttgtttgtttttttttttttttagaaatggactttcttatttctgggaagccaccaacattagataaaaaactttatttttgaactataactcatatgaaatctaaaagagggcaccaccaatgatgggttgttggtatgaacactgatgggtttgtcaaagcaagttggttgaatggcatcaattgttgcaattgttataaggtgccaagctttggcgcaacgtgctggttgaacgggcaccactgtggt

SEQ ID NO: 33026 - DNA, 303 bp, Zea mays
  Clone ID: LIB3059-005-Q1-K1-G10
ttcactcgttcgaaaaaaaaaaaaaaatgagatataaaaaaaaaagaaaaaaaaaaaaaaatgaaaatgagtatgctaaatctgttgtaagatcaccttgtattggacctcatacatattatttagcgcgatctaaatgaacattcagtggctgcatttttaagtgcatccataatgtgaaaactgctggggctaacgaaattaatctgattgcatctcatcaaggtttatcaagctggggtaatatcgaagaggccggtacagattgacgttccgaacattttgacaccctgaatggggaat

SEQ ID NO: 33027 - DNA, 232 bp, Zea mays
  Clone ID: LIB3059-005-Q1-K1-G12
ttcatgatatctgggaaatctcctctatccatccctctctatctatatctgtaataatgcagtaagacgacacacattatcatgtgtggtatgaccaataatatatgcatgatcataataaagttttggttttaaaaaaaaaaaaaaaaaaaaaaaaaaaaaaaaaaaaaaaaaaaaaaaaaaaaaatataaaaaaaaaaataaaataaaaattatatacaaatgtataaag

SEQ ID NO: 33028 - DNA, 443 bp, Zea mays
  Clone ID: LIB3059-005-Q1-K1-G6
tagcaacatagaaagcacaatagtgtaccaacaatggcagccaaaatattttgcttccttatgctccttggtctttctgcaagtgttgctaccgcaaccattttcccacaatgctcacaagctcctatagcttcccttcttcccccatacctatcaccagcggtgtcttcagtgtgtgaaaacccaattgttcaaccctacaggatccaacaggcaatcgcaacaggcatcttaccattatcacccttgttcctccaacaaccgtcagccctattacaagagttacctttggtccatttggtggcacaaaacatcagggcacaacatctacaacaacttgtgctagcaaaccttgctgcatactctcagcaacatcagtttcttccattcaaccaactggctgcattgaactctgctgcttatttgcaacaacaactaccatt

SEQ ID NO: 33029 - DNA, 443 bp, Zea mays
  Clone ID: LIB3059-005-Q1-K1-H3
tggaaaattgcaaggatgaatttttgaagtttgatctggagtatgaccagattgttgtcctcgagacgaaaactgcaaaggctgctacccaggacattctgacgacgcactgtataccttctgcaacgtcggatgaccttaaggcctagtgggaggagaagggagcatgacgcagccctgggcctgagccagggccatcaggtgggccaatagtttgggccacaatttcggctgaattgattagcgcagcgtacgatccgtgatgaagaggaaccccaatgtttatctgtttaagttaaatatcttttgaagggttgtggatgtgagagtgctggctggtgtctaaagctccgccattatagaaggtttgagggactgtcactgtcagataacaataaactggagttgttacagacagagtcatcgtgaaaacgatagtgtct

SEQ ID NO: 33030 - DNA, 447 bp, Zea mays
  Clone ID: LIB3059-005-Q1-K1-H6
tagaatctcgagatatgatcagactccgactacagcctggtctcagagagtaaatgagtagagccaaacatattatggatgtggatgccaactggcatatacggatgagacctagacacatcatagatgctaacgaagttcaagagagaaatgtcgagtgcagaaaacaaatgctatgtaatatgtaccagggttcaaatgtctattgctatgacagtttgcgcctaactaagagatcttttagtgacttgagtgccatcttacgggaaaagagtggcctacaggataccctaaatgtgtcggtagaagaaaagcttacaatttttctgcttatagtaggtcataacaccaaaatgaagttgatccgtagcacttatgggtggtcccttgaaccaatcaatcgacacttcatcgaagtgcttatagggattctatctttaagtcatg

SEQ ID NO: 33031 - DNA, 154 bp, Zea mays
  Clone ID: LIB3059-005-Q1-K1-H9
ctcaactacgaagttctatcgtctctagcttgattgtaatttttttatgagggtgcggttggataagcaaatagcttggtgagttggcgttcgattgttatattgagtgagaactgagatttgaaggcatcttcgagacacttttttgaaggca

SEQ ID NO: 33032 - DNA, 417 bp, Zea mays
  unsure at all n locations
  Clone ID: LIB3059-006-Q1-K1-A2
gggtcgacccacgcgttcgcccacgcgtncggttttacttgatgtgtaaccatgggacgatgagactgacatggccaagcttgaggaagctgttaggagtgttcagatggaagggctgctctggggcgcatccaagcttgtcccagacggatatggtatcaagaagctgcaaatcatgatgaccatagtcgacgatcttgtctctgtcgacactctcattgaggactatctgtgcgctgagccagttaacgagtacgtccagagctgcgacatcgttgccttcaacaagatctaggcgtgactttcgatcagtccttcccctggggtgctggcgatggtggtggctgggcaatgcaccagcctaatttttccataactttatgtctgctttgtgttggccagtgatattgccgtgag

SEQ ID NO: 33033 - DNA, 222 bp, Zea mays
  Clone ID: LIB3059-006-Q1-K1-A9
cccacgcgtacgctttatactgtaataataaagttctcattctgatatgtgcaacttctcagtgataaaagatcagagatctatactaaaaatacacaagaaataataaaaaaatagaaaaaaaaaaaaaaaaaaaaagctatagaaaaaagaaaaaaaaaaaaaaagtaaaaaaaaaaaaaaacaaaaaaaaaaaaaagggggggcatcttttaaggatcc

SEQ ID NO: 33034 - DNA, 341 bp, Zea mays
  Clone ID: LIB3059-006-Q1-K1-B3
gaaattaagagaacactgtccgttccatatcatttcgatgaagatcgggtgcttggagttgtccgtcgagcaaaagataacttctgactaacaaaaggaaatgctcgtgacgtatgacccatatcttgttaaagttcagacagagaacctaagtcacaataaacataggaggaaatgaaggtatatatgtttgagctagattttgaaaaaatgaaataataagttgctaaaacagacctgtgctaaaattataaaagataaaaaaaaaagattgaaagaatatgaaaataaaaacaagggcggcccgttttataggttccaagcttacgtaccccggcatt

SEQ ID NO: 33035 - DNA, 72 bp, Zea mays
  Clone ID: LIB3059-006-Q1-K1-B6
agagttatagttcaataataaaggtatcagactgatgtttgaggcttaccagaaatcataaagtccatttct

SEQ ID NO: 33036 - DNA, 446 bp, Zea mays
  Clone ID: LIB3059-006-Q1-K1-B9
cgtaccggtccggattcccgggtcgaccagcgtccggcaacatagaaagtggaatccagtagcaacaacagagctcaatggcgaccaagatattttccctccttatgctccttgctctttctgcatgtgttgctaacgcgacaattttccctcaatgctcacaagctcctatagcttcccttcttcccccataccttccatcaatgatagcttcagtatgtgaaaacccagctcttcagccctataggctccaacaagcaatcgcagcaagcaacatacctttatcacccttgttgtttcaacaatcgccagccctatctttggtgcagtcattggtacaaaccatcagggcacagcagctgcagcaactcgtgctacctgtgatcaaccaagtagctctggcaaacctttctccctactctcagcaacaacaatttctttcattc

SEQ ID NO: 33037 - DNA, 209 bp, Zea mays
  Clone ID: LIB3059-006-Q1-K1-C2
ccgggtcgacccacgcgtacggacacaaaatgaacgtagaataagggctgggctttgctagagaaccaagcataaggccgggaagagtacaaaacattgattcatataaatgaaaaacggacgccttattaaaggatccgtgcttacgatcggctacttgcgacttaaaaccttttatatcgagtctcataaactgcaattacttgcat

SEQ ID NO: 33038 - DNA, 392 bp, Zea mays
  Clone ID: LIB3059-006-Q1-K1-C8
tgcacctaagagaagcaaaatatcgtgcatagtttgcccagaatgtcagggtactggaattcacgtcaacggagatgaacttgagaagccaagcatttctttatcagagatgtttcgcttcaagatgaaagcaatcgaagctcacaaagcatggctgaagagacctgaagtgcttgaaaactgttccactgggcttcatttcccctcagaacatgtggagaaccctgaggagaaggtgatgccactcaagtcacttcccttctatgccgctgatgggtagaaagatagttgatggcagctactggaggatgctgcagttgttgatgtaaataagctcgcttgacagttgtggaacagtgttgttagatgctcacctacgtgcattatctcag

SEQ ID NO: 33039 - DNA, 94 bp, Zea mays
  Clone ID: LIB3059-006-Q1-K1-C9
aaaaaaaaaaaaaaaaaaaaattaaaatttaaaaaaaaaaaaaaaaaaaaaaaaaaaaaaaaaaaataaaaaaaaaaaaaaaaaaaaaataaaa

SEQ ID NO: 33040 - DNA, 438 bp, Zea mays
  Clone ID: LIB3059-006-Q1-K1-D1
tcgacccacgcgtacgtgctaggctgaccattgatccaaataccaatccgtggaacacaaagctgcagaagatgactggctacaaagtttctgaactcaaggattgcatcgtagccatacatgacttgcagctcaacaggaaatgtccatcattaacggcaattcgagacaagtacaagcagcacaagttcaaatgcgtgtcattgatcctcgtgcctgtcgtgatccctacttcatactttgaagacttagctgagtagctgctctcggactgtaccgctgtaaggctaacaatctgagctctccttgagctcttagggacaagcagaaaataaccgtttgatgagctttcctctcatttaagtagcgtggtgaaagctattggtttgaggttctttaggattcgcgccgctgtgtcactcttagtgagaccaggca

SEQ ID NO: 33041 - DNA, 335 bp, Zea mays
  Clone ID: LIB3059-006-Q1-K1-D2
ccgggtcgacccacgcgtacggtgaccgacatggttcttcggtcacattaatagtacctgactctgctcgttagctgatatcaggaggaattcaggatcacatgatgattagtagtgcgccagcattttttgcaatctctatttttgaggtcaaatgatatctacctccacataaatccacattggcagagacaaaaatgaaaataatagatcctagtacctgtaagagatccatactaaatactatgaatacttagatgttaaccatgttactcgactgaactcgttgtaaggataacaaaaaagggggggcccttttaaaggacccactttta

SEQ ID NO: 33042 - DNA, 360 bp, Zea mays
  unsure at all n locations
  Clone ID: LIB3059-006-Q1-K1-D3
ccgaattcccggtcgaccacgcgttcgccacgcgncggatgccttcaatgattagccaaacatgatgacagtgccacatggactctgattcatctcgcacattatacaacaacaacaatgaccattcatgttcagccccacagccgggcgatctcacccatgtttttacagcagccctttgttggtgctgcattctagatataagcatttgtgttgtacccaataatgaagtcggcatgccatcgcatgcgactcattgtttaggaataaaacaagctaataatgacttttctctcattataatgtaaaaaaaaaaaaaaaaaaaaataaaaaaaattgaaacaaaaaaatgaaaataat

SEQ ID NO: 33043 - DNA, 268 bp, Zea mays
  Clone ID: LIB3059-006-Q1-K1-E4
cggaatcccggtcgacccacgcgtacgctggcccggggcgaggccgaggctaggtccgcgcaggtgctcgtgcgcatgtacggcgcgggcgtcgaggtcttcttcgaccgcgccgacgaggtccgtaccttcgagtgcatgtcgcgccacggtcaggggccccgtctcctgagccgcttctgcaacggccgagtcgaggagttcatcaacgccaggaccctcttagctgaggatctgcgctacacggatatgtgcgcgctgattgcca

SEQ ID NO: 33044 - DNA, 184 bp, Zea mays
  Clone ID: LIB3059-006-Q1-K1-F2
ggaattcccggtcgaccacgcgtccgacaggtcgcaagccataatgataagacctgcatgctctctcttgaagtgaccagatcggtctgtgaccgagagttcgaagctgtcatgatgtccaagcgcgccggatggggaggatggcaagccacaagagtggcgagacagagacaccttcattgct

SEQ ID NO: 33045 - DNA, 421 bp, Zea mays
  Clone ID: LIB3059-006-Q1-K1-F4
ggaattcccgggtcgactcacgcgtccggaggagctggcgaacctcgtgatcgttgccggtgaccacggcaaggagtccaagggcagggatgagcaggcggagttcaagaagatgtacagcctcatcgacgagtacaagttgaagggccatatccggtggatctcggcgcagatgaaccgcgttcgcaacggggaactgtaccgctacatttgcgattcgaaaggcgcatttcgtgccagctgcgttcttcgaaacggtcgggctgactgggatcgaatccatgacgtgcggtctgccaacgatcgcgaccttccatggtgggccctctgaaaatatcgtggactgggtatttggcctggacattgaccctttccacagcgacaaggccttggatattccggttaacgtttttgaccaatg

SEQ ID NO: 33046 - DNA, 411 bp, Zea mays
  Clone ID: LIB3059-006-Q1-K1-G4
ggaattccggtcgacctacgcgttcgcaaaaaattgccatgtttgagaagaattgtggaatgcaggctctaattcaatatccagatatgacaactgcagccgttgctaaacaagctttggagggacactgcatatatgatggtggttactgctcatgatgatagaagcagagactacactctttcagaccctaatgcgcagctgcaagctgctgcacaggcgccagttataagttctccgggagtggcatggcgaaaccctgcattagcaccagttgttcctttctatggaagcacgggggcttaaactcctgttggacaaccgcttgctgggaaccctaaaatgcaggcccttggttttcattttgattggacagggtacccaaaccaaccattaatggccaattcaagg

SEQ ID NO: 33047 - DNA, 319 bp, Zea mays
  unsure at all n locations
  Clone ID: LIB3059-006-Q1-K1-G6
gtaccggtccggaatcccgggtcgacnacgcgtccggcaacagccgcaaagcggtcaggtcgtggagctgatggcggcgcagatagcgcagcaactgacggctatgtgcggcctgcagcagccgactccatgcccatacgctgctgccggcggtgtcccccactgaagaaactatgtgctgtagtatagccgctggctagctagctagttgagtcatttaccgtcgacgattgagtaataatgtgtcacgcatcaccatgagtggcagtgtcagtgtgagcaatgacctgaatgaacaattgaacgacaagaaaaagta

SEQ ID NO: 33048 - DNA, 469 bp, Zea mays
  Clone ID: LIB3059-007-Q1-K1-A2
tcccgggtcgacccagcgtacgcccacgcgtacgatcacaagctagcgagtgacccggcgcggaataagagagagacgacgtattatgatatagtagttttatagctatctatcctaatcttattttatggtactctgcttatatttttagtttttttttttttatctggttttttttatttttctgttttttttttatatttctctcatttttgttttattttttttttttacttttttttttcttttttatatatttttttcttatattattttttattttttcttctatttatttttttttttattttatatttatttttttattatttttatattatttatattttatttattttctttttttatttttttttttatatttatttaatttttatttttatttttatttttattttattttattttatttttttttttattttttttttctttacttattttttat

SEQ ID NO: 33049 - DNA, 249 bp, Zea mays
  Clone ID: LIB3059-007-Q1-K1-B5
tccgtgtccacgtgacattggagtccctactgaacgacaaggacatccaggcaaccatcaaggacctggtcacaagcagcgggaggtccttccccggaaagaaggcggaaggtgctgacgagagcggggagaagctgtccaaggtgcagctgaatggtaaagcttaggaaaggattgcgagagctgctggaagtgaccacggttacaagtaaataaatagaataaggcgacagattgcatcaccgtgtt

SEQ ID NO: 33050 - DNA, 423 bp, Zea mays
  Clone ID: LIB3059-007-Q1-K1-C10
cgcctgcagtaccgtccggaattcccggtcgcccacgcgtcggcaacaacatggtggagcaggagctgctggagcggctcctcggtaccagagcttctgtgctgctgaagacgctgtgctacctcgcccaaatctgtttccactgctttgacggcgagaacgtggagagtgctcctctcctatgaagaaggactacaaactggctaatcttctatgctgggaggaggaaccggatgccatggaggagaaggcgggagtgcttgatgagtaagacgggcttctggggtcgatttgcttctgagttgtttattttatatcgtcgcaatttcgtggttgtcgtttggttattctgtgaagcagccatgctctgctattgttatgaaattttgtcgtctgtaagcatgtgtactttctactttgcca

SEQ ID NO: 33051 - DNA, 197 bp, Zea mays
  Clone ID: LIB3059-007-Q1-K1-D1
ggattcccggtcgcccacgcgtccgcggcaagcgctgaacgcgacgctggactcgaccttcgacccctacgagaacagcctcaacttgctcgtcgcctcctacatcatcccctacgtcggcctcaccggctacgtcggcgccaaccccaggctcctcacccttcaggccagaaagctgctggcggggctgctgtcgg

SEQ ID NO: 33052 - DNA, 170 bp, Zea mays
  Clone ID: LIB3059-007-Q1-K1-D7
aattctatttttaagaatctaaaaatgtactatcttatctggggcaagccacaaacatcagacaaaaaactttattattgaactataactcataagaaatgtaaaagagggcaccaccaatgatgggttgttggtagaacactgctaggtttgtcaaagcaagttgtctg

SEQ ID NO: 33053 - DNA, 371 bp, Zea mays
  Clone ID: LIB3059-007-Q1-K1-E10
cgatatgctgcggttgagtcaccatatcccgcaaaaggaaggtctgcctcaaagcttccagtgtctgcacctgggcgtgcagcgcttcctagtgccaccccgaatctaaacattgggatggacatttggaatgcttctcctgccttggctgtgcctgcagtgcagggggaagtgagtcctgggttggcacttgcccgacgtgatggcgttactcaactggacgaacgtgaaatgaagagaaggatcggcgttaaaatggtattgtgaagggagaggtttttaagcaaaatactgtaccgtcgttttgccatcgagtatatttgaccctcgattatatagatcacattaaatttttggagcatcaattttat

SEQ ID NO: 33054 - DNA, 455 bp, Zea mays
  Clone ID: LIB3059-007-Q1-K1-E2
cgtctcggattcccgggtcgactcacgcgtccgcccacgcgttcggacaactatcaacatagaaagcacaatagtgtaccaacaatggcagccaaaatattttgcctccttatgctccttggtctttctgcaagtgctgctaccgcgaccattttcccgcaatgctcacatgcttctatagcttcccttttttccccgtacctcttaccatctgtgttttcggtatgtgaatacccatatttttaaccctatatgattcaacaggcaatctcaactgtctttttatctagtttactattgtttttttaatatttatcatttttattacattattttctctttgttgcatttatttgtcttatttttttctttgttcatacatcttttttttctttttttttgttattctttttaatttttcttatttttatatttttatttttctaattaatttt

SEQ ID NO: 33055 - DNA, 270 bp, Zea mays
  Clone ID: LIB3059-007-Q1-K1-E6
gtaccgtccgcattcccgggtcgacccacgcgtacgcggacgcgtgggcttctatcagtaccatcaatcatcattcatcttagtagtataggcaccaaatcaaatctgcatcatcaattatctaactccaaaaaccatgaagctggtgcttgtggttcttgctttcattgctttagtatcaagtgtttattgtacacagacaggccgttgtctctgtggtcaacaacaatatcttgagcagtaacattttttatatcttacatctattcc

SEQ ID NO: 33056 - DNA, 437 bp, Zea mays
  Clone ID: LIB3059-007-Q1-K1-E8
tgactagatttaaggacaatgaagaagatgatggaagcgatgaaaacgaggtgttcaatgacctaatagcagctggttatgaagaaaaagaagtagatcacgagaagcgtaatgaactccaccaaaagtggcttcaacaacaggatgctgctgaaacaaataatgttatccaaaggctgaagtttggtcaccgggagcaaaaagaatcagcatatgaagatgaagatgaagacgaagacgaagatgaagatgaagatgaagatgtagctgattgtgaggaaggatcacaaaatgaagatttaactccagcaaatattgtgcgacaaaattcagagaaggcaaaacagatgattgcaaagatgtttgaagatgacaatgatacttatgagcactcggatgatgaggaaatagaagagcatttggctcgtcagcgcatt

SEQ ID NO: 33057 - DNA, 323 bp, Zea mays
  Clone ID: LIB3059-007-Q1-K1-F3
ccgtaccggttcggaattcgaggcacgcgtcacgcgtgcgcttacgcgtagcatcaactaattcacaatggcgaccaaagtatttttccctccgtatgctccttgctctatctgcatgtgttgcttacgcgacaatttatacacaatgcttacaagctcctatatctttcctttattatctcataccttgcatcaatgatagcttcagtatgtgaaaacccatctcttcaaccctataggctccaacaagcaatcgcagcatgcaacatacctttatcaaccttgtttcaacaatcgtcagtcctatcttaggtgcattcatt

SEQ ID NO: 33058 - DNA, 359 bp, Zea mays
  Clone ID: LIB3059-007-Q1-K1-G3
gcctgcggtaccggtctcggaattccggggtacgacgtcacgcgtacgcggacgcatcgagtcgttccaaatccatgcatgctcgtctgctcatttccgcagcgatgtaacacggatgtccaagatcaagatcgggatcaatgggctcggcaggatcggacggctgatggccagggcgaccctgcatagtgacaacttcacgctcgtaagcgggcaagactgcttaatcagcacagaatacatgtcctacatgaccaagtacgacactgtgcacggactgtggacgcactctgcaaccaatgcgaagtgactgcaaaactcctgttcgtttagcgagaaggatgttgcctgtgttagtc

SEQ ID NO: 33059 - DNA, 120 bp, Zea mays
  Clone ID: LIB3059-007-Q1-K1-G4
cgggtcgacgcacgcagtcaggcatcggcgtagtcaccaaggtcggagtgtggggtggagagggagggtcggcgcatgagatctggacgacagaaccttcgaggcgtctgcagagcctga

SEQ ID NO: 33060 - DNA, 429 bp, Zea mays
  Clone ID: LIB3059-007-Q1-K1-H12
accaaggccaaaacatttttaaaatagtaaaacaaagcgggaaaattggaacatgaaactcaacttgatatggggcttcaatgaagcatctaatctatgctatgagaagaatcgacgtaaaaagaataagaagaatcaacacaatgagtccatggagccaataccattttgggtggaagccggaatcatcatgactaagaacctatactgccagggcgccagaaacccttggtggcaagaagaaattgatgtttgacaattgtagtcttgtaatgcaaagacctgagaacagggtccatctttcttatcatgtctatagtgtcttgcagcacaaaccatctaccaggtctaagtattctgtcaatttcagctgcaacttcaatgatgtggcaccttttcgtaaggggccctaagagataactcatgtga

SEQ ID NO: 33061 - DNA, 438 bp, Zea mays
  Clone ID: LIB3059-008-Q1-K1-A11
ccggatcgacccacgcgtgcgtccacgcgtccgaaggagggcatcccaccggaccagcagcgtttgatcttcgctggcaagcagctggaggatggccgcacccttgcggattacaacatccagaaggagagcaccctccacctggtgctccgtctcaggggtggtatgcagatctttgtgaagacactcactggcaagacaatcacccttgaggtggagtcttcggataccattgacaatgtcaaggccaagatccaggacaaggagggcatcccacccgaccagcagcgcctcatcttcgccggcaagcagctggaggatggccgcaccctggcggattacaacatccagaatgagagcactcttcaccttgtgcttcgtcttaaggggtggcatgcatatttttgtgaagactttgactggcaagaccattacctt

SEQ ID NO: 33062 - DNA, 332 bp, Zea mays
  Clone ID: LIB3059-008-Q1-K1-A4
gtccggaattcccggatcgacccacgcgttcttcaactagcaacatagaaagcacaatagtgtaccaacaatggtagccaaaatattttgcctccttatgctccttggtctttctgcaagtgctgctacgacgaccattttcccgcattgctcacaagctcctatagcttctcttctttccccatacctttcaccagcgttgtcttcagtatgtgaaaacccaattcttcaaccctacaggatccaatatgcaatcacagcaggcatcttaattttatcacccttgttttttcaacaatcattagtgctaattacataattacctttggtgc

SEQ ID NO: 33063 - DNA, 279 bp, Zea mays
  Clone ID: LIB3059-008-Q1-K1-B1
aattcccgggtcgacccacgctttcgagatgctttatgcaagctcaatccagaaattcaagagtggccttaatggcattcatgttgaactccaggccacagatgctagtgaaatcagcctcgatgagatcaaggatcgggcacgctaggcgcaccgtcatcgcgagtttcatggtcacgcatcatggactcgcctactactgtggatttgtacgccattatagacttggtgctgcgaaagactgctttggtgatttgtgggtatgatgctgtgtaaaaa

SEQ ID NO: 33064 - DNA, 430 bp, Zea mays
  Clone ID: LIB3059-008-Q1-K1-B6
tccactcgttcgtgccgaaggaaaacaatcctgaaaccaagccatgggtctgcaggaggaatttgaggagcatgctgagaaggcaaagaccttgcctgagaacacgagcaatgagaacaagctgatcctatacgggctctacaagcaagccacggttggagatgtgaataccgatcgtccgggcatattctaccaaaaggacagggccaattgggatgcctggaaggctgttgaatgcaaatcgaaggatgattcgatgaatgactacatcaccaaggtgaagcagctccaggaggaggctgccgccttttaaaagtcttgtaatagtgttgccaaacagctatttgtcagatgagctttgtgccatttccttaataggtgtatatcattcgatccattggggatctgtgaaccatgtacctgtttatgt

SEQ ID NO: 33065 - DNA, 249 bp, Zea mays
  Clone ID: LIB3059-008-Q1-K1-C8
gcctgcagttccggtccggaattgccgggtcgactcactctttcgctagcattcgcagtttcccctctccttgatacgcatcttttttctaggagtaagtttgttcttttattgatatggcgaggtaggagaatgtctacatggccatgctggcatatttgtccgaaaggtatgaatagatggttgagtatatggagaatgtgtctaatactgtatatgtggaagtgctcactgttgaggagcgtaact

SEQ ID NO: 33066 - DNA, 62 bp, Zea mays
  Clone ID: LIB3059-008-Q1-K1-D10
ggccggaatcccgggtcgacccagcgttcgggaacgtgggctcgcatatcatggacaacctg

SEQ ID NO: 33067 - DNA, 264 bp, Zea mays
  Clone ID: LIB3059-008-Q1-K1-D2
gtaccggtccggaattccggtcgaccagtcttctacagtttcaagcatgcctagatgcagtaatgcaaagtcttgcaaaatccatagcatgggatggtgagggtgcaacatgcctaattgaggttactgtaagtggctcctacaacgatgctgaagctgctaaaattgctcgttcagtatcatcttcttttttggttaaagccgctatatttggaagagacccaaattggggacgaattgcttgctcagttggttattcaggca

SEQ ID NO: 33068 - DNA, 349 bp, Zea mays
  Clone ID: LIB3059-008-Q1-K1-D4
gtaccggtccggaatacccggatcgacccacgcgtgcaggcaggcagccagcagctgattacccgcaagaatcaggggcagtcaaccaactggcatcattgaactctccggcttatgtacagcagcaacaactactaccattcaggcagctaagtggtgtgagccctgctgccttcttgacacatcaacagttattgccgtgctaccggcacgctgcgcctaacgctggcaccctcttacaactgcaacaatttctgccattcaaccaacttgctttgacaaacccagcagcgtgggaccgacaacccatgagtggtggtgccctcagatagagatcttatgagttata

SEQ ID NO: 33069 - DNA, 416 bp, Zea mays
  Clone ID: LIB3059-008-Q1-K1-E12
tgctgccatacgctatggaactggttccattgctggttttttcagtgaggatagcgttacattaggtgatctggttgtgaaggatcaggaatttattgaagctacaaaggagccagggcttaccttcatggttgcaaaatttgatggcattcttgggctaggctttcaagaaatctctgttgggaatgcaacaccagtgtggtataacatggtgaaacaaggtctcatcagcgaccctgttttctctttctggtttaaccgacatgctgatgaaggagaaggtggtgaaattgtgtttggtggaatggattctagccactacaagggtgatcacacgtttgtcccagtcactcgttaagggatactggcaatttaacatgggtgatgtcctggttgatggaaagcccacttgtttt

SEQ ID NO: 33070 - DNA, 219 bp, Zea mays
  Clone ID: LIB3059-008-Q1-K1-F10
tgaatttctgatgatgtcttatgtctgtactctgaatcaactatgtatgagatctcatctcctttctcctactgaatgaatgaatcattattggctttgctttgcttcaaaaaaaaaaaaaaaaaaaaaaaaaaaaaaaaaaaaaaaaaaaaaaaaaaaaaaaaaaaaaaaaaaaagaaaaatacaacactaataaaatacgacataaaaacaacaaca

SEQ ID NO: 33071 - DNA, 251 bp, Zea mays
  Clone ID: LIB3059-008-Q1-K1-F5
tagaaatcgcgctgcaggacgctagcggccgtacactaccaacaacgacccctacaccaaccaaacccagcgagcgaactggaccccgcgagctattggcagcaccctatactagcaccactgagccagctagctacagcaggcccagcgaacccagggacacagcaacagcggccgcgcgagctaccagcaacaggcagcgaacctcgcagaccctctcacaactgcaacaatgggcgaccatagaccaa

SEQ ID NO: 33072 - DNA, 69 bp, Zea mays
  Clone ID: LIB3059-008-Q1-K1-F9
ttgatgcgatcgggcacgcatctataattagggccataaatactggagcaaggtagtagcgtgatatct

SEQ ID NO: 33073 - DNA, 172 bp, Zea mays
  Clone ID: LIB3059-009-Q1-K1-A5
tcgaccgacgcgttcgatccttctatcagtaccatcaatcatcattcatcttattagtaaatgcaccaaatcaaatgtacggggtcaattatctaactgcaaaaaccatgaagctggtgcatgtggttcttgcttatattgctttagaatcaagtgtatctagtacacatac

SEQ ID NO: 33074 - DNA, 414 bp, Zea mays
  Clone ID: LIB3059-009-Q1-K1-A7
gaagaaaccatggatgatatcttcaaggacgatgagccggacagctacgccgacaagaggagctagtttgtgccctctccaaagagtgctcatcaatacgattccagaacgatatgtattggctagtgtttgctgttaacatcatagcggcctgtatgttcaaataatggagcgagtatttctgatgagtttgagttgtcgggggctgtggaactttcaaacatggcgatacgttataatgtcgttttgctagatgctatgctttcatcgtggcttggaaatcggggtcttgtcaagtttcagctcacagacggatctgtaaatggtactgaaccctacatcttatgttttctgttaaaaaaaaaaaaataaaaaaaaaaaaaaaaaaaaaaaaaaaaacatataaaaaatatt

SEQ ID NO: 33075 - DNA, 451 bp, Zea mays
  unsure at all n locations
  Clone ID: LIB3059-009-Q1-K1-B1
cggaattccggtcgaccacgcgtncgccacgcgtccgttaaagtaaaagtccatttgtaggtgtttatttgtaggtgttatgtatataaaggggctaaccgctaacgtgttatagataattatcttagccatcattgtctcttttcctaaggttacagacgtctaagacagtcatcgaatcatcaaagtatgagaccctcactacagataagctttttcagcgagttcaagttcatagaaattaatcactagacttggaaaccctagtgcatccaccataagccttgtcttaagaggtgatatctctttagcttggcacttgttgtcagtcgtttttgcagcttcacaacaatgatatgaatcggcggtgtggcacgaacaaggacgcctgctttcactatacagacctcgactatttcatcgccaactatttcaagatgaagggcaagtc

SEQ ID NO: 33076 - DNA, 434 bp, Zea mays
  Clone ID: LIB3059-009-Q1-K1-B11
accaaggcgtccgcccacgcgtccgcccacgcgtccgagaaaatgagagagaaagtccaaaagatcatagctcacggaatcaactgtttcatcaacaggcagttgatctataacttccctgaggaactctttgctgacgctggcatacttgcaattgagcatgctgactttgagggcattgaacgtctggctcttgttactggtggtgagatcgcatcaacttttgataatccagattctgttaagcttggtcactgcaaggtaattgaagagattatgattggggaggacaggttaattcatttctctggggtcgcgatggggcaggcttgcaccattgtcctaaggggggctagtgagcatgtgcttgatgaggcagagagatccttgcatgatgccttgtgtgtgctgtcccagacagtaaatgatacccg

SEQ ID NO: 33077 - DNA, 407 bp, Zea mays
  Clone ID: LIB3059-009-Q1-K1-B12
gtccgcgcaaattgcaccaagaaatccatcgagaggccgtcgacaggggaattaatggcgtcgtcgtctagcagcagccaccgccgcctcatcctcgcagccgccgtcctgctctccgtgctcgcggctgccagcgccagcgccgggacctcctgcgtgccggggtgggccatcccgcacaacccgctcccgagctgccgctggtacgtgaccagccggacctgcggcatcgggccgcgcctcccgtggccggagctgaagaggagatgctgccgggagctggcggacatcccggcgtactgccggtgcacggcgctgagcatcctcatggacggcgcgatcccgccgggcccggacgcgcagctggagggccgcctagaggacctgccgggctgcccgcgggaggt

SEQ ID NO: 33078 - DNA, 451 bp, Zea mays
  Clone ID: LIB3059-009-Q1-K1-B2
aagcgaagcacattagcaacaacctaacaacaatggctaccaagatattatccctccttgcgcttcttgcgctttttgcgagcgcaacaaatgcgttcattattccacaatgctcacttgctccaagttccattattacacagttcctcccaccagttacttcaatgggcttcgaacacccagctgtgcaagcctataggctacaacaagcaattgcggcgagcgtcttacaacaaccaatttcccagttgcaacaacaatccttggcacatctaacaatacaaaccatcgcaacgcaacagcaacaacaattcctaccagcactgagccacctagccatggtgaaccctgccgcctacttgcaacagcagttgcttgcatcaaacccacttgctctggcaaacgtagttgcaaaccagccacaacaacagctgcaacagtttctgccagc

SEQ ID NO: 33079 - DNA, 453 bp, Zea mays
  Clone ID: LIB3059-009-Q1-K1-B4
aattcccgggtcgacccacgcgtacgcccacgcgtccgcagaaacacaccaagttatacacattagcaacagcctagcaacaatggctaccaagatattatccctacttgcagcttcttgcgctttttgcgagcgcaacaaatgcgttcattattccacaatgctcacttgctccaagttccattattacacagttactaccaccagttacttcaatgggctacgaacacccacctgtgcaagcctataggctacaacaagcaattgatgagagcgtcttaccacaacctattttccagatgcaacaacaacacttggcacatgtaacattacaaaccatctcaacgcatcagtatcaacaattcctaccagcactgtaccacctagccatggtgaaacctgatgcctacttgcaacaacagttgcttgcattaaacccacttgctctggcaa

SEQ ID NO: 33080 - DNA, 285 bp, Zea mays
  Clone ID: LIB3059-009-Q1-K1-B5
gtgacgcgtgaatggtggagccatcatcccggcgaaggtggcggcggcgggctggggacgaaatatcgcgctgctttctttttattggggttcgtttttaagctttgtttttggccgtgaaataaaaatagttgctgtactaagaaaaaagagcaatctcatttatggatatgaaattttacctgaagccattaaaaaaaaagggcgggcgttctaaagggtcccagctttactacgccttccttcgaccgtatagcctttttttaggggcacctaaatttaatt

SEQ ID NO: 33081 - DNA, 439 bp, Zea mays
  Clone ID: LIB3059-009-Q1-K1-C11
cgtccgaataaataaaaatgaagaagataaaaaaaagacaaagaaaataataaaaaaagataataaagaaaatagaaaatttagaaaaaagaaaaaaaaaactaaaaaaataaaaataaaaaaataggaaataaaagaaaaaatcaaaagaagaaaaatttaaagtcaagcaaaaagaatacagaaaaagaaataaaaaaatgaaaaataaaagaaaagagattgataaaaaataaaaaaaagaaaaaaagatagataaaaagatataaagataacaaataaagtaacaattcataaggaatttaaaaaataaaaataataaagaaaaatataataaacaagtaataaaagaaaaaaaaaaaaggaaaatgtgaaatataaacaagaaaaaataagaaaaaaataaaatcaataaaaaaaaggaaaaaataataataaa

SEQ ID NO: 33082 - DNA, 212 bp, Zea mays
  Clone ID: LIB3059-009-Q1-K1-C3
gtaatcataaagcagccctgatcgggtttgactcgatgaatcacttcttgattgaataagcgaagaacgccagtaagaattacagccaataatctgtacacatgatcttcaattcagggagaaactgaactgatcgaaaagatctgatggattctgattttgcgtgcttgtcttcctcgatcttgccagcgaagaggacccatcattattgt

SEQ ID NO: 33083 - DNA, 428 bp, Zea mays
  Clone ID: LIB3059-009-Q1-K1-D11
accaaggcgtccgctggctaccaagcttccaaggatgacttggctgtctacacttcgttttcgtctgctccctcgtccaagtatatcaacgtagcaaggtggtttaatcacattgatgcgctcgtgaggctgagcggaattactgcagagggccaaggtgtgaaggttgaatcgtcagcagttccttcagccccaactccagatgttgctgaagcacaggccccagttgctgaggaggacgacgacgatgatgttgacctttttggtgaggagaccgaagatgagaagaaggctgctgaagagcgtgctgcagctgccaaggcttctggcaagaagaaagaatctgggaagtcatcagttttacttgatgtgaagccatgggacgatgagactgacatggccaagctcgaggaagctgttaggagtgt

SEQ ID NO: 33084 - DNA, 62 bp, Zea mays
  Clone ID: LIB3059-009-Q1-K1-D3
tcgacccacgcgtacggggcgtgggcgcctacgttggacgcgtttttgtctggggcttcttc

SEQ ID NO: 33085 - DNA, 382 bp, Zea mays
  unsure at all n locations
  Clone ID: LIB3059-009-Q1-K1-D9
cggacgcgtgggcgcgcccgtgccgcgcatctncatcgccatgttcctgctcgcgcccaaggacgaccgcgtgagcgccccggaggcgttggtcgacgcgggccacccgcgtcggtacaagccgttcaactacgacgactaccggaggctccggctgtccaccggcgagcgcgcaggcgaggcgctcgcgcggatggcggcgtgacgtcgtcacgcacgtgcaagccgttaattataggctcgcgcatgcatacgcctacacgtacgagaggttgtctcgttaagccgttctattaaaatgtgtgggggagaaagatgactaccgtggtgccatgtggattgctatcgggtctgatcaataaaatcttgcaacacttgcaac

SEQ ID NO: 33086 - DNA, 442 bp, Zea mays
  Clone ID: LIB3059-009-Q1-K1-E5
tacagccgggtgctgcgagtcagcggcgagcggcggcgcgcggaggagcacaggggcgaccactggcaccgcgaggagcgctcccacggcaggttctggcgccagttccgcctccccgagaacgccgacctcgactccgtcggcgccagcctcgacaacggcgtcctcaccgtgcggttccggaagctggcccccgagcaggtcaagggcccgcgcgtcgttgggattgccgggggagacggtgacggcgacgcgaagaagagtattggcggcggcgccggggatggtcatcatcagaccaagaaggtggagctctgaacagtcaaacgaggggtgttcgcgtttttttttttttttgggtatgttctttatgttccacgacgtatccggtatctccacctgtattgtatggagaggcagagaaagtgtgccatcttgactg

SEQ ID NO: 33087 - DNA, 444 bp, Zea mays
  Clone ID: LIB3059-009-Q1-K1-E8
tctcgctctcgcggctctcggcggatcggcgttcagtgaaagctaaaagcctaaaaccctagttcgaacctctactagccggcgacagcggcggtggagcgcgggatacccggagatgccagcgccgtctgcggttgcgtcggccgtagagaggctacaggcagcggcgcaggacgccgccaagtcctcgtcgcgctcggccggcgccttctccgagcaggcgcagcaggccctcgtgtccaggaccgccggggttcacactcaagaaaaggctgcgcagatgggctgctagactgctgaagagaattaaggacgacgactattgactaatgcgatcttttcctcattgtctttggagtttgttcagaaatcagaactatggctactacgtacctcagcatcttgtgtagccaactgtttttgtgccttcacatatttgctatg

SEQ ID NO: 33088 - DNA, 401 bp, Zea mays
  unsure at all n locations
  Clone ID: LIB3059-009-Q1-K1-F12
ccgggtcgacccaagccttcgggaacccaaattcgttcaagtggatgcttcaaaattcaatgtaccggccacaacttccgggttttcttaagaacattggtggatcttctgatcaatgggataacccaattcttgatcaacttgagaactttgaacctaacaatccaaaaatgccgcagcaatttgcgcaaagtggcatgacttccgaggaagtggtatcgaaaataatggcaaacccagatgtagctgtcgcattccagaatccaaaaatacagacagccatcatggactgctcgcaaaaccctcttaacattgtaaagtaccaaaacgacaaggaagtcatggatgttttcatgaagatatcacagatcttnccccaaatcaacggctagctggtcttc

SEQ ID NO: 33089 - DNA, 414 bp, Zea mays
  Clone ID: LIB3059-009-Q1-K1-F2
gggagttccactccctcattttcacaagaaaacgggatcgatcattccatgacgccactatctgtatctagatcgtctgctgaaacagcaaaggagaagccctctgaggcaacttctgtgatctgcaagctaactgaggagaaaatgtctgctgttcagcagaaccagaaattacgccaagagctggagcttctacggaaagagagcagcacaaccggcggcggtttctccatcaccttcttgtttgtcgagggcctactgggcatcgtcgttggctacatgcttaagagaacatagtggaacggtgtctccagcagatctctactactcccattaaaggacacccacccaccccacaggtggcgtggtatgcctctctctccccatgtgttttcgctcctaatcggagcgccc

SEQ ID NO: 33090 - DNA, 426 bp, Zea mays
  unsure at all n locations
  Clone ID: LIB3059-009-Q1-K1-F4
ggattcccggtcgacnacgcgtccgcaacaacttgtgctagcaaaccttgctgcctactctcagcaacagcagtttcttccattcaaccaactagctgcattgaactctgctgcttatttgcaacaacaactaccattcagccagctagctgctgcctacccccaacaatttcttccattcaaccaactggcatcattgaactctcctgcttatttacagcagcaacaactactaccattcagccagctagctggtgtgagccctgctgccttcttgacacaacaacagttattgccgttctacctgcacgctgcgcctaacgctggcaccctcttacaactgcaacaattgctgccatttaaccaacttgctttgacaaacccagcagcgttctaccaacaacccatcattggtggtgccctctt

SEQ ID NO: 33091 - DNA, 445 bp, Zea mays
  Clone ID: LIB3059-009-Q1-K1-F6
ttgcaatcacaacgaacaaaagctctcgatctcaccgacaccgaggaagaagagatcaatggcgtccgagcagggagtcgtgatcgcgtgccacagcaaggctgagtttgacgcccacatgaccaaggcccaggaagccggcaagctggtggtcattgacttcactgccgcctggtgcggtccatgccgcgccatcgccccactgttcgtcgaacacgccaagaagttcactcaggtcgtgttcctgaaggtggacgtggacgaagtgaaggaagtcaccgcggcctacgaggtcgaggcgatgccgaccttccacttcgtcaagaacggcaagacggtcgcgaccatcgtgggtgccaggaaggacgagctcctggcccagatcgagaagcatgctgcgcctgcgcctgcgtctgcgtctgcctaaaggagatcagatcaatcg

SEQ ID NO: 33092 - DNA, 303 bp, Zea mays
  unsure at all n locations
  Clone ID: LIB3059-009-Q1-K1-G10
cgggtcgacccacgcgttcgattttgagcattcagaaacacaccaagccgaacgcactagcaacaacctaacaacaatggctaccaagatattattcctccttgcgcttcttgcgctttttgcgagcgcaacaaatgcgtncattattccacaatgctcacttgctcctagttccattattccacagttcctcccaccagttacttcaatggccttcgaacacccagctgtgcaagcctataggctacaacaagcgattgcagcgaacgtcttacaacaaccaattgcccaattgcaacaaca

SEQ ID NO: 33093 - DNA, 453 bp, Zea mays
  Clone ID: LIB3059-009-Q1-K1-G11
cggtccggattcccggtcgaccacgcgtccgcccacgcgtccgcgggccacctccctacggaggagacgacccccatctcaaggtcgaggtcgagggctcctctctctctaccatctccgttcgatcccatcgccccgccgccgccatggcgtttctcgcgcgggcgctgcggcagtccaactggcgcctgtcgtcgcgctgccccgccgtggccgcctcctgccgttggatctccccgaccgccgccgcgggatcgccggaggccggcgcggcggtggcgtctgccgacccggagctgcctccgccgcgggagcccgttggcggcgcccgcgtggagcttcctcctaacccggaggacgcgctcgaggtattcgtggatggccatgcggtgcggatccccaaggtgttcaccgtgctccaggcctgcgaggtcgccggcgtcgacatcccgc

SEQ ID NO: 33094 - DNA, 433 bp, Zea mays
  Clone ID: LIB3059-009-Q1-K1-G2
tagcaacatagaaagcacaatagtgtaccaacaatggcagccaaaatattttgcctccttatgctccttggtctttctgcaagtgctgctacggcgaccattttcccgcaatgctcacaagctcctatagcttcccttcttcccccgtacctctcaccagtgttgtcttcagtatgtgaaaacccaattcttcaaccctacaggatccaacatgcaattgcatcaggcatcttacctttatcacccttgttcctccaacaatcatcagccctattacagcagttacctttggtgcatttattggcacaaaacatcagggcacaacaactcgtgctagcaaaccttgctgcctactctcagcaacaacagttacctttggtgcatttgttggcacaaaacatcagggcacaacaactacaacaactcgtgctag

SEQ ID NO: 33095 - DNA, 423 bp, Zea mays
  unsure at all n locations
  Clone ID: LIB3059-009-Q1-K1-G9
tagcaacatagaaagcacaatagtgtaccaacaatggcagccaaaatattttgcttccttatgctccttggtctttctgcaagtgttgctaccgcaaccattttcccacaatgctcacaagctcctatagcttcccttcttcccccatacctctcaccagcggtgtcttcaatgtgtgaaaacccaattgttcaaccctacaggatccaacaggcaatcgcaacaggcatcttaccattatcacccttgttcctccaacaaccgtcagccctattacagcagttacctttggtccatttggtggcacanaacatcagggcacaacaactacaacaacttgtgctagcaaaccttgctgcatactctcagcaacatcagtttcttccattcaaccaactggctgcattgaactctgctgcttat

SEQ ID NO: 33096 - DNA, 432 bp, Zea mays
  Clone ID: LIB3059-009-Q1-K1-H10
cacgcgtccgtgctgatggcaacggcaccatcgatttcccagagtttctcaaccttatggctcgcaagatgaaggacaccgactctgaggaagagctcaaggaggccttccgtgtgtttgacaaggaccagaacggcttcatctcggccgccgagctccgccatgtcatgacaaatcttggtgagaagctaactgatgaggaggtggacgagatgatccgtgaggctgatgtcgatggtgatggccagatcaactacgaggagtttgtcaaggtcatgatggccaagtgagccacagaaccataatctgaaggcagagaagattatgcattgcatattagtcaagatgcaactttttattccatcgacttctagtgaaacattctgctagttgtagttgctgaaaaaggcaatgtagttcctgctttgttct

SEQ ID NO: 33097 - DNA, 245 bp, Zea mays
  Clone ID: LIB3059-009-Q1-K1-H3
aagaagttatatttccaaattctaatgtgctaaaaaaaaaaaaaaaaaaaaaaaaaaaaggaaaaaaaaaaaaaaaaaaaaaaaaaaaaaaaaaaaaaaaaaaaaaaatataaaaaataaaaaaaaaaaaaaaaaaaaaaagcaaaaaaaaaaatataaaaatagtgataactaaaaaaaataaaatagggcggcgatttacaattttatgactgggaaatctttataataaccaaactaaattg

SEQ ID NO: 33098 - DNA, 413 bp, Zea mays
  Clone ID: LIB3059-010-Q1-K1-A11
ttcacccacacgctggtcatagagatgtcggctgcagaggcgaaggcggcggcggtcccggagtctgtgctgcggaagcgcaagcgggaggagcaatgggcaacggacaagaaggagaaggcgctcgcggacaggaagaatgcgctcgagagccgcaagatcatcttcgcccgcgccaagcagtacgccgaggagtaccacgcccaggagaaggagcttgtgcagctcaagcgtgaggcccggttgaagggtgggttctatgtgagcccagaggccaagcttctgtttgaggttcgcatccgtggtatcaatgccatgcaccccaagacccgcaagatcttgcagctcctgcgattgaggcagatcttcaacggtgtcttactcaaggttaacaaggcaaccattaacatgct

SEQ ID NO: 33099 - DNA, 342 bp, Zea mays
  Clone ID: LIB3059-010-Q1-K1-A12
taccggtttcggattcccgggtcgaccccgcgtccgagcaagcggggatgtgggatgcagtgaatgacgggctcgcgaacctcaacatcagccagggcaccgtcctgacgcccccggcggtgcaggccgtctgcgactccttcccggcgctgcacacctgccccgacaggcactccctgatcatcagtggctgcctcagcctcacgtgagcccactgcgcctgcgcccatcacccacaccgtgccaggagagccctgatggccaaccatgcgtactaataaacatgttggtggcagtgcactgaaagttcacgggaatggggacgcatgcccggggggtgat

SEQ ID NO: 33100 - DNA, 223 bp, Zea mays
  Clone ID: LIB3059-010-Q1-K1-A4
gccgtaccggtctcggattcccgggtcgactccacgcgtccgacttgaacggaggatttccggtctgaataatataaatgcacgcttgcaactatatccatggaataagaatgggcggccgatctaacggatccaagtttcagtactgcatgcatgcaacgacataaatattatatagagtaacctaaatgcaatccactgtccgtgattcaacaacatattc

SEQ ID NO: 33101 - DNA, 137 bp, Zea mays
  Clone ID: LIB3059-010-Q1-K1-A9
accggtctcggaattcccgggtccgacccacgcgtcacgcggacgcgtgggtggctttctcctccccctctcggttcgggttacgggattcgcgagggactagcggggattcgggatcaagagatcgagcggatcag

SEQ ID NO: 33102 - DNA, 430 bp, Zea mays
  Clone ID: LIB3059-010-Q1-K1-C6
tggagctctctcgcaagctcttcacggccgtcctcctcgtcatgctgctgctgctgtccgcagaggtcgggccggtggcggtggcggaggcgcggacgtgccagtcgcagagccacaggttccggggcccctgcctccgccggtccaactgcgccaacgtctgcaggaccgaggggttccccggcggcaggtgccgcggcttccgccgccgctgcttctgcaccacgcactgccactgattcgctcgcccagcggccggctggcgtcgccgtcgatcgcgcgcgtcgcgaccagtccatggctccatgcatgaataacaagggtgtgcggtttgtgatgccaaattgtatcctctcgtcgtgtgttgaagcgttcgatcgtcggtctagtagtgtgcctgtgagcagcggcgtgctgttgtacgtacgtc

SEQ ID NO: 33103 - DNA, 447 bp, Zea mays
  Clone ID: LIB3059-010-Q1-K1-D1
gcctgccgtccgtccggattcccgggtcgaccagcgtccgtccggtttcgcagtagggtggcgatggtagctgacgcgaaggaagatgggattgagtaagtgagctattaaacttgttgcttatagacagcaatgcaactaccatgattgatccagatagctgatgtgagacctgtagcctttttgacacaacaacagttgaggccgttatacctgtacgctgcatctaacgctgtcaccatattacaactgcaacaatcgctgtcattaaaccaacttgctttgacaaacacaacaacgttataccaacaacccatcattggcggtgccctattttagattgcttatgagttatagttcaataatgaagttttttggaagatgtttgtggcttcccagatataagaaagcacatttctagattctataaataatattaattttttt

SEQ ID NO: 33104 - DNA, 171 bp, Zea mays
  Clone ID: LIB3059-010-Q1-K1-E6
acgtccgcgatctacaactagtggacgcgtgtgctaagttatttgtggacacatcaccaatagaaaggctacgagtaaatgttgatactttctaaacgaattaaactgtttttaagctattgggtgatcttggagtttcttggggaaaagagttcgagcacttttaataat

SEQ ID NO: 33105 - DNA, 423 bp, Zea mays
  Clone ID: LIB3059-010-Q1-K1-E9
ttcaaaacttcgacatgctcctagtgtccactttcaagagagagttcctgacacagaaatacctgagcaagatgaagaccaagatgatccagatgaacgacatgatcctgactctgatatggaagtggatgatcacaaggctgtggaagagtcatcgaggaggagcattctaggtataaaaatcaagagagaatttggtgaaaatgcgaccagagtacaggatggtggcagagtcgcatctgaacatagaggactggaacccatggcagaagacatcggttcctccaagcaagctcctgcagatgccagtgcaatggccatcgatgaaccaagcaatgtcaagaatgaacctgagagctcaactaaattgcaaggccaagcagctgcgtaccacaagccatagctgcgaccatcaagagttgc

SEQ ID NO: 33106 - DNA, 78 bp, Zea mays
  Clone ID: LIB3059-010-Q1-K1-F3
aaaaaaaaaaaaaaaaaaaaaaaaaaaataaaaaaaaaaaaaaaaaaaaaaaaaaaaaaaataaaaagcgaaacgaaa

SEQ ID NO: 33107 - DNA, 267 bp, Zea mays
  Clone ID: LIB3059-010-Q1-K1-F7
tgccctcttttagattgcttattagatgtaattcaataataaagttttttggatgatgtatgtggccaaccagaaataaaaagttacatttccaaaaaaaaaaaaaaaaaaaaaaaaaaaaaaaaaaaaaaaaaaaaaaaaaataaaaaaaaaagcacaaaatataaaaaaagaagcctcctaaaataaaaactatggtctctgctattacagaataagcctattctacattatgatgggccattataagtgcacattgatattata

SEQ ID NO: 33108 - DNA, 214 bp, Zea mays
  Clone ID: LIB3059-010-Q1-K1-G5
cccacgcgtccgccgcaccaacccctgtggcgtctccgctgccattccgccctactactgattcatgatatttgggaaatctcctctatccatctctctctatctatatatgtaataatgcagtaagacgacacacattatcatgtgtggtatgaccaataatatatgcatggtcataataaagttttggttttaaaaaagaaaatacacgatt

SEQ ID NO: 33109 - DNA, 354 bp, Zea mays
  Clone ID: LIB3059-010-Q1-K1-G8
tcgagctcgagtccttcggttacgaagaccatgaccacggccaccaccaccaccaccaccatcaccacagccacggcgacatggagacatcgcccatgggcgtgtggctgagcgcgatggggtgctcgctgctggtcagtatggcgtcccttgtctgcctcgtcctcttgccggtcatcttctttaaggggaaaccgtctaaggccatagtggattcgcttgcagtgtttggggcaggagctatgcttggagattcatttcttcatcagctggcacatgcttttggtggagggcattctcactcgcatgatcatgagggtcatgatcatgctcatgctcatgaacatgcacatg

SEQ ID NO: 33110 - DNA, 337 bp, Zea mays
  Clone ID: LIB3059-010-Q1-K1-G9
cttgtgtccatcgacactctaattgaggaccaccttacgcaagagcccatcaatgagtacgtccagagttgcgacattgtggctttcaacaagatctagagttcagtttctgagtttgggcaacggcagcggctcagctcgtcaagtttgtgctgggatgccagtttatcccttctagtctattacagaaacgttgttcggagctgagtctattataaacatcttggtctgagtttattgttgagtggtgccagtttttttcaatatacatttatcttaaaaacagcggtactgatgtttttttgtctaaagttaatgagtttgcaaaacaaatgct

SEQ ID NO: 33111 - DNA, 442 bp, Zea mays
  Clone ID: LIB3059-010-Q1-K1-H10
gtaccgtccggattcccggtcgacccagcgtccgtcttgcgtatcctctgatgcctctgttagagcaattgaaacaaatctgctgtggatgatcagcaatggctcacgtactgggtgctgtactcatttatcactctattcgagctcacctttgctccggtactcgaatggcttctttctggtcttatgcaaagctgttcttcaattgctggttagtattgccacagttcaatggagctgcacatgtatatgagcattttgtgaggccaatgattgtaaatcagcaagttgtaaacatctggtatattccaaagaaggatgaatcaagtagacctgatgatgtaatttcagctgcacagaggtacattgagcaaaatggatcaaaagcgtttgagaatcttgttaacaagtttaagagttcgaacccaaggcgctcaattct

SEQ ID NO: 33112 - DNA, 326 bp, Zea mays
  Clone ID: LIB3059-010-Q1-K1-H8
gccggctgctgtcaagttccatctgtttgctatcgcagacatgtatggccgcggcaagggaggcaaggacctgagtaacggcggcgcgaaacgccaccgcaaggtgctccgcgacaacatccaaagcatcacgaacccggccatccagaggctggttcgaaagggcagcgtgataagcatctccaggctcatctaccatgagacctacggcgtgctcaagatctatatcgagaacgtcatccgagacgccgtaaactacacggagcacgcccggcgcaagaccgtcacagccatggacgtcgactacgcgctcaagcactatggtc

SEQ ID NO: 33113 - DNA, 279 bp, Zea mays
  Clone ID: LIB3059-011-Q1-K1-B1
acccacgcgtccgcctcacagcgtcgacagcatcctctacttcagcagaaagtactgaaagcaagagctgggctgatctgggcttgcggggaggcagcccaactctgaagttatgtttccctagactgcccatgttccgaggattagcatcagcattctagctacaaacatttcagatatctttcttgtaagggcaaacattatggcatacctagattcacttttcctgcttgtaattttgatcttcattttgaagtaataagtacttgagttaagggg

SEQ ID NO: 33114 - DNA, 431 bp, Zea mays
  Clone ID: LIB3059-011-Q1-K1-B12
cggattccgggtcgacccagcgtccgcgccgcgtccgaaacacatggaaaatcgcattcatgtaccaccattgaccgacagtgtagggcaatatcttatgcatcctgatccttctggatgtgctggtacctgaaccatacgccaacattgctcataagctcttataacttcctatatttgcccatacctctcaatacctgtgattaaagactgttaaaacctaataatacaaacctacacgatccaacaggctataacaagcagtatcataactcaattaaccttgatcatccaacaactgtcaacaatattacagcatatacctggggcacatatggtgacacaccatatcaacgcacaacatctacaacatcttgctatcagaaaccatgctagctactctgagcaacattagttcctaccattaaaac

SEQ ID NO: 33115 - DNA, 472 bp, Zea mays
  Clone ID: LIB3059-011-Q1-K1-B2
aattcccgggtggacccacgcgtccgctgatgtcttatctgagtcgagcctgtttgtctacccgtacaagattgtgatcaagagctgtgtaagtacaaagcgtctgctcgctattccgaggatccttgaacttgctgaagagctcctgttgccactcgctgcagttaaatactcccgtggaacgttcatattccctgaagcacaaccttccccacacaagaacttcgctgacgaggttgccttcctgaatcgcttcttcggtggcctcaagtccggtggcaatgcttatgtgattggtgactctgcgaagcccgggcagaagtggcacgtctactacgccgctgagcaccctgaggagcctgttgttactctagagatgtgcatgactgggctggacaagaagaaagcttctgtcttcttcaagaccactgctgatggttactcgctgtgcgccaaggagatgaccaagctc

SEQ ID NO: 33116 - DNA, 333 bp, Zea mays
  Clone ID: LIB3059-011-Q1-K1-B9
gcgacgcgtccggaactctcctgcttatttacagcagcaacaactactaccattcaggcagcgagctggtgtgagccctgctaccttcttgacacaaccacaattgttgccgttctaccagcacgctgcgcctaacgctggcaccctcttacaactgcaacaattgctgccattcaaccaacttgctttgacaaacccaacagcattctaccaacaacccatcattggtggtgccctcttttagatttcttatgagttatagttcaataataaagttttttgtctgatgtttgtggcttcccagaaataagaaagtacatttctagattctaa

SEQ ID NO: 33117 - DNA, 477 bp, Zea mays
  Clone ID: LIB3059-011-Q1-K1-C2
aattcccgggtggacccacgcgtccgcgccggagttactaccccgagttacctcgctctctttgtcaggcacttctactcgcagctatcatcgagatctcggagctggcgtccagttgcacaacggcgatgacctcgcctacagttttcgcgccaagaaggccgtcctgttcaaaccagataatgggttcctaggtctgaaccttaaagggcgcctacttaccgataaagagttgaagccgacgaagacaactggatccgttgaactggcatggaccatacttgacttgaaacagggccaagacgtaaggctcaaagttggttacgaattgtgtgacaaggtgccttatttccagctcagagagaacggttggacgctgaatgcttatatggatgggaaatgggatgttagatttgaaatgtgaatccacttgctcagtagtgttaccaattctacttgtctgtactgcacttggaa

SEQ ID NO: 33118 - DNA, 475 bp, Zea mays
  Clone ID: LIB3059-011-Q1-K1-C3
aattcccgggtcgacgccacgcgtccgccgacgcgtccggtgaaaagattggtgcaacagcccgtttctggcgattttctgctggttcttatcgagaccttatagaggcattaccaaaaaaaccgcttacatctgtaaataagacagtgaatggcagttttgttcgaccatccaatgctgggggcgatgtttatcctgtggaatcttacgagagctcagctaaccaagtacttgatgctcactggggtgttctggatgatgatgatgcaactggactttgctcgcataccctctccatccttgtgaatgattgtcctggtgttctcaacattgtaacaggagtctttgctcgcaggggctacaatatacagagccttgctgttggctcagctgagaaggaaggcatttcacgtattacaacagttgttcctggtacttgtgaatccattgggaaattagttcagcaactttacaa

SEQ ID NO: 33119 - DNA, 451 bp, Zea mays
  Clone ID: LIB3059-011-Q1-K1-C4
attcccgggtggacccacgcgtgcgggctcatggtcgtgtaatatttgccagtggcagtccatttgaccctgtggagtacgaggggaaggttgttgtacctggacagtcgaacaacgcctacattttccctggatttggcctcggtcttgttatctctggagccatccgtgtccacgaggacatgcttcttgccgcctcggaagcactagctgctcaagccacacaggagaacttcgacaagggatcaatcttcccgcccttcaccaacattagaaagatctctgcgcgcattgccgcagccgtggctgcaaaagcttatgaactcggtttggcgacccgtctgccttccccaaaggacctggtgaaatatgcacagagctgcatgtacactcctgtctaccgtaactaccggtagtgctgctgggatcaattctgcagtaataaaatatg

SEQ ID NO: 33120 - DNA, 379 bp, Zea mays
  unsure at all n locations
  Clone ID: LIB3059-011-Q1-K1-C7
cccggtcgaccacgcgtccggtancatcagtgttgctgttggcacttccaagggccttgtggttcgtgttatccgggatgctgataccatgaactttgctgacattgagaaagggataaacaaccttgcaaagaaagcaactgagggggcgctctcaattgatgacatggcaggtggaacattcaccatctccaacggtggtgtctatggaagcctcctcagcacacctatcatcaaccctccacagtcgtctattctggggatgcattccattgtgcaacgccctgtggttgtgaatggtgacatccttgcgaggccaatgatgtaccttgcgctgacttacgaccacaggttgatcgatggcagagaggctgtcttc

SEQ ID NO: 33121 - DNA, 105 bp, Zea mays
  Clone ID: LIB3059-011-Q1-K1-D1
gagcgacaaagctagctctctccagggtatcggattctgatcaccatgccgtccacccgtaactccgggtccctcgaccagaaccttgagctcgccaagcaatgc

SEQ ID NO: 33122 - DNA, 419 bp, Zea mays
  Clone ID: LIB3059-011-Q1-K1-D5
accggtccggaattcccggctcgacgccacgcgtccgcgcacgcgtccgccataccccaccttttgtgtgatggataagattatagatggattggaacacttcgcagcatggcacatggctagcctgctagcgtgcggcacccacacaacacaacacactgctcgccagaagcgccccatgaggccaggggaggacacgacaccgccatcagccatcatcatcatctcatactcagagcatgccatggcacgcaactgactgactgactcgaaacacacacatcgactccgctatactttattaagctttataattaactagcttcctccggccggcctgcacggtggagcacctagctcactttccgcagttgcaaggatctcactgtcagttgcctccatacttgcacccttcattc

SEQ ID NO: 33123 - DNA, 454 bp, Zea mays
  Clone ID: LIB3059-011-Q1-K1-D9
ggattcccgggtcgactcacgcgtccgaaaaaaaaaaaaaaaaaaaaaaaaaattaaaaataaaaaaaaaaaaaaaaaaaaaaaagaaaaagaaaaataacaatttatggaaaaccaaaataaacaatcactcttacttccatcttattaactcttttttattgccacttaatttcaatctattgccctttttttaacaacattaataacttataaaaccctgacattacccaatttaatcccttttaaaaacatccccttttcctaatttagcttactaccaataaatcccctttcgttcccctttcctaaaatttactcaccctaatttacaattggtacactccctttaccctccctttacccaccttaatctccttgctttaacatccccctttacccatactttttaaatcccattagtcccttacccttttccttttccaacaatttc

SEQ ID NO: 33124 - DNA, 419 bp, Zea mays
  unsure at all n locations
  Clone ID: LIB3059-011-Q1-K1-E1
attccctggtcgacccactcatccggaggatcccagaggccatcctgtactatagggactacatggtaccctntgctactntgatcaatttgaaattttgccaaaccacctctttcccaaatcatactaatttactgcacctcacttttccctttcagaaaccttcatactttcacaccatatctatcttcacaatacatatcttattaccatacattttatcataacattaattgaactatttccaatactcttgttcttttcacataccataattcctagtcaattgaatttaccactcttgcaatattcattctgatcataatccctcaaaaatttttataccacaatacatttaaaccttttaatacttataatcatatatttaataaatcctatcaaattattaaatattacca

SEQ ID NO: 33125 - DNA, 433 bp, Zea mays
  Clone ID: LIB3059-011-Q1-K1-F10
tggacatcctgcagaaggtgttctaccgctccaacgcggcgcgcgaggccttcgttgagatgtgcgccgacgactacgtgcagaagatgaccttcgacagctacctctacaagcgcgtcgtgccgggcaacccgctcgacgacatcaagctcgccgtcaacaccatcggcagcctcgtcagggccaccgcactgcgccgggagatggagaaggtcaccttgtgagccgccgcccgcgacgtcattgccgtcgaaatggtgtcgcagctgatcggccggtgtattagtagagatttgcggctgatcgggttaatttaggccaacatgcgtgggcagtgggcgcggagaggaagagaaacaagttgtgcaagtgcagcaagtagatcaaaagtgctgcctgtttgtatcgatggatcctgcaacatatagcatat

SEQ ID NO: 33126 - DNA, 477 bp, Zea mays
  Clone ID: LIB3059-011-Q1-K1-F7
taccggtccggagttcccggctcgacgccacgcgtccgagcaacatagaaagcacaatagtgtaccaacaatggcagccaaaataggttgcctccgtatgctccttggtctttctgcaagtgctgctacggcgaccattttcccgcaatgctcacaagctcctatagcttcccttcttcccccgtacctctcaccagtgttgtcttcagtatgtgaaaacccaattcttcaaccctacaggatccaacatgcaattgcatcaggcatcttacctttatcacccttgttcctccaacaatcatcagccctattacagcagttacctttggtgcatttattggcacaaaacatcagggcacaacaactcgtgctagcaaaccttgctgcctactctcagcaacaacagttacctttggtgcatttgttggcacaaaacatcagggcacaacaactacaacaactcgtgctagcaaacct

SEQ ID NO: 33127 - DNA, 333 bp, Zea mays
  Clone ID: LIB3059-011-Q1-K1-G1
cggacgcgtgggttgaggaccaccttacgcaagagcccatcaatgagtacgtccagagttgcgacagtgtggctttcaacaagatctagagttcagtttctgagattgggcaacggcagcggctcagctcgtcaagtttgtgctgggatgccagtttatcccttctagtctattacagaaatgttgttcggagctgagtctattataaacatcttggtctgagtttattgttgagtggtgccagtttttttcaatatacatttatcttaaaaacagcggtactgatgtttttttgtctaaagttaatgagtttgcaatggttctgagtctaaa

SEQ ID NO: 33128 - DNA, 450 bp, Zea mays
  Clone ID: LIB3059-011-Q1-K1-G12
ccggattccgggtcgactcacgcgtccgcccacgcgtccgcccacgcgtccgcccacgcgtccgcccacgcgtccggcacaatagggtaccgacaatggcagccaaaatattttgcctccttatgctccttggtctttctgcaagtgctgctaccgcgaccattttcccgcaatgctcacaagctcctatagcttcccttcttcccccgtacctctcaccagcggtgtcttcggtatgtgaaaacccaattcttcaaccctataggatccaacaggcaatcgcagctggcatcttacctttatcacccttgttcctccaacaatcatcagccctattacagcagttacctttggtgcatttattggcacaaaacatcagggcacaacaactacaacaacttgtgctagcaaaccttgctgcctactctcagcaacagcagtttctttcat

SEQ ID NO: 33129 - DNA, 237 bp, Zea mays
  Clone ID: LIB3059-011-Q1-K1-G6
cccacgcgtccgcccacgcgtccgtgtactttgatgaagagaggaaagcatgttttgccacaactgatggattgtttgtttaaaaaaaaaaaaaaaaaaaaaaaaaaaaaaaaaaaaaaaaaaaaaaaaaaaaaaaaaaaaaaaaaaaaaaaaaaaaaaaaaaataaaaaagatcaaagtttaaatacagatgcatgcaatgtaataacttttaaaaagtgtacctaaatttaatta

SEQ ID NO: 33130 - DNA, 442 bp, Zea mays
  Clone ID: LIB3059-012-Q1-K1-A12
accggtttcggaattcccgggtcgagccacgcgtccgtgttcctccaacaaccgtcagccctattacagcagttacctttggtgcatttgttgggacaaaacatcaaggcacaacaactacaacaacttgtgctaggaaaccttgctgcctactctcagcaacagcagtttcttccattcaaccaactggctgcattgaactctgctgcttatttgcaacaacaactaccattcagtcagctagctgctgcctacccccagcaatttcttccattcaaccaactggcagcattgaactctgctgcttatttacaacagcaacagctaccaccattcagccagctagctgatgtgagccctgttgccttcttgacacaacaacagttgttgccgttctacctgcacgctgcgcctaacgctggcaccctcttacaactgcaac

SEQ ID NO: 33131 - DNA, 171 bp, Zea mays
  unsure at all n locations
  Clone ID: LIB3059-012-Q1-K1-A2
taccggttcggaattcccggctcgacgccacgcgtccgcccacgcgtccgcccacgcgtccgcccacgcgtccgaaagctagctctcggcananatgggattctgatcaccatgccgtccaccgtgaactccgcgtccctcgaccagaaccttgagctcgccaagcaatgc

SEQ ID NO: 33132 - DNA, 250 bp, Zea mays
  unsure at all n locations
  Clone ID: LIB3059-012-Q1-K1-A6
attcccggtggacgcacgcgtccgccgagcgtccgcttcgccttgcgaggttgcggaggggaggtggtagtggtagggtatgcangagtgctctgcccatggagaaggcggggcaacaacgccatgttatcggcggcggcggcaagaaggcgcccgcgctggggctgcagaagcagaactcgtggtcgccggacatcgagcgcgacgaggcgtgggagcgccggctcaggggcatgcgccgcgggggcac

SEQ ID NO: 33133 - DNA, 241 bp, Zea mays
  Clone ID: LIB3059-012-Q1-K1-A8
ttaattcccgggtcgacccactcgtacgttgtttttttatttttttaatatttttttttatttttatttttttttttattttttaagtttttttaatatttttgtaaatttttatttttttattttattttaattttattttatttttttgtttaattttttaaatttttttttcattaaaaaaaaaaatataaaaaaaattatactataaattaaaaaaaatttaaaaaaaaaatataaa

SEQ ID NO: 33134 - DNA, 420 bp, Zea mays
  Clone ID: LIB3059-012-Q1-K1-A9
ggaattgccgggtcgagccacgcgtccgggagcagctagggttccgtcctcgatccgatccgccgagtgcacaccacctgtcccgctccgatcgaatcgatggccgccgagggcgagaagaagatgataaccctcaaaagctccgatggcgaggagttcgaggtggaagaggcggtggcgatggagtcgcagaccatccgccacatgatcgaggatgactgcgccgacaacggtatccctcttcctaacgtcaactccaagatcctatccaaggtaatcgagtactgcaacaagcacgtacatgccgccgccgccgccgccgccgcctcgaaggccggttccgacgacgtgggtgccgcctccgccaacagcaccgccgcctccggtgaggacctcaagaactgggatgcggacttcgtc

SEQ ID NO: 33135 - DNA, 136 bp, Zea mays
  Clone ID: LIB3059-012-Q1-K1-B1
gtcagtgtgagcaatgacactgccacccatggtgatgcgtgacacattaggactcaaggatcaccatgggtggcagtgtcagtgtgagcaatgacctgaatgaacaattgaaatgaaaagaaaaaagtattgttcc

SEQ ID NO: 33136 - DNA, 258 bp, Zea mays
  Clone ID: LIB3059-012-Q1-K1-C11
gaaattttctgttgtagcttaaaagatgattgtatagtaacacggtactatgagatgtgtattatattgctatgaaaaccttgtcaaggtcctgtatttccaactaaatttatacctgtttgaaaatttttgagcagaccctaaaaaaaaaaataaaaaaaaaaataaaaaaaaaaaaaaattaaataaaaaaaagggccggccgttttaaaggatcaaagttaacgtacccttccttccaacgtaatacttttttaa

SEQ ID NO: 33137 - DNA, 420 bp, Zea mays
  Clone ID: LIB3059-012-Q1-K1-C3
aagcaacatagaaagtggaatccagtatcaacaacagagcaacaatggcgggcaagaggttttccctccttatgctccttgctctttctgcatgtgttgctaacgcgacaattttccctcaatgctcacaagctcctatagcttcccttcttcccccataccttccatcaatgatagcttcagtatgtgaaaacccagctcttcagccctataggctccaacaagcaatcgcagcaagcaacatacctttatcacccttgttgtttcaacaatcgccagccctatctttggtgcagtcattggtacaaaccatcagggcacagcagctgcagcaactcgtgctacctgtgatcaaccaagtagctctggcaaacctttctccctactctcagcaacaacaatgtcttccattcaaccaac

SEQ ID NO: 33138 - DNA, 353 bp, Zea mays
  Clone ID: LIB3059-012-Q1-K1-C8
gtccggaattcccgggtggacgccacgcgtccggtgcctgaggcagccgcagagcagccctttggcggctgcgccctactacgccgggtagaggcatggtagcgccatgtaccatccgctccggcaacagtgctgccagcagcagatgaggatgatggacgtgcagtccgtcgcgcagcagctgcagatgatgatgcaacttgagcgtgccgctgccgccagcagcagcctgtacgagccagctctgatgcagcagcagcagcagctgttggcagctcagggtctcaaccccatggccatgatgatggcccataacatgccggccatgggtggactctaccatgaccagctgc

SEQ ID NO: 33139 - DNA, 217 bp, Zea mays
  Clone ID: LIB3059-012-Q1-K1-D1
aattcccgggtcgacccacgcatccgcggactcgtggtcggacgcttgggcaacaattgctgccattcaaccaacgtgcttttgcaaacctaacagcattctaccaacaacccatcattggtggtgccctcttttagatttcttatgagttatagttcaataataaagttttttgtctgatgtttgtggcttcccagaattaagaaagtacatttct

SEQ ID NO: 33140 - DNA, 179 bp, Zea mays
  Clone ID: LIB3059-012-Q1-K1-D3
tcccggtcgacgccacgcgtccgtccagttctctttgatgaaccctgccttttcgtggcaacaacccatcatgggaggttgcatcttttagatgacatatgagatgtaatcgataatggtgccctcataccggcatgtgtttcctagaaataatcaatatattgattgacatttatctc

SEQ ID NO: 33141 - DNA, 370 bp, Zea mays
  Clone ID: LIB3059-012-Q1-K1-D5
acgtccggaattcccgggtggacccacgcgtccggagaatgagagctacaagaagctgattgcagacattgaagcccagccaagcattgcgggtcatatagtgctgaaatccttcttgcacaagatctacaagaggcagaagtagggtgctcttggataaacgagctcaggagtcgttactccttcgcatgcttgacataaccggacttcctcacctggttgctctagtatgatgtggagcgtctagttaaaaaaaatcgatgtagtatgaaacaacctgcttggtctaattttaaccaggctattaaggcaaagtgctgtatcggtttggtggaccgtatgttgcagataataaattagttagtttgtc

SEQ ID NO: 33142 - DNA, 467 bp, Zea mays
  Clone ID: LIB3059-012-Q1-K1-D6
tccggaattcccgggtcgacgccacgcgtccgcactccggttcgtacctcgcacaggggctgcggcaaggcagctctgaggggatctcagcggcgacggcgcggcgacagcgaccgccgggctcgaggattcgcacggagtgaacaaggctgagcgtcgcctcattccgacttccgatccccaacggaaagcggagccaggaccgggagctggagcagttgtcttcccccctcgtctccgtcaactggtctttaattctctctttacacatatcttggtatttaattctctcatcaccagcgtaagaaaaaaccatttgaagctaaatttttcaacaagccacttgagaactaccattacatggctgttatatttgggaatcatcaagcaactggactatttgcaaaatgcaccagtgatcccctaggtttcgacacatctgaaagtgcatgtacatatggtgtggg

SEQ ID NO: 33143 - DNA, 417 bp, Zea mays
  Clone ID: LIB3059-012-Q1-K1-D8
tcttcattcactcactctcttcgatcactgtactgaagataccatggccaagtcgacggcgatgtgtgtagccgccctggccctggtggtggtgatggcgacgacgagcacaggcggtggcagggcggcagcggcgtgcgatcccaagccgctggtggtgtgcgatccggcgttcatggacggagcgaaacccgcggcagcatgctgctccaccctgcgtgcgcaggaggcatgcttgtgcgtgtacgccaaagaccccaagtttgcaaaatacatcaacaaccccaacaccgtcaaaacctttacctcgtgcggcatagccatccccaaatgctaagcaagcgctctgcgtcgtcgcttcgcttgctcttgctcttgtgtgtaacatatccagcttatgaataaattatgtggatc

SEQ ID NO: 33144 - DNA, 442 bp, Zea mays
  Clone ID: LIB3059-012-Q1-K1-E12
taccgtccggattgccgggtcgactcacgcgtccgattctttggttaaggatacaggattgggcaaatttcatatttaactttgtagaggagaacgggttggaagtaatgactatcgaagaaatacgctctggaattgatacacgtggaactgaactcgagggaattgatcgtggtgttctcatgcgggctctgcggcagttggagcaaaagggaaaggcagctatcttcaaaggcacctctgctgatgacgaaggcgtaaagttttcggtgtaattattttgcgatccttaaactggcagactaataatctcgttcagccggtgcccttgaacatggcatgacacacccatagcctcgatcattcagtgccctttgaaaatggcatgacacatccttgtaaaaagcagtagggctgatcacattcttcccgagtggtatcc

SEQ ID NO: 33145 - DNA, 285 bp, Zea mays
  unsure at all n locations
  Clone ID: LIB3059-012-Q1-K1-E5
ggaattcccgggtgcgacgccacgccagtccgactcgattcctccgcaacaaccactctcnngcctgcgatcgttcgtagccctccgtcagcagtcgagcagcngatcagtgtcggctctacnntgcggaaagtaccaaggatgagccctcatcaagaatgccctgcctacattggcatcccccggcaangggtatttccttgctgctgatgaagtccaaactggcaccatnntggcaagcgccctttccaaagcatcaatgttcgagatacgnnttgaggagaa

SEQ ID NO: 33146 - DNA, 311 bp, Zea mays
  Clone ID: LIB3059-012-Q1-K1-E6
ggaattcccgggtcgacccactcgtccgcccacgcgtccgtgcttgtttttctctttgttgttcaaacactttacacccaaataaggaacttcagtgacattaattttggctgcaccaaagttacatgaactgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggcgaccgttttaaaggatccaagtttacttacccttgcttgcaacttcaaattttttttatagggaaacctaaattaaa

SEQ ID NO: 33147 - DNA, 439 bp, Zea mays
  unsure at all n locations
  Clone ID: LIB3059-012-Q1-K1-F12
taccgtccggaattcccggtcgagccacgcgtccgcattcaaccaacttgtcaggagccctgctgccttcttactgcagcaacaggtgttggcattccatctacaagttgtggcaaacattgctgctttcttgcaacaacaacaattgctgccattttacccacaggttgtgggaaacattaacgccttcttgcaacagcaacagttgctgccattctacccacaggatgtggcaaacaatgtcgccttcttacaacaacaacaattgctgccatttagccaacttgctttgacgaatcctaccaccttattgcagcagcccaccattggtggtgccatcttctagattttttatgctttatactgtaataataaagttctcatactgatatgtgcaacttctcagtaataaaagattagagatctatattntaagttc

SEQ ID NO: 33148 - DNA, 455 bp, Zea mays
  Clone ID: LIB3059-012-Q1-K1-F4
taccggttccggattcccgggtcgcccactctccgggaaacccattgttcaacctacagtaccacaggcaatcgcaacgggcatctgacattatcacccttgttcctccaacaaccgtcagccctattacagcagttacctttggtccatttggtggcacaaaacatcagggcacaacaactacaacaacttgtgctagcaaaccttgctgcatactctcagcaacatcagtttcttccattcaaccaactggctgcattgaactctgctgcttatttgcaacaacaattaccattcagccagctagttgctgcctacccccagcaatttcttccattcaaccaactagcagcattgaacttctgctgcttatttacagcagcaacaactactaccattcagccagctagctgatgtgagccctgctgccttcttgacacaacaacagttgttgc

SEQ ID NO: 33149 - DNA, 450 bp, Zea mays
  unsure at all n locations
  Clone ID: LIB3059-012-Q1-K1-G5
gtccggattccgggtcgacccagcgtccgcggacgcgtgggcaactatcgcgttctctctacttccggtcttccaaaatccggagttgagaaccagcagagcatgcctcttctttggcatgggtgcatctggcgtgatacctgttcttcacaagctagtactcttctggcaccaaccggaggcattgcacacgaccggatacgaaattctgatggggctcttctacgggctgggagcattggtatatgcggcacgggtacctgagcgctggatgcctgngaagtttgacatcgccgggcacaaccaccagctgtttcacgtcttggttggtgcccgagcctacacacactaccacgcagggcttgtgtacctcaagtggagagacctgcaaggctgctgaaaggtactgcatcgttgaggatgtggatagattgtagattccgggaattc

SEQ ID NO: 33150 - DNA, 385 bp, Zea mays
  Clone ID: LIB3059-012-Q1-K1-G6
aattcccgggtcgacgccacgcgtccgagaaatccatcgagaggccgtcgacaggggaattaatggcgtcgtcgtctagcatcagccaccggggcctcatcctcgcagccgccgtcctgctctccgtgctcgcggctgccagcgccagcgccgggacctcctgcgtgccggggtgggccatcccgcacaacccgctcccgagctgccgctggtacgtgaccagccggacctgcagcatcgggccgcgcctcccgtggccggagctgaagaggagatgctgccggaagctggcggacatcccggcgtactgccggtgcacggtactgagcatcctcatggacagcgcgatcccgcctggcccggacgcgcagctggagggccgcct

SEQ ID NO: 33151 - DNA, 312 bp, Zea mays
  unsure at all n locations
  Clone ID: LIB3059-012-Q1-K1-H4
aattcccaggtctacccacgcgtccggtcttcagtatgtgaaaacccaattcttcaaccctacaggatccaacatgcaattgcagcangcatcttacctttatcacccttgttcctccaacaatcatcatccctattacagcagttacctttggtgcatttattggcacaaaacatcatggcacaacaactcgtgctagcaaaccttgctgcctactctcagcaacaacatttacctttagtgcatttgttgtcacataacatcagatctcaacaactacaacaactttttctagcaatcctttctaactac

SEQ ID NO: 33152 - DNA, 453 bp, Zea mays
  unsure at all n locations
  Clone ID: LIB3059-012-Q1-K1-H7
ggaattcccgggtggacccacgcgtccgagtgagaaagcgagcagctacgacactccgttgtatgcaagctttggtcagggttcaggcccgtgtgagagcaaggcgagttcgcatggctttggaaaaccagactgatcggcaaaatacttcaccagagcacacgatcgaggcacgtgtcagagaaatcgaggatggctggtgtgatagtatcggttctgtgggagatatccaagcaaaacttctaaagaggcaggaagcggcagctaaacgtgagcgagccatggcctatgctctagctcatcagtagcaagcaaattcaagacaacctacagcatttgaacctgacaagaacaacttgggctggaattggctagagagattgattgctgttcagccttgggagaatcngttccttggcacttacgggacagatgggatttttgtagttaatg

SEQ ID NO: 33153 - DNA, 191 bp, Zea mays
  Clone ID: LIB3059-013-Q1-K1-A10
cacgcgtcctcgcactgctatgcctctatgccggatttcactccaatcacctgccgtaacagctcgaagcaggcttacgaattagaaaacgaagcaaacgaacttatccgcatcaagaactatctctatggcaagctcccggtgcacacaggccattctgtcgaaaaaatccatgagaacctgtctagggt

SEQ ID NO: 33154 - DNA, 447 bp, Zea mays
  Clone ID: LIB3059-013-Q1-K1-A12
taccggttcggaattcccggctcgacccactcgtccgcccactcgtccgcccacgcgtccgcgaactcgtgggaaaaaaaaaaaaaaaaaaagaagaaatattaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggaccaccattttaaagaatccaatttaactttcccttgcttacaacataaaactttttttatatcatccccaaaattaaattaacttcccgtattttaaaaaaatactaatttgaaaaaccctgggataaccaaattaaatcactttgctaaaaatccccttttcacaaattggcgtattacaaaaaagcccccaaccaatcccctttccaaaaaattgccaaccttaaattgcaaattgaaccccccct

SEQ ID NO: 33155 - DNA, 296 bp, Zea mays
  Clone ID: LIB3059-013-Q1-K1-A3
gcgtccgcccacgcgtccgcggacgcgtgggcggacgcgtgggctggaatcccagagagttgtagcatgaggatcaaaccgtgtaacggtttgatcctgatgctggaatcccagagagttgtagcagtagctggcccaaatgcatgctgggtggttttatctattgctgatgagttgtttaagcaagatccattcctgtattgtactccataagccacttgggtgttgctttgtattgttcactactgtgttttttctatgtgtgggaccgcatctacagtactagttgcttgtcg

SEQ ID NO: 33156 - DNA, 443 bp, Zea mays
  Clone ID: LIB3059-013-Q1-K1-A4
cggaattcccgggtgcgaccgacgcgtccggaaccttctagccgcacctagggtttggattggcgccgagcatggcgtacgtcgaccgcgcgttctccatctccgacgaggacgacctcgtcggcggcgccatggggggcccgcgcggggcgcccgtgaaggagatcgccttcgccgccgcgctgctcgccttcggggcgctcggtaccatcggtggcctgctaatggccgtcaaccgcgtcggaggggaccgcgcgcacggaattttcttcatgatgttgggcattgtaatgttcatccctgggttctactacacaaggatcgcctactatgcttacaaaggttacaagggcttctctttttcgaacattccaccgatctgaaggagtgtgctgctgcctgctggttatgaagtggtgtccctggtttaagagtttgtcgac

SEQ ID NO: 33157 - DNA, 395 bp, Zea mays
  Clone ID: LIB3059-013-Q1-K1-A6
cggtttcgaattcccggcgggacccacgcgtccgcggacgcgtgggcggacgcgtgggcggacgcgtgggcggacgcgtgggcgggggcgtgttggtcgtcatgtccatggctgacgtcccgctcgggttcggcattgcggcgaggtcggcgcaggattgcaggaaggccgacaccaacgccgtggtcgtgctgcaccagtcggacgccggggagtacctccgcaaggaggaggagctcatgtgaggtgagcgcataggcttggctggttaggtcatattcatgagtgaattatggaagattgtgccttactgttgtgtgttccaaggcttggggcatatatatatgtactgaatgattaatcactggttatgagatgcgattattgctgttgcc

SEQ ID NO: 33158 - DNA, 445 bp, Zea mays
  Clone ID: LIB3059-013-Q1-K1-A7
accggttcggaattcccggctcgacccacgcgtgcgcggacgcgtgggcaaaggtgaagcaaacatatcatatatatgttcacgttatggccggtctccatagctcatatgtggggcaactgagtacacaacatcaattgatatttggtcagctggatgtgttcttgctgagctgcttcttggccagcctctcttccctggtgaaagtgctgtggatcagcttgttgagataataaaggttcttggtaccccaacgcgcgaggaaatccgatgtatgaatccaaactacaccgagtttagatttcctcagatcaaagctcacccatggcacaagattttccacaagcggatgcctccagaagctatagatctcgcttcacgcttgctccaatattcaccaaatctaagatgcactgctcttgaagcgtgtgcacatccattcttt

SEQ ID NO: 33159 - DNA, 305 bp, Zea mays
  Clone ID: LIB3059-013-Q1-K1-B4
cggattcccggtggacccacgcgtccgccgcatcgtccgcggacgcgtgggcgatcccttcatcagcaccgactacatgacctagatggttatagtacgacactgtacacggacagtggaagcaccatgaagtcaaggtgaaggactccaaaacccttctctttggtgagaaggaggttgctgtgtttggctgcaggaaccctgaggagatcccgtggggttcggttggtgctgaatatgttgttgagtctactgttgttattacttacctgtaataatcctgcatcttactttaaattctatcc

SEQ ID NO: 33160 - DNA, 377 bp, Zea mays
  unsure at all n locations
  Clone ID: LIB3059-013-Q1-K1-B5
agtttcacagacagcatccattccacagtcaccagagcactagagcagagcagcaacggacaagagcagagcgagatcgtcgtcagcgagctcagcagagagccagatacgagagagaggatggcggacatcgcgttgctggtggcggagcagttcgagaagacggcaaggcgaggcgcccccggcggggacggcggcagcggcagcgggaccggcggcgagacgaggaacttcggggccgtggccaaagtgtggagctcgtgggtggagtccgcctccgccgccgcgtccggggtcagattcaccgtcgcggtgcagctggagcccaagaccgggctcgcgctggccgncgccgacggcctcttcttcgcctagct

SEQ ID NO: 33161 - DNA, 372 bp, Zea mays
  Clone ID: LIB3059-013-Q1-K1-B6
tgaattcccggctcgacccactcgtccgaaaaaaaaaaaaaaaaaaaaaaaaaaatataaaaaaaaaaaaaaaaaaaaaaaaaagaaagattattataaaaatccaaacttacaaaacacatacatacaacaaaataaactcttctatattttcaccctacatacaattcactcccctcctttttacaacttcattacttttaaaaccctctcattccccaacttaatctcctttcaccacattcccctttctccaaatccctaatacccaaaattcccccacctatcgccctttccaacatttccccattctaaatatccaataaaaccccccctgtatcgcctcattaacctcttccactattttaattc

SEQ ID NO: 33162 - DNA, 352 bp, Zea mays
  Clone ID: LIB3059-013-Q1-K1-B9
aattcccgggtcgacgcacgcgtccgcccacgcgtgcgcaacaactcgtcctcgtcgtgaacaaaacccatacctcacctcctatcacaatgcctttacatgcgtgcttattttgttccttctcttttgagctaccattacatagttgcaaactgcagaacggcttttcgcatgtgaaacccgtttgaaaaaaataatcggctttggataggggtttggggtcctcctttccctgaaagaacgcatcggcgtgctgctcgcggtcaagccgtgcctgtcgccttgcggttgcctctagcgtcatgtgtaacgcggctatgcccagtgaaataacgtttggtccttgtgtttg

SEQ ID NO: 33163 - DNA, 414 bp, Zea mays
  Clone ID: LIB3059-013-Q1-K1-C11
gaattcccggtcgacgctcacgcgtccgaatagaccactgatttcacaatgaaaagtgagacaatgccttcatggctagaactgtttgttgcaacacaattctttacgacttgtgctaaccatcttcttgctagtcgcaatgaatgtaacctattttgcacccagtgtgagaccaaaccagctgctttctgtaactattgtcgttcaagtgatcattccacccaccgtgtaatccagataaggcgttcatcgtaccatgacgttgtgagggtgtccgagattgaggatatccttgatgtcagcgatgtgcaaacttatgtaatcaatagtgcaaggattgtattcctgaatgagcggccacaactgcgtgcttctagtgtccccatttgttaggcacctacattatcaacacat

SEQ ID NO: 33164 - DNA, 207 bp, Zea mays
  Clone ID: LIB3059-013-Q1-K1-D10
ggaattcccggctcgacccactcgtccgaaaaaaaaaaaaaaaaaaaaaaaaaaaataaaaaaaaaaaaaaaaaaaaaaaaaaaaaaagtaaatctttatacatactaccaaacttactaacacatacatacaacttcataactatttatataacatcacctaacttcatttcactctccaaactctttacaacttacctaacttaa

SEQ ID NO: 33165 - DNA, 317 bp, Zea mays
  Clone ID: LIB3059-013-Q1-K1-E10
tcccggatcgacccactcgtcacggtgcaaagcgctcagatgcccacctatttaccaatgactctgcactctatcctgacacgttgtaatatacactcctacgtctactaatcaactattctacagacactcgccaccttctatgattccccctcacccaagatttgctatccagcaacagcttgctccaagcatgaggcctgggggtcctcatatgccaaactatcatgaaccggttgtccaacagggccaacagggtccacgcccacctattacgcgtcgagcttgagcccagggacagcaacctgcgccatcat

SEQ ID NO: 33166 - DNA, 226 bp, Zea mays
  Clone ID: LIB3059-013-Q1-K1-E6
tgcagatcggcaggccggcagcagggaacagcgtgctgtccgacggcgacctgtgcggaaacgccgatcggttcatcagttaagctaaggcggtcgtcgtgatgcttccgacccctgctttgcacgatgtggattgtggagtgtcagttgatgatgcatcatgcatgcatgcgtacgtgggatacttgaggccgatttattatattgatgcgagccgatcaccact

SEQ ID NO: 33167 - DNA, 280 bp, Zea mays
  Clone ID: LIB3059-013-Q1-K1-E8
actcaggttcaccatcaccaacgtcttttaaactttttaacccttgaattttacagaaccaaaaaaataccttggtttagcctaaaaattcatcatttcctaaaacaaggtttccaatacaaatcccctaccatcaaaaacaacaaaaggcttttacaaaacaaaatttctaccaacaccccggttccaacaagtttatctttttttttcaacaatcatttaaataaggggccgtctcaaaaccgccccatccgcggcatccctttcttttcactcccct

SEQ ID NO: 33168 - DNA, 223 bp, Zea mays
  Clone ID: LIB3059-013-Q1-K1-F2
ccggaattcccgggtcgaccgacgcgtccggcagcttctgcttgctttgtgggggaaggagagagagagagagagagatctagtagagagggtagtaagtggtcctcgaacgaagatgttggcggtgttcagcgggcaggtggtggaggtgccggcggagctggtggcggcgggcagccggacgccgtcgcccaagacgaaggcgtcgcagcttgtggggcgc

SEQ ID NO: 33169 - DNA, 244 bp, Zea mays
  Clone ID: LIB3059-013-Q1-K1-F6
tcccgcgtgtttttttttttttttttgtttttttttttttttttttttttttccaaatcaacaaaccttcattccggaaagagtacttaaaacataaccgcataaaaattctcatctctctcaactactcccatactttctcacctcccaccccctatacaatacacatcccctcccctttcacgacatctccataacttttactccattatctcattacaaacccccttattagtcccctaat

SEQ ID NO: 33170 - DNA, 431 bp, Zea mays
  Clone ID: LIB3059-013-Q1-K1-F9
tattttgagcattcagaaacacaccaagcgaagctacctagcaacgacttaacaacaagtgtctaccaagatattagccctccttgcgcttcttgccctttttgtgagcgcaacaaatgcgttcattattccacaatgctcacttgctcctagtgccattataccacagttcctccgaccagttacttcaatgggcttcgaacacctagctgtgcaagcctacaggctacaacaagcgcttgcggcgagcgtcttacaacaaccaattaaccaattgcaacaacaatccttggcacatctaaccatacaaaccatcgcaacacaacagcaacaacagttcctaccagcactgagccaactagatgtggtgaaccctgtcgcctacttgcaacagcaggtgcttgcatccaacccacttgctctggcaaacg

SEQ ID NO: 33171 - DNA, 362 bp, Zea mays
  unsure at all n locations
  Clone ID: LIB3059-013-Q1-K1-G3
gctgctcaagaccaggttcgggttcgacgacgccttcaactacaaggaggagcccgacctcggcgccgcgctcaagcgctgcttccccgacggcatcgacatctacttcgagaacgtcggcggcgccatgctcgacgccgtcctgctcaacatgcgcgtgcacggacggatcgccgtctgcgggctcatctcgcagtacaacctggcggacggggagaaggacgccgtgcgcaacctcgccgccgtcatctccaagcgcctncgcctgcaggggttcatcgagcccgaccacaagcacctntacccgcagtacgaggcgttggtgctgccgtacatcagggacggcacgctcgcctacgtcg

SEQ ID NO: 33172 - DNA, 417 bp, Zea mays
  Clone ID: LIB3059-013-Q1-K1-G4
cacgcgtgcggaagtcgccggcgccgccgcgacaggatgaaggagcagcagcggcagcggaggcccggcgatctcgtctgctgcgtgcggcgagggagtaaccggagccgcgacaggatgcactcctttgggcaccgcgccaacgcggtggcaacgttcgcggtcaccatactggccgcgatttgcttcgccgcctccttctccgacaacttcaacaccccgacacccactgcctccgttaagatcttgaatctaaactggttccagaaggaggccaacggcaacgacgaggttagcatgacgctgaacatttcggccgacctttcgtctcttttcacgtggaacacaaaacaggtgtttgtttttgtggcagcagagtatgagactccacagaatgcttttgatcaaagtttcctt

SEQ ID NO: 33173 - DNA, 373 bp, Zea mays
  unsure at all n locations
  Clone ID: LIB3059-013-Q1-K1-G9
aattcccgggtcgacgccacgcgtccggtggaatttgctttgaggtatgtgatgtcgttcttcatgctgatgctatccacagggntgatggtcaggtcattcccactgccaggagggtcatctatgcctctcagctcacggccaagccaaggctgctggagccagtctacctggtggagatccaagccccagaaaatgcacttggtggtatctacggtgttctgaaccagaagagaggtcatgtctttgaggagatgcagaggccgggtaccccgctctacaacatcaaggctttcctccctgtcatcgagtcctttggtttctccagccaacttgaggccgcaaccttctgtcaggcgttcccccagtgtgt

SEQ ID NO: 33174 - DNA, 408 bp, Zea mays
  Clone ID: LIB3059-013-Q1-K1-H1
cggaattcccgggtcgacgcacgcgtccgcccaggtgatgcagagattctgttttcagagactactaaagcagagagggagcttaagtgggaagcaaaatacggtattgaagagatgtgccgcgaccaatggaactgggccagcaagaacccttatggctatggatcacctgactctatcaagcagaatggtcaccaaacaaacggatccgctgactcctccaagcagaatggccaccgcacaaacggttcaactgactcacccaagcggaacggccaccatgcgtatgggtctgctgactcacccaagcgcaacgggcactgcgtttttggatcatcagacctcaagccgaatggtaatggccacctgcgctgaacagaactgtttggcctgtgagctccctgtaca

SEQ ID NO: 33175 - DNA, 91 bp, Zea mays
  Clone ID: LIB3059-013-Q1-K1-H4
aaaaacgcaaccggcccttttaaaggacccaagcttacctacccgtgcatgcaacgtcataacttttttataggggcacctaaattcaatt

SEQ ID NO: 33176 - DNA, 267 bp, Zea mays
  Clone ID: LIB3059-014-Q1-K1-A11
atattattattattttttttttttaaaaaaaaaactcttaaaaaccctttattcatcaataattataataaccctccccaattttttaaaaacatattttttttacaaaaaaattatcactaattttttttttatccattataaataattttacaccttattttttaaataaaaataaatcatattaaatttttttttttccaaaaaaataatattttacctttaaatttttttaaaaaaaattttcatccccaaaaaatttttttt

SEQ ID NO: 33177 - DNA, 397 bp, Zea mays
  unsure at all n locations
  Clone ID: LIB3059-014-Q1-K1-A2
attcccggctgcgacgccacgcgtccgccgacgcgtccgcggacgcgtgggttatctaccacggcaccgncagcccgggcggctatgaagactatgcccatcgcgaaatcgacggcgatgaagaagaccagttcccctctcctgatcgtcctgttcctcacagcagcagccatggcggccgagccggagaagcaggcggcccccgcggcacaggagacggccgtgcacatcgtgtacgttgaccgccccgaggacgccgaccctgaggagttccacatccgcaccctcacccccgtcctcggcagcgaacagaaggccatggacgcagtgctctaccactacaagaacgccgtcagcggcttcttcgccaagctcaccctccagcatgtcaaggatc

SEQ ID NO: 33178 - DNA, 276 bp, Zea mays
  Clone ID: LIB3059-014-Q1-K1-B10
attcccggctcgacgccacgcgtccgcccacgcgtccgcccacgcttccgacaatctttacaaagcctaacaggtagattgttttgtttttttaatcttgtgtgaattcataaacgtgcctgaagctttcacatatacatcacttgcttttatcatttcaataatttcagcctttctgtcagatgaaaaaaactacaaagtgctttcagtatttattgcaactatgtagtaattgaaagaatggaaacaccatcattatctataaaggaaacattt

SEQ ID NO: 33179 - DNA, 206 bp, Zea mays
  Clone ID: LIB3059-014-Q1-K1-C10
tccctggtctacccactcgtcctcggacttcgtgggctgactcttgagatctcgagcgctcacccattcatacatacaacaagatatttttaaaattatatgacctatattacatccactttcctaaattatacaacatattaactaataaaaccctaatcatacataacttaatatcatatcaaaacatcctcatatatctatca

SEQ ID NO: 33180 - DNA, 223 bp, Zea mays
  Clone ID: LIB3059-014-Q1-K1-C11
ggaattaccggctggacccactcatccgcccactcgtccgcccacgcgtccgcccttacgtccatccacacgtccctgaacagtagaaaatttatacaagcattgatgcatcaaaaaaaaaaaaaaagctctctcgctctatagcatccaaactaacatacccgtgcatcctacgtcatatctcttctatagagtcacctaaatacaattcacttatccctca

SEQ ID NO: 33181 - DNA, 405 bp, Zea mays
  Clone ID: LIB3059-014-Q1-K1-D10
aattcccggctcgacgccacgcgtccgctagcaacatagaaagcacaatagtgtaccaacaatggcagccaaaatattttgcctacgtaggctccttggtctttctgcaagtgctgctacggcgaccattttcccgcaatgctcacaagctcctatagcttcccttcttcccccgtacctctcaccagtgttgtcttcagtatgtgaaaacccaattcttcaaccctacaggatccaacatgcaattgcatcaggcatcttacctttatcacccttgttccttcaacaatcatcaaccctattacagcaattacctttggtgcaattaatggcaccaaaccttaaggcaccaccaccttttccaacaaaccttgcttgccaactttatcaacaacagttaccttt

SEQ ID NO: 33182 - DNA, 406 bp, Zea mays
  Clone ID: LIB3059-014-Q1-K1-D2
ggttcggaattcccgggtgcgagccacgcgtccgcagcatcaggaagcgtatccatgtccgcgtggagcatgtgcagccgtcccgctgcacagaagagttccgcctgaggaaggtgaagaatgaccagctgaaggcggatgcaaaggagcgcggcgaggtcatcagcaccaagaggcagccgttgggccccaagcctggcttcatggttgaggggactaccatcgagaccgtcactcccattccgtacgatgtggtcaatgatcttaagggcggatactaggttgttgtttggtctttctacctgttctacatctgtgttactctagtgcgtacaatgttgctcacactgagcagtagtatgaacctattgtgtgttcatgttgaaatttttcccgttctgtgcaa

SEQ ID NO: 33183 - DNA, 274 bp, Zea mays
  Clone ID: LIB3059-014-Q1-K1-D4
catccttgagggtaaagagctcgagttctacatgaagaagctccagaggaagaaggggaagggtgttgcatcttagagcattcttttagctagaactgcaaaatatcttctacttgggggattttgttgttagtctttatgcatatcatttgcggacctgatgaacacttcataagtgaatcaactctcgattctaagaattgataattttcacatgcggtggttgtaattgtgatatttaggtttgctatttattgaaacttcttgtctaaaa

SEQ ID NO: 33184 - DNA, 449 bp, Zea mays
  unsure at all n locations
  Clone ID: LIB3059-014-Q1-K1-D7
accggttcggaattcccggctggacccacgcgtccgaacccaccagccaccacgcacagcagcagctagctagctagcaaccacctcgatcgacagaggccggaagctcagccgcgaattcggcaagcaacaaggagaagtcttgggttcctcgccacctctcgatcggccaggcggatccaagaagagatggagaagaaggcaggacgcgagcatgtgatcgggatcccagtgaacaacagggccttcggcatcgaggagccggatttctccagcaaaggcgccgccaggaacgcagccgccgcgggacgggctgcaaagtccggctggacgaccggggacagggtcgctcaaggcctgaaagaacacgtggctctggggccaaacctgtacgagaccgtgaggggcaagctgtcgctggnggcgaggatcctncgggcaggcggcgt

SEQ ID NO: 33185 - DNA, 420 bp, Zea mays
  Clone ID: LIB3059-014-Q1-K1-E5
tgcattctctctacacaagcgactgacaaagcaattaccaaagtcaacaacagaacgtcaatggccaccaagatattttccctccttatgctccttgctctttctgcatgtgttgctaacgcgacaattttccctcaatgctcacaagctcctatagcttcccttcttcccccataccttccatcaatgatagcttcagtatgtgaaaacccagctcttcagccctataggctccaacaagcaatcgcagcaagcaacatacctttatcacccttgttgtttcaacaatcgccagccctatctttggtgcagtcattggtacaaaccatcagggcacagcagctgcagcaactcgtgctacctgtgatcaaccaagtagctctggcaaacctttctccctactctcagcaacaacaattt

SEQ ID NO: 33186 - DNA, 391 bp, Zea mays
  Clone ID: LIB3059-014-Q1-K1-E7
ctctaggtgcccaggtcttcgccggtccggtggccgcctcttcgccgccgatgagcaccagccaggaagaaaagaagctgaaccatggggaagagaaagtcagctgctaagccacctcctaagaagcggatggacaagcttgacactgtcttttcctgcccattctgcaaccacgggagtagtgttgagtgccgaattgacatgaagaatctgattggcgaagcatcttgtagaatctgtcaggaaaacttcagcacaactgttaatgcactcactgagcctattgatatatatagtgaatggattgacgagtgtgagcgtgtcaacactgttgaaggcgacgatgatgcgtgagcttgccccatgcgatgaaactgttacctaccatcgt

SEQ ID NO: 33187 - DNA, 291 bp, Zea mays
  Clone ID: LIB3059-014-Q1-K1-F11
ttcccgggtcgacccactcgtccgtacctacatagataataaatcaattcacgtttaaatgaagctcattattctcaccaatgatcattcttacaatcccatgtatcactcctacaacctacatctttcatacactctacttcataatgctcctcgtcccagtataacttatatacatccaaacccctcacaatacacttcctaatatctacgcatttcttaaccattatataactcatctctttaattatattcacattccttataccccaatctacaacatcaacactt

SEQ ID NO: 33188 - DNA, 446 bp, Zea mays
  Clone ID: LIB3059-014-Q1-K1-F2
ttcccgggtcgagccacgcgtccgtagcaacataaaaagcacaataatggtccaacaatggtaggccaaataattttgcctcctgatgctccttggtctttctgcaagtgctgctacgacgaccattttcccgcaatgctcacaagctcctatagcttctcttcttcccccatacctctcaccagcgttgtcttcagtatgtgaaaacccaattcttcaaccctacaggatccaacaggcaatcacagcaggcatcttacctttatcacccttgttcctccaacaatcatcagcctattacatcaattacctttggtgcatttattggcacaaaacatcagggcacaacaactacaacaactcgtgctagcaaaccttgctgcctacgctcagcaacagcagttacctttggtgcaattgttggcacaaaacatcagggcacaaca

SEQ ID NO: 33189 - DNA, 179 bp, Zea mays
  Clone ID: LIB3059-014-Q1-K1-F9
gtgaacatggcggtcgttggctttactcccaaaatacgagcgacaaaaaaaaaagaagaaaataataaaaaaaataaaaaaaaaaaaaaaaaaacgacctcccactttatataatccatccttacattctcatgcattcgacctcatatctacaactatagtgacacctaaatccaatt

SEQ ID NO: 33190 - DNA, 219 bp, Zea mays
  Clone ID: LIB3059-014-Q1-K1-G1
attcccagctggacgccactcatccgcccacgcgtccgaaaaaaaaaaaaaatttattaaaaaaaaaaaaaaaaaaaaaaaaaaaagaaaattaaaaaaaaaaaaaaaaaaaaaaaaaaaaaaaaaaaaaaaaaaaggccgcccgttctaaagaatccaagcttacttacccttccatccaacttcatacctcttctatagtgccacctaaattcaatt

SEQ ID NO: 33191 - DNA, 365 bp, Zea mays
  Clone ID: LIB3059-014-Q1-K1-G2
tacagggtgaacggagtcgttacagcagcaggtaacatgacaacgaatgtagtagtagcagcagtagcaatctcatttttacagtggctaaaccaatcaatcaaccgaacggacgaaggggactagggggaggaaggaattgtagcagcgatctcgctcaccattctcaccgggacgcccgcggaatcctcaaatccacccgaaccggtcaccattttttttcctgagatactttggacacctttcctttgaccactcaatcagcgttccttcccctgctccggtccgacgaccgatgtggcggtcaggcgcggccggctccgtcgtggggcggcagcggcggcgggccgaagagcggcggcgcg

SEQ ID NO: 33192 - DNA, 78 bp, Zea mays
  Clone ID: LIB3059-014-Q1-K1-G3
tcccggctcgacccactcgtccggtcaaacaaaacatatcatacaaatccacttttggttttgttaattccaaatacc

SEQ ID NO: 33193 - DNA, 221 bp, Zea mays
  Clone ID: LIB3059-014-Q1-K1-H10
ggattcccgggtgcgcccacgcgtccggcggcggcggcgcccgcctcggcattgcctcggggcggcggcggcggcctgatcagattgcatctacgtcatccgggacgtcaacggggaactgttctcgggcggtgtcggcggcggctgcttgccgacggcgtcgaatgccgcgatcgccgctctgtaagaggtgaaggcctgtgagtggttcggtcgctctt

SEQ ID NO: 33194 - DNA, 421 bp, Zea mays
  Clone ID: LIB3059-014-Q1-K1-H12
cggctggacccacgcgtccgcccacgcgtccgcccacgcgtccggcacggatcttgaccaaaagcttcacttctgatttccctcatgttgagaggtatttctggaccatggttaaccaacctaatttcaagaaggtcattggtgaggtcaagcaggcagagtctgtacctcctgttcttaaaaagggtgttcctcctaaggagtcaaaggcaaaggatgtgaagaaagaaactccaaaggaggcccccaagccaaaggtggttgaggtaccagcagaagaggaagcaccaaagccaaagccaaagaatcctcttgacttgctgccaccaagcaagatggtccttgatgactggaagaggctatactcaaacacaaagaccaacttccgggaggttgccatcaaaggtttctgggacatgta

SEQ ID NO: 33195 - DNA, 436 bp, Zea mays
  Clone ID: LIB3059-014-Q1-K1-H3
ggtttcggaattcccgggtggacgtcacgcgtccgctgcggggttcgggttcgtgggtgagcggatcgagatggcggcgtcggatgttgagtagctgtgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggtgggtacggtggtggccgtggaggcggcggctacggcggtggcgggcgccgtgatggcggtggcggctacggcggtggcggc

SEQ ID NO: 33196 - DNA, 546 bp, Zea mays
  unsure at all n locations
  Clone ID: LIB3059-015-Q1-K1-A5
ggattcggaattctccgaggtcgaccctacgcgtcgcgaacagctaacagacttgctttcattctatgccctgctcgctttatgggnctaatgcactctacgtgagccgtgcatacaacagtatgtgtgcaaccaaccagttgcatgcnatacaaagttgtaccagcttcttaactcagcgtagcttgtggcagaacgccttgctgcgctaacttgacaacaacttgacttccatttcaacgcaacatgacctgtgtacgaacttctgactgcgtacacttacaacagcgacatacagcttacttaatccacttagcggtggcataaacccattnnggtcgctgacctgtcctatcagcagcaacatattgctcgccatacnatccagtatctcttttgatgatacacctgccttgtcgttggcagcaaccccatcgcttggtggtgccaatcttttagattacatatgangatgtactcgataatggtgccctcatagcggcatgtgtttcctaaaaataatcaatatattgattgagatttatc

SEQ ID NO: 33197 - DNA, 440 bp, Zea mays
  Clone ID: LIB3059-015-Q1-K1-A7
caagcttggaggcattgacaagcgtgtgatcgagaggttcgagaaggaggctggtgagatgaacaagcggtccttcaagtacgcgtgggtgctcgacaagctcaaggctgagcgtgagagaggtatcaccattgatatcgctctgtggaagtttgagaccaccaagtactactgcacggtcattgatgcccctggacaccgtgacttcatcaagaacatgatcactggtacctcccaggctgactgtgctgtccttatcattgactccaccactggtggttttgaggctggtatctccaaggatggccagacccgtgaacatgctctccttgcgttcacccttggagtgaagcagatgatttgctgctgcaacaagatggatgcaaccactcccaaatactccaaggcacgttatgaagagattgtgaaggaagtctcat

SEQ ID NO: 33198 - DNA, 248 bp, Zea mays
  Clone ID: LIB3059-015-Q1-K1-A8
cccacgcgtccgagcgagtctgttattagtactggatcggttgtcaatctccaggatgtggtcttcaagtttttgctctgtgcccagacgttaaggtcatgaactaccttagctaaggctttccgcatgttgttctattgctgctatgtatctcacgttggttattgctgaacttatagcttgtttggttcggattatgataaaccaaatggatatttgaattatattatgggaaaaacaaactgtac

SEQ ID NO: 33199 - DNA, 73 bp, Zea mays
  Clone ID: LIB3059-015-Q1-K1-B2
cccacgcgtccgcccacgcgtccgcggaccgtgggaaaaaaaaaaaaaaaaaaaaaggaaagaaaaataaaat

SEQ ID NO: 33200 - DNA, 271 bp, Zea mays
  Clone ID: LIB3059-015-Q1-K1-B8
cggacgcgtgggctgatcctcacattgcaccggaactgttcggcgagaataaagttgggtgttagaccttgaacgtcttttgcaatatgcttttttgtctgccctgattatattctaccccttcatataacgcttgatgtgccgtcaagaaatggcgaaacattggcatgactgtaaacaagaaactaaatacgggtataaaaatcgtgtcatgtcatgtccaaaaaaaaaaaaaaaaaaaaaaaaaaaaaaaaaaaataaaaaaaaaata

SEQ ID NO: 33201 - DNA, 451 bp, Zea mays
  Clone ID: LIB3059-015-Q1-K1-C1
gacccacgcgttcggcacacgttcggccacaccttcgctttatggagcaagggaatcacattggcattgcaggcgagaagtttgcattggttgggcttctaactttttgtgcaaacggcaattatggtaaccatattccaagggacctggtaacaattctggtggcaatgggttacaatgaacccttggttccatacttgattaaaccacaagggggtggcaacctggtaacgtgggcgacccttaatctgcaacaacttgtggccttaccgcttcagccgtgccaaatgccaatgatgatgccaggtatgatgccaccgatgacaatgatgccgatgccgaatatgatgccatcgatgatggtgccgactatgatgtcaccaataacgatagctagtatgatgccaccgatgatgatgccaaacatggtttcaccaatgatgatgccgag

SEQ ID NO: 33202 - DNA, 307 bp, Zea mays
  Clone ID: LIB3059-015-Q1-K1-C11
tttgtttttttttttggttgtttttttttttttttttttttttttttttttttttttatatcgagataaatctcaatcaatatattgattatttctaggaaacacatttcggtattagggccccattgtcgagtacatctcatatgtaatctaaaagatggcacctccaacgatgggttgctgcaaggcagggttcatcaaagagaactggttgtatggcaacaattgttgttgctgcttcaggaaggtagccaccaatgggttagccactgccaatggattaagtaactgttgtcgcttttgtagg

SEQ ID NO: 33203 - DNA, 321 bp, Zea mays
  Clone ID: LIB3059-015-Q1-K1-C12
gtctgttttttttttttttttttttttttttttttttttttttttttttttttttttttttttttttttttttttttaaaaaaatttgctaatttttttcctggaaaaaaactcggtgtataaaaaactttaaaactatttaattaaaaaactaattaaaacccaatttaaccatgaacaaactttgttaaattattacagtctacaaatacttattcaggcaaaaaactttgaggttggccctactgttgggccctacaaaattgacctttttggaaactcccaattccaacaggattaaacaaaaccagttaatgcttt

SEQ ID NO: 33204 - DNA, 445 bp, Zea mays
  Clone ID: LIB3059-015-Q1-K1-D10
tgttcccaagcctcaacaaagtcgtatttcttgatgatgatgttgttgtccagcatgacgctagcaccactttgggatattgatctatctgggaaggttaatggcgctgttgagacttgcagaggtggagatagttgggtgatgtctaagaggttcaggaattatttaaacttttctcatcccctcattgcaaaaaactttgatccttcagagtgtgcttgggcatatggtatgaatatttttgacctgaatgcatggaggaagacaacaatcaaagacaaataccatcattgggtcaaggagaacctgaagtcaaacttcacactttggaggctgggaacattaccaccaggccttatagcatttaaaggccatgttcacccaattgatccatcatggcatctgttaggtttggggtatcaggaaaagacagatatcagtagtg

SEQ ID NO: 33205 - DNA, 430 bp, Zea mays
  Clone ID: LIB3059-015-Q1-K1-D11
tgctgcctactctcagcaacagcagtttcttccattcaaccaactggctgcattgaggtctgctgcttatttgcaacaacaactaccattcagtcagctagctgctgcctacccccagcaatttcttccattcaaccaactggcagcattgaactctgctgcttatttacaacagcaacaactaccaccattcagccagctagctgatgtgagccctattgccttcttgacacagcaacagttgttgccgttctacctgcacgctgcgcctaacgctggcaccctcttacaactgcaacaattgctgccattcaaccaacttgctttgacaaacccaacagcgttctaccaacaacccatcattggtggtgccctcttttagattgcttatgagttatagttcaataatgaagttttttggatgatgttt

SEQ ID NO: 33206 - DNA, 327 bp, Zea mays
  unsure at all n locations
  Clone ID: LIB3059-015-Q1-K1-D12
aaaatctggaaatgtaacttcttatttctggttggccacatacatcatgcaagaaactttattattgaattacaactaataagcaatctaaaagagggcaccaccaatgatgtgttgttggtaggaggccgctgggtctgtcaaagcaagttggacaaagggcaacaattgttgtagttgtaagagggttgcggggttagccgcaaactgctggtagaaaggcagcaactgttgctgtgtcaagaaggaagcacggtttgctgcagctagctggctaaatggtagtagtatttgctgctgcaaataagcagcggngttcagtgcgac

SEQ ID NO: 33207 - DNA, 442 bp, Zea mays
  unsure at all n locations
  Clone ID: LIB3059-015-Q1-K1-D3
ggtccggaattcccgggtcgacccaagccttccggcctacctccaggagggccattggtgaggtcaaccaggcaaagtctgcacctcctatgccgaaaaaggttgctccttctaaggagccaaaggcaaaggatgtcaagaaggaggctccaaaggaggccaccaagccaaaggtggttgaggcaccagcagaagaggaagcaccaaagccaaagccaaagaatcctcttgacttgctgccaccaagcaagatggtccttgatgactggaagaggctatactcaaacacaaagaccaacttccgggaggttgccatcaaaggtttctgggacatgtacgacccagagggctactctttgtggttctgtgactacaagtacaatgatgagaacaccgtctnctttgtgaccctgaacaaggttggtggattcctgcagcggat

SEQ ID NO: 33208 - DNA, 475 bp, Zea mays
  Clone ID: LIB3059-015-Q1-K1-D7
taccggtccggattcccgggtcgactcacgcgtccgcggacgcgtgggcgacatgcgggcgtcgggcgccacctggtacacggcggtaccgacgatccaccagatcatcctggaccggcacgcgtcgcggccggaggcgtacccggcgctccgattcatccgcagctgcagcgcgtcgctggcgccggcgatcctggagcggctggaggcggcgttcagcgcgccggtgctggaggcgtacgcgatgacggaggcgtcgcacctgatgacgtcaaacccgctgccggaggacgggccacggaagcccgggtcggtggggcgcgcggtggggcaggagctggcggtgctggacgaggaggggcggctcgtggcggcggggagccccggggaggtgtgcgtccgcggggacaacgtgacggcgggttacaaggggaacccagaggcgaacgaggcggcgttccggttcgggtggttc

SEQ ID NO: 33209 - DNA, 472 bp, Zea mays
  unsure at all n locations
  Clone ID: LIB3059-015-Q1-K1-E1
gaattcccgggtcgacccaagccttccggggccttagttaacttgaagccggttgttatgaaccacagactcgtaaagcttcctcgggggaaacctgcagcatgagcaccaatttgagagccctcaagataccaaggagaaactggaagttaggagaaaagaagtccttggccgaataaaatgtgtgcctacactttactttttggtctctacagctttgcaggagtatttagtattttgatttgacagcaacacataatgacataactactatgagcattgctaattaatttacaccggtaccttcgtttgagaaattttcttccatttccagcatctgctggcagacctgaagggtcatctccagctcagggatcatctagtgngaatcaccaccaaaatgaactctattaggagggattatatgaagacaattcatgcttctnctattgaagatcctcgtttcagtcat

SEQ ID NO: 33210 - DNA, 402 bp, Zea mays
  Clone ID: LIB3059-015-Q1-K1-E2
cggggaaccccatggacttttaactgtcaagcccattcggtggaggccccgcaggaagggtgaagagaaagaatcagaagaaggcaagcggtggcggcgatgctggcgatgaggatgaggagtgaggatggacaagtagcgttacccaatataataatattatctagttttcttgaacttgttcgaatgatgagtgcttagctgtgtgatctgacgcagagttccctgtgctgactctgtgtcatggatggtccattttatcttgtggtattatcagcctttacataactgctatgtttggatatgttcaattctgttgcaattttatgtggttgttttttgcgttttgttgctattaagctgttctttcaatcggctaatggtttgcttaaatgttattta

SEQ ID NO: 33211 - DNA, 462 bp, Zea mays
  Clone ID: LIB3059-015-Q1-K1-E3
ggaattcccggtcgacccaagccttccgcaaggaccctttcttggaactcgcccttttgctttaaccacattgccctcgtcggcggggccgaccagctgccgccgcgtccagcaaaacaaccggccgtaggtccaaaatagttccccatggcgtccatatcgtcgcttccctttgcgccgctgcgcggagccgccgagtggaggccgtcgtcgacggcgccggccgtctccggcgccgtcgtgctcagcgcgaggtctcggcggggctcgggctcgggctcgggctcggtggtgcgctgcgtcgccacggcgagtgatgtcccacctactgttggagaaacaaagttgaacttccttaagtcatacaaacgcccaatcccaagcatttacagtacggtcttacaagaacttctggtacagcaacacctgatgagatacaaaagaacctatcagtatgatgct

SEQ ID NO: 33212 - DNA, 232 bp, Zea mays
  Clone ID: LIB3059-015-Q1-K1-F1
cggaattcccgggtcgacccacgccttcggtggtgccaaatctgggtgtatttggtattattaaccagaaaaccattggtggattagcgagggtatcaagaaaaggcctgaatcttctggcactaatcctgcattgcattcaaaccatttatatcttgcaacaacctctaccgattgtaaattccaaatggtctctacctttattaaaggtgtaaaccccaagggatcacca

SEQ ID NO: 33213 - DNA, 462 bp, Zea mays
  Clone ID: LIB3059-015-Q1-K1-F3
ccggaattcccgggtcgacccacgcctccggggtggatgtgacaagcaaggcttcccaatgaagcagggagttttgacttctggtcgggttcgtcttctgctccataggggcactccctgcttccgtggttatggcaggcgtaatggtgagcgcaggaggaagtctgtccgtggttgcatcgtgagccaagacctatctgttatcaacttggtgattgtgaagaagggtgagaatgatctgcctggtctgactgacactgagaagccaaggatgaggggtcccaagagggcctccaagatcagaaagctgttcaaccttaacaaggatgatgatgtacgcaagtacgtgaacacataccgtacgacattcactaccaagaacggcatgaaggtcagcaaggcacctaagatccaacggcttgtgacacccttgacccttcagaggaagcgtgctataatcgc

SEQ ID NO: 33214 - DNA, 457 bp, Zea mays
  Clone ID: LIB3059-015-Q1-K1-G1
ccgggtcgacccacgcgttcgcccacaccttccaaagaaaaaagtgttatggaattaggtagaaataccggggttccaccgaggaattaccttttgggccaaccttgtaccttaaagaaaccttccactgggaaaaaggaccatgctcttatttctggaatggaaaatgccaatgaaactggtactagaaaccgatcatttgccccgaaaccatcttatttttatcaaggtgaagacccttggacctgttaacttttccggatacttgaaacccttaatggttaaacctcaaatttaaccgtccacattttgaccagttaaacacccaggcctttcaaccagaggagccgacctcctgggtttctcagcaggaggagcagttaaatgttgctaaaggccagagatcaaagaggaagaggccttcgatggagaaggcagatggtttggacggtataac

SEQ ID NO: 33215 - DNA, 430 bp, Zea mays
  Clone ID: LIB3059-015-Q1-K1-G2
ttcggtcattcaacttccaccaatctgtctcccaatctttcttgctgctccaattcggtctgtttactcggccagcggaaggggagaggagggcgagatgacggtggagaaggtggacgcggggctttccgacttcgacgcccacttcgatcgcctcttcgcttccccggacgccgcctccgacggcaaggtgaagctgctgctcttcctggccgaccgcaagcctggctcctccctctcctggtgccccgactgcaacgtggcggagccggtgatctacgagcggctggaggcactggagggcaaggacgcggtgctcctgcgcgcctacgtcggggacaagcccacttggcgcgacccggcgcacccgtggagggtggaccccaggttcgggctcaagggcgtgccaacgctgatccgctgggaggat

SEQ ID NO: 33216 - DNA, 172 bp, Zea mays
  Clone ID: LIB3059-015-Q1-K1-G5
cggtcccgaattcccgggtcgacccaagccttcggccaagccttcggaatgatgtgttggtggtggtgcccttttttaaaatgcttaatagggggaattcaataattaaggtttttggatgatgtatgtggcccacccgaaattagaagttacattttcagattttaatggg

SEQ ID NO: 33217 - DNA, 352 bp, Zea mays
  Clone ID: LIB3059-015-Q1-K1-H11
tcccgactcgacgcacgcgtccgccgactcgtccgcccacgcatacgcgcttctttcagtgcccgtggcgactactgtcgagtgggatccaccgcccttgtgaagcacctcgtacacggctactgcctactgacccgttcatcttgattaggcaatatggttatcccttcaccagctatggctcctgcaatcaccaagttcctcaatccgtatattttgaatatgcatttcacaaacaatttcatgagcgctcatgtcatccacacacctacagccactgtcgcatgctcttcaagctctcatgataaactccttatgccaagcatggagtctactcttatttttcttcttc

SEQ ID NO: 33218 - DNA, 368 bp, Zea mays
  Clone ID: LIB3059-015-Q1-K1-H6
aattcccgggtcgacccacgcgtgcggcttcccgcagatccatttcattcgcctgcgcgcgtagcaagcactagcagcggtgatgccgactggacacgggctgcgctcgcggacgctcgacctgttcgcgcgccccttatgcaagaagggctacatcccgctcaccacctacctccggacctacaagatcggcgactacgtcaacgtcaaggtgaacggtgccgtccacaatgggatgccgcacaagttctaccacggtcgcaccggtcgcgtctggaacgtcaccaagcgctccatcggcgtcgagataaacaagcaggtgaatggtcgcatcattaggaagcgtatccatgttcacctggagcatg

SEQ ID NO: 33219 - DNA, 218 bp, Zea mays
  Clone ID: LIB3059-016-Q1-K1-B1
cccgggtcgacccacgcgtacgcaactactaccattcagccagctagctggtgtgagccctgctaccttcttgacacaagcacggttgttgccgttctaccagcacgcttcgcctaacgctggcaccctcttacaactgcaacaattgctgccattcaaccaacttgctttgacaaacccagcagcattctaccaacaacccatcattggtggtgccc

SEQ ID NO: 33220 - DNA, 359 bp, Zea mays
  Clone ID: LIB3059-016-Q1-K1-B3
gtccggattcccgggtcgacccagcgtccgggaccgtggcgaccgtggcgacctggttcagaacacacctacgggccactacacgactacacaaggctaccaaatttatccttttgcgctcttgcccttttggagcgcacaagcgtcattattccccaatgctcacttgctctaggccattattcacagtctccctcagtcttcaaggcttcgaacacccactggcaagcctacaggctacaacagcgcttgcggcagcgtttacaacaaccaattgccaattcacaacaatctggacatctaaccatacaaaccatcgacgcacagcacacaatttctaccagcctaaccaactagct

SEQ ID NO: 33221 - DNA, 455 bp, Zea mays
  Clone ID: LIB3059-016-Q1-K1-B4
attcccggtcgaccccgcgtccgcggcgcgtgggcggacgcgtggggttctagatcgagcggccggatctgcctcgtccgctcggtcgtctactgggccgcgcagctgctcggcgccgtcgccgccgcgctcgtgctcaggctcgccaccggagggatgcatctgccggagtacgcgctggcggtgggcgtgagcggatggaacgcggcggtgctggaggcggccatggcgttcgggctcatgtacgcctactttgcgacggtgatggacaaagcgcggagggtccgcgccggcgccggagcgctggcggcgccgctcgccgtgaggcttctggcgggggccaacgtgctggcctgcggcgcgctggagggcgccgtgatgaatccggcgcgcgcgttcgggcccgccgtcgtgggctcccgtcgctggaacaccaatgggtgtactgggtgggg

SEQ ID NO: 33222 - DNA, 365 bp, Zea mays
  unsure at all n locations
  Clone ID: LIB3059-016-Q1-K1-B6
tagcaacatagaaagcacaatagtgtaccaacaatggcagctaaaatattttggctcggtatgctccttggtctttctgcaagtgctgctacggcgaccattttcccacaatgctcacaagctcctatagcttcccttcttcccccgtacctctcaccaacggtgtcttcggtatgtgaaaacccaattcttcaaccctacaggatccaacaggcaatcgcagctggcatcttacctttatcacccttgttccttcaacaatcatcagccctattacagcaattaccttnggtgcatttatgggcacaaaacatcatggcacaacatctacaacaacttgtgctatgcaaccttgctgcctactc

SEQ ID NO: 33223 - DNA, 68 bp, Zea mays
  Clone ID: LIB3059-016-Q1-K1-C3
ggattcccggctcgaccccgcgtctcccacctccctcgcgcgcctctcccgactcgccaccatttccg

SEQ ID NO: 33224 - DNA, 408 bp, Zea mays
  Clone ID: LIB3059-016-Q1-K1-D12
cggattcccggtcgaccacgcgtccgttctgcctttggaataatctgtatgggtatttaattgctcatcgtattaggtggtttctgtgtggtccattgtgtatgggcggcagctgaagcgtactccgcgccttcaattgtgttgacatctcgttcacgagatgggttgcatgtttttgatgatttccgtgaagcttacgcatggctgagccataacacagatgttgatgacaaggttgcttcctggtgggactatggttaccaaacaactgcaatggccaacagaactgtgattgtagacaataacacctggaacaacactcatatagcaacagttggtacagcaatgtcgtccccagaaaaagcagcttgggaaatcttcaattctttagatgtcaaatatgtgctt

SEQ ID NO: 33225 - DNA, 453 bp, Zea mays
  unsure at all n locations
  Clone ID: LIB3059-016-Q1-K1-D9
ggattcccggtcgaccacgcgtcggccacgcctcccaactgggggcccaagttctggtaactgatccaagggaacttgagaggatgcggtcagagagaatctgacataacaaaggagcgaattgagaaaattctcaaggctggagctaatgttgtgttgaccaccaagggaattgacgatatgtccttgaagtactttgttgaggttggtgcgattgcagtaaggcgtgtgcgcaaggaagatttgcgacatgttgccaaagccactggtgcaactatggtgtctacttttgcggacatggaaggtgaagaaacattcgattcatcattccttggtcatgctgatgaagttgttgaggaaagaattgctgacgatgatgttattctggtgaaaggcacaaagaacaccagcgcggtctctataatacttntnngcgcaaatgactacatgctt

SEQ ID NO: 33226 - DNA, 386 bp, Zea mays
  Clone ID: LIB3059-016-Q1-K1-E12
tcttctattggtaactccatccaagtggctaaccaactccaactacactgagctgggccagctctatgagaagtacaaggaccaaggctttgaaatcctggctttcccatgcaaccagtttggtgggcaggagcctggtaccaatgaggagattgtccagtttgcctgcacacgcttcaaggctgagtaccccatcttcgacaaggttgatgtcaacggtagcaatgctgcgcccatctacaagttcttgaaatctagcaaaggtggccttttcggcgacagcatcaagtggaacttttccaagttcttggttgacaaggagggacgtgttgtggatcgctatgctccaaccacttcacccctgagcattgagaaggatatcaaga

SEQ ID NO: 33227 - DNA, 422 bp, Zea mays
  Clone ID: LIB3059-016-Q1-K1-F2
ttgagcattcagaaacacaccaagctatacgcactaccaacgacctaacaacaatgggtaccaagatattagccctccttgcgcttcttgccctttttgtgagcgcaacaaatgcgttcattattccacaatgctcacttgctcctagtgccattattccacagttcctcccaccagttacttcaatgggcttcgaacacctagctgtgcaagccaacatgcaacaacaagcgcttgcggcgagcgtcttacaacaaccaattgcccaattgcaacaacaatccttgccacatctaacaatacaagccatcacaacgcatcagcaacaacagttcctaccagcactgagccacctagccatggtgaaccctgccggctacttgcaagagcagctgcttgcatccaacccacttgctctggcg

SEQ ID NO: 33228 - DNA, 212 bp, Zea mays
  Clone ID: LIB3059-016-Q1-K1-F3
tcggattcccggctggacccacgcgttcggcgttcgcggctgtggcggtcgtggcgctggacagggcgcggatcagccgcgcgcagacggggagcggatcaagacgtggcatgactgtgccggatacgtccgcggcgtgcgcttcgccgacgtggccgtggacggcgtcgaccaccccatcgtcatcgaccagttctactgcgacgtgaccc

SEQ ID NO: 33229 - DNA, 312 bp, Zea mays
  Clone ID: LIB3059-016-Q1-K1-F4
tcccggctcgacccacgcgtacgggagatagggatggtctccggcatccttgattgcacctccgccgtaaggttgtaaggtatggcaccactaggactgcatctcagcatggttcaagcaaagatgtgaggtggaaaattaactttttgtcaacccaaaagtgggagaacccgttgatgggatggacatctactggggatccatatgctaatgtcggtgtagcaagacttacattcaacagtgcgtattcagctaaagcatttgcagaaaaacatggatggaatgatgtggtacggaaacggcatacacctt

SEQ ID NO: 33230 - DNA, 207 bp, Zea mays
  unsure at all n locations
  Clone ID: LIB3059-016-Q1-K1-F5
ccggggcgncccacgcgtccgggggcccgngnngntncgcttgtgtntgtttccgccgtgtgcctcgtcngtcgggccggggggcgcccgttctcggtggctgccctgcgtggcccgtgcgctgtgcctgctctgcgggctctggncggtggcctcgcgggcctggccctgggctggnggtggctgtggtgctctgggcccggggcc

SEQ ID NO: 33231 - DNA, 376 bp, Zea mays
  Clone ID: LIB3059-016-Q1-K1-F8
cgaattcccggctcgacccacgcgtgcgcccacgcgtccgcacaatgctcactttttccgagtgccattattccacaggtgctccgtgcagttacttcaatgggcttcgaacacccagctgtgcaagcctataggctacaacaagcgcttgcggcgagcgtcttagaacaaccaattgcccaattacaacaacaatccttggcacatctaaccatacaaaccatcgcaacgcatcaacaacaagcactgagccacctagccgtggtgaaccctatcgcctacttgcaacaacagctgcttgcatccaacccacttgctttaacatacgtggctgcataccaacaacaacaacagatgcaacagtttctaccaacgc

SEQ ID NO: 33232 - DNA, 386 bp, Zea mays
  Clone ID: LIB3059-016-Q1-K1-G2
cggattcccggtcgacccagcgtccggtcgccgtcgtcgtcgtcgttttcgttcccatcgtcacaagtccagtaccaaacgtgcgagcgcgacgtcgacaggcacaacgtctgcgccatggaggtgaggcacagcgtcgaacggctggaccaggccgacgtctacagccctggggctgggaggatcacactgcctcaccagccacaagttccccgtcctcaacctcgtacagatgatcgcggtgcgagtagacctgtaccaggacgccatcatgtcaccgttctggaacttcaacgcccacagcgccatgtacggcatcaagggcagtgcaaggatccaagtcgccagcgacaacggtaccacggtgttcgacgacgtgctccgtg

SEQ ID NO: 33233 - DNA, 405 bp, Zea mays
  Clone ID: LIB3059-016-Q1-K1-G4
cccgggtcgacccacgcgttcgcggacgcgtgggcgacccaccgtccgtcccaacatgagcattgttgtgaaggcgctggctccgctccttcaacaaagacctgcaccaggcaccgcagagccagccccgcaacctgtgagctgaatccagtcacgtgtgatgggacctcgcagcatcaggcatctccgcgatcattcaatcagcaagtcattgagagtattttgaatatttgttctgtagcattctgttcctggcttgatgttggcgctgcacaatgacaatggtatatgcagtaggtttgattattctttttcttttaccttctctataccagtaccaagttaccaactgttccgagattttcagaattcgctgcttgaagaatagatgcaggatgatctgga

SEQ ID NO: 33234 - DNA, 208 bp, Zea mays
  unsure at all n locations
  Clone ID: LIB3059-016-Q1-K1-G5
tcccggctcngcccacgcggccgccgtctcgtccgggctcgtgcttctcctcctctccggcgtcgtcttcctcgggggtggcgctgttcgcgtcccctgtgtccccgntgtcgcgctcctggctgcgctgggcggcgccggcgcgcggctgcggctgttctgggcgggcctgcgggtccctgccggcgtctccgcggccgtggctggc

SEQ ID NO: 33235 - DNA, 438 bp, Zea mays
  Clone ID: LIB3059-016-Q1-K1-H10
taccggttcggaattcgagccacgcgtccggctccatgtatggatgaattgttggtatcaagttcctcaacatttttgtgtttaaatgctctgtatggaagaatgagccgacggatcttgagatcgacgaaatcactaaaccacgcggaggaggaggacgattatatatatggacataaattgggtctccttgctgcgtaaatgcttcaagaggctgctgatccaaaagaatgaagccatccatggtctgactgcaaatatcgacaacatgttttggacaagacatttagcgatataggtcgtcattagttttaacatttacaaaagaacaatatttgttttcaattgaagtttaaacttgcagactgtatagttgtgattacaacaagtattgcggatcctgtcactttaaaccattgtttagttgccttaatcaaa

SEQ ID NO: 33236 - DNA, 391 bp, Zea mays
  Clone ID: LIB3059-016-Q1-K1-H12
taccggtctcggaattcgaggtacgcgtacgcgaacacgatgcccgaccaagcttttcaagcattcatagaccactgcaccgtttcaaggacagttgatgcgaatgtgtctgaggcggaaggtgtatacagcgccttggagaagcttggcatcgactgggaacaggttggaaagcagcttgagctggaacgcgtggactccttcaagaagagctttgacagcctactcgtgagcctgcaggacaagggcaacagtctcaagatggcgagtgtgtaaagctgataagattgggtacctgccagtgaacgattttactaaataaaatgctagcttgctggctcttctcttactatttacgctgtacctttgctctcaattatctgaatcggct

SEQ ID NO: 33237 - DNA, 443 bp, Zea mays
  Clone ID: LIB3059-016-Q1-K1-H6
cgggtcgacccacgcgtacgcgcacgcgtccgcccacgcgtccggcgccgacgcttcccaattccttccaatcggcacgctcggcgtcctcgtgtgcaatccccagctctcctcgcccctccctcccaaactccagcggccccccctgaccaagctccggggacggatggacggaggagccggctttccgggcacgcagccggtctcccgctcgccggaggacgtcttccgggactaccgcgcgcgccaggccggcctgatcagggcgctcaccaccgatgtggagaagttctacgtgatgtgcgacccagagaaggagaacttatgtttatatggacttcctaatgagacatgggaaataaacttgcctgctgaagaggtccctcctgaactgccagagccagctcttggaattaattttgctcgtgatgggatggatgaaa

SEQ ID NO: 33238 - DNA, 256 bp, Zea mays
  Clone ID: LIB3059-016-Q1-K1-H7
gttgctactcggacgaggagggaaagcggaggtaaatctctcttggtagatcggacgggtgctttgatttttcatacgaatgtgcttgttttatggtatatagattattgggtatttctactgtactgtttctgcccctgctttcatttgatgtcactagtggtagggagtgtggcataatcatgtagatgtacctgctatgcatacatcgtattaataaatggcaccattgctctcatatactaagaacaactgt

SEQ ID NO: 33239 - DNA, 55 bp, Zea mays
  Clone ID: LIB3059-016-Q1-K1-H9
caacaacaactatgtgaaaagatcaacattcaacatccctaaaattcattattta

SEQ ID NO: 33240 - DNA, 220 bp, Zea mays
  Clone ID: LIB3059-017-Q1-K1-A1
tgttgccgttctacctgcacgctatgcctaacgctggcaccctcttacaactgcaacagttgctgccattcaaccaacttgctttgacaaactcaacagtgttctaccaacaacccatcattggtggtgccctcttttagattgcttatgagttatagttcaataatgaagttttttggatgatgtttgtggcgtcccagaaataagaaagtacatttct

SEQ ID NO: 33241 - DNA, 415 bp, Zea mays
  Clone ID: LIB3059-017-Q1-K1-A10
gctgcctacccccagcaatttcttccattcaaccaactgacagcattgaactctgctggttatttacagcagcaacaactactaccattcagccagctagctggtgtgagccctgctaccttcttgacacaaccacagttgttgccgttctaccagcacgctgcgcctaacgctggcaccctcttacaactgcaacaattgctgccattcaaccaacttgctttgacaaacccagcagcattctaccaacaacccatcattggtggtgccctcttttagatttcttatgagttatagttcaataataaagttttttgtctgatgtttgtggcttcccagaaataagaaagtacatttctaaaaaaaataatattatttattataataaaaaaagggcggccgttttagaggatcc

SEQ ID NO: 33242 - DNA, 292 bp, Zea mays
  Clone ID: LIB3059-017-Q1-K1-A8
taaaagctcgcagcagcagctagcagctcgttcttgttcgtcagctctagcctagcctgcgctggctcttctttaattctgcagggaagttccagtttcagctagagtgcaggcggagaaccaatgggggcggcgccgtcgtccgacgactcgtcacgcgccggagacggccgggctgtggcgagcagcgctgcctctggcactggcactgtcagcaacagcatccaggcccagtctaagctggcgtcctttgttttaatgttcctattagatgtttttgtttgttctatta

SEQ ID NO: 33243 - DNA, 246 bp, Zea mays
  Clone ID: LIB3059-017-Q1-K1-B10
atctttttttttttgtttgtttttttttttttttttattttttttttattttttttataattttttttttttttttatttggggccataaaatcaatcattaattaaaataaaaaaatcattatacccataaaaaaaattaacatactatattcccaacaaattttaactgacattatacaataaacaaaataaaaaaaatacccccaattatgaaatccccttaattaattgaatataaaccctt

SEQ ID NO: 33244 - DNA, 445 bp, Zea mays
  Clone ID: LIB3059-017-Q1-K1-C4
ggaattcccgggtcgactcacgcgtccggggcgatgaaattgatcaaaaaagacgagatgatagtggtagactgcaggggaaggtggatgagcgttatcatgccaaacaaaaggatgacaactggagacatagagaaagggacaatagacagaggcccaagcatgaaaatgtgttaacccttccgaaggaagaaggaagaggaactggtcggcgtagtcggatgatggatgataagttggtcagtggtggtaggaacaagggtgaaccaagatcttctgtattaagcaaagacactcgagaacgtacaaggcaaaatgaatcttcgaggagaggtcagggtgtgcaagaaaacaacatgcataataaagggcgtactgatgtacattcacgtgatgacagtttaaacagtgagaggaacttcaggctagtataacataacaataa

SEQ ID NO: 33245 - DNA, 280 bp, Zea mays
  Clone ID: LIB3059-017-Q1-K1-C5
tttgctaagtgagtgcgaatgtatgtttgaaacccctatttgttgtcgttctttacagtctgctctctcaattctactactgcaactatcaacctgtattccaccagcattcctaaacaacatgcacacatactggtagacaataaggcacaacatgaaggaaccagggggggggcgactatttcttcatgtcgtcaagaaaagacatgcatgcatttggcgcctccctgcatcgttgtaccacaaacgcgcaggctccctggatgcatcaccgaatttt

SEQ ID NO: 33246 - DNA, 377 bp, Zea mays
  Clone ID: LIB3059-017-Q1-K1-C6
cccacgcgtccgcccacgcgtccgaaagcagtaaagccatctgggagcacaactgatcgtagtagggatttgtcctcagtcagccaaaaccaagatcctatttcagtagcccagcagtttctggaaggttttgcttcccgaaatactaatggtagcagaagcaacaccctctcctctggtcctccatcttctgtgccacatgctactgaagttcctccgagaagacagggtggtggacaacctgatattggcagcatgatatctggtatgctcaacaacccagttttcagcaacatgttgtcgaatgtggcaacacagccagggggctctagtgctgatttgaagagcgtgttggaaggattacaaagccttgctat

SEQ ID NO: 33247 - DNA, 117 bp, Zea mays
  Clone ID: LIB3059-017-Q1-K1-D11
tcccggtcgactccacgcgtccgcccacgcgtccgcggactcgtgggtgttaaccatggcggcgtcagcaggcggaggcggggttctctcgcagtttgagatggagcattacataca

SEQ ID NO: 33248 - DNA, 444 bp, Zea mays
  Clone ID: LIB3059-017-Q1-K1-D4
tccctggtcgacccactcgtccgcccactcgtccgcccactcgtccgcccacgcgtccgaaaaaaaaaaaaaaaaaaaaaagaaaagtttaaaaaattaggtaaaaaaaaaaaaaaaaaaaaaaaggttatctattttaaattttccatgtttacttacccttccttcctatttaataacttttttatttcttcccctaatttaaatctattgcccttatttaaacatctcctatacttttaaaacttttcttttaccaattttattttccttgaaaaatttttctttttctcaagttttctattttttttatttcctccttttttatgggtgttttcaatatttttacttctttattttattatttttttctcttttttattttctttttatttccctttttttttctttttttttctcatttttacttttttttttctttat

SEQ ID NO: 33249 - DNA, 327 bp, Zea mays
  Clone ID: LIB3059-017-Q1-K1-E12
gattcccgctcgacccactcgtccgcgttctcgtcatgtacctacctcttttttacaacaactcctccaacatacagaagcagctttaattcaactatctgtaaccaacccttttacctacttacaacaatatattccattcaaccaactttctacactaaacccttctacttattttcaacaacaacaactactaccattcaaccatctatctatcttctactctcatcatcaacaatttcttacatttaaccaatttaccttacttaacccctttgcttattttcatcatcaaatactactaccaattttccatcataactacaa

SEQ ID NO: 33250 - DNA, 418 bp, Zea mays
  Clone ID: LIB3059-017-Q1-K1-E7
tatagaactaacttatcgtaaaaaagattaagaaaaaaagaacccatgactgcggggtgcctgttttccaacaagttgtcacttccttgagctgaaccatgttgaataaaggaaccaagcgatccacaatggagaaatgacaacaagatatgccaagataaatgtaactggctcgttcgacaaaccacaactatatttgttggattccatcacatcacgtataaaacattgggccttgtaatgaaacttccgtgccaatgagatgaaaatgcctacctacaacagcaacaactgctttcatgtagccctctcgttgtgggtaatgcacctacatacctgcaacaacaattgctgcaacagattgtaccagctctgactcatctagctgtggcaaaccctgctgtctacttgcaacaac

SEQ ID NO: 33251 - DNA, 312 bp, Zea mays
  Clone ID: LIB3059-017-Q1-K1-G3
gctgcttatttacagcagcaacaactactaccattcagccagctagctgatgtgagccgtgctgccttcttgacacaacaacagttgttgccgttctacctgcacgctatgcctaacgctggcaccctcttacaactgcaacaattgctgccattcaaccaacttgctttgacaaactcaacagtgttctaccaacaacccatcattggtggtgccctcttttagattgcttatgagttatagttcaataatgaagttttttggatgatgtttgtggcgtcccagaaataagaaagtacatttctagattca

SEQ ID NO: 33252 - DNA, 188 bp, Zea mays
  Clone ID: LIB3059-017-Q1-K1-G5
actcggttcggaattcccggctcgacccacgcatccgatcgtcctccactccaaggagatctgcatgtctgtcatcctcatccgacacaacgtgagtttccttcgatacctccgcaaccttatgaacaccaacccgttccactcgcccatccactttcactccccctccaatatccttcatcacacca

SEQ ID NO: 33253 - DNA, 439 bp, Zea mays
  Clone ID: LIB3059-017-Q1-K1-G6
acccacgcgtccgggcacaaaacatcagggcacaacaactacaacaactcgtgctagcaaaccttggtgccgactctcagcaacagcagtttctgccattcaaccaactagctgcattgaactctgctgcttatttgcaacaacaacaactactaccattcagccagctagctgctgcctaccaccagcaatttcttccattcaaccaactggcatcattgaactctcctgcttatgtacaacaacaactactaccattcagccagctagctgctgtgagccctgctgccttcttgacacagcaacagttgttgccgttctacctgcacgctgcgcctaacgttggcaccctcttacaactgcaacaattgctgccattcaaccaacatgctttgacaaacccaacagcgttctaccaacaacccatcattggtggtgc

SEQ ID NO: 33254 - DNA, 317 bp, Zea mays
  Clone ID: LIB3059-017-Q1-K1-G8
ggaattccagtgtcgacctagacgtacgcgtacgcgtacgcctacgcgtcctgttctcacatatataggacagagaacaataaattgcagaatccgtatcttattatcaactggtaataatcccttcgcgtcaagcgcatcaaggccctgttcaaagcccacacaaagcatcaccggacggtgctactcgacaacatacagatcatcacgaatcatactatccctatgctatcacggatgcacgacactgaccgcatttctgagctcatctactagaatacccgcaacgtactcaagatctttatggaaaacttcat

SEQ ID NO: 33255 - DNA, 428 bp, Zea mays
  unsure at all n locations
  Clone ID: LIB3059-017-Q1-K1-H12
cgggtcgacccacgcgttcgcccacgcgtccgcggacgcgtggggcattcagagtggcgtgctgctaagaaggctaacggaatgaaggttgtttctcttataagggagaagacaggatatattgtcagtccagatgcaatgtttgatgtgcaggtgaaaaggatacatgaatataagcggcagctgctaaatatccttggaattgtctaccgctacaagaagatgaaagaaatgagcacagaagaaagagcaaagagctttgttccaagggtatgcatattcggtgggaaagcatttgccacatatatacaggcaaaaaggatcgttaaatttattacagatgtggcagctaccgtgaaccatgattcagacattggagatttgttgaaagtcgtatntgttccagactataatgttagtgttgccga

SEQ ID NO: 33256 - DNA, 376 bp, Zea mays
  Clone ID: LIB3059-017-Q1-K1-H2
ggattcccggtcgactcacgcgtccgcccacgcgtccgcccagcgtccgggctcaccacaccaaccaacaagcaaaaattccggagatggtactagtctccgcggcgaagatgtcagtgcgcggcaagggcggcaagggcctgggcaagggcggcgcgaagcgtcaccggaaggtgctgcgcgacaacatccaggggatcacgaagccggcgatccggatgctgtcgcggcggtgcggcgtgaatcgcatctcggagctcatctacgaggagacccgcagcgtgctcaagaactttctggagaacgtcattcgatactccgttacctacaccgagcacgcgcgccgtaagaccgtcaacggcatggacgattacta

SEQ ID NO: 33257 - DNA, 168 bp, Zea mays
  Clone ID: LIB3059-018-Q1-K1-A10
ggattcccgggtcgactcacgcgtccggcatacagttatctgctatactccattgcataaggtcccgttggatcaattagctaggaataatagttagctagctaagggcatgcacagtaagggagtgtttggtacgatgaatcactctatctatgcacagataaagaa

SEQ ID NO: 33258 - DNA, 401 bp, Zea mays
  Clone ID: LIB3059-018-Q1-K1-A7
acccacgcgtccggagacatttaacaactttggagacaatctggatcgcaaaacagtggtgcatagactggttggatgtggagttgcagagaaagtggttgctgctggtttgagatgcatcgtaagcaaccaggataagtggtacctagatcacttggatgctacatgggaaggattttacacgaatgaaccactgacaaatatctacaacccggagcagcagaaattggtacttggtggtgaggtatgcatgtggggcgaacacattgatgcatcagacattcagcagacaatttggccacgtgctgcagcagctgcagagcggctattgacaccaattgagaagctggcgaaggacacaagatcggtcactgcaagattggcacgcttcaagtgcttgc

SEQ ID NO: 33259 - DNA, 420 bp, Zea mays
  Clone ID: LIB3059-018-Q1-K1-A9
ttctttttcccccacgtgcgccgccgcgaccttcctcgatcccatctcccagcgccgccgcctcgcctcgggatcccgccgccgctccatctgcctttgctcccccacccgcaggcagcgagcgacagcgacggcaagggatggccaaggccaggtcgttggcgaagcagaagcaggcgcagcaatcaaacggcggcagctgccacgcgctgtcctgcaagctcgcccggtacctcgacccggaggcctccatggacatggaccaactgctggacgcggtgcactggatccgccaggcggtggtgctcatatgcagcctgctctggggagccgtccccgtcgtcggcgccttctggatcgcactatttatggccatctcgactggcattatctattgctactacgcctacttgctgaaag

SEQ ID NO: 33260 - DNA, 311 bp, Zea mays
  Clone ID: LIB3059-018-Q1-K1-B6
cgcagttgcgagagttggtcgtactgttggtacttggtagcatccctgcctggcctggtctttgagtgaagcgttggaacgtggcgtgtgtgtagtgtaactgtgtatgcaggcggtgatttatatgcatgcttcctttaagtagattgccagtagtatttgcgtatggtgagctggtcggtccttaatgtctgtccccatgtacaaaaccagatcaagatgcttgggcttccggttgagtttacgccttaggtgctgtttgtttaccctcgacattatataatccagcttaaataaatcaagagttaaac

SEQ ID NO: 33261 - DNA, 202 bp, Zea mays
  Clone ID: LIB3059-018-Q1-K1-B9
cccacgcgtcagcagaatcatcaacatcatcatcagtagcagcgcagcacgggcctgggcagcaccagcttctccagttcctgcacacacaacagcagattctccagaagcaccagtttctgtttgttcttctgttttttctctcccagcaccagcttgtactgcacttacagttaaaagattattactaacgttgtgtgcc

SEQ ID NO: 33262 - DNA, 425 bp, Zea mays
  Clone ID: LIB3059-018-Q1-K1-C11
tcggtccggattcccgggtcgatcacgcgtccggccacacattcgtgcagaaaatgcagtacttatcacaatggatataaaatcggatcgtgatgctgagcatgctaaaggcaatgttaatgttgacatagatctctacgaaggcatctgcactgacatcttaactttaataatatggaaactgtatgtcacaaaattatactctctaaaatactctggcaatgctgtttgcactgagctgatgattgtcgagatcattatggcaaatccaacaagagatccatgatcagatgccgagactgacgacgatatggacgatgattattgtgatcatagtattatgctttagatgacttatatcaggtatcatagcatatatcatactttatctttgctgaaggttctgtataatgtatgttagcctt

SEQ ID NO: 33263 - DNA, 379 bp, Zea mays
  Clone ID: LIB3059-018-Q1-K1-C7
tgaagcttgtattccagccggctgagtgtatggccagggcggcgcgtactacgggctgggagaaggcgtccttgacgacgcgtcagccatattcggcttgcacgttgacccggccctccccgtcggcgtcgtttcgtccaggccagggcccttcgcggcgacgtccggtcggttcctggcgacggtcaccggtaaaggcgggcacgccgcgatgccccacgaatccatcgaccctgttgtagctgcagccactactgtcgtcagcctccagaagatcatcttccgagatatcgatcccctgcagggcgcggttgtgtccgtcacttttcttaatggaggagtagcttacattgtctttctagatattgtggcctttttc

SEQ ID NO: 33264 - DNA, 205 bp, Zea mays
  Clone ID: LIB3059-018-Q1-K1-C8
aattcgaaagacttctcaattacattacaaaaaaacatcaacttttatcctcatgatatcatgttttaccacaaattaatgacattacgacatgccacagttctttctcatagcttcttacaatctttaaatcctacacacctcaataccctattactctatatcttatatagtagatatatttactcaaattgtcatcctttat

SEQ ID NO: 33265 - DNA, 311 bp, Zea mays
  Clone ID: LIB3059-018-Q1-K1-E2
gattcccggctggacccacgcgtccgcggacgccttcggagcaaaataactcgttacataaggagacgccgaaaattcgaaatggtagggttaagcaaacctgatggcggatgcccactgcaaagcaaagcaaatggcggatgccccgagcaagatcgaatgcatgattaagagcctcgaccagcacaagctcagagccgtatgttgccactggctaggtggcatcagcagttcgatcgcctacaactggtcgcggcccaatatgaagcctaacgtcaagatcatccactcaaggttgcatgctcaagctc

SEQ ID NO: 33266 - DNA, 264 bp, Zea mays
  Clone ID: LIB3059-018-Q1-K1-E6
accggtctcggaatcccgctcgacgccacgcgtccgcggactcgtgggctgacgcgttttcctttagctcaatgacggaagggtcataggagtggttccatctactggttaactggagcgttcgctatggcgataggcgtcataaggagaacgttttttgccatacactagcgttcttaacttctactaactttctctgtagtttctcttccttttgtcctgtctcatctcatttgtctcatctttatttacatttttatatca

SEQ ID NO: 33267 - DNA, 403 bp, Zea mays
  Clone ID: LIB3059-018-Q1-K1-F6
cccggctcgacccactcgtcctatggcagcatggacgctaaattctacatacgacccgcactccaaattcgcctgctcaggtatcaccatccatcccgctagctactgcctactctcatcaacaacaacttcttccatttaaccaattgtccgcacttaaccccgctgcttatttgcatcatcaaatactactaccatttatccagctagctgcatcaagccgttcttccttctttacacatcatcagttgctgcctttctaccatcagttttcggctaacccctcaaccctcttacaactacaacaattgtttccctttgtccaactttcttttacaatacccatattcttctaccaacaacacattattttttattcccttatttatatttcttattattt

SEQ ID NO: 33268 - DNA, 432 bp, Zea mays
  Clone ID: LIB3059-018-Q1-K1-F7
tagcaacatagaaagcacaatagtgtaccaacaatggcagccaaaatattttgcttcgttatgctccttggtctttctgcaagtgttgctaccgcaaccattttcccacaatgctcacaagctcctatagcttcccttcttcccccatacctctcaccagcggtgtcttcagtgtgtgaaaacccaattgttcaaccctacaggatccaacaggcaatcgcaacaggcatcttaccattatcacccttgttcctccaacaaccgtcagccctattacaagagttacctttggtccatttggtggcacaaaacatcagggcacaacaactacaacaacttgtgctagcaaaccttgctgcatactctcagcaacatcagtttcttccattcaaccaactggctgcattgaactctgctgcttatttgcaacaa

SEQ ID NO: 33269 - DNA, 425 bp, Zea mays
  Clone ID: LIB3059-018-Q1-K1-H8
tgaaatttctgccaagagcaactacaactttgagaaacctttcctgtaccttgcaagggagctggctggtgatccgaaccttcactttgttgaagctgttgctcttaagcctccggaagttaccatcgacatggctatgcagcagcagcatgaagctgagcttgctgcagcagctgcacaacctcttcctgatgacgatgatgatctgattgagtagaaaggatcatgagtcttggacttgagcaggagttgtgccttgcacgatttaagttgttctagggtggactctctcttgagttatcattgtctggatcatttttttctccttggacttgttgcaacttttgagtgtggaaatggattggaatagtcgccatgaatttgctggctactttatacatgtctttggtcataaaccttggttt

SEQ ID NO: 33270 - DNA, 465 bp, Zea mays
  Clone ID: LIB3059-018-Q1-K1-H9
taccggtctcggattcccgggtcgactacgcgtccggcaaaccttgctgcctactctcacatcagcagtttcttccattcaaccaactaggttcattgaactctgcttcttatttgcaacaacaacaactaccattcagccagctacctgctgcctacccccagcaatttcttccattcaaccaactagcagcattgaactctcctgcttatttacagcagcaacaactactaccattcagccagctagctggtgtgagccctgctaccttcttgacacaaccacagttgttgccgttctaccagcacgttgcgcctaacgctggcaccctcttacaactgcaacaattgctgccattcaaccaacttgctttgacaaacccagcattgttctaccaacaacccatcattggtggtgccctcttgtagatttcttatgagtcatagttcaataataaagtttttt

SEQ ID NO: 33271 - DNA, 460 bp, Zea mays
  Clone ID: LIB3059-019-Q1-K1-A9
accggtccggaattcccgggatgacccacgcgtacaaacacacctagcgaagcacattagcaactacctatcaacaatggctaccaagatattatccctccttgcgcttcttgcgctttttgcgagcgcaacaaatgcgttcattattccacaatgctcacttgctccaagttccattattacacagttcctcccaccagttacttcaatgggcttctaacacccagctgtgcaagcctataggctacaacaagcaattgcggcgagcgtcttacaacaaccaatttcccagttgcaacaacaatccttggcacatctaacaatacaaaccatcgcaacgcaacagcaacaacaattcctaccagcactgagccacctagccatggtgaaccctgccgcctacttgcaacagcagttgcttgcatcaaacccacttgctctggcaaacgtagttgcaaac

SEQ ID NO: 33272 - DNA, 325 bp, Zea mays
  Clone ID: LIB3059-019-Q1-K1-B5
gcccacgcgtccgcccacgcgtccgcccacgcgtccgcccacgcgtccgggtcgcggggctgttggcggcgcagatagcgcagcaactgacggcgatgtgcggcctgcagcagccgactccatgcccctacgctgctgccggcggtgtcccccactgaagaaactatgtgctgtagtatagccgctggctagctagctagttgagtcatttagcggcgatgattgagtaataatgtgtcacgcatcaccatgggtggcagtgtcagtgtgagcaatgacctgaatgaacaattgaaatgaaaagaaaaaagtattgttccaaata

SEQ ID NO: 33273 - DNA, 118 bp, Zea mays
  Clone ID: LIB3059-019-Q1-K1-C1
ctgactccaaatgggtgacacaacgtaaaatatacagctatctacttcggctgtaaacatacgtgtctccgaagttttttatattttgggctaaaaaaaaaaataacaaaaaaaatca

SEQ ID NO: 33274 - DNA, 355 bp, Zea mays
  Clone ID: LIB3059-019-Q1-K1-C10
attcccgggtcgaccacgcgtccgccacgcgtccggaaaaaataatgtttaaagtgcaggctatgggaaagctggactctgagaatcacttgtcggctgcaactgaggtgagacttcatcagatcacaggatcctgccactggacgtatctcgcgctactggaaagcgatactttacgtttcggccctagcttttgcttgtcggccaggatacaagaacatgctttgatgccatcttccaaattggcataatgtgagaattgaccggctgcacgactgttcggcatattgacatactatgaccaatggagtatgttatgtagctagctgctactttgtagttagtgcgtgatgat

SEQ ID NO: 33275 - DNA, 168 bp, Zea mays
  Clone ID: LIB3059-019-Q1-K1-C7
cccacgcgtccgcggacgcgtgggaaattaaaaaaaaaaaaaaaaaaacgaaaaaaaaggaaaaaaaaaataaaaaataaaaaaaggccatacaatttagaagatccaagcttacatccgctttcttgcaaagtcttaactcttttatagtgatacctaaattcattt

SEQ ID NO: 33276 - DNA, 370 bp, Zea mays
  Clone ID: LIB3059-019-Q1-K1-C8
caactccccagtcgtagacgactggctttacagcgacgagaccaggagcggccaccggtagatcgggcgagatggatggacagtgaagaggccatgtttgctggtccttgtggttatctaaaacgcacgcatgctctattatagctagtcatcactatatatatacttgtgtttgtgtattgatgttcttgttctgctggtgtctccgccgtttaatttgacctatgttatggagtgagtgatatatgtgccgtcactcctagtatatagtagtgagtgactagttggtatgtgtagtactgtactatcttttatccatatgcatgttttgccagcgcgtaatgaatgtaatgtcagtactgctactaac

SEQ ID NO: 33277 - DNA, 72 bp, Zea mays
  Clone ID: LIB3059-019-Q1-K1-D12
attctttgcaactctgagtagagagatacacggaatgttcagcttttcagatccaaaggaaaaaaggaaaaa

SEQ ID NO: 33278 - DNA, 133 bp, Zea mays
  Clone ID: LIB3059-019-Q1-K1-E1
cgattcacggttgatctggtgactgctgttcagtttgcttctttcgcgtaaaattatcgggtgctctggaaaagaaacttgaggcttgtattgcatctttgataacataatattataatatatgtagagactc

SEQ ID NO: 33279 - DNA, 223 bp, Zea mays
  Clone ID: LIB3059-019-Q1-K1-E10
ggaattcccgggtcgacccacgcgttcgaaaaaaaaaaaaaaaaaaaaaaaaaatttaaaaaaattaaaaaaaaagaaaaaaagatatggaaaatagggatttacaaaatcaataatgctaaattattaacaataaaaaagtggtatctaaattcatataaattggacgatatttaacaactgtaactaatgataaaacgttgtaagttagcgatcttattaa

SEQ ID NO: 33280 - DNA, 435 bp, Zea mays
  Clone ID: LIB3059-019-Q1-K1-E4
tgaagctgttacccgcaagacccgtattctcgacgtggtctacaatgcatcaaacaatgggcttgtgaggaccccaaaccttgggaaagagtgccattgtgcaagttgatgctgccccattcaagcagtggtacctcactcactatggagttgacattggtaggaagaagaaaacccctgctgcaaagaaggataatgctgagggacaagaggttgaggcagcagctgaggaaacgaaaaagagcaaccatgtcacgaggaagcttgagaagcgcaaggagggacgtacccttgacccacacattgaggagcaatttggcagtggacggttgctggcatgcatttcttcccgccctggacagtgtggccgagctgatgggtacatccttgagggtaaagagcttgagttctacatgaagaagctacagaagaaga

SEQ ID NO: 33281 - DNA, 469 bp, Zea mays
  Clone ID: LIB3059-019-Q1-K1-F5
accggtccggattcccgggtcgactcacgcgtccgcggacgcgtgggctcgcgcatcctattgccctcgcgccaccgtcgccgccgctgcagcgagccaccgccctgccgtcgcctgaggtagacaccaagccaccgccatggggcgtatgcacagccgcgggaagggtatctcttcatcggcgctgccgtacaagaggactcctccgatctggctcaagacagctaccaccgaggtggaggagatgattaccaaggctgcgaagaagggccagatgccgtcgcagattggtgttctgctccgtgaccagcacggcatcccgcttgtcaagagcgtgactggtagcaagatcctgcgcatcctcaaggcccatgggttggcgccggagatcccggaggatctctacttcctcattaagaaggccgtggcgattaggaagcatctggagaggaacaggaaggacagggac

SEQ ID NO: 33282 - DNA, 452 bp, Zea mays
  unsure at all n locations
  Clone ID: LIB3059-019-Q1-K1-G4
tgcataccaacaacaacaacaattgcaacagtttctgccagcgctcagtcaactagccatggtgaaccctgccgcctacctacaacagcaacaactgctttcatctagccctctcgttgtgggtaatgcacctacatacctgcaacaacaattgctgcaacagattgtaccagctctgactcagctagctgtggcaaaccctgctgcctacttgcaacagctgcttccattcaaccaactgactgtgtcgaactctgctgcgtacctacaacagcgacaacagttacttaatccactagcagtgcctaacccattggtcactgccttcctacagcagcaacaattgctaccatacagccagttctctntgatgaaccctgccttgtcgtggcagcaacccatcgttggaggtgccatcttttagattacatatgagatgtaatcgataatgg

SEQ ID NO: 33283 - DNA, 446 bp, Zea mays
  unsure at all n locations
  Clone ID: LIB3059-019-Q1-K1-H2
ctgctgggtcgacccacgcgtgcggctttggtggcaagaaaaagctggtcctctccactgcaacctggcttgggggaagaacgattttcgtggctttgcataccttatagttggtgggctctgcattttcctggcatttgcattcaccttgctgtacttcgtaaaaccaaggaaactgggagaccacaactacttatcctggaacagacgctaggatgtttcggaacaccaagtgtccgtactactcgaaatgtagcttgtatgaaatgaaatgctctgaaccagaaatgtcgatgggcataagcaagcatggttcaggaaagaacttcatgtatattttttacgaaggggtctaagtggctacgttaattttggttncttggggtccttagtgtagcactgaacaggagaataccaaatgaactctattagcttgcttccgtggt

SEQ ID NO: 33284 - DNA, 228 bp, Zea mays
  Clone ID: LIB3059-019-Q1-K1-H9
gtacgtccagagttgcgacattgtggctttcaacaagatctagagttcagtttctgagtttgggcaacggcagcggctcagctcgtcaagtttgtgctgggatgccagtttatcccttctagtctattacagaaatgttgttcggagctgagtctattataaacatcttggtctgagtttattgttgagtggtgccagtttttttcaatatacatttatcttaaaaac

SEQ ID NO: 33285 - DNA, 406 bp, Zea mays
  Clone ID: LIB3059-020-Q1-K1-A3
tactgtcaccgcttgaactcaatccagtcatattgtgatatcaatcgagatgttataggggaagttagccacctgtctggttattcgttttctgcacaaaacaatattatccacccatcctctgttcttggatcaaagactacagaccacactgtattcttgctgagggttcacagcttggtgacaagtgtagtgtgaagcgatctgtgattggtcgtcattgccgaattggttccaatgtaaagatcgtcaactctgttgtgatgaatcatgttgttgttgaagatggttgccacatccaaggttctgttgtatgtaataatgttcaactgcaagaacgggcagttctgaaagattgccaggttggaactggttatattgtgactgctggcagcgagcacaaagc

SEQ ID NO: 33286 - DNA, 436 bp, Zea mays
  Clone ID: LIB3059-020-Q1-K1-A6
tgtacatcatccttatggcttatctggaaatggattgccatgtttctcaattctctcccagctactacaagtctacaacctacccttcacgctttcctcaaggtatgaatctgcttcaggacctcctatttatgtgccattggttaattagagttcttatgttgttttagatggctggttctgctttcctgtttacgaattatgcgtcgtcgatagggcgtccgtaagggcgcctctgaccacctactgtgtgcttcgctacattttcagcccaccgtgtgccagcccacgcatgcttgtttaaaacgcgcggcgggtgtgcgcgttagtcgttggtttcttgtgcgctgtgctgccgcgcttgcatatgctcagacttgcaggcaatctgtcgtgtgcgcggctgggctggaccttcaaatgcagatgcacagca

SEQ ID NO: 33287 - DNA, 434 bp, Zea mays
  Clone ID: LIB3059-020-Q1-K1-A8
cccacgcgtccgaagcaacatagaaagtggaatccagtagcaacaacagagcaacaatggcgaccaagatattttccctccttatgctccttgctctttctgcatgtgttgctaacgcgacaattttccctcaatgctcacaagctcctatagcttcccttcttcccccataccttccatcaatgatagcttcagtatgtgaaaacccagctcttcagccctataggctccaacaagcaatcgcagcaagcaacatacctttatcacccttgttgtttcaacaatcgccagccctatctttggtgcagtcattggtacaaaccatcagggcacagcagctgcagcaactcgtgctacctgtgatcaaccaagtagctctggcaaacctttctccctactctcagcatcaacaatttcttccattcaaccaactg

SEQ ID NO: 33288 - DNA, 432 bp, Zea mays
  Clone ID: LIB3059-020-Q1-K1-B1
accggtccggaattcccgcgtcgcagctagtcgtccgcccactcgtgcgtcctactctgccagcgccacctccacgcatacaagcggcggctgcgggtgccagccaccgccgccggttcatctaccgccgccggtgcatctgccacctccggttcacctgccacctccggtgcatctcccaccgccggtccacctgccgccgccggtccacctgccaccgccggtccatgtgccgccgccggttcatctgccgccgccaccatgccactaccctactcaaccgccccggcctcagcctcatccccagccacacccatgcccgtgccaacagccgcatccaagcccgtgccagctgcagggaacctgcggcgttggcagcaccccgatcctgggccagtgcgtcgagtttctgaggcatcagtgcagcccgac

SEQ ID NO: 33289 - DNA, 426 bp, Zea mays
  unsure at all n locations
  Clone ID: LIB3059-020-Q1-K1-B2
cgacccacgcgttcgctcagctagctgcggcaaaccctgctgtttacttacaacagttgcttacattcaaccaactggctgcgtgaaactctgctgcgtacctacaacagcgacaacagttacttaatccattggcagcggctaacccattggtcgctaccttgctgcagcagcaacaacaattgctgccatacaaccagttctatttgatgaaccctggcttgcagcatcccatcgtcggaggtgccatgctttaaattacatatgagatgtactcgacaatggtgccctcataccgacatgtgttgactagaaataatcaatatatcgatcgagatgcatctcgatcaataaaaagctttaggaaccccggtcggngtgtggtgggagttcggcaaggacggcgacacccacctactcggcgac

SEQ ID NO: 33290 - DNA, 136 bp, Zea mays
  Clone ID: LIB3059-020-Q1-K1-C11
ttgttttttttttttttttttttttttttttttttttttttttttttttttttttttgtgttttttttttttttttttttttttttttttttttttttttttttttttttttttttttttttttttttttgttctt

SEQ ID NO: 33291 - DNA, 161 bp, Zea mays
  Clone ID: LIB3059-020-Q1-K1-C8
gttcatgtactttttctgcattaagataaatttaccaacaaggactccatgaattgtttctagttcaatcaaatatacgttattattacaatgcttattttatcactttttttaccttacccatttttaaaacatctctttggtctcatgctatattttgt

SEQ ID NO: 33292 - DNA, 527 bp, Zea mays
  unsure at all n locations
  Clone ID: LIB3059-020-Q1-K1-D6
accggttccggaattcccgggntctacccacgtcgtccgctcgacgtcctctctctctttcctccgagtcttctcgaaactcctaggtgtcgtgtccgactcggtcggcggcggctgagggtgatggtcgatggactccggtacgtctgtggtcgaaagtctcttcgtggagcatctactactcggactgttcgacaccataccgcgcggcgtctggtggggtctgtatcagngagactctccatgtctcactcttcgagggctcagaagttccagggtcccatccgccattgctcggcaagtctcggatctcnttcccttccaggtcctgcgagcacctagatcgtcactcgtcgacttgccagccgtcggggccccaggganggcatggctcgtcttcgtctctcggttccattccgcactcggctcccgtaggagcatccccatcaaggttctctcagggcatttccatttgctgccggcaagctgggtcccttcttcgtgcagnaatgatcatgttccgcctg

SEQ ID NO: 33293 - DNA, 261 bp, Zea mays
  Clone ID: LIB3059-020-Q1-K1-E10
tacgtttcttgctcccctttcagggtcccgatcgctaggctagctgcagctcaggtgcttgtctgagggtgcctctgctcgttggcagccggatcgcctgctgttggtgcatctggtgattaataatactactatgacagagccatgctctgtgaagagtattagtagcagcgctcataaaagctacagttccgtctcttttctcagctatgtaaaacttccaaactgttcatgcttaaaactgagggttttcttggtgtg

SEQ ID NO: 33294 - DNA, 353 bp, Zea mays
  Clone ID: LIB3059-020-Q1-K1-E7
aagcaacatagaaagtggaatccagtagtcaacaatagagcaacaatggcgaccaagatgttttccctccttatgctccttgctctttctgcatgtgttgctaacgcgacaattttccctcaatgctcacaagctcctatagcttcccttcttcccccataccttccatcaatgatagcttcagtatgtgaaaacccagctcttcaaccctataggctccaacaagcaatcgcagcaagcaacatacctttatcacccttgtttcaacaatcgccagccctatctttggtgcagtcattggtacaaaccatcagggcacagcagctgcagcaactcgtgctacctgtgatcaa

SEQ ID NO: 33295 - DNA, 534 bp, Zea mays
  unsure at all n locations
  Clone ID: LIB3059-020-Q1-K1-E8
accggttccggaattcccgggntctacccacgtcgtccgcctagttccatgtatgccacagtgttctcctcaccagttatcttcatatggcctgtcgaacaccgcgagctgtgtcaagtcctatgaggctacatacaaggcgattggcggcgagcgtcgttacaacaactcaattagcccaattgacaacaactaatccattggcacatgctaacaatacagaaccatgcgcaacgacatcagcaactaacagttgcctactcagctactgagccatcctagccatggntgaactcctgtcgtcctacgttgcaacagtcagctgcttgctatccaaccgcactttgcttctagcaagacgtagattgcaaaaccagtcaacaaccaacatactgcaacgagtttctggccagcgcttagtcaacttagccatgtgtgaaccactggccgcctgacctacatacagcaacaacatggctttcatnctagtcccgcttcgcttgtgtgccaatgctacctacatactctgcaaca

SEQ ID NO: 33296 - DNA, 339 bp, Zea mays
  unsure at all n locations
  Clone ID: LIB3059-020-Q1-K1-F10
tcccgggtcgacccacgcgttcgcggacgcgtgggcggactcgtgggtttttttttttttttttttttttttggttttttgttttttttttttttttttttttttttttttttttttttttttttttttttttttttttttttttttttttttttttttttttttttttttttttttttttttttttttttttttttttttttttttttttttttttttttataaaaaaaataaattttttnttttaaaatttaatataatttttatattttataattttaattttttttttttaataatatatttttttaataatttatttttattttattttttttt

SEQ ID NO: 33297 - DNA, 441 bp, Zea mays
  Clone ID: LIB3059-020-Q1-K1-F2
tagcaacatagaaagcacaatagtgtaccaacaatggcagccaaaatattttgcctccgtatgctccttggtctttctgcaagtgctgctacggcgaccattttcccgcaatgctcacaagctcctatagcttcccttcttcccccgtacctctcaccagtgttgtcttcagtatgtgaaaacccaattcttcaaccctacaggatccaacatgcaattgcatcaggcatcttacctttatcacccttgttcctccaacaatcatcagccctattacagcagttacctttggtgcatttattggcacaaaacatcagggcacaacaactcgtgctagcaaaccttgctgcctactctcagcaacaacagttacctttggtgcatttgttggcacaaaacatcagggcacaacaactacaacaactcgtgctagcaaacctt

SEQ ID NO: 33298 - DNA, 353 bp, Zea mays
  Clone ID: LIB3059-020-Q1-K1-G1
ggaaatacgatgctggtttgaactttacatgtgttggattgcgcaccatggaccaacatgaagtataccctgaggcatttgcagatccagaaggcctaatatggcaggtgctaaatgctgcgtgggatgctggtatacaagtggctagtgagaacgctctaccttgctatgatagggatggattcaacaagattttggagaatgccaaacctctgaatgacccagacggacggcatttgttaagtttcacctacctaaggcttggcaaagatctgtttgagagacccaacttttttgaatttgagcgcttcatcaagagaatgcatggtgaggcggttcttgatctgcaagta

SEQ ID NO: 33299 - DNA, 356 bp, Zea mays
  Clone ID: LIB3059-020-Q1-K1-G4
tggacacgtgcgatggtctcgactctggtactatatgctaccaagacgctgactctgagcgcgactgcgatgacgaggcacatgttacgtgatgcgcaacgagttgcacagatggccgatgcctgtgataaaccaggttagtgccgactactacgctgctctgcctaccaccacatgccttgctaaggcatgcatggcggacctgatgcttccagtctacgcttcccatgccccgagaaatagctaccggtgctatgcgcttggctagtgtgatgactgctatcatgggagactcagcagtgccagcttatatgtgtctatgatctcgcagccgagcacttggaaatctgggccca

SEQ ID NO: 33300 - DNA, 340 bp, Zea mays
  Clone ID: LIB3059-020-Q1-K1-G6
ttagaactgaaggaaagacggtagctgtaggcaaagttgttgatattccgcctgctggtagcccaacattctgagcttaagtcaattttgaacaggatggataatcatgaagcagtgcgttcgcttaagatacttttttttgggaagtgagattagttgttgaggttagattttttttcagtccatcttgagaatggtctatgcctttatggtttaggctagcaagtcttagattggttgcataaaattacatctctggttacatgtgaggttgtaaaatcagtatggaattatggatgagtgtaccaaccttaatgtacccgttcaagattatggtggt

SEQ ID NO: 33301 - DNA, 404 bp, Zea mays
  Clone ID: LIB3059-020-Q1-K1-H5
catccccctgcatatactaaccctgcaaaactgaagggtgatagcaaaatacaatgaggattgtgtacatggcagctgttatgtgtttggttcttgcaaccatgtcttctacctccccatcattctgccaagctgggggctgcatcggctgcccacgggctccaccaccgccgtccgatgagacatgctacgaggacctcaagtgttcggcttcgaggtgccacctgggttgcatacacaggggctacaagggtacgggttcgtactgtcgtgggagggactgctgctgcaaacattgatgcaccgtagtgcatctatgcatttcatgaccatacaataaacctagatgtgtatcctttgcctccgacgactataaatgaaatgaaatactactaaggttcagc

SEQ ID NO: 33302 - DNA, 86 bp, Zea mays
  Clone ID: LIB3059-021-Q1-K1-A10
ctaaatccattcttactactataattatctcaaactttctgtacctttacactcattaaattatgcattcttaattcaacccattt

SEQ ID NO: 33303 - DNA, 437 bp, Zea mays
  Clone ID: LIB3059-021-Q1-K1-B1
ggaatttccgggtcgacccacgcgcccgcggacgcgtgggtccaactcctgagcactttctcctcgtcccagacaagccaatcggagccggggtacgaccatggactccaccggcaccggagcagggggtaaggggaagaagggagcggccgggcgcaaggtcggcgggccaaggaagaagtcggtgtcgaggtccgtgaaggccggtctccagttccccgtcggccgcatcgggcgctacttgaagaagggccgctacgcgcaacgtgtcggcaccggcgcccccgtctacctcgccgctgtcctcgaatacctcgccgctgaggttctggagctcgccggtaatgctgccagggacaacaagaagactcgcattattccgcgccacgtgcttcttggcgatccggaacgacgaggagcttgggaagctgttgggc

SEQ ID NO: 33304 - DNA, 294 bp, Zea mays
  Clone ID: LIB3059-021-Q1-K1-B7
ccttcgaagctgagcccgagaagctttgcgacgctggaatggaccgttcctgaagacgccccgtcgggcgtttataggttgaggcattttggtgcctgcaaaccactgattgggtccatcaaacattgtactgggacctctatggcgttcgcagtgcgttaggtagcacaccagtgcgttgcgttgcgttcgacggcacacctgtcagagaatcgacaccgggtcatatacttactttgcatacctgccacagtatatggacatgttttgcctatagttactaaaaagatgaat

SEQ ID NO: 33305 - DNA, 363 bp, Zea mays
  Clone ID: LIB3059-021-Q1-K1-C6
tgtttttttttttttttttttttttttatatgcaatgcaatgattggatatatacaggggtcacaaaaagaattggcgtacaaaccacacacacctaatcgattctcctgcacaaaggctgttgcattcagcaacctgtacactttatttattcctcgtcgggaatcagtcgtcctcctccggcgaggagaagaacgacgacgacgagctgaccgagagggacctatggtgtacacttcattattcctcgtcggcaatcagtgactcgtcctccttcgacgaggaggaggagaaggacgaggacgaggacgacgagctgaccgagagcgacctccggtaggtgtacagaaccgcgtcgggcac

SEQ ID NO: 33306 - DNA, 146 bp, Zea mays
  Clone ID: LIB3059-021-Q1-K1-C9
cccacgcgtccgctcaatgtttgttgtgtgaacagagatacgcgtttgaatttggcgtaaagcgaactgttgtcttctttttcccttcccctctctctctatctccagtcatcggtaataggacaagtacctttccttattccatc

SEQ ID NO: 33307 - DNA, 362 bp, Zea mays
  unsure at all n locations
  Clone ID: LIB3059-021-Q1-K1-D5
ccggttccggaacttcccggcgtcgactccacgcccgtccggaggataccttnngtttcttggtaaggtnnctgttatgcatggtnnttgaacccanntagcaatgtgggcggagcgtnngtgtaaatnactgtcagtatgatcggaattccaactannttcatcannaccgaaatnntatggcgcgccttcannatcgtggctaccgccctgatggggacccctganntccgttatnnggtgtnngcttgaannntcgtggctttgtggagaaaatgtgtggaaacttcaaattggcttaaagtnnngtgcttntnnattaactaatgnnngtgatgctngnnatggaactngnnattttg

SEQ ID NO: 33308 - DNA, 355 bp, Zea mays
  Clone ID: LIB3059-021-Q1-K1-E10
tgagggaggtgatgatgcacattccgtagattatgagagcagcgaacagagttgggccctgaggtctttatctgaatcaactatagcatgtgttactagtgattacgcgatgcaaaacgtcatcctgcagattggcctccggctcatagcaccgggtggcatgcagatacgccagatgcataggtgggttttgaggtgccatgcttgctataaggtgacccaagaggttggcaaaatattttgtccgaagtgtggcaatggtggcaccttaaggaaggtctcagtaacagttggtgaaaatgggatcactatggcttcacggcgcccacgtgttacactttgaggcacaaaattt

SEQ ID NO: 33309 - DNA, 221 bp, Zea mays
  Clone ID: LIB3059-021-Q1-K1-E5
cttgttctttgggattggagctttggaagagaagattggaggagaggagaggatcggaagaagctggtcgtgttcttctcccttattgggcgcgcgtgttgtgttgtgcgctgctgtgtctgtgtactccagctgtagctgctgctgtgcctagctgattgaagttggaactgtagtgggtccacagtattatgcatgttttgtttggtgagacgtcaaag

SEQ ID NO: 33310 - DNA, 440 bp, Zea mays
  Clone ID: LIB3059-021-Q1-K1-F6
ggaattcccggctcgagccacgcgtcacgcgtcacgctcaaagccaagcgacagcagcagctttcctagcaacaccttgcccctgagctcatgggatccctgggccccacagtgagcttgagcatcatggccaggccaggcggccagcagccggcggagatggagaggaagaaggacagcggtgtcttcttcggtgggggctgcggcttccggatgccgctgcactacccgcgctacaagaaggcggactacgagagcatgccggagtggcgcgtcgactgcctgctccgcgagtacggccttcccgccgacggcgacgtcgacagcaagcgccgcttcgccatgggcgccttcctctggcccgaccagtactgatccaaccaaacaaagctcagcgctagctagctgcgtgccggccgtgatctcgtcatatttagagg

SEQ ID NO: 33311 - DNA, 274 bp, Zea mays
  Clone ID: LIB3059-021-Q1-K1-G2
aaggaagcgagaagaccagaaggtgataagagagagagagagtgtgtgtgatcggtgcaaggatcaccgctgtgcctgcgcgtgctgcttcaccgaatcgagtcagatcctgtccgaatccgagctaagggatggcaaccggtagtgaagcctcgaaggcagctgaggctgtggttgactggcataaacacgacagcaagaggatgctccatgcggtttaccgtgttggggatctggaccgcacaatcaagtactacacggaatgctttgggat

SEQ ID NO: 33312 - DNA, 397 bp, Zea mays
  Clone ID: LIB3059-021-Q1-K1-G4
ttgagaccaacaagcaacatagaaagtggaatccagtagcaacaatagagcaacagtggagaccaagatattttccctccttatgctccttgctctttctacatgtgttgctaacgcgacaattttccctcaatgctcacaagctcctatagcttccctttttcccccataccttccatcaattatagcttcagtatgtgaaaacccagctcttcaaccatataggcttcaacaagcaatcgcagcaagcaacatacctttatcgcccttgttgtgtcaacaatcgccagccctatctttggtgcagtcattggtacaaaccatcagggcacaacagctgcagcaactcgtgctacctgtgatcaaccaagtagctctggcaaacctttctccctac

SEQ ID NO: 33313 - DNA, 318 bp, Zea mays
  Clone ID: LIB3059-021-Q1-K1-G6
ggattcccggctcgacccacgagtcacgcgtgcgggatggctttccaccactctctgaattcactgaggtgcttgctaagatctgggagagactcaaagaagtgggagagaaatttgaagttgtagctgtatccttggacagtgaagagtcatcatttaatgagagttttgcaaagatgccttggcttgcaattcctcaaggtgacattaagtgtcagacgctggttcgttactttgagcttagttctcttccaacactagttctgattggccctgatgggaagacactgaacaacaatgtcggcgacataattgacg

SEQ ID NO: 33314 - DNA, 241 bp, Zea mays
  Clone ID: LIB3059-021-Q1-K1-G8
tgtaaagcctatatgatgttgtattgaattgaatcgatgactgctttatgcaagattcttttgtccaagagtgactgctttatgcaagattcttttgtccaaggggtttgtagttctctattgttagtatcaccttataagatgttttagtttttctaaatatttttttactacacatctaaacataatgtacaagttacacaatacaagagtgactgctttatgcaagattcttttgtcc

SEQ ID NO: 33315 - DNA, 449 bp, Zea mays
  Clone ID: LIB3059-021-Q1-K1-H1
cggattcccgggtcgaccaacgcgtccgcaaagacactgtgttaatttatgttcctgctgtcagatgctcaacaagaagcatacggtagcgcatacttggcacatctgaagtaggtgcagattggtgcataaaaggcatccaggacatcagtagttatagcatcctctcacatctgacgctttcaaaatgtcatctccccatagttagaacgaattcatctcaagactgtaggtcctctgcttgagaagcatcctcaccgctgtcctatacggctcctcgaatgcatccaacacccaggctgcaccagcagccccattccaaactgtgtcccctgttccttcctcacttggcttgatggccacaagcgttgcgccatttagcaccagccccccaggcagctcaatacatggtgcgtaccacagtcacatgctaagctctggcatgagcg

SEQ ID NO: 33316 - DNA, 273 bp, Zea mays
  Clone ID: LIB3059-021-Q1-K1-H2
caaggctgccaagaaggagaggcttctgaagagggcccaggctgagaatgaaggaagaactggtgaatccaagaaaccaattgttgtgaagtatggccttaaccatgtgacttacctcattgagcagaacaaggctcagctcgttgtcatcgctcatgatgtggatccgattgaactgggtgtttggctttcagccctgtgcaggaagatggaagtcccatactgcattgttaaaagaaaggctcgccttggatcgatcgttcacaagaagac

SEQ ID NO: 33317 - DNA, 360 bp, Zea mays
  Clone ID: LIB3059-021-Q1-K1-H7
ggaattccaggcacgacccacgcgtccccagagtgtcacacatctgatgcatatgtagacgctaggaacactgatcaatggctacggtcatatgttccatcttctcacaaggttaatacaagctgtcacatcatccctatcaagcagcatatgataaaacagtaagacatcctcgccggatggataatgaacgaaacaactacatggagagccaaagtggcatacgtgataataaccctgaaaacggtgctgcaacctccatgtgaacatgcattgcaacaagacttgttcaatagactactttggacttttggtgaacgctgcatgtacattctgtttacaccctttcacagtgaactt

SEQ ID NO: 33318 - DNA, 429 bp, Zea mays
  Clone ID: LIB3059-022-Q1-K1-A12
tagaccactgatttcacaatgaaaagttagacaatgccttcatggctagaactgttgcttgcaacacaattctttacgacttgtgctaaccatcttcttgctagtcgcaatgaatgtaacctattttgcacccagtgtgagaccaaaccagctgctttctgtaactattgtcgttcaagtgatcattccacccaccgtgtaatccagataaggcgttcatcgtaccatgacgttgtgagggtgtccgagattgaggatatccttgatgtcagcgatgtgcaaacttatgtaatcaatagtgcaaggattgtattcctgaatgagcggccacaactgcgtgcttctagtgtccccatttgtaaggcacccacatcatcaacacatagctgtgagacatgtaaccgtgtgctacttgatgcatttcgcttc

SEQ ID NO: 33319 - DNA, 358 bp, Zea mays
  Clone ID: LIB3059-022-Q1-K1-D1
ccggttcggaattcccggctcgtcccacgcgtccgatgctgctcatgctggtcaagagttgattggcttgatattcagtgataaggaactgtgggttggaagagcacagaagatgtatgaaagagagatggagttgaaggagaaatttgtaatgaatgttcaagaggtagctgagaagttgcaaaacacatacttatatttgaagaacttataggtgaacatatttgatgataaattgcgtgagctctttgatgattatggtaatattacttttctgcaatgttatgctgaattctaatggggttatcagaggttctggatttgttgctttcaaatctgctgaatatgctaaccgagc

SEQ ID NO: 33320 - DNA, 353 bp, Zea mays
  Clone ID: LIB3059-022-Q1-K1-D7
gtccggtccgaatcccgggtcgacccacgcgtaccgccagtgcacgactaggttcagatcttggcgtcatgtgtttggcaacgagccggaaagatggtagtccttagaatcgatcggttcctgagcgagctgacgtgcatgttctagcggagcacggagaagggctacgtatggatgaccatgtagcgagcaagtctcgagggcgaggcacagttgcgttgagatggagaataatgatcaggaggtttagctcaattgagtgattcgcgcctccaatggcaagaagaatattttcagcttggtttctctaattgagtacacaaagtttcaagcttcatacgcaacagttctta

SEQ ID NO: 33321 - DNA, 531 bp, Zea mays
  unsure at all n locations
  Clone ID: LIB3059-022-Q1-K1-E11
ggaatttccggctcgacccacgcatccaggcgacgcgcggacgcgtgggctggacgctgtgggacgcttgtcggcgagctgccttacaacaacgcaattgcgccaattgctaacaacacatccttggcacaaatctaaccctacaaactcattgcaactgcacaacaacaacaacnagtttctgccatcacttgagnctcacctagccgtggtgaacacctgtcancctacttgcaacnagcagctgcttgcattccaacccacttgctcttggcgaacgtagctgcattaccagcaactaacaaccagcttgcaacagtttaatgccagtgctcaagtcaactagctcatggtgaactcctgccgtctacctttacaactactttcanntctagcccgctttcgcggtgggcaaatgcaacctaacgtacctatncaacaacagttgcttgcaaccaaattgtaccaagctctgactcagnctagcttgtggcaaaaccctgcttgcctacttacaacaagttgctttca

SEQ ID NO: 33322 - DNA, 145 bp, Zea mays
  Clone ID: LIB3059-022-Q1-K1-E2
agaaaaaaaaaataaaaaaaaaaatattaaaaatgaaaaaaatgaagaaaaaaaaaaagaggaagggcagacgatctagaggatccaggattacgtacgcctgcatgcgacgtaataaaaattcaatagggacaccgaaattcaa

SEQ ID NO: 33323 - DNA, 250 bp, Zea mays
  Clone ID: LIB3059-022-Q1-K1-F12
cagacaacccatcattggtggtgccctcttttagatttattattgaactatgactcagaagaaagctaaaagagggcgcccccactggtgcgaagcagcgtacgcgtggttcgtacaggaaattccggaccggttccaggaggcgtgccagcaattcctatagtgagacgaataacacacaaaactgcaaaactataaggttgctatctatcctagtatcacactactactactacaaacaatccctcta

SEQ ID NO: 33324 - DNA, 320 bp, Zea mays
  Clone ID: LIB3059-022-Q1-K1-F5
tggtttttcttgtcaggttgctgaacgtgctttgttcttgtggaacaatgatcatggggtaagcttgatagcacaaaatggtgttgttatatttccaattatatttgaagctgttgagaggaatatacagagccactggaatcaagcagtttatggtctcactgcagaggtgcgcaagatgttattggacattgacagtgaactatttgaagagtgccagcagcagtacatggagaaacaagcgaaagccaaagagatacatgaacaacgagaatcagcaaggagacaattggaagctgttgttgctgccaaggctgctg

SEQ ID NO: 33325 - DNA, 316 bp, Zea mays
  Clone ID: LIB3059-022-Q1-K1-G1
tccacgcgtccgtccacgcgtccgcccacgcgtgcggcagcttctgcttgctctggggggaaggagagagagagagagcgagagagagatctagtagagaggctagtaggtggtccttgaacgaagatgttggcggtgttcagcgggcatgtggtggaggtgccggttgatctggtggctgagggcagtcggacgccgtcgtccaatacgaaggcgtggcatctggtggggcgctttctggccgtgtccgatccggccgtgttcgagcagatcggcgaccactatcacctcgcctactcccacaccaaccaggcgc

SEQ ID NO: 33326 - DNA, 159 bp, Zea mays
  Clone ID: LIB3059-022-Q1-K1-G5
agccgggtcgaccgacgcgtacgaagacatcgagtactccaagcgcgcttctaaggcagatgcaaagacaatgtccagggatgaaccaggcagagtcaaaattgaacctgttagctcaactaaattgcaaggccaagcagatcgcgtccacaagccata

SEQ ID NO: 33327 - DNA, 131 bp, Zea mays
  Clone ID: LIB3059-022-Q1-K1-G6
taccggaccggaattcccagatcgacccactcgtaccgcccactcgtacgaaaaaaaaaaaaaataaaaaaaaaaaaaattaaaaaaaaaaaaagagaaaaaaaaaaaataaaaaaataaatatacataag

SEQ ID NO: 33328 - DNA, 360 bp, Zea mays
  Clone ID: LIB3059-022-Q1-K1-G7
taccggtccggattcctgggtcgacccacgcgtgcgaaaacatttcggtctcatctacgtccacattcgtcctccagcactccagctgcatggacgaggaccgacgtagcgatatgcgaagcaagggacgggagaggaacccgaggaaggcgaaaatgatctaccgcaactggtcgctgctctcgtccacgagcgtgatttgggatagagtggtcaccgtcggcctagtcgggatcttgctctggggcgagttggaggaattcagatggtatctgtgcctggatggcgataggcttatgcggcaggacagagccgcggtgggccgaagctaagcgttagcttctttggtatctcaaggga

SEQ ID NO: 33329 - DNA, 167 bp, Zea mays
  Clone ID: LIB3059-022-Q1-K1-H2
ccgggtcgacccactcgtccggacacactagcaatccaactagcaccatatagtgcacactatggctccaacaatggcaggcctaataatacgccttcttattatcgttagtgcttctgcaagtgctattacggcgaccatcttgcaggattgcacgcatgctccta

SEQ ID NO: 33330 - DNA, 380 bp, Zea mays
  Clone ID: LIB3059-022-Q1-K1-H4
tccacgcgtccgcccttgcccatgccattgctaatgagactggcgtgccgttctatgagatctccgcaccggaagtcgtatctggagtgtctggagcatctgaggaaaacatcaggggcttgtttcagaaggcctatcggactgccccctcgattgtgtgtatggatgagatagatgcgattgcatccaagagggagaatctacaacgagagatggaactgctgatagttactcaattaatgacatgcatggatcaattccaccagaatattggatcgggaagtaacaatttggaagctgaatcatctgaaaagaaacctggttatgttattgtcattggagccacaaataagcctgatgctgtgatccaagctctgcga

SEQ ID NO: 33331 - DNA, 286 bp, Zea mays
  Clone ID: LIB3059-023-Q1-K1-A10
cgacccacgacgtcacgcggtcgtcgactcgtaggtaacactgctatcgaacaccctgaaggcaatgatgtgacggggtgctctcagcatgatcaaagaaagcaccctgtgatatttgacgacagagctaaatgtacgaagtctaaattaatttcctgaggtagtggagttatattggagtcatattggaactttaagacaagtgggctgcctgtgcgcgtgcttttctaccaacatggtaactgtgatgattttccaaaggatgttgtaaatcaagcccaacagg

SEQ ID NO: 33332 - DNA, 412 bp, Zea mays
  Clone ID: LIB3059-023-Q1-K1-B8
tttgtgattccagggacaactgttattcttggtgctgttgctgtagcagtgttgggaagtcgttgcaatgctgttactgttatggttttaaatttggccgccactccaattgagctaagcttgatcgtccctttcttgcgtttgggggaaaccatcactggcagtgggcacttccccttgacagccaacgcactgaagaatgttctcactggtcatgcatcaaaggatgtgctgctgagcatcgtcaatgcgatgctgggttggcttattgctgcaccatttgtacttgccgtgctgtacgctggttcgttcccttggttcaaggtcctggttaacaggtttggcggcattccatcgagccccaggaccccactcaaagcggtgtaagtagtgtgtagcatgctgaatgctc

SEQ ID NO: 33333 - DNA, 403 bp, Zea mays
  unsure at all n locations
  Clone ID: LIB3059-023-Q1-K1-D11
tccggattcccggtcgaccacgcgtncgggcctttgcgacctctctggcgcactgattaatcggaggcccattcgtacaggtcacgggtgatggcaggcggattctgttaaccactaaagctgggcgtgttcatgtgctagattcgtttgaaggaaacagcattgcatcgtttcgcgcgaagccaatattaaccaattcgacactggaggcatcgttctgtcccgagggaaaccatattgtatctggctccggtgatggtagtgtctatgcttggaacgttgagagcggaaaggttgcatgctgggaaagcacagatgtgaaaccgccgcgggtaaggtggtctccaggatccttgatgttcgtgacaggaacgtcngagctgtcctgctgggtgccggattt

SEQ ID NO: 33334 - DNA, 388 bp, Zea mays
  Clone ID: LIB3059-023-Q1-K1-D4
acggtccggaattccgggtcgacccaagccttccgacttcggcggccggcctcctcttcttttaacccacacgctggtcataaaaatgtcggctgcagaggcaaaggcggcggcggtcccggagtctgtgctgcggaagcgcaagcgggaggagcaatgggcagcggacaagaaggagaaggcgctcgcggacaggaagaaggcgctcgagagccgcaagatcatcttcgcccgcgccaagcagtacgccgaggagtaccacgcccaggagaaggagcttgtgcagctcaagcgtgaggcccggttgaagggtgggttctatgtgagcccagaggccaagcttctgtttgtggttcgcatccgtggtatcaatgccatgcaccccaag

SEQ ID NO: 33335 - DNA, 354 bp, Zea mays
  Clone ID: LIB3059-023-Q1-K1-E10
tcgcgcgcgcagaacacacctgctcgggctggattaggaggacagcttcttcgggcggcggcatggcggacgagaagggcgcgcagcagtccgatagggagtgggtggtcgaccacaagctccaggccgtcgggacgctgtggctcaacggcatcgtctgcttgatcgcctacgacaggatcaagccgtgcatgatgaccaacgtcaagatcatccacgccaggctgcatgctcaggctctcacgctggctgccttggctgggtccgcgctggtggagtactacgaccaccagcaagggtcaggatcgaaagttcaccaatatgcaaagcagttcctttcatctgatagcaata

SEQ ID NO: 33336 - DNA, 326 bp, Zea mays
  Clone ID: LIB3059-023-Q1-K1-E7
ttcgcgtccgcctcagcccgccgcaaggagaggtaagttcaggagacatcttcgagaagctgaaatggctcctaaagctgctcctgccaagaagggtgatgccaagacccaggccttgaaggttgccaaggctgtgaagtctggggcagccaagaagaagaccaagaagatccgaacgtctgtgacatttaaccgcccaacgaccctgaagaaggctagggaccccaagtacccacgaatcagcactaccggaaggaccaggcttgatcagtaccaaattctcaagtacccctttaccacagaatcagcgatgaagagattgaaga

SEQ ID NO: 33337 - DNA, 429 bp, Zea mays
  unsure at all n locations
  Clone ID: LIB3059-023-Q1-K1-F11
cggattcccggtcgaccacgcgtncgaccaactgtctacactgaaccctgctgcttatttgcagcaacaactattaccatttagccagctatctactgcctactctcaacaacaacaacttcttccatttaaccaattggccgaactgaaccctgctgcttatttgcagcagcaaatactactaccatttagccagctagctacagcaagccgtgcttccttcttgacacaacaacagttgctgccgttctaccagcagtttgcggctaaccccgcaaccctcttacaactacaacaattgttgccctttgtccaacttgctttgacaaacccagcagccttctaccaacaacacatcattggtggtgccctcttttagattgcttattagatgtaattcaataataaagttttttggatgatgtatgt

SEQ ID NO: 33338 - DNA, 380 bp, Zea mays
  Clone ID: LIB3059-023-Q1-K1-G1
gacgggaatcaatggaaggaacggggcacgggcaccgtcaagcttctcaagaacaaggagaccggcaaggtccgactcgtcatgcgccaggccaagacgcttaagatctgcgcgaaccacctcgtggcccccaccacgagaatgcaggaacatgccggcagcgacaaatcgtgcgtctggcacgcttctgactttgcggatggcgaactcaaggaggagatgtttgccatcaggtttggttcggtagaaaactgcaagaagttcaaggagttggttgaagagattgctgagtcacttacagagaacgaggacaaggaaggtcaagatggctcttccacggccggattgctggagaagctcactgtgagcgagggcaaatc

SEQ ID NO: 33339 - DNA, 178 bp, Zea mays
  Clone ID: LIB3059-023-Q1-K1-G12
taccggtccgggattcccgcgtcgacccacgcgtaccttgacgcgttagaaagacatttttgatgttcatggaatcacttggaccacggcacgctaatgatataacttggtcttcttttgaaaagcacatgcttaccactaatatcataaaacgagccaagacgattgcctttaaatg

SEQ ID NO: 33340 - DNA, 445 bp, Zea mays
  unsure at all n locations
  Clone ID: LIB3059-023-Q1-K1-G2
tcgacccacgcgtacgggcncnagccaggaggcgggtcaggttacggtcaccgncaagactgctccagccaagggagggccacaagggtccgactcgtgatgcaccaggccaagacaccgaacagatcgacggagtacttgtcctctccatcgagaagctccaggagatacaggacgagctcgagaaggtaaatgaggaagcaagtgacaaggttatggaggtggagcagaaatacagtgagatccgcagacctgtctatctcaagaggggtgacattatcaagaccatcccggacttttggctcacagcgtttatgagccatcctctattaagtgagcttctgactgaagaaggaccagagatattcaagtacttagactccattgatgtggatgattctgatgttaaggcaggatactccattcatcttaacttctctgagaa

SEQ ID NO: 33341 - DNA, 293 bp, Zea mays
  Clone ID: LIB3059-023-Q1-K1-H1
gatatcagagcaaattaaagcacagttggttgcatataatgattattgtacaaattgacaagatcaccggctcaccgatggagaaaaaaaacatatactatttcagagaaaataaatccggacaaattgaactttcatcggcgcaaacaatcactgggcatgcatgttccatccatccatccatggtcctcggtccaacactgaatctatctatctcgcggtttcgccgccagagaagcacccacaacagctggcgaagaagcccgattccttaggagcagcggagctgccct

SEQ ID NO: 33342 - DNA, 436 bp, Zea mays
  Clone ID: LIB3059-024-Q1-K1-B1
ccgggtcgacccaagccttccgtggtccactgttcaaggaccgcaggaaattccctaaaatggctgatccaatgcttcagggccgcttccctatgaggggtctatatcaggccttagctgttgctgccatgtgcttgcaagagcaagctgctacacgccctcacatcggggatgttgtcactgctctctcatatctcgcttctcaggcttatgacccaaacgcccctgttcaacacagccggagcaacgcatctacccccaggtccagaaaccctgctgcatggaacggtgatcagcgcagtgtgcgctcgcctaatcatcaccattctccagacccgcggcggagggaccctgccagggcatccaagtatggagcagaggttagcaggactagctctgccagcgattctggccggcggtcaggtctggatgacat

SEQ ID NO: 33343 - DNA, 179 bp, Zea mays
  unsure at all n locations
  Clone ID: LIB3059-024-Q1-K1-B12
tcgtaccggttccggaattcccgggntctacccacgcgtctcggattttctgccctccttggccctccttggctctttcagncaaacnngttgctaccgcgactatgtgattccacgaatggctctnacaacaatnnacctctcnntccggtgaccagcnncgcgagaatnnttgaata

SEQ ID NO: 33344 - DNA, 219 bp, Zea mays
  Clone ID: LIB3059-024-Q1-K1-D10
gtctaaacctgatgaactagcagtcatataaactgttgtgttggctgcgaaatgtggaggcctgatgttgaacttgcaaggagataataacaaattatcagctttgcgcctgtgcccagtggaaggggctgtcttccaagttattgtctgatatggaattgttccagattatcatgtctcggcgtttacccattattattatttgatttgaaccttaaa

SEQ ID NO: 33345 - DNA, 277 bp, Zea mays
  Clone ID: LIB3059-024-Q1-K1-D2
tttctgggccaccaaaccctaatcgggttggcctaaaaaccggccgattggcgattaggtaggggccgttaaccaaagtcctcgttggttaaggtccagtctagtaggaggcgcagagacccatctgtatggtcgctgggagatctatcttgacctcctttttctgttctttttggtcttagttatcgtggttggattctatagcagccttgacaggcattcgaacaataatgtttatggttctcctatccgctttggactctaagcatgttttccc

SEQ ID NO: 33346 - DNA, 70 bp, Zea mays
  Clone ID: LIB3059-024-Q1-K1-D6
ttttttttttttttttggatatgttataattttatttttttttttttttttttttttttttttttttttt

SEQ ID NO: 33347 - DNA, 438 bp, Zea mays
  unsure at all n locations
  Clone ID: LIB3059-024-Q1-K1-E3
cggaattcccgggtcgacccacgccttccggtggcggtctttggcggcccccgaattgcgtgtggccaacgagctcggcgcggccaacggggagggcgccaggttcgcgaccatcgtgtcgacggtgacgtcgctggtgatcgggctcttcttctgggtgctcatcatgggcctgcacgacaagtacgcgctcatcttcacctccagccccgtcgtcctcgacgccgtcgaccacctctcggttcttctcgccttcaccatcctcctcaacagcatccagcccatcctctcaggtgtggccgtcggctccggctggcaatccatggtggcctacgtcaacatcggctgctactacctcatcggaatccccatgggcatcctgctcggatggctattcaaccttggcgtgctggggatctgggcggngatgatcggcgg

SEQ ID NO: 33348 - DNA, 228 bp, Zea mays
  Clone ID: LIB3059-024-Q1-K1-E4
cagatttcacatcaaaccttgagagccagaggaagcatgtcaccatttgtggctttagcaatgttttcgaaaagattatgatctgtatcttggaaccttatttcaatggaccaaatttctttctttgccaaaaaaaaaatttggtggattgacgttctggaggatgcaagatatcgtacgcttgcatgcaacgtaataattctactataggggcacctacattgaatt

SEQ ID NO: 33349 - DNA, 441 bp, Zea mays
  Clone ID: LIB3059-024-Q1-K1-E8
ggttcggaatacccggctcgacccacgcgtgcgccgaggtcgaaataagctgctgcgggcttaccgtgaaccctgggcaacctgggcgcggcttggtggagcggtggctgagggttggcccggcgcgcccgctgcacacggtgatcggctcctccgggggagattatgtgatggtgataagctatgggcggcccaagtccgcgtcctgttaaaaccatatcaccatcgacggcctggcgaggtcgattcctagttcgaacaagggttggtgccgccgccgctgccgccgccggggaagaggccgtcgacagataaactcaagcagcggtagcgggctgctctgccgcagcaactcgtcctctcaccggcgtgttctttaaagatctggtcgttcggtcgttggtgtcatacatgcacatgtgattgaagtcgctattaatt

SEQ ID NO: 33350 - DNA, 433 bp, Zea mays
  unsure at all n locations
  Clone ID: LIB3059-024-Q1-K1-F1
ccaagccttccgtggccgccaaaccctgcccctaagtttcctatggccgcccgttgttccaagaccgtgtttgcggctgtagcctcaagattccctggtaaggctgttggtgtaaatctgcctgcgggatcagctcctgcggcagctgctcctgcggatgaagctgaggatgatgatgaccttgatctttttggtgatgaaactgangaggacaagaaggcagctgatgagcgtgctgccgctgccaaggcctcttctaaaaagaaagaaagtggtaaatcctccgtccttatggatgtaaaaccatgggacgatgagactgatatgaagaagctggaggaggctgtccgcagtgtccagatggagggtctgacttggggagcatcaaagcttgtgcctgttggatacggcatcaagaagatgactatcatgt

SEQ ID NO: 33351 - DNA, 389 bp, Zea mays
  Clone ID: LIB3059-024-Q1-K1-G7
ccggttcggaattcccggctcgacccacgcgtgcgcggacgcgtgggttttttatttttttttttttttttttatttttctacgtgggtggctggccaattattccattcagacctggggagcactgaagcacagaatcataaacatgcatgcagccggagcgctatcatggccatggtcaaggcttgattaccgcaattcctttccatacgttgttcgaggcctaacacatgctttcgcttcattgcactctaacagttgatcgctcccttgacattttaaaccgacacgacaacctaataacgccaattacgtttactgcatttcatttgaccagctatgggataccaaacgactatccaagcctgaaagattctcttaccaataaa

SEQ ID NO: 33352 - DNA, 390 bp, Zea mays
  unsure at all n locations
  Clone ID: LIB3059-024-Q1-K1-H12
ttcccgggtcgaccacgcgtccggggatagcagccaagatactttgaaggtttgacaatcgccttggtcactaggatccgtcttggttgtcaaaccttcaaagtatgtgggatagcagccaagatggatgttaacgaccatgccgatcaccaaggctccaaagccagtggaatgccaaccaagacagatgctaatgatcaatgcagcaaccaaggttttgttacatgtccctttaagacagctgagaggttagatcatcttctgaaccaaccagcaaacagatactgtgctgattgtggtgctccagatccaaaatgggtgtcaatgactnttggtgttttcatttgcatcaagtgttcaggagctcatagaagtcttggagtacacata

SEQ ID NO: 33353 - DNA, 422 bp, Zea mays
  unsure at all n locations
  Clone ID: LIB3059-024-Q1-K1-H5
tttcatataagcgaaatattgcagcaattgaagggagttggtttggatcttgggcaccagagaggatgttatgggatcacattatttataaaccaatacgggcaatgcttggaggacgtctaagatttgttctttgtggtggtgcacctctgtcaagtgacacacaaagatttatgaatatatgtctaggtgtcccagtcggtcaaggctatggattgactgaaacttgtgctggagcagctttcactgaatgggatgatacaagtgtgggtcgtgttggtccaccacttccttgctgctatgtgaagcttgtctcatgggaagaaggtggttacaagatttctgattctccaatgccgagaggagaggtcgtggttggtggacacagtataacanaaggttatttcaacaatgaagcaaag

SEQ ID NO: 33354 - DNA, 289 bp, Zea mays
  Clone ID: LIB3059-024-Q1-K1-H7
cgacgccacgcgtccgccgactcttacccacacactgcctcatttgcatggacttggcttgcatctagggcaggatacagaatctcatgccatcacattatctataaaccattaccagcaatgctcctatgacttccaacaccagggcctttgtcctcgcccaccccgttcaagctatacaccgactactatgaacatatgcctaagcttcacagtcagcccaacttatacatgaacagcaccttgggctcgagcacatttcactacaccggatactacaacttgtcgt

SEQ ID NO: 33355 - DNA, 237 bp, Zea mays
  Clone ID: LIB3059-025-Q1-K1-A7
ctcgtttcggattcccggtcgactcacgcgtccggccgcatcaccttaacatactttgtcgtctaatagccgaactggtttacccagacgatgtataacatattctgttgacagaaaaaactggtttcaccaaaccaaaagacaacatactctgttgacagacacgaaactggttccacaaaaacaaaaaagaggcaaatgtgcggcgaagtaaataacaaaagggccatatgcaag

SEQ ID NO: 33356 - DNA, 319 bp, Zea mays
  Clone ID: LIB3059-025-Q1-K1-A8
aattcccggctcgacccacgcgtacgctcacacgtccggtgctgctgcgcttattggacctgctcgagcggcacgcatagggggtggtgacgctgtatacgtgggacaaccgcatgatctggtcatgcctattggccgatgtccccatggtgtcttcgatgcgtgcggtactacaccggttgggctgactagatccactgcctgattgcaccagtcgacggcgcgcaccacgttcttgtgctgcactagccggtcggaattgtcttacagatcatcccctggatcttacatcttctaatgttcgactcgaaggtcattc

SEQ ID NO: 33357 - DNA, 438 bp, Zea mays
  Clone ID: LIB3059-025-Q1-K1-B1
aattcccggcgggacgccacgcgtccgggagtagcagcccaacagaccatgtgattagcccaccacctaaggataacggcgacgggaatggttcataccgtggcgacagccccagagggagggaagacagcaggagccgcagccgcagcccatccggtggtaaccgcaaccctgcagctaatgggcgtagcccgagccccaaaggtgaccgtggcccgagccccatggctgaccgtagcccgagcccaaagggcaatggtaacaacgatggtggtgatgatgatactggccgtggtggtttccccacacgaagcaagtcaccctgaacgcttcaccgtctcaattcttaggtgcttcgtgatgcattgggcaaacataccaaaaacgttgatagctgtttcgtttcccttatttgaaaccttggacttaatttaactt

SEQ ID NO: 33358 - DNA, 214 bp, Zea mays
  Clone ID: LIB3059-025-Q1-K1-B6
cgctcgcagtttaatttagcggtttaagtgtggatctgtgaaccccatggcgccggttgttgattcgtgttacacgtgctatgttctgagattcatgattaaaaataaaaaacaaaaaaaaaataaaagggcttaagctctaaatgatccatactttagtacgcactcatgctactacttaagtcttctatagtgacaactaaatatcaatgct

SEQ ID NO: 33359 - DNA, 418 bp, Zea mays
  Clone ID: LIB3059-025-Q1-K1-C4
ttcattcgttcccggcctcaccccgagccagtcgtctcgctagggtttcgccgccgccggcatgcctcgccgcagctcaggaaggtctgccccacgcccagctccccgtgctgcttcactgaggaacccgccacagccagcacgccaggctcctcctccagctcctgttcgagatggtggtggctccatgtttggaggaattgggtccaccattgctcaaggtatggcgtttggcacgggtagtgccatggcacacagggctgttgactctgtattaggtccccggaccatccagcatgagactcttgccacagaagctcctgctgctgcccctgctgctccagcgatgaatgctgatgcttgcagcttccattctaaggctttccaagattgtctcaacaactatggcagcgagatc

SEQ ID NO: 33360 - DNA, 467 bp, Zea mays
  Clone ID: LIB3059-025-Q1-K1-C7
accggtctcggattcccgggtcgacgccacgcgtccgaatacccgtgagaaataatgtgttgtgcgcagccccgtccgtgatgctgtcgacgcgtggctagtggtcgacgccgcgcttcgcgttttgcccgttcaacaaaacaccgagctgtgtggacaacctatgtgactagtctcggttcgtccaggaccgagagatgacgaccgtgcaagtgatgtggtgccaaccacaagatgcagttggtggacgacctgaagaatggacttaaccagtggatgctcgccaagcgagtaccctaccacagcaaacactatctaagtgttaaattaaaggtacttcttaggatgattggttgctggtgtgacttggccttcatccctgccaccgggatagatggtcgagtgggttattgcttccgcaggagaggaccaggaggagtagcgtggctaggcttcgccatgttact

SEQ ID NO: 33361 - DNA, 430 bp, Zea mays
  Clone ID: LIB3059-025-Q1-K1-D1
tgctcagcgactagctggatagaatcaggcgacactgtaaggaaaaaggtgttcctgaggaacctctctgctcccttcatttgtgagttcttccgtgatgcccaagagaaggtcctcccgtatgctgactacatcttcggcaacgaaactgaggcaaagatctttgccaaagtcagaggatgggagactgagaatattgaggagattgctttgaagatctctcaacttcctttggcttcaggcaagcaaaagaggattgctgtgattactcaaggtgctgatccagtggttgttgctgaggatgggaaggtgaaaacgttccctgtgatcctattgcccaaggagaagcttgttgacaccaacggcgcaagtgatgctttcgttggaggcttcctctcacagttggttctaggcaagggcattgaagact

SEQ ID NO: 33362 - DNA, 137 bp, Zea mays
  Clone ID: LIB3059-025-Q1-K1-D10
gaattcccgggtggacccacgcgtccgcccacgcgtccgactcaatataggacgtgaggtacagcttcatcaacacatcctgcgggaaggtcaagatattggaacctccttaaggcttcttgatgaattatgaatgt

SEQ ID NO: 33363 - DNA, 427 bp, Zea mays
  Clone ID: LIB3059-025-Q1-K1-D11
ggattcccggtcgacccacgcgtacgcaacaaccgcagcaccaccaccaacaacaacaacaacagcaccaacaacaacatcaaggtgaaggccaacaacaacatcaccaacaatcacaaggccatgtgcaacaacacgaacagagccatgagcaacaccaaggacagagccatgagcaacaacatcaacaacaattccagggtcatgacaagcagcaacaaccacaacagcctcagcaatatcagcagggccaggaaaaatcacaacagcaacaatgtcattgccaggagcagcaacagactacaaggtgcagctataactactatagcagtagctcaaatctaaaaaattgtcatgaattcctaaggcagcagtgcagccctttggtaatgccttttctccaatcacgtttgatacaaccaagtag

SEQ ID NO: 33364 - DNA, 402 bp, Zea mays
  Clone ID: LIB3059-025-Q1-K1-D12
ggattcccgggtcgactcacgcgtccgttgtttttttttttttttttttttttttttttttttttttttttttttttttcatgggtttgttttctcttttgtttatatttctatatttaaatatttctaaaaaaacaaccaaccctttttaagaaccaaaatttactacattaatcttaaaaaataaaatgaacctataaggttacccaaattcaattcaattagccatcatactaaaaaactattgacttacaaaaacctaaactaacccaacataatcaccttttaaaacatatcacattaaaaaactatttgaaacccaaaaagccccaaccaaaagccatttccaatcattaaacaacactaattctgaaagggaccatccctatatcccttcataaa

SEQ ID NO: 33365 - DNA, 470 bp, Zea mays
  Clone ID: LIB3059-025-Q1-K1-D6
accggtctcggattcccggtcgacgcacgcgtccggcgctctctttctctatcgactggcgacgactccgccaccgacgccgctctacgcgaggggcccaggtcttcgccaacgacgagcatccgggttagagaggaagaaattgcaaccgaaacaatggcggcagattccggcgctcgcagacaaccaagcttcaccaaggtcgaccagctgcgccctggaacccacggccacaacctcatcctcaaggttgttgactccaagatggtcgtccagagaggccgagagggagggccccagggaagacagatgaggattgcggagtgcttggttggtgatgaaaccggcatcattgtcttcactgcaagaaacgatcaagtggatgtaattaggcctggaacaactgttgaactgaggaacgcaaagatcgacatgttcaagggttcgatgcggcttgcagtggacaagtg

SEQ ID NO: 33366 - DNA, 374 bp, Zea mays
  Clone ID: LIB3059-025-Q1-K1-D8
tgcggacacaaattctacaggagttcggttaagcgattttaagcatgaactctggggagacagattcagacattgcaacggttttatgggtagcctgcctgaagggtcgccacctaatccctgccgatcggggcaatgctattctgggaaatgctatgcttgcacttgtaataactgccgcttctctgactgagcttcgtttgcagctgctggacttcaatcatgccgcttctctgtgattgagcttcgcttcctttttgctgcagctacttttcgtcgtacaagtggttaccaacagctgcagtagatttggtgggtgtttgcattctaagtactcatggttagacgccttatctgacacttttataatgatc

SEQ ID NO: 33367 - DNA, 465 bp, Zea mays
  Clone ID: LIB3059-025-Q1-K1-E4
tcggattcccggtcgacgcacgcgtccggatatattcaacgggaaaaagctcgaagtatattgttccttcgtcacacaactgtgatgggccgcatgtgaaccgtactgagtatcagctgattgatatatcagaggatggatttgtgagccttcttacttcagatggcaacactaaggatgatcttagactcccaactgatgagactcttgtggcccagatcaaggaagggtttgaaagtggcaaggatcttgttgtgactgtccagtctgctatgggggaggagcagatctgcgcgctgaaggatgttggccccaagtaacttccctgccttggaatactgtatctcaaaacctaaatcgaaaaaagaagtgtatcaaggattgctacagagacatccatctggcttgagctggcttttgctatgtcaaacacaagtgcagggatcgctgggtgttgcaccgtgt

SEQ ID NO: 33368 - DNA, 333 bp, Zea mays
  Clone ID: LIB3059-025-Q1-K1-E5
gattcccggctcgacgccacgcgtccggcgggaagcaaggacaccgtggggcagttcgagtcccacatcgcgttcactcttgctgggctctaccgtgtcgtccatggcatcgatgttttcgatcccaagttcaacattgtctcccctggagcagacatgagtgtttactacccgtatacggaaaccgacaagagactcactgccttccatcctgaaatcgaggagctcatctacagcgacgtccagaactccgagcacaagttcgtgctgaaggacaagaagaagccgatcatcttctcgatggcgcgtctcgaccgcgtgaagaacatgaca

SEQ ID NO: 33369 - DNA, 434 bp, Zea mays
  Clone ID: LIB3059-025-Q1-K1-E6
tgcaaggagtgtgatgtactcgtggaggtacaagctttacagagagcactgcaagagtgggtggcacaaacacaactacacacgccacaagaatgggctcccgcctctcagccaagaggagtgtatggtggagatggaattggccgactccaagaaagaccttaaagactacgatttctgatgaggttacctggaagttcctttgacatgctatcttgtatttgggcactaatgttgtctgtctaatgcttttctaccacccaatcttatccaagatggttaacaaggggtgcacatggcatgaagttgtttccaatccgtttttattttaacgaggaagtgatgagtgaggcacatggtcgctttctgatgctgtatacgaattattagaatgagatggtttagccacatctttgaactgagggtagaacctg

SEQ ID NO: 33370 - DNA, 232 bp, Zea mays
  Clone ID: LIB3059-025-Q1-K1-E7
accggtttcggattcccggtcgacgccacgcgtccgataatatacagttaggcaccgacgttggtcctccttgcgcttcttgcccttagagtgggcggcaacaaatgcagttgattattaccacagagcattacttgctccatagctgcacaggcttccaaaatctactcctactcagttacattcaatgtcatcaggaacattcatcacgtgcaagcactacacagctact

SEQ ID NO: 33371 - DNA, 454 bp, Zea mays
  Clone ID: LIB3059-025-Q1-K1-E8
ttaccggctggacccacgcgtatcgatggatccatgtaacaactcgacttgttctatcctcccgacacacactgggatatgccggatatgaaacccaactgtgtatcacctaattcatatatcaaactatggatttaggagccctgttacttcagatggcaacactaacgatgatcttactactaccaactgatgacactcttgtggaccatatcaacgaagggttttaaagtggcaaagatcttgatgggactgtacaatctactattgttgaagatcaaatatgcgcgctgaacgatgttggccacaagtaacttccctgtcttggaatactgcatctgaaaacctaaatcgaacaaataagtgtatcaatgattgctacagagacatacatatggcttgagctgcctgttgctatgtcaaacacaagtgcaaggatcgctgggtgttgcac

SEQ ID NO: 33372 - DNA, 405 bp, Zea mays
  Clone ID: LIB3059-025-Q1-K1-F1
cggacgcgtgggaggacaggggctggttctggtgggagaagttcaagtcctacaagtatgatggcaggagcgaggagttctaccgtcttccttatggcttgagcaggtacttcccctcgctctaggacgccgggaggaagacgacggacccaagttctatgtagctgctcgagcgtagaagctgaacatcagttgaaggcaacagaaccatatgttattttcatatatcaagcagttgggagggagcttgatgttttgatttaccttgtaaaacattttggatgataaacttttgcaattactgggagagtaggatcaaccaggggagaattctgcaacaattcagtcaccgtttttgcttcagattcgaaacagaacacagatgccttcacaggcttcgattaa

SEQ ID NO: 33373 - DNA, 427 bp, Zea mays
  Clone ID: LIB3059-025-Q1-K1-G5
tttgagcattcagaaacacacctagcgatacgcactaccaacgacctaacaacagtgggtaccaagatattatccgtctttgcgcttcttgccctttttgtgagcgcaccaaatgcgttcattattccacaatgctcacttgctcctagtgccattattccacagttcctccctccagttacttcaatgggcttcgaacacccagctgtgcaagcttacaggctacaacaagcgcttgcggcgagcgtcttacaacaaccaattgcccaattacaacaccaatccttggcacatctaaccatacaaaccatcgaaacgcaacagcaacaacaatttgtaccagcactgagccaactagctgtggtgaaccctgtcgcctacttgcaacagcatttgcttgcatccaacccacttgctctggcaaaca

SEQ ID NO: 33374 - DNA, 374 bp, Zea mays
  Clone ID: LIB3059-025-Q1-K1-G8
tgcatcaaaccgtggcactgtgatggagttgggtattactccaattgtgacctggggggtggtaatgcaacttcttgtcggatcgaagatcattgaagttgacaacagtgtgagagaggatcgtgctctgctgaatggtgcacaaaagttgcttggtatcttgatcgctattggggaagctgtggcatatgtcctgtctggaatgtatggtactgtaagccaacttggaacaggtaatgctattctcattatacttcagcttttctttgctggcatcattgtcatctgcttggatgaactttttcagaaaggttatggtttgggatctggtatctttctgatcattgctaccaatatctgttagaatatcatct

SEQ ID NO: 33375 - DNA, 157 bp, Zea mays
  Clone ID: LIB3059-025-Q1-K1-H10
tttttatcaaaatgcaaaggcctgtattagacaacgatttgtgtacatacagacactacaaccaacaaacatataataccatttattgtacatatcacatatataagacctacatcatccatattttctatactcatacctatgacattaattttac

SEQ ID NO: 33376 - DNA, 318 bp, Zea mays
  Clone ID: LIB3059-025-Q1-K1-H11
cccgggtcgacccacgcgtacggagcattcagaaacacaccaagcgaagcgcactatcaacaacctaacaacaatggctggcaaggtattatccctccttgcgcttcttgcgctttttgcgagcgcaacaaatgcgtccattattccacaatgctcacttgctcctagttccattattccacagttcctcccaccagttacttcaatggccttcgaacacccagctgtgcaagcctatatgctacaacaagcgattgcggcgagcgtcttacaacaaccaattgcccaattgcaacaacaatccttggcacatctaac

SEQ ID NO: 33377 - DNA, 432 bp, Zea mays
  Clone ID: LIB3059-025-Q1-K1-H7
tccaaatctgacgaggagactactgcaaataggaaattggctaaggagctggttgatggatggagtcgaccaatattcaacaagagcacgagatttgaggacatgaagagatatgatgatgaaagagcaccttacaggcggccacaaatgaagaaaccttcatcgagtagctctggaatggaatccagagatgatgatcttgatgctgacttttcacaacgcaagtctgggcaaagtagttcaaggcagcacgcttctaggccggaagcctcgcctttggactttgtcattcgtccacagtccaaaattgaccctgagcagatacgggctcgtgctaagcaggctgtccaagaccagcgtcggctgaagatgaacaagaaattgcagcagctgaaagcgcccaagaagaaaaaccttcaggcgtcgaagctc

SEQ ID NO: 33378 - DNA, 312 bp, Zea mays
  unsure at all n locations
  Clone ID: LIB3059-026-Q1-K1-A3
attcccgggtgggcccacgcgtgcgaggcantcgcagctggcatcttacctttatcacccttgatcctccaacaatgggcaggcctattacagcagtaacctttggatcctatcgggttgaagaatcgggttttcacataccgaagacaccgctggtgagaggtacggtggaagaagggaagctataggagcttgtgagcattgcgggaaaatggtcgcggtagcagcacttgcacaaagaccaaggagcataaggaggcaaaatattttggctgccattgttggtacactattgcgctttctatgttgcta

SEQ ID NO: 33379 - DNA, 332 bp, Zea mays
  Clone ID: LIB3059-026-Q1-K1-B10
cggaattccagctggacccacgcgtccgaggacgcgtaggcacttatgcaggtattgaaagtgatcagtaactcatcttgcaggacgggagtcaaagtcgggctctattcagtgggcattaacaaacgacatgtatacaccaaacgcgagctgactcatggccagtaccacacaaaaggtatagcatccaagaagccgtactatcgtcatttcactaatcacagaggataacaggaatagattttatcataagcgcctcatcacactaactaaggttgtcactgacaatccacatcagatcattgccactagaaacattgctactaacaaca

SEQ ID NO: 33380 - DNA, 452 bp, Zea mays
  unsure at all n locations
  Clone ID: LIB3059-026-Q1-K1-B11
cggtttcggaattcccgggtgcgacccacgcgtcacggtcagctctgcaagcttgaatcatgtgcggagcaccttggcttacgatcctttggtacgcgagagaggacaagggtcaactgcgcctttttacttcaagattggggncttgtcgtcatggggatcgctgttctcgtctgcacaacaggccaactatatcgccaactcttgtgcttgctaacatgtatcagcgccctgatatgataactcctggagttgatgctcaaggccaacctattgatcctgagaagatgcaggagcattttgaggacttctatgaggacatctatgaggagttgggcaagtttggtgagattgagaatctgaatgtttgtgataaccttgctgaccacatgattgggaatgtctatgttcagttcagagaggaagaacaggcagctgcagcatacaatgct

SEQ ID NO: 33381 - DNA, 223 bp, Zea mays
  unsure at all n locations
  Clone ID: LIB3059-026-Q1-K1-B4
ccggcgggacccacgcgtgcgagtgcacaattatgctgnctaataaaaaatatcttgggcatctattctacagggtccgagcctacacactaaaagacacgaatcgacatctcttcactgcagagaccccactcagaatactaagcctactcttacacctccaagacctacacaaacctggcttacaccatcctaatcaacttctacatcatcctcaataacc

SEQ ID NO: 33382 - DNA, 271 bp, Zea mays
  Clone ID: LIB3059-026-Q1-K1-B8
ccggtggacccacgcgtccgctgcccctgctctctggacctcttctcccccaaacaccgcagagatgcagaagggtaggggccaccacaccttgacggccgccccgtcgtcggcgccgtccaagggcaagtcgtcggcgccgaaccctagcggcaaccacgctgcgacgccggcgccatcggggacgccttcaaagggcaagtcggcggcagcgcaggccgcggctttgggccacggttcctcctcccaccaccactctgccggcggtggc

SEQ ID NO: 33383 - DNA, 288 bp, Zea mays
  Clone ID: LIB3059-026-Q1-K1-C12
ggaattcccagctggacccacgcgtacgacgaacagactgctctgagcggcgtcaatgtggataggaatgtaatcggacggatatgactggttccatgtttgttttcatattttctcattgatattaatgcaaatattatcgagttgggcaaaaaaaaaaaaaaaaaacaattaaaaaaaaaaaaaaaaaacaaaaaaaaaaaaaaaaataaaaaaaaaaaaaaaaaaacacaaaaaaaaaaacatataatctaaaaaaaaaaaatcacagcacgtatcattccaaca

SEQ ID NO: 33384 - DNA, 324 bp, Zea mays
  Clone ID: LIB3059-026-Q1-K1-C2
gaattcccggcgggacccacgcgtgcgctccttgtcaataagaagaaacagaggttatcttagcttttgtgaccgcatgggaccgcacctgaggcaatcgttctgctggacagaggtcctagtttgttgggctagtaaatgtaatgttatcttaggtggtacttactaatcgggccagtaatgttgaattctagctggaacgcggtaatgtttgatgcaccgaagtcgcttgcagtaggttccgatggcccaagccaccaaaaacttgtttgctccatgaacctcgcaatcctgttaggtgataatataatatacattgtgttg

SEQ ID NO: 33385 - DNA, 222 bp, Zea mays
  Clone ID: LIB3059-026-Q1-K1-C3
cggttcggaattccgggctcgacccacgcgtgcgcccacgcgtccgtccacgcgtccgccctcgcgtccgccgacacctggtgccgggctaggttctaatgagagtagggatgcacactgcactggagactgcgtagctgctcactttgaacacaaccactaccgatgtggactaaacgtgccatatccaagaaaattgtcaaaccagccctacaagtctca

SEQ ID NO: 33386 - DNA, 455 bp, Zea mays
  Clone ID: LIB3059-026-Q1-K1-D10
ccggtctcggaattccgagctggacccacgcgtgcgaatcgccagccctatctttggtgcagtcattggtacaaaccatcagggcacagcaggtgcagcaactcgtgctacctctgatcaaccaagtagctctggcaaacctttctccctactctcagcaacaacaatttcttccattcaaccaactgtctacactgaaccctgctgcttatttgcagcaacaactattaccatttagccagctagctactgcctactctcagcaacaacaacttcttccatttaaccaattggccgcactgaaccccgctgcttatttgcagcagcaaatactactaccatttagccagctagctgcagcaaaccgtgcttccttcttgacacagcaacagttgctgcctttctaccagcagtttgcggctaaccccgcaaccctcttacaactacaacaattg

SEQ ID NO: 33387 - DNA, 304 bp, Zea mays
  Clone ID: LIB3059-026-Q1-K1-D9
ttctcttcttcccccatacctctcacctgcgttgtcttcagtctgtgaaaaggcaatggttaaaccctacaggatccaacatgcaatcacaacatgcatcttacctttatcacccttgttcctccaacaatcatcagccctattacatcacttacctttcgtgcatatattggcacaaaacatcagggtacaacaactacaacaacttatgctaacaaaccttgctgactacgttcagcaacagcagctacctttggtgcaatagctgtcacaatacatcatggcacaacaactacaacaactc

SEQ ID NO: 33388 - DNA, 380 bp, Zea mays
  Clone ID: LIB3059-026-Q1-K1-E11
ggaattcccggctggacccacgcgtacgcctactcaaccgccccggccttagccttatccccagccacacccatgcccgggccaagagccgtatccaagcccgtgccagatgcacggaacctgcagcgtttgcagcaccccgatcctgggccagtgcgtcaagttcctgaggcatcagtgcagcccgacggcgacaccctactgctcacctaagagccagtcgttgctgaagcagtgttaccagcagctcacgcaggtggagcctcagcaccggtaccaagcgatctatggattggacctgcagtccatcctgcagcactagccgcaaagtggccaggtcgctgagctgttggcagctcatatagcgcatcaactgactg

SEQ ID NO: 33389 - DNA, 282 bp, Zea mays
  Clone ID: LIB3059-026-Q1-K1-E12
aattcccatttcgacctagacctacgcctgcgtctgaatcgtgaacaaccgttgtcatttcatgtgtcgtaccccgtgcaatgcgtggctgcgcatggttgatttctctgtggcaaacttcccgtactgcatggggttgtaagctgtctctaaatttcacggcaagtcatgtgcctgaaccttcatcttaagttgttgtcgtatcccttcgtcttgcttcggttgcaccccgtgatggtatggattggctgctgaccacttgatctaaccaaaagtaaaact

SEQ ID NO: 33390 - DNA, 189 bp, Zea mays
  Clone ID: LIB3059-026-Q1-K1-E3
aattcccggctagacccacgcgtgcgggccaccaatcgagagtcggctgcagcatgagcgtggtaatcataggctcgagcgtggctgcttcggtcgaaaatcccgaccatcctatctatgacatgttcgcacatccatctctgcatggtacctcttcttcagatactccatactctctcaccacctaat

SEQ ID NO: 33391 - DNA, 240 bp, Zea mays
  Clone ID: LIB3059-026-Q1-K1-F1
aatcagtaggcctgaaaccgtacttccatttacgtggctacgcgagctgatttgccggtctgcctctcccatctgtatcctggacatggcagtatggtcacgaagtccagatggcgatatgcctgactgccggtaacggagggcagctgtggtgtagtatatctcagtcacatgggaggcgttagataatttttgaccaaatgttataaaataagacactattaaatagtttttttatat

SEQ ID NO: 33392 - DNA, 419 bp, Zea mays
  Clone ID: LIB3059-026-Q1-K1-F10
gctcgacccacgcgtgcgctgcaagaaactggatgtctacgccatggctgtatacaaagcagaagcttgtagggcccgtgacagtgaacagcaccgacgtttgatgctccatgacaacgccgtacagtccttgacgacaggcgaaacttacatgtgtggactagctataatcgtgccgcgctccctcttgatgaaactgtacccgcaacaccgactcttggtcagctgaccatccgccttgttccttaactgttcacctttagcaggactacagctatgcattagacctgcgtttgctacaagatgttcaactagtgcatgtacatgtatatggatgcccacctcgcgtacgcgcaggtatgttcaattcacagaggaaacacaatagcatgtatgcagtgtttttcttaccacacata

SEQ ID NO: 33393 - DNA, 309 bp, Zea mays
  Clone ID: LIB3059-026-Q1-K1-F3
cccggctagacccacgcgtacgcgcggacaaccagctttccggggacattcctccggggatagggaacctgaccgattggcaggtgctggatatgtcgaataaccgattgttcgggtcagtgcctgcctgacttgcacgctgcttccagcttatggacctgcagcttgtggggaaccagctctttggggcactccttccggagctagacgcactatctagtctcaccgttctagatttgtctaataacaagatctctggggagattcccgtagcgttggctgggtacacgtctttggaggtcgatgact

SEQ ID NO: 33394 - DNA, 64 bp, Zea mays
  Clone ID: LIB3059-026-Q1-K1-F6
cccacgcgtccgcccacgcgtccgaaaaaaaaaaaaaaaaaaaaaaaaaaaaaaaaaaagaaag

SEQ ID NO: 33395 - DNA, 323 bp, Zea mays
  Clone ID: LIB3059-026-Q1-K1-G1
attcccggctggacccacgcgtgcgcgcttctcctccccctccggttccggttcgggtccgagaggttctccggagggcgggggcgtgcgtgagcgtatcgagatggcggcgtctgatgttgagataccgcttgattgtccgccgtctcacctgtgccacggacgaccactctctccacaacgcctttagcacctacagtgaggtcctcgactccaagatcatcctcgatcgggagacgcagatgtaccgcggcttccgcttcgtcaccttcttcacgggagacgcgatgcggaacgccattcgagggcatgaacggcaagga

SEQ ID NO: 33396 - DNA, 299 bp, Zea mays
  Clone ID: LIB3059-026-Q1-K1-G2
tgctcctagttccattattccacagtttctcccaccagttacttcaatggccgtcgagcacccagctgtgcaagcctataggctacaacaagcgattgcggcgagcgtcttacaacaaccaattgcccaattgcaacaacaatccttggcacatctaacaatacaaaccatcgcaacgcaacagcaacaacagttcctaccagcactgagccacctagccatggtgaaccctgtcgcctacttgcaacagcagctgcttgcatccaacccacttgctctagcaaacgtagttgcaaacc

SEQ ID NO: 33397 - DNA, 412 bp, Zea mays
  Clone ID: LIB3059-026-Q1-K1-H12
cgccacgcgtccgttgcaagattgtctcaacaactatggttatgcgatcagtacgtgccagctgggcctggtcatgctgaacgagtgccctcgcgttggagcgcctgtctaagctgctctctagcattattcatgcgatgctgttttcgaatgggtatctcattaataagacacctatgaaactactaccatatacacaccttgaaaccaaactttctgagattcattaccttctgatatcctatgctgatggaacatactctggactcttcaccattcatacttacaccatcctgtgatcttggagtaacaacttctactttggcgaccgttctagatgatccaaccttacgtacgcatccatgcttaatgctacctcttctatactgtcacctaaatctaattcaatagc

SEQ ID NO: 33398 - DNA, 75 bp, Zea mays
  unsure at all n locations
  Clone ID: LIB3059-026-Q1-K1-H4
accgtccggaatcccgggtcgacccagcgtccgcccacgcgtccgnncactcctttcggttagctcagccggacg

SEQ ID NO: 33399 - DNA, 348 bp, Zea mays
  Clone ID: LIB3059-026-Q1-K1-H6
cgacgccacgcgtccgtccacgcgtccgaatacaaacagtttcaaggtcatccttaaaggaaggaaaaggaaggtgtgggagagtatcatgggcactattggaccacatgtactcatagttgatgacacctttgttgatcgccttgtggcatctcgagttttgaagacttgtaacattcaagtgacaatggtggagggcccaaagcaagccttagattttctagatgtggagaatgatgtaaatttgattctgaccgattattgtatgcctggtatgactggatatgatctcctaatggaggtgaaggaatcaccaaagctgaagcacatgaggagtattggtcatgt

SEQ ID NO: 33400 - DNA, 375 bp, Zea mays
  Clone ID: LIB3059-027-Q1-K1-A1
aagcaacatagaaagtggaatccagtagcaacaatagagcaacaatggcgaccaagatgttgtccctccttatgctccttgctctttctacatgtgttgctaacgcgacaattttccctcaatgctcacaagctcctatagcttcccttcttcccccataccttccatcaattatagcttcaatatgtgaaaacccagctcttcaaccatataggcttcaacaagcaatcgcagcaagcaacatacctttatcgcccttgttgattcaacaatcgccagccctatctttggtgcagccattggtacaaaccatcatggcacaacagctgcagcaactcgtgctacctttgatcaaccaagtagctctggcaaacc

SEQ ID NO: 33401 - DNA, 442 bp, Zea mays
  Clone ID: LIB3059-027-Q1-K1-A4
cggtccggaattcccgggtcgacccaagccttccgcggacccttggaatgggttgcgatgccccgtattgattcctaaggtccaggtcctcgggcgattgccttcccaaatacctgttgtccttaagggcagggttaaaccgacctatcccccacttgtcaaaaatggagacatgtgcattgtacttaatgcacaggatatcagtgttacatgaaggaaaatgaccgataagatttactattggcatacacggtatgttggccatttgaaggaaaggaggctcaaggaccagatggagaaagacccaactgaagtgatccgcaaagctgtgttgcgcatgcttcccagcatcatactgcgtgatgatagggatcgcatgctgaggatattttctggaaacgaacatccattccatgaccgccctatggaaccttatgtgatg

SEQ ID NO: 33402 - DNA, 329 bp, Zea mays
  Clone ID: LIB3059-027-Q1-K1-B5
tagcaacatagaaagcacaatagtgtaccaacaatggtagccaaaatattttgcctcgttatgctccttggtctttctgcaagtgctgctacgacgaccattttcccgcaatgctcacaagctcctatagcttctcttcttcccccatacctctaaccagcgttgtcttcagtatgtgaaaacccaattcttcaaccctacaggatccaacaggcaatcacagcaggcatcttacctttatcacccttgttcctccaacaatcatcagccctattacatcaattaccttcggtgcatttattggccacaaaacatcagggcacaacaac

SEQ ID NO: 33403 - DNA, 162 bp, Zea mays
  Clone ID: LIB3059-027-Q1-K1-C1
attgctgccattcaaccaacttgctttgacaaacccaacagcattctaccaacaaccgatcattggtggtgccctcttttagatttcttatgagttatagttcaataataaagttttttgtctgatgtttgtggcttcccagaaataagaaagtacatttct

SEQ ID NO: 33404 - DNA, 277 bp, Zea mays
  Clone ID: LIB3059-027-Q1-K1-C9
tcgatactatggttggacttgtgaatgttgtttccatactggatgttaggttttatatgcgccctacggtgacctgccgttaaggcaaagaacttatttgcaagtctgagcactattttggggggtggggtggggggtgcgttgtttttataactgtcttttttcccatagttggaagttttcttactcaattgaatgaacgagggaacttattgcatactatcaaatgttttgtgatatggtgttgagtaattatcaacaccttggattttaaaaa

SEQ ID NO: 33405 - DNA, 444 bp, Zea mays
  unsure at all n locations
  Clone ID: LIB3059-027-Q1-K1-D11
cggattcccgggtcgacccacgcgtgcgnccgacgcaacccttgcgtggtggcgtcaccacccaaatcccaccatccggatctggggagccgccgtcgccatgtcccgctcggagcgccgtctcgcctcggccgtggtgcgccttcccggccgctccagggtctccgtctcgccatccccgcgccgacgctcccagtccccatccccgcgccgcgaccgccgccgccgcgaccgctccccgatcccttaccgcgatcgctccccaagtccatatcgagcccgtcgtcgtgaccgatccccgagcccttaccgcgatcgccgcgaccgctccccgagcccttatcgcgatcgccgccgccagtggtcaccctaccacaacgaccgcggccgggaccgtgaccgggtcctgcccgtccgtagcggcagaggcgcctggtccgatga

SEQ ID NO: 33406 - DNA, 428 bp, Zea mays
  unsure at all n locations
  Clone ID: LIB3059-027-Q1-K1-D3
accaacccgtccgtagcaccatagaaggcacattagtgtaccaacaatggcagccaaaatatttggcttcgtggtgctccttggtctttctgcaagtgttgctaccgcaaccattttcccacaatgctcacaagctcctatagcttcccttcttcccccatacctctcaccagcggtgtcttcaatgtgtgaaaacccaattgttcaaccctacaggatccaacaggcaatcgcaacaggcatcttaccattatcacccttgttcctccaacaaccgtcagccctattacagcagttacctttggtccatttggtggcacanaacatcagggcacaacaactacaacaacttgtgctagcaaaccttgctgcatactctcagcaacatcagtttcttccattcaaccaactggctgcattgaactctg

SEQ ID NO: 33407 - DNA, 320 bp, Zea mays
  Clone ID: LIB3059-027-Q1-K1-E2
tccaaatccaagcaaattgggcgtccgagtttctgactgatgaagatataaccgaagggcacggataccagcttaacgtcgacagtgttacggacttgaggcttgagatggcctttccagctcaaccagtctgttgcagacttgtagctttgggtgtacatagtttatcctttttttcatagggtagaaaggaaagcgtaattatccttcgcaaaagctgttaactgtgtattgaggcagcttatgtcaatatgtactatacctgttggtatcgattgttttaatgattcaaggcatttgattggtaaaaaagatgcaac

SEQ ID NO: 33408 - DNA, 116 bp, Zea mays
  Clone ID: LIB3059-027-Q1-K1-E4
attcccggctctacccactcgtcctctcacacttaatcatacacatcatcattatatataaaaaaacaaaaaaataaataaaatggaagtttttaaaaaattataaaacatctaat

SEQ ID NO: 33409 - DNA, 150 bp, Zea mays
  Clone ID: LIB3059-027-Q1-K1-F7
ttcccggctcgacccactcgtcctcccactcatactaaaacacacaactcttttatctaaatcaataattaacatactgctgaccatcacaactatttaattaactcttaatcaaatacaatctacatacaacaatacaaacaatcaata

SEQ ID NO: 33410 - DNA, 254 bp, Zea mays
  Clone ID: LIB3059-027-Q1-K1-F9
cggacgcgtgggatctaggtttaccaccttttcccattgcgtatggtctctgctggtgaagttgaaaaataatgtatctgaaattattcacagtgcttttcttttcgagatagcaaaatgttgtgaagagatttcacccaatcaatgaaagaaaacatgtatcttgttgatggctatagtggtttgaaaacaaatcgtccataaaaaaaaaataaaaaaaaaaaaaaaaaaaaaaaaaaaaaaaacaacaaaaa

SEQ ID NO: 33411 - DNA, 263 bp, Zea mays
  Clone ID: LIB3059-027-Q1-K1-G4
ggaattcccgggtcgacctacgcgtccgcttggctaaagaactacttccgtgatctgatatctaccccagagttcaaataactaggggggagtccgaatcctatgtatttcttcaagacattagtgatgggaatctaaccttattgttgtgttgtgggtaggccagccaagcgcctattgcttgagaacaacagcttggcaagtgacaatgtgcaatattgccagaagttctttttgaagcgccataattattctcctacgtc

SEQ ID NO: 33412 - DNA, 395 bp, Zea mays
  Clone ID: LIB3059-027-Q1-K1-H12
ggtttcggaattccgcgggtgcgacccacgcgtcgcgcccacgcgtcacgaatccatctttactatctcgtggtaataaggcaagcttgagcatcgttccttatggcggcgatgaagagcagcacaatggtcacccttctattggctgttgccattctgtcctcactgtcttcatgctacgaagccggcggctgcattcgtaaacacactaagtcaccagtcgccgccgagaatgccatacttctcgtcctattccgaggagcaccagaactgccgcttgatctgtaactccaagggtttcaaggacagtggctgttgtgacgaaagcgtggagcacaaagtgtgctgctgctcccattagaaatataatagcctatgttaagttgatgcatata

SEQ ID NO: 33413 - DNA, 237 bp, Zea mays
  Clone ID: LIB3059-028-Q1-K1-A4
cccacgcgtccgtaccgcaccaaccccttgtgggcgtctcccgttgcatttccgccctactgctgattcatgatattggggaaaactcctctatccatctctctctatctatatatgtaataatgcagtaagacgacacacattatcatgtgtggtatgaccaataatatatgcatggtcataataaagttttggttttaatgaatctatcggccgcttgatgtctatgatggacaa

SEQ ID NO: 33414 - DNA, 142 bp, Zea mays
  Clone ID: LIB3059-028-Q1-K1-B5
tgtttgttttttattttttttttttttgtttttttttttttttttttaaaattttttttttcccgaaaaaaattttgtctttcaccaaaatttttggactctaacccgcatatctatcttctcactcacagagctttttttt

SEQ ID NO: 33415 - DNA, 385 bp, Zea mays
  Clone ID: LIB3059-028-Q1-K1-B7
ccggtttcggaattcccggctgcgagccacgcgtccgagctactgcctactctcagcagctacaatttcttccatttaaccaattcaccggactggacccctgtgcttatttccagcagcaaatactactaccatttggccagctagctacaacaagccccgcttccttcttgacacaacaacaattgcttccgttctaccagcaatttgtggctaaccccacaacccttttacaacttcaacaattgctgccctttgtccaacttgctttgacaaacccaacaaccttttaccaacaacacatcattggccgtgccctcttttaaattgcttattaactgccattcaataatgaagttttctggcttgatgtatgtagcctcct

SEQ ID NO: 33416 - DNA, 446 bp, Zea mays
  unsure at all n locations
  Clone ID: LIB3059-028-Q1-K1-C1
cggtccggaattcccgggtcgacnacgcgtccgcccacgcgtccgcccacgcgtccggaattaccggtgtgctataccaaagctgaacaaggaaattgttcctgagaaatgtaaggttgtggtgaaaccaaccagggttgttgttactcttttcaagggttctaaaggcaactggttagacttgcacttcaaggaagacaagttcaagccaaacatggacaaggaaaaagatccgatgtcaggaattatggacttaatgaagtacatgtacgaggagggcgacgaggatatgaagcgcacaatagccaaagcttggtctgatgccaggtctgggaagacgactgattcgatgagcggattacgttgagctggtataatcagttgatgggcttaagttttctgcgctagcccctgcagccgaagtgtttctgatggttcanatagcg

SEQ ID NO: 33417 - DNA, 375 bp, Zea mays
  unsure at all n locations
  Clone ID: LIB3059-028-Q1-K1-D1
tgaaatgctcgcaaggtttggtggagatagtcacgccagatcccaacccaaaggggctgacctttgaaaccggggttcaaatggtggggattaagaaccaattggttgttgaagggaaggttgcccaaatgtccctttccaagaaattgttgaaaaatacataacctattcctaacttgatggggttcccaaaaatccttgatgccgattctagacaagaataacccatggttatgcttgaactccgncgtgaatccccttcatggccaaggggttccttattgcagtaaggcatatagagtcaatcatccggatgtcggaggcacatgcaaggatgcatctgangagctacgtgtctcaggaagatgttgacat

SEQ ID NO: 33418 - DNA, 62 bp, Zea mays
  Clone ID: LIB3059-028-Q1-K1-D11
cggacgcgtgggaaaaaaaaaaaaaaaaaaaaaaaaaaaaaaaaaaaaaaaaaaggagggaa

SEQ ID NO: 33419 - DNA, 354 bp, Zea mays
  Clone ID: LIB3059-028-Q1-K1-D2
acgcacgcgtccgtgggatcctcgcaaggtttgttgtagacagtcactccagatcccagccgaatgcggctgtacgtctaatacaggtttgtgactgatgtggatgatgatccactggctgctgcacagcaagctgacccagatgtcctttcccaagacatgctgaacaaatacataacctatgctaatctgaatgtgtttcccaaaatacatgatgcccatctagacaagattaaccatgtttatgctgaacttcgtcatgaattctctcatggccaagtagtgtctattgcaataaggcatatagagtcaatgatgcggatgtctgatgcacatgcaacgatgcatttaaag

SEQ ID NO: 33420 - DNA, 64 bp, Zea mays
  Clone ID: LIB3059-028-Q1-K1-E1
aaagaaaaaaaaaaaaaaaaaaaaaaatttttaaaaaaaaaaaaaaaaaaaaaaaaaagagggg

SEQ ID NO: 33421 - DNA, 60 bp, Zea mays
  Clone ID: LIB3059-028-Q1-K1-E11
cggacgcgtgggaaaaaaaaaacaaaaacacataaaaaaaaaaaaaaaaaaaaaggaagg

SEQ ID NO: 33422 - DNA, 404 bp, Zea mays
  Clone ID: LIB3059-028-Q1-K1-E6
cccacgcgtccgcccacgcgtccgaagcaacatagaaagtggaatccagtagcggcagacagagcaacaatggcgaccaagatattttccctccttatgctccttgctctttctgcatgtgttgctaacgcgacaattttccctcaatgctcacaagctcctatagcttcccttcttcccccataccttccatcaatgatagcttcagtatgtgaaaacccagctcttcagccctataggctccaacaagcaatcgcagcaagcaacatacctttatcacccttgttgtttcaacaatcgccagccctatctttggtgcagtcattggtacaaaccatcagggcacagcagctgcagcaactcgtgctacctgtgatcaaccaagtagctctggcaaacctttc

SEQ ID NO: 33423 - DNA, 414 bp, Zea mays
  Clone ID: LIB3059-028-Q1-K1-F11
ttctgccgtctccaccgccgccgcagccagcgtcaccggagggatctgccgtctcccgtgctccacgcgatgaacaccgacatcaccgcctcgactaagccggagtacccggtggtggatcggaacccggccttcaccaaggtggtcggcaacttctctgcgctcgactacatgcgcctctccaccatctccgccgtctccgtcaccgttggctacctctccgggatcaagccggggatccggggcccgtcgatggtcacgggcggcctcatcggggtcatgggagggttcatgtacgcctaccagaactccgccgggcgcctaatgggattctttcccaacgacgccgaggttgcgcgctacaagcacaagcttcattgaggatccagctccattccgtctctcttttcgcaa

SEQ ID NO: 33424 - DNA, 413 bp, Zea mays
  Clone ID: LIB3059-028-Q1-K1-G1
cccacgcgtccgcccacgcgtccgcccacgcgtccgtagcaacatagaaagcacaatagtgtaccaacaatggtagccaaaatattttgcctccttatgctccttggtctttctgcaagtgctgctacgacgaccattttcccgcaatgctcacaagctcctatagcttctcttcttcccccatacctctcaccagcgttgtcttcagtatgtgaaaacccaattcttcaaccctacaggatccaacaggcaatcacagcaggcatcttacctttatcacccttgttcctccaacaatcatcagccctattacatcaattacctttggtgcatttattggcacaaaacatcagggcacaacaactacaacaactcgtgctagcaaaccttgctgcctacgctcagcaacagca

SEQ ID NO: 33425 - DNA, 436 bp, Zea mays
  Clone ID: LIB3059-028-Q1-K1-G5
tattgagaccaactagcaacatagaaagcacaatagtgtaccaacaatggcagccaagatattttgcttccttatgctccttggtctttctgcaagtgttgctaccgcaaccattttcccacaatgctcacaagctcctatagcttcccttcttcccccatacctctcaccagcggtgtcttcaatgtgtgaaaacccaattgttcaaccctacaggatccaacaggcaatcgcaacaggcatcttaccattatcacccttgttcctccaacaaccgtcagccctattacagcagttacctttggtccatttggtggcacaaaacatcagggcacaacaactacaacaacttgtgctagcaaaccttgctgcatactctcagcaacatcagtttcttccattcaaccaactggctgcattgaactctgctgcttat

SEQ ID NO: 33426 - DNA, 176 bp, Zea mays
  Clone ID: LIB3059-028-Q1-K1-G8
gtggttattatattttttttaattatttttatttttttttttaatttttttataaaaaaaaaaaaataaaaaaaattaaaataaaaaaaaaaaaataaattaaaaaacatatattacataaaaaataacttaaatatatcaaaacttaattattaaaccatataacttaaaaaata

SEQ ID NO: 33427 - DNA, 451 bp, Zea mays
  Clone ID: LIB3059-028-Q1-K1-G9
taccggtctcggattcccgggtcgacgacgcgtccgatctgcccttgccgccgactgctcactcctctccggtccgctccactccgaatggccggcacgaagcagacggcgcgcaagtcgaccggcggcaaggcgccgcggaagcagctggccaccaaggcggcgcgcaagtcggccccggccacgggcggcgtgaagaagccgcaccgcttccgccccggcaccgtcgcgctccgcgagatccgcaagtaccagaagagcacggagctgctcatccgcaagctccccttccagcgcctcgtccgcgagatcgcgcaggacttcaagacggacctgcggttccagtcgtcggcggtggcggcgctgcaggaggccgcggaggcgtacctggtggggctcttcgaggacaccaacctctgcgccatccacgccaagagggtcaccatcatgc

SEQ ID NO: 33428 - DNA, 412 bp, Zea mays
  Clone ID: LIB3059-028-Q1-K1-H11
tagcaacatagaaagcacaatagtgtaccaacaatggtagccaaaatattttgcgtgcgttatgctccttggtctttctgcaagtgctgctacgacgaccattttcccgcaatgctcacaagctcctatagcttctcttcttcccccatacctctcaccagcgttgtcttcagtatgtgaaaacccaattcttcaaccctacaggatccaacaggcaatcacagcaggcatcttacctttatcacccttgttcctccaacaatcatcagccctattacatcaattacctgtggtgcatttattggcacaaaacatcagggcacaacaactacaacaactcgtgctagcaaaccttgctgcctacgctcagcaacagcagttacctttggtgcaattgttggcacaaaacatc

SEQ ID NO: 33429 - DNA, 467 bp, Zea mays
  Clone ID: LIB3059-028-Q1-K1-H5
accggtcggaattcccggctcgcccacgcgtccgacctactgtacatataagtacttttgatggccaacctgtctcccatatgaggtggcctatttatgctagacggcctgtctgtgagtactgcttcctaaaccgtaaatccgctcatgttacattcagctatccataataccttcaagattcacatattgccatgaacagattccatatgcagagacctgattatggaggcctataacatcccattggattgcagcattcagacaccaccttaataaggttctacttaggcaacatccagaaccgtcattcttttgagaagcctgggacgattaacgactcaagctatgaatactctttacctgcgacgacttgtgctcacgatatgaagcagctatgctccacaagcagtctttcggtgatgtacatggagctcttgcatagagtagtgtatgtggcaattatc

SEQ ID NO: 33430 - DNA, 361 bp, Zea mays
  Clone ID: LIB3059-028-Q1-K1-H6
acccacgcgtgcgcccacgcgtccggaagtctgctgactgctatagcttcattcaaaaggaagaaggaaagaaaaaactcaacggttacatcataaatgatccctcacagactgttccttgttctgctctgaataaaaggttggagtgatggttctcttcctaggtagtcggttattatctccaggggatctttatctttctttttttcctttttgaatgaagctatagaaggtctgctgactgtctcgagatatttacttttcgtaacagactgataagtctgatctttgagccattctgttttccgacgtcatttgtttgaccatttagttaagctggaatacaaaagatatcgctaac

SEQ ID NO: 33431 - DNA, 453 bp, Zea mays
  Clone ID: LIB3059-029-Q1-K1-B7
cggttcggaattcccggctggacccacgcgtgcgtggaagccaaatcaagaggtgatgatgtcttcagaagaaaggactaccttgtaggggggcatgcttatacgcaggctacagagttggacccaactgatgcaacagtgctctcaaacagaagcctgtgctggctgcgggcagggcaagctgagcgtgctctggaggacgccaaagcatgccgtgcattgagaccagattgggcgaaagcctgctacagggaaggtgcggcgcatcgtctgttacagaggtttgaggaagccgcaaacgccttctatgagggggtgcagcttgagccggagaacacggagctcgtcaacgcattcacggaggccatcgaagccgggaggaagttccatggcgtgaacacgccaaactcaacacaatgagactttgctgatagggtggataggtagatgatg

SEQ ID NO: 33432 - DNA, 199 bp, Zea mays
  Clone ID: LIB3059-029-Q1-K1-B9
gaattaccggcccgacccacgcgttcgcagggcagcccgacggcgacgccctacttgtcttctcagtgccagtcgttgcggcaaagttggtgccagcagctcaggcaggtggagccgcagcaccggtaccaagcgatcttctgcttggtcctccagatcatcctgcagcagcagccgcaaaacggacaagttgcggggc

SEQ ID NO: 33433 - DNA, 80 bp, Zea mays
  Clone ID: LIB3059-029-Q1-K1-C11
attcccgggctcgacccacgcgttcgacaacccgttcaagaactccttcgagatcgggttcgcaaccctggtgaactaca

SEQ ID NO: 33434 - DNA, 95 bp, Zea mays
  Clone ID: LIB3059-029-Q1-K1-C3
ctgtcgatttaaaagatcctagctttcctacgcgttcatgcgacggcatagctcttgtatactgtcacctaacaataattcactccccgtggctg

SEQ ID NO: 33435 - DNA, 441 bp, Zea mays
  Clone ID: LIB3059-029-Q1-K1-D2
cgcgtccggcgcgctccctcactctcctccgaaccatcgttcacgtcccagcctccccggacttggggcagaagctgcagcgtcgagatggtgaaggggcgcacggggcagcgcgtgaggctctacgtccggggcaccgtccttggatacaagcggtccaagtcgaaccagtacgagactacgtcgctggtgcagatcgagggggtgaacaccaaggaggacgtcgcgtggtactgcgggaagcggatggcctacatctacaaggccaagaccaagagcagcggcacccactaccgctgcatctggggcaaggtcgcccgcccgcatggcaactccggcgtcgtccgcgccaagttcaggtccaacctgccgccggaatccatgggccgtaaggtcagggtgttcatgtaccccagcagcatctaaagataatctgaatgt

SEQ ID NO: 33436 - DNA, 423 bp, Zea mays
  Clone ID: LIB3059-029-Q1-K1-D9
gaattcccggctcgacccacgcgttcgcggacgcgtgggcggacgcgtgggcggttcgcgtgggcggacgcgtggggtcaccaacggaaagtgcaccaagaaatccatcgagaggccgtcgacaggggaattaatggcgtcgtcgtctagcagcagccaccgccgcctcatcctcgcagccgccgtcctgctctccgtgctcgcggctgccagcgccagcgccgggacctcctgcgtgccggggtgggccatcccgcacaacccgctcccgagctgccgctggtacgtgaccagccggacctgcggcatcgggccgcgccttccgtggccggagctgaagaggagatgctgccgggagctggcggacatcccggcgtactgccggtgcacggcgctgagcatcctcatggacggcgcgatccc

SEQ ID NO: 33437 - DNA, 409 bp, Zea mays
  Clone ID: LIB3059-029-Q1-K1-E10
gacccacgcgttcgaacacgcacaccacctcaccatacacctcttctcttctaccagtagttcattcattaggagtgcggtaccgggttggagtaattaaaaggccaccctccactcgcaccaccacactttagctccccactgctataggcagcccacatgcgcgcacactcctaagctagctatagcagcaaggcagccagctgagctcagagctcccagtccagcgccggcgccaccaccgcagctgctcgctggtcaccatgagcaaggagaagcaccaccgcgactggatcctccggcgctgctgcggctccatcaccgactgcatactgaatctatgcatatttgtaagcttgatagggctgataatgtacctagcgctgccccccttcaagccgaacttcta

SEQ ID NO: 33438 - DNA, 451 bp, Zea mays
  Clone ID: LIB3059-029-Q1-K1-F10
ggaattcccggctcgacccacggtccggcaacagccatccttagtgcatctgtatctccaaagaatcgcggcacaacaactacaaggacagttgctaccaacaatcaatcaagtagttgcagcgaaccttgttgcttacctcgagcaacaacagtttcttccattcaatcaactagctggggtgaaccctgctttctacttgcaggcacaacagctactaccatttaaccaacttgtcgggagcccttatgccttcttactgcaacaacagcttctgccattccatctgcaagctgtggcaaacattgctgctttcttgagacaacaacatttgttgccattttacccacaggttgtgggaaacattaatgccttcttgcaacagcaacaattgctaccattctacccacagaatgcggcaaacatttgtgcctttttacaacaacaacaa

SEQ ID NO: 33439 - DNA, 373 bp, Zea mays
  Clone ID: LIB3059-029-Q1-K1-F12
cggattcccggctcgaccgacgcgtccgatcaaaatcactttgcgtgcagcatcgattgggtcggaaatcgacggtttggtaagcgagagcgccgccggtgacagctgacagggacgagatggacgccggcggaggcggcgtcttggtcgccgttctctgcatgctgctggtcttcgccatcttccccctcctcctctggcgccgtcgctccgatgccggcaccgccgataaccaccgcgtgccggcccagcccctccacgaggatcaggtgctgcacggtcgctcgtcggcgcgacggatgcgtcggaggcctggggctgccggagcaagctcctctactgcgtcaactagccccaatgctgtagaagacga

SEQ ID NO: 33440 - DNA, 205 bp, Zea mays
  Clone ID: LIB3059-029-Q1-K1-F3
cccacgcgttcgggtaattcagccgtatgttgctatgctggttgagatttactcgtgagccagagtttttctatcttatatcctgaatttgttatcccaaagtttcctggctttttaactattttgttgttacatgttgatattgctttgttcaaaaaaaaaaaaacaaaaaaactacaaaaaaaataaaacgaaaaacatatac

SEQ ID NO: 33441 - DNA, 63 bp, Zea mays
  Clone ID: LIB3059-029-Q1-K1-F9
acccactcgttcgggtatgaccaataatatatgcatggtcataataaagttttggttttaatg

SEQ ID NO: 33442 - DNA, 375 bp, Zea mays
  Clone ID: LIB3059-029-Q1-K1-G12
tcccggctcgacccacgcgtacgatgtggttgacatggagacggtgtcaatcgagaacctcagacggctgttcatgtacagaagggagctgcctctgattgtcccagacatcatcttcagtgcgtatgatttccacatcaaatgactttccacgctaccttcccgacgaccttcagccagtgcccagctccagttaatcttatgcccccatgtcctccattttcatgctttgctcaagcttttggaagtgcctgaactgatttggaaccgcaagccttccagtggtgctttagaaacttgtttagtgcctgcatgcatccctaatcatatgcagacactctgtacatatctgacttggctcagataatatgggac

SEQ ID NO: 33443 - DNA, 345 bp, Zea mays
  Clone ID: LIB3059-029-Q1-K1-G6
ggttcggattcccggctcgacccacgcgtgcgcccacgcgtccgctctgggcagcgtgcgcacgtggggtacctagctcgctctggtaggctaccatggctgatcaccaccggggtgcgacgggaggtggcgggggctacggcgacctccagcgcgggggcggcatgcacggcgaggcgcagcagcagcagaagcagggcgccatgatgacggcgctcaaggccgcgacggccgcgaccttcggcgggtcgatgctggtgctgtccgggctgatcctggccggcaccgtgatcgcgctcacggtggccacccccgtgctggtgatcttcagcccggtgctggtgc

SEQ ID NO: 33444 - DNA, 327 bp, Zea mays
  Clone ID: LIB3059-029-Q1-K1-H10
tcccggctcgacccacgcgtacgggttggcttctactacccctgcgggtcgggttcgggttcgtgaggctctccgggttgggatgcgtgcatgaccggatcgagatggctgcatcagatgttgagtaccgttgattcgtcggcggcctcacctgggccacggacgaccactagctacacaacgccttcagcaactacggcgaggtactagagtccaagatcatcctcgatccggagactcataagtccgccgattatgctacgtcaccttctccacggaggaggcgatgcggaacgccatagacggcatgaactgcaaggagctgga

SEQ ID NO: 33445 - DNA, 388 bp, Zea mays
  unsure at all n locations
  Clone ID: LIB3059-029-Q1-K1-H3
cggaattcccgggtcgacccacgcgntccgtccacgctgtacanttggacaccagacgtactatgtctcgagagcggagatatcatccatctatgggaggacaacatgcgcctagtccgttcaatatcattatgcagctccaagttcctatcgcatgatgttcagactgttagacgaagaaccgctgatattgtgatagtgaattggtcagatgaaaatgataagctattgcaacaacacatcacatatacattgcctattacatgctgctatgaagatgctaactatgagtggatcaacatcagccactgctctgttagagctttcgtagacctgtaagaaacgaaggcagcatcagctgatcatggaccacgactgaaatctctct

SEQ ID NO: 33446 - DNA, 81 bp, Zea mays
  Clone ID: LIB3059-029-Q1-K1-H4
aaaaaaaaaaaaaaaaaaaaaatttaaattaaaaaaaaaaaaaaaaaaaaaaaaagaaaaggaaaaaaaaaaaaaaaaaaa

SEQ ID NO: 33447 - DNA, 342 bp, Zea mays
  Clone ID: LIB3059-029-Q1-K1-H7
cggaattccgggtcgacccacgcgttcgtgattcctctgatgctgcggctgcacaagctctacgtacagaccaaagacggggctgcgaaccggtttgcatagttgtgggttctcacgttaaccctagtgactctatggtggatacttgatcctattttttgctagaagctttcgcattgacctgtcaacccgctaggtcacgcctggtgtcatgtgcttctgggccttaacttataccatgcggacacactgctaatggtttgttagtctcagcagcgcatgctgctagcacgaatccccttacctgttggaaatctggcttacgtcatggcacagaaacca

SEQ ID NO: 33448 - DNA, 442 bp, Zea mays
  Clone ID: LIB3059-029-Q1-K1-H8
tatgcattggtttggccaggatacagtacagcccctcctagctgtaggttgcccatggagcatgaagcgcctccggtgttccattagaggccaaaaactgaatcaaccacagtgtactatgtaagtcttgcggattgactactcgggtgcattagtttggcagataatcttaaagaaggctatcatgtgggtgcaagaaacattcacattcatatacatcagctgcggattaccgcgtaccgcgatgggttcaggactcagggagaatgctcattgtgaccaatctccagcaacgtcatatatatccgttctttacagttttctctaaaagtttttgtcctctatatctcttctctcttcaacaatgttctctatctcgttctctatacataaatacatatgttctatatacataaatgcatatgttagagatatattttgg

SEQ ID NO: 33449 - DNA, 416 bp, Zea mays
  Clone ID: LIB3059-030-Q1-K1-A12
cggaattcccgggtcgacccacgctccgctgaataatatctccacaattaacacggacttagatattgaagcctctggtggatacgatgatgacctgattgccagactgttgaagctcgggtgttgcaaaaataaggaaatagctgttaagacagtcaaaaccatcaagttcttgggactacatgaagagactcaaatacctaagggttgttcgagcccatttgatgtgatttgccagcgaatggaacagaggatggcctatggccacaatgagcaagacatggtactgctccaccacgaagtcgaggtggaatacccggacgggcaacccgccgaaatgcaccaagcgacgctactggagttcgggaaggttgaaaatggcaggtccaccactgccatggcgctgaccgtcggca

SEQ ID NO: 33450 - DNA, 382 bp, Zea mays
  Clone ID: LIB3059-030-Q1-K1-A5
tagcaacatagaaagcacaatagtgtaccaacaatggcagccaaaatattttgcttccttatgctccttggtctttctgcaagtgttgctaccgcaaccattttcccacaatgctcacaagctcctatagcttcccttcttcccccatacctctcaccagcggtgtcttcaatgtgtgaaaacccaattgttcaaccctacaggatccaacaggcaatcgcaacaggcatcttaccattatcacccttgttcctccaacaaccgtcagccctattacagcagttacctttggtccatttggtggcacaaaacatcaaggcacaacaactacaacaacttgtgctagcaaaccttgctgcatactctcagcaacatcagtttc

SEQ ID NO: 33451 - DNA, 320 bp, Zea mays
  Clone ID: LIB3059-030-Q1-K1-B2
cccacgcgtccagccacgcgttccgtttgaggccaagcgcgccaagagcaaggctaggcctgagaagaaaatcgctaggaaggaaggaaagttggcccaaggtccacgagaaataacaccacctgtctaatcacagctccaactactggggcaccgaagaaagcaaagaagtgaagtattgaaataaagctgtagctttctagtccagtactgcactttcttttataagctctagtcaaattttggagcgcctgaactgttttgctgttatataacttagtgtattgataaattcgactatcacatctggattattctaa

SEQ ID NO: 33452 - DNA, 204 bp, Zea mays
  unsure at all n locations
  Clone ID: LIB3059-030-Q1-K1-C2
ggaattcccgggtcgacccacgcgntccgaaacacatacgaacacgcgtataaaattttaacggaagaagctaaaaaaaaccacaggggcggtaacgcatccaggttaagtaaccagggctgccgctttaaaggatccaaattaagtcagccatacttacgacgttagacctctgttatacgagcgcacctaaaattgaaataa

SEQ ID NO: 33453 - DNA, 406 bp, Zea mays
  Clone ID: LIB3059-030-Q1-K1-C7
taatgttggcgctcttttaagcatagatgagagcctaatgtgttcatttcagatcctgaagccaactgatatgggtccaccgcatgcaagaaaacaaattccaaataagccaacaagagggtgaagccttggaccagcatccaatacttccagttccagtatcatgatgatcgtcagtcagctcaaagggggtgatctgttgtttggatagttggatccaccagggcctgacattagacatccatcagccaattaatccctttagccaccctttactcgtgtcttgggaggcggcttggctgtaaaggatattctgtacagcatttagttggattcaacacatcatctgttttactggtcttcctgccggcaagggacctcattggcagcatgacatacaatagat

SEQ ID NO: 33454 - DNA, 335 bp, Zea mays
  Clone ID: LIB3059-030-Q1-K1-D11
tccggaattccggtcgaccagcgtccgccaccgtccgcccaccgtcgcggaccgtggcgtgcggagcacgacggccagggcagaccacagttccgggcccctgcttcgcggtcaactggccacatctgcaaaacccagggttccccggcggcaggtgccgcggcttacgcgcgatgttctgacacaacactgccactgattcgtcgccagcggcggctgcgtcgcatcatcgcgccgtagcgaccagaccattctcatgcatgaataacaaggcgtgccgttgtgatgccaaatgatactatcgtcagagccgaacggctatcgagctcaactat

SEQ ID NO: 33455 - DNA, 143 bp, Zea mays
  Clone ID: LIB3059-030-Q1-K1-D9
ggaagggaacccgggcatagcattctctctgtttatttaaacttctttcatctcgctggtttggttaatttgtactattggtggtttgtaagattggcttatgtgattcaatttatgcgcctgccgctgttgatactgcaaaa

SEQ ID NO: 33456 - DNA, 351 bp, Zea mays
  Clone ID: LIB3059-030-Q1-K1-E10
tcccggctcgacccactcgtccgagaaggtagcaatgtcgtgaagcgtacgtgaactggaaacggatggacaagtatatgtgcaggttgatgtggtgtttccggatcgtgtgtttgtctcagatgaaaaatatacaatattttgagtccaagttaatcaatgttccatttgcctatactgagctcaatttgctaggtcgcatgttccatgtaattactatatctgcctatatcaattttcaagctcttttagatgtgcttaatacttaaccggtctaacctcatctacatgctaagggacctctttcctcagtacccaatcttacgcaagtgcgaatacgactgcatatct

SEQ ID NO: 33457 - DNA, 389 bp, Zea mays
  Clone ID: LIB3059-030-Q1-K1-E11
cgacccacgcgtacgctctcctgcccaccgccatcgcccctcctacgctctgcgctgccacagcctcaccccggcgcccccgccgattcacgtaggcctttgttggaaggaacgatggagcagaccttcatcatgatcaagcccgacggcgtccagcggggcctgatcggcgacatgatcagtctccttcgagaagaaagggttctacctcaaggggatgaagctcatgaacagtgagagggccttcgcgcagcagcactacgctgacctttacgacaagcctttattcactcggttgaacagatacattatgtccggccccgtagtggcgatggtgtgagaggcgaatgacatcatgttgactggccgcaggatcattggggccacca

SEQ ID NO: 33458 - DNA, 352 bp, Zea mays
  Clone ID: LIB3059-030-Q1-K1-E8
caggatgcggctctccttcccccttgtcgccggcgccgtcgtgatcggagtgattggtgggaatgttatatttgggccaccgcttcagaagtactgggcagagaagcagcagcaagaggcagcaaaagaaggccaagctggttcaacctgacaaaatgtcctccccttctgcagttacacggagaaatgtgtactcctcggtcctgaactagcatcggcttttgttagcattggttacatttagttgcccaagtttttggcgctggaagaagacaccgtgcaatgcacagaaagatttgaaaaacgtttaaatgctggttgatctcattctgaaatacagtacctttgatga

SEQ ID NO: 33459 - DNA, 380 bp, Zea mays
  Clone ID: LIB3059-030-Q1-K1-F1
cccacgcgtccgcccacgcgtccggagagggtctattctagaaaggagggagtccaagaacttgttcttggtctgtacattatcaggggtgacaacataagcgttgtgggcgaggttgatgaagagctggattcaagattggatatgtcgaagctaagggcgcacccactgaagcctgttattcactgaggtccgagtatgtctttgggtaatatgtggactggatggatgggtcactgttgaatgcaggatgtagcatcatcatggtgaggggactgagtaatatggacatgtatcttgcgtattgtgcaatgaatgtgttggctgttgggtcgcttgcctacgcattctgtaagattgcagttaccattaggaactga

SEQ ID NO: 33460 - DNA, 416 bp, Zea mays
  unsure at all n locations
  Clone ID: LIB3059-030-Q1-K1-F11
ggtcgacccacgcgttccgaagaatcattctggatgcatttctttcaagggccatctatttttacaaggtctagcggcatggtncctactaccaaatgtgcccctgccctgagcacgttttgtcccctttaaaaactaggaacagaattagaacctattctcttcttgcgggtttccacggacgggcgacgaatatgggtaaaaccaaagaacgtatttgctttgctgccttcacatcacgatgcggaggacggctaggccgacggctgagatcgaaacaatggtacctatgcagtacttgatgacatcgtactttgctgcctacaactgggccttcagtgagtggatttccttgtcaagctttgtggtaagctcagtggtttcctcattctgctcggcaagctcatcacgtatgc

SEQ ID NO: 33461 - DNA, 374 bp, Zea mays
  Clone ID: LIB3059-030-Q1-K1-F12
tccggaattcccgggtcgacccacgcgtacggggttaacggcgacgggatatgtgcggatcggctaggaaatgatgcgggtgaccgcggaagatctgtggctcaggcgctgcagatgctaggctgatgtcaatgtgccatgtctgatgctactctgccgtagcagccactgcggtaccggtggttgcttcctaggccctatatacattcaatgctcgctataacaggagtatgcgtgcgcgacagtgtattgatgcgaacgacgctgcggaccattgctcggacaatgctacaaggaaacagagtgtattatcatacgatctgatactgccgcccaacacggaacagctgagcctggcggtcattatagagata

SEQ ID NO: 33462 - DNA, 398 bp, Zea mays
  Clone ID: LIB3059-030-Q1-K1-F2
tcccgggtcgacccacgcgttcgcggacgcgtgggtctacacaccaggagggtgcatatgctagtatgctgggcaacctcgcaggggcagacaagaagggcactgtcattcttgtgcacgcaaactttgtccccaatgttgacaccttgcttgaagcaaacatgggcatttcccagacaccttcaagaatggtggtgcctgaaggcctctgtggtgccattatgccggtcacaaatacctgggacaggtagctgcataactcaacaattcgacacggggtggcatcatgccttgggaacttgctttcataaggatcggtggacgccaaggctcaagcggcgacatgcttggcccaactgttacagtacacgattgcgctactcaagttaaaaacgcca

SEQ ID NO: 33463 - DNA, 209 bp, Zea mays
  Clone ID: LIB3059-030-Q1-K1-G10
ccgggtcgacccactcgtccgaaaacaaaaaaaaaaaaaaaaaaaagaaaaaaaaaaaagaaaaaaaaataaaaaaaaaaaaaagaaacaaaaaaaaaaaacaaaataagaaaaaaaaaataaaaaaaaaaaaaaaaaaaaaatcactaaaaaatcaaaatacaacataaaatcacataaaaaccctgtacactatcaaaaacaatgtc

SEQ ID NO: 33464 - DNA, 430 bp, Zea mays
  unsure at all n locations
  Clone ID: LIB3059-030-Q1-K1-G7
tacatagtgaagtacactagcaacatcttagcaccaatggcagccaagatttttgccgtccttgccctccttgctctttcagcaaacgttgctaccgcgactattattccacaatgctcacaacaatacctctctccggtgacagccgcgagatttgaatacccaactatacaatcctacaggctacaagaggccatcgcagcaagcatcttacggtcgttagcattgactgtccaacaaccatatgccctattgcaacaaccatccttagtgaatctatatctccaaagaatcgtagcacaacaactacaacaacaattgcttccaacaatcaaacaagtagttgcagcgaaccttgatgcttacctncagcaacaacaatttcttccattcaatcaactagctggggtgaaccctgctgcttacttgc

SEQ ID NO: 33465 - DNA, 295 bp, Zea mays
  Clone ID: LIB3059-030-Q1-K1-G9
ccggaattcccgggtcgacccacgcgtacgcggacgcgtgggcggacgcgtgggctttcaacctgcatgaacaagagcaattgctgcgggatgcaatcatgaggcaccctgcagactacccaactgatgtacccgtttagttttcttggccttagatgagcagtatcgttgtgtaattattgatgagtcaggtccatagcattttgaataatacagtgattcatccagtgaactgctgattcaacacgttcttaaaaaaaaaaaaaaatgatgcataaaaaacataggaggactt

SEQ ID NO: 33466 - DNA, 423 bp, Zea mays
  Clone ID: LIB3059-030-Q1-K1-H1
tgccagctttggttatgattacttgcttaggcagtgccgcctaagaggcaaaatagactcgaatggtgttgttgccgcatacttggaagagaggttgaacatgggtgtcaacttccttctatctgctgagattgaccattgtaagaagaactacaagtttggttttggaatgaccgtaggagagtaattctgccaaaacaattgctgtgagcgcacatgagatacttatgcagtcggcttcgcgcgtatgttgacttgttaaagatatttcaggtctcagttttgactgatcaggttttgccattgcgccgtggaaaaacacaggccgttgctgctttacagggttttgtatttcagtgttttttcagctacttgagcatgggggccatgattctttggtcatcttggatgtaactagctgat

SEQ ID NO: 33467 - DNA, 218 bp, Zea mays
  Clone ID: LIB3059-031-Q1-K1-A2
cacgcatgcgggaggctatacgcccagccacgcctatgatctgcaggacgctcagcgccagctcggtggcaggttgccgggggctgtgcctttctgtccaagatggtcattattgaccatggagacttctagcagcaattggcaccttgcattgttagctatgccttttctgatgctgttgctaacaaggaaggcatcccatcccaattggattgtac

SEQ ID NO: 33468 - DNA, 453 bp, Zea mays
  Clone ID: LIB3059-031-Q1-K1-A6
tcggaattcccggctcgacccacgcgttcgcgagcttcgtgttgcaccagaggagctctcctgtgttgctcactgaggctcctttgaagccagaggccaacagggagaagatgacccaaattatgtttgagactttcaatgttcctgccatgtatgttgcaatccaagcagttctatcactctatgctagtgggcgtactactggtattgttcttgactctggtgatggtgtgagccacactgtgcccatttacgaaggatatgcccttcctcatgccattcttcgtttggatcttgctggtcgggacctcacagactccctcatgaaaatcctgactgagaggggttactccttcacaacctctgccgagcgagaaattgtaagggacatcaaggagaagctggcatatatagcccttgactatgagcaagagttggaaactggcaagaaca

SEQ ID NO: 33469 - DNA, 73 bp, Zea mays
  Clone ID: LIB3059-031-Q1-K1-A9
aaaaaaaaaaaaaaaaaaaaaaaaaaattaaaaaaaaaaaaaaaaaaaaaaaaaaaaaagaaaaaaaaaaaaa

SEQ ID NO: 33470 - DNA, 450 bp, Zea mays
  unsure at all n locations
  Clone ID: LIB3059-031-Q1-K1-B11
ccggtctcggaattcccgggtcggacccacgcgtctcgcgggacgcgtgggggcaaaatttatatgttagatntagacatggaaaaaatattagaggtacgaaagtaggatcatgtcagtgtatgagctagaaactacgaagtaatcacatggctaactatgtacacttgagcatacctttacgggccagaaaactaagtggaaagactaggcattggacttcagatagtggattttatgttttagagaaataagtaaagatcttttgacttgagtcagcaagtgtctcatgtttcacctgaaatgctctctggctgtgcatgtcctaaaaactattaatgattttaacttttacctttcaatttttcatttactagtttgctgtccacagattattttggttcaagttgttacttttatagattcaataactgttatccaaatattatg

SEQ ID NO: 33471 - DNA, 442 bp, Zea mays
  Clone ID: LIB3059-031-Q1-K1-B12
gaattcccggccggacgcacgcgtccgcggacgcgtggggcaaaatttatatttttattagacatgaaaaaatattagaagtgccgaagtatgatcatgtcagtgtatgagctagaaactacgaagtaatcacatggctaactatgtacacttgagcatacctttacgggccagaaaactaagtggaaagactaggcattggacttcagatagtggattttatgttttagagaaataagtaaagatcttttgacttgagtcatcaagtgtctcatgtttcacctgaaatgctctctggatgtgcatgtcctaaaaactattaatgattttaacttttacctttcaatatatcatttactagttcgctgtacacagattattttagcccaggtagattctttcatagattcaataacttgtattccaatattatgacctgatg

SEQ ID NO: 33472 - DNA, 362 bp, Zea mays
  Clone ID: LIB3059-031-Q1-K1-C10
actcgtaagtcgtgacacagttattcgtggatatatatacctcatatatactcgtagagcagatgttgctacgcgttagcacctgtactctcagtccggtaggagtaggacgtaggacctcacccgacatactcgatcccgacgccaccaacagttaccatgtccccggcgcacctcggcacgagcgacacgatgatcgtcttgtccccgtcagcaccgatgtcgtcgagcaggtcgcatatgccgaacctcgccacggtcttcaccgtgcccttgcccttcccaggccggaccgcgtgcggcgtcagcgccacgctccccgcgcactgcgccgccgccggcattgccgccccgctctggga

SEQ ID NO: 33473 - DNA, 302 bp, Zea mays
  Clone ID: LIB3059-031-Q1-K1-C7
cacgcgtccgaggttcagccttgctgccatgtacggttttgctgtggctgctcttggaatgctcaagacaagcgctactggcctggccattgatgcctatggtcctatcagtgacaatgctggaggaattgctgaaatggctggcatgagccacagaatccgtgagagaactgatgctcttgatgctgctggaaatactactgctgccattgggaagggttttgcaataggttcagcagccttggtgtctcttgccctctttggtgcttttgtcacccgtgctgaaatctctactgttgaag

SEQ ID NO: 33474 - DNA, 350 bp, Zea mays
  Clone ID: LIB3059-031-Q1-K1-C9
ccggtttcggaattcccggctagacgcacgcgtccgcggacgcgtgggaaaaaaaaaaaaaaataaaaaaaaaaaaaaaaaaaaaaaaaaaaaagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaataaaaaaaaataaaaaaaataaaaaatatagaaaaaaaataaaaataataaaatttaatgatattaaaaaaaaataattttttaaaaatttaaaaaaagagggaggggg

SEQ ID NO: 33475 - DNA, 420 bp, Zea mays
  Clone ID: LIB3059-031-Q1-K1-E10
accggtttcgaattcccggctggacgccacgcgtccgcgcggagaagctgcagagccggtttgttcagcgaggcgagatcgtccgcgtggagccgtgacacggctttgaccagctgaatccgtcgccgtcgtcgtcgtcgttttcgttcccatcgtcacaagtccagtaccaaacgtgccagcgcgacgtcgacaggcacaacgtctgcgccatggaggtgaggcacagcgtcgaacggctggaccaggccgacgtctacagccctggggctgggaggatcacacgccttaccagccacaagttccccgttctcaacctcgtacagatgagcgcggtgcgggtagacctgtaccaggactccatcatgtcgccgatctggaacttcaacgcccactgcgccatgtactgcatcaagggca

SEQ ID NO: 33476 - DNA, 455 bp, Zea mays
  Clone ID: LIB3059-031-Q1-K1-E11
ccggtttcggaattcccggctcgacgcacgcgtccgcccttgttgattcaacaatcgccagccctatctttggtgcagtcattggtacaaaccagcaaggcacaacagctgcagcaactcgtgctacctctgatcaaccaagtagctctggcaaacctttctccctactctcagcaacaacaatttcttccattcaaccaactgtctacactgaaccctgctgcttatttgcagcaacaactattaccatttagccagctagctactgcctactctcagcaacaacaacttcttccatttaaccaattggccgcactgaaccccgctgcttatttgcagcagcaaatactactaccatttagccagctagctgcagcaaaccgtgcttacttcttgacacagcaacagttgctgcctttctaccagcagtttgcggctaaccccgcaaccctctt

SEQ ID NO: 33477 - DNA, 266 bp, Zea mays
  Clone ID: LIB3059-031-Q1-K1-E3
ccggctcgacgccacgcgtgcgctggtgattaataatactactattacttagccatgctctgtgaagagtattaggaccgtcgctcataaaagctacagttccgtctcttttctcagctatgtaaaacttccaaactgttcatgcttaaaactgagggttttcttggtgtgaggtgtgcatgtcgttgttgaggccattgctgcacattccacctattgaggccctcctcaaattaagcctcgaaaaagctgatatcttttcgtag

SEQ ID NO: 33478 - DNA, 209 bp, Zea mays
  Clone ID: LIB3059-031-Q1-K1-F3
aattcccggctggacgccactcgtcctagaatgtgactgatgtcgcttactacttttacacggacaccagtatcggtcccgtggtattaaacgccagggttagcctcaccactttactgtcgcccaacgacctgcttaacatgttccttatgtcataatgcaatagaatactcacatgaacacttctactcattagcacatatatcact

SEQ ID NO: 33479 - DNA, 199 bp, Zea mays
  Clone ID: LIB3059-031-Q1-K1-F4
agagaagcttttggagatggtcgtaaagcgacagacttcaattacaaatgcaaatactagagcagttcagcaagtgatgatggaaggaaacacccaaacattacccatggggccaggacacaaacaaaggttttttaacaccacaacctggctcgacaaccaaacagattcatgcaagcagaacaatatttctcctcct

SEQ ID NO: 33480 - DNA, 340 bp, Zea mays
  Clone ID: LIB3059-031-Q1-K1-G3
tcggaattcccggctcgacccacgcgtgcgaggtcgccaacccgcacctgctgttgcttggttagcggcgccatcgcctgcgcggtgggcaggacgtgtgtggcgccgatcgagacgatccggacgcacttgatggtcggcagcatcggcgtcgactccatggccggggtgttccagtggatcatgcagaacgaagggtggaccggcctgttccgcggcaacgccgtcaacgtactgcgcgttgctccaagcaaggctatcgagcattttacctatgacacggccaacaagtttctaacccccaagggctactagccgcccaagatgccgatccccactc

SEQ ID NO: 33481 - DNA, 427 bp, Zea mays
  Clone ID: LIB3059-031-Q1-K1-H10
acgcgtccggtccgtcagcactgggccacatatggtcgccattactacacacgctatgactatgagaatgttgatgcaggggctgctaaggagcttatggcaaacctagtaagcatgcagtcatcactttctgatgttaacaagttggtcaaggagatccggtctgatgtttctgaagtagttgcagctgacgagtttgagtacaaggatcctgttgatggctctgtgtccaagcaccagggcatccgatacctctttggagatggttcacgactggtgttccgcctctctggaaccggttctgttggtgccaccatccgtgtctacatcgagcagtacgagagggactcctctaagaccggcagggattcacaggacgcccttgcttcgctggttgatgttgcgctcaagctcttcaagatgcaag

SEQ ID NO: 33482 - DNA, 393 bp, Zea mays
  Clone ID: LIB3059-031-Q1-K1-H2
cggctcgacccacgcgttcgagaccaactagcaacatataaagcacattagtttaccaacaatggcagccaaaatagtttgggtccttatgctccttggtctttctgcaagtgttgctaccgcaaccattttcccacaatgctcacaagctcctatagcttcccttcttcccccatacctctcaccagcggtgtcttcagtgtgtgaaaacccaattgttcaaccctacaggatccaacaggcaatcgcaacaggcatcttaccattatcacccttgttcctccaacaaccgtcagccctattacaagagttacctttggtccatttggtggcacataacatcaaggcacaacaactacaacaacttgtgctagcaaaccttgctgcatactc

SEQ ID NO: 33483 - DNA, 437 bp, Zea mays
  Clone ID: LIB3059-031-Q1-K1-H7
cggaattaccggctggacccacgcgttcgcagatatctactatactatactctaggtagcatggacaccaccgccatggcagccaagatgcttgcattgatcgctctcctagctctttgtgcaagcgccactagtgcgacccatattccagggcacttgccaccagtcatgccattgggtaccatgaacccatgcatgcagtactgcatgatgcaacaggggcttgccagcttgatggcgtgtccgtccctgatgctgcagcaactgttggccttaccgcttcagacgatgccagtgatgatgccacagatgatgacgcctaacatgatgtcaccattgatgatgccgagcatgatgtcaccaatggtcttgccgagcatgatgtcgcaaatgatgatgccacaatgtcactgcgacgccgtctcgcagattatgct

SEQ ID NO: 33484 - DNA, 286 bp, Zea mays
  Clone ID: LIB3059-032-Q1-K1-A1
cccgctcgacccacgcgttcgagcaagtcaacttgtggagggtgctttgaccacggcacatgcgatcactgatgcgcggaagcactatacctggtccgatctatctcgactatacctatgtatggcactactagtttgaacctcatgcccagctactgtagatctgatccagcattccttattctgcattgtctcctcattctacaagtgacttgtatgaatctcacggtcctaactgagaatctttgtgagcttgatccagatcctaagatcttgatcctaaaca

SEQ ID NO: 33485 - DNA, 453 bp, Zea mays
  Clone ID: LIB3059-032-Q1-K1-A6
gaattcccgggtcgacccactcgtccggtgaaaacccaattcttcaaccctacttgatccaacaggcaatcacagcaggcatcggacctttatcacccttgttcctccaacaatcatcagccctattacatcaattacctttggtgcatttattggcacaaaacatcatggcacaacatctacaacatctcgtgctagcaaaccttgctgcctacgctcagcaacagcagttacctttggtgcaattgttggcacataacatcatggcacatcaactacaacaactcgtgctagcaaaccttgctgcctactctcagcaacagcagtttctgccattcaaccaactagctgcattgaactctgctgcttatttgcaacatcaacatctactaccattcagccagctagctgctgcctaccaccagcaatttcttccattcaaccaactggcag

SEQ ID NO: 33486 - DNA, 404 bp, Zea mays
  Clone ID: LIB3059-032-Q1-K1-B3
ccggtctcggaattcccgggtcgacccactcgtccgcgcactcgtgctcccacgcgttcgcattgaagggataaaacgccctccaaggtgtggagctctaattgagagcagtacatacaagggcatgtaccatgccctaaaggacattgtcccaaaggacggatttggaggcctttataagggccttttcccctctttggtgaaatcgacccctgctggtgctgtgacatttgtggcatatgaatacatctcagactggtctagagtcaatactgatgtgaaaatcttcaatgcagatactgagcaaggctggatttgagtgacttcttgatggatcatggaactatcaatacaccatgacgagaactttttgcacaccgtggacatggacgatggagaccgca

SEQ ID NO: 33487 - DNA, 375 bp, Zea mays
  Clone ID: LIB3059-032-Q1-K1-B8
aattcccgggtcgacccactcgtccgtgtgcatctttatgaatagagtattctgctcagcataattttttaacccgctcgatacgatccattgaagaggtgacttttccaggattcatctactgcttctacataggtgcaccaagtgaactcatactggacattggaataggtgacataaaagccaattcatacttaaagtatatggagatctggaacaaattatgactccgaccgacatagacgatccaagattacttacgcgtgcattctacgttatatttattctataatgccacctaaattaaattcactgtccgttggtcgacaacgttctcactgttaaaacccttgcgtaccttacttaatcgccttt

SEQ ID NO: 33488 - DNA, 416 bp, Zea mays
  Clone ID: LIB3059-032-Q1-K1-C12
ccggattcccgggtcgacccagcgtccgcggcaccatggaatccatccgtgccggccccttcgcggcatcttccgccggacagctttgtctacggccagtccggcgccgggaacaactgggccaagggccactacaccgagggcgccgagctcatcgactccgtccttgacgtcgtgcgcaaggaggccgagaactgcgactgcctccaagggttccaagtatgccactccctgggtggcggcactggttctggcatgggcacgctgctcatttccaagatccgggaggagtacccggaccgcatgatgctcaccttctccgtgttcccgtcgcccaaggtgtccgacaccgtcgtggagccctacaacgccacgctgtccgtgcaccagctcgtggagaacgccgacgagtgcat

SEQ ID NO: 33489 - DNA, 419 bp, Zea mays
  Clone ID: LIB3059-032-Q1-K1-D2
tccggattcccggtcgacccacgcgttcgcgactcgtccggctttgcttctgggttacattgtactgaatcatgtggatgtgaagcttggcataacaagccacaattgcaaggtactctgcggatggcaacagttttacctctgaaacctgtccaaacattcgaagctggccaagatatagtggaacaagtcataaggtctcctatggatcttattagaagaaaatgcacatgcaagaagtcaggctgccttaagaagtactgcgactgctaccagggaggggcaggatgctccatcaactgtaaatgctatgattgtagaaacccatttgggagaaaagtcggcgttattttggacggtaaaagcaatcttactgcacctatactgcacgaaagaaacggtactgaagttgactcaag

SEQ ID NO: 33490 - DNA, 150 bp, Zea mays
  Clone ID: LIB3059-032-Q1-K1-D5
tccggaattcccgggtcgacccacgcgttcgcggactcctcggcggacgcatctgctgacgcttctgccgtcgcttaggaacccatcgttgctggtgccctctcttagattgcttatgagccatagctcaatcttaaagatttgctgctg

SEQ ID NO: 33491 - DNA, 444 bp, Zea mays
  Clone ID: LIB3059-032-Q1-K1-D8
aattcccgggtcgacccactcgtccgaagatctgttatatcatgtgagcggcttgcctccacatgatataacagatcggattgtggtccatgaacaccgtggtcaacctgatggtttgattgtctcccatctaccacatggtccaactgcatactttgggttgctcaatgtggtgacacgtcatgatatcaaggacaggaagactatgggcaaaatgtcagaagcttacccccatttaatactggacaacttctcaacccagattggcgaaaggactgcaactattctgaagcacctctttcctgtcccaaagccagattcaaagcgaataattacatttgctaacagagacgattacatctctttcaggcatcatgtatatgaaaaaccaggtggccccaaatcgattgacctgaatgaggtcggcccccggttcgagttgcg

SEQ ID NO: 33492 - DNA, 230 bp, Zea mays
  Clone ID: LIB3059-032-Q1-K1-E11
tcccgggtcgacccactcgtcctcccactcttcctcccactctttcgaattaaaaaaaaaaaaaaaaaaaaaaagggaaaattaaaaaaaaaaaataaaaaaaaaaaaaaaaataaaaaaaaattttttaattaaaagcgtccgttctatagtatccaagcttacttacacttctttgctacttcataccttttttattgtgtcacctaaattaaattcattgtccttct

SEQ ID NO: 33493 - DNA, 433 bp, Zea mays
  Clone ID: LIB3059-032-Q1-K1-E3
cggtccgtgattcccgggtcgacccactcgtccgggcggcgacccggtcgtgtcggcgttccccgagggggacaacatgctccactgggtgggcaccatcgcgggatccgccgggactgcctacgagggcacctcctaccgcctcgcgctggccttcaccgccgagtacccgtacaagccgcccaaggtgcggttcgacaccccctgcttccaccccaacgtcgacgtgcacggcaacatctgcctggacatcctccaggacaagtggtcctccgcctacgacgtgcgcaccatcctcctctccatccagagcctgctcggagagccgaacaacgactcgccgttcaacacgcaggcggcggcgctttgggcgaaccaggaagagttcaggaagaaggtggagaagctctacaaggccgtcgcgtagaggaca

SEQ ID NO: 33494 - DNA, 426 bp, Zea mays
  Clone ID: LIB3059-032-Q1-K1-E5
ccggaattcccgggtcgacccacgcgttcgccgactcgttcgcccacgcgttcgcccacgcgtccgcccacgcgtccgggaaaaacgtgttgggtccaagaaaccaattgttgtgaagtatggccttaaccatgtgacttacctcattgagcagaacaaggctcagctcgttgtcatcgctcatgatgtggatccgattgaactggttgtttggcttccagccctgtgcaggaagatggaggtcccatactgcattgttaaaggaaaggctcgccttggatcgatcgttcacaagaagactgcatcagtcttgtgtctgaccactgtcaagaacgaggacaagcttgagttcaacaagatcttggaagctattaaggcgaacttcaatgacaagtttgatgaagtcaggaaagaatgggggaggtg

SEQ ID NO: 33495 - DNA, 413 bp, Zea mays
  Clone ID: LIB3059-032-Q1-K1-E6
tggactcgtggtcggacgcgtgggcggacgcgtgggcaactagcaacatagagagcgcaatagtgtaccaacaacggcagctaaaatattctgcctccttatgctccttggtctttctgcaagtgctgctacggcgaccattttcccacaatgctcacaagctcctatagctgcccttcttaccccgtacctatcaccaacggtgtcttcagtatgtgaaaacccaattcttcaaccgtacaggatccaacaggcaatcgcagctggcatattacctttatcaccctcgttactacaacaatcatcagccctattacagcagctacctttggcgcattcattggcacaaaacatcagggcacaactactacaacaacttgtgctagcaaaccttgctgcctactctcagcatc

SEQ ID NO: 33496 - DNA, 280 bp, Zea mays
  Clone ID: LIB3059-032-Q1-K1-F3
attcccgggtcgacccactcgtccgtcggactcgtgcgttcaaaaacacaccattcgaaactacctagcaactactcagcatggatatctaccaagatattatcccttctttcgctttttgacctgtcagcgagcgcaacatatgcattcattattcctcaacgctcatttgctcctagtaccattataccacagttcttacgaccattatcttcaatgggcttctaacacctatctctgcatgcctacaagctacaacatgcacttgcttcgagcgtgt

SEQ ID NO: 33497 - DNA, 352 bp, Zea mays
  Clone ID: LIB3059-032-Q1-K1-F5
ctcggaattcccgggtcgacccactcgtccgagatcacattatctgactcgctccatctactatggcaatagcctcctcaattctatgcatagtgcacattaaaaattatgaagctaactacaaagaatacaatgccatatgtcaaataatcacttttctagggcaatatagaacacatgagcttcatacatatgacctactggctattattggacagtcagttgaaagcgaaagtgcttcaatgctaatgtaggatcattttgctagcttatcaacttgttatttaagaagacggctcgactctctgcagaaagcttgtattatcataatgattatcgacacatatcttat

SEQ ID NO: 33498 - DNA, 372 bp, Zea mays
  Clone ID: LIB3059-032-Q1-K1-F6
gccacgcgtccgtacacgcgtccgtagcagcattggcgaccaagatatgggccctccgtaagctgaatagctctatctgcatgcagttgctaacacgacaatgatcactcaatgctcacaagctcctatagctacccgtattcacgcataccttccatcaatgatagcttcagtatgtgaaaacccagcatcttcagccctataggctccaacaggcaatctcagcacgcaacatacctttatcacacttgttgttgcaacaatcgccagtcctatctacggtgcagtcactggcacaaaccatcatggcacagcacctgcagcaactagtgctacctgtgatcaaccaagtaactctgacaaacctttctg

SEQ ID NO: 33499 - DNA, 136 bp, Zea mays
  Clone ID: LIB3059-032-Q1-K1-F7
ggaattcccggctggaccgactcgtccgtggtatgcgtacacggtctccctctttctggctttagtagagtgagagtgattcatgtattagtagacaaggggaaatggtgaatgttgctcaagggatcgatgcggc

SEQ ID NO: 33500 - DNA, 436 bp, Zea mays
  Clone ID: LIB3059-032-Q1-K1-G5
cggctcgacccacgcgttcgcggggtattagtatttgagttgatttgtggaactcacgaagctgtgtttgcttagtgtcggagaaatacgagaagcgctggggctttggtactatatactcacccaaattttcatgtgtgcttgacgcgtgataagttcggagataacacgctcatagtttaagacctgtctgactactggcagaacatgacatcatttgattttctgttcatagttgggaaatcttgttttgtttcggactaatgcttgttccatggatttttaacgaatacatttagggtctgttcttctaatgttaattcatgtggattggaagaggttgaggccttccgtttctccagcattagatccagaattgttccagctgatcaaatcttatatattttagataagcaatccggctggtaaatcgttt

SEQ ID NO: 33501 - DNA, 336 bp, Zea mays
  Clone ID: LIB3059-032-Q1-K1-G6
aattcccgggtcgactccactcgtcctgcctagtatgatgccaccaatgatgattcctagcatggtgtcaccaatgatgatgcgaaacatgatgactgttccacaatgttactctggttctatctcacacattatacaacaacaacaattaccattcatgttcagccccacagccatggcgatcccacccatgttcttacagcagccctttgttggtgctgcattctagatataagcatttgtgttgtacccaataatgaagtcggcatgccatcgcatactactcattgtttaggaataaaacaagctaataatgacttctctttcattataact

SEQ ID NO: 33502 - DNA, 397 bp, Zea mays
  Clone ID: LIB3059-032-Q1-K1-G8
gtccggaattccaggctcgacccacgcgttcggcaaattgcaccaagaaatccatcgataggccgtcgacaggggaattaatggcgtgggcgtctagcagcagccaccgtcgtctcatcctcgcagccgccgtcctgctctccgtgctcgcggctgccagcgccagctccgggaccttctgcgtgccggggtgggccattccgcacaacccgctcccgagctgccgctggtacgtgaccagccggacctgcggcatcgggccgcgccttccgtggccggagctgaagaggagatgctgccgggagctggcggacattccggcgtactgccggtgcacggcgctgagcattcttatggaccgcgcgatcccgtcgggcccggacgcgcatctggaggg

SEQ ID NO: 33503 - DNA, 450 bp, Zea mays
  Clone ID: LIB3059-032-Q1-K1-H4
ggaattcccggttcgagccacgcatcacgagtaaagttaacgtgtagaaatctaggacttatccattattcgttccatggaaagggggagtgattatgggcgtccttgatattggtaaggatgcgtggattcatagagaagattggattaaaaatggtgtccacatcgggagtggcagaaaatataaggattcctattttcttcaggcgcaagtaatgtgctacttcaacgtataacaatatcttatattcgagctacacacgaagacttgcacttatacaggttgttcgaccgtccaaaccatcctagaatatgattggtggactgcgattaaattgcgtacatgatgcatcagttctatgcatgctcgctgctgtctgttcggaggtcatcaactcgggacctggactaaggtgcctgtcgttcgctcaacccctatgaaaaagtttg

SEQ ID NO: 33504 - DNA, 461 bp, Zea mays
  unsure at all n locations
  Clone ID: LIB3059-032-Q1-K1-H8
tccggaattcccgggtcgacccatttttatgggtacgggagcgagtagatcgtgcgcgcctactacatctccacgaccttgtgatggggtggggctcaccttcacgaagctcttcagccggctcttctccaagaaagagatgaggatccttatggttggtctcgatgcagctggtaagaccaccatcctctacaagctcaagctcggagaaatcgtgaccaccaatcctacaatcgggtttaaatgggaaaactgtgaatacaagaacattagctttactgtctgggatggtggaaggcaggacaagatcaagccattgtggaggcactatttncaaaacacccaaagccttatcttttgtggtgatagcaatgacagagatcgtgctgttgaagcaaaagatgagctccacaggatgctgaacgaggatgaattganggatgctgtcttgcttcgtttcg

SEQ ID NO: 33505 - DNA, 249 bp, Zea mays
  Clone ID: LIB3059-033-Q1-K1-A6
ccggttcggaattcccgcgtcgacccacgcgtgcgttgttttttttttttttgtttttcttttttttcttttttttttttttttttgtgattgcacaaacaaatcccaatcccctttaattattgttccggatgaaccatcctagaaatgctttaatctttttgctcgccttattatttaaacatatgaactagcttcaagctcattcctcatgcactatactctttgcaattacttggagggcatttt

SEQ ID NO: 33506 - DNA, 410 bp, Zea mays
  Clone ID: LIB3059-033-Q1-K1-A7
aattcccggctcgacctacgcgtccagttcttcgcatcagctggtgtttcgctaccttatcgccctccgactgctggtgggctgtcggcaccggcgcctccaaactccatgtgctgaggcctacgccagtgtcttctacgactacgagcacgttctatcaccaaacatgatgtctgaaagaagtcaacatgctgaaccatagatcgataacctcagtaaatgttaccatgcagtcctcataggaaggatccacgatgatgacctggatgtctcaaatttggaattcgttaaaacagcttttaccttgaccatgtgaaagctggtaacttgaatggttacacgtaccttttctttgagactagggtagctattatagaatcttccttatgctcatacttctgcgccttttc

SEQ ID NO: 33507 - DNA, 457 bp, Zea mays
  Clone ID: LIB3059-033-Q1-K1-B1
gaattcccgggtcgacccacgcgtacgggacgacgcactgagatcgaaatgcgctaggatacgagatctgaagcttcctcacgggtccggctccgacttcaagtatcgggcttacatcgtcagcagcatagccaactcgggctctgattttgaggttgatatgtatgatgatctgctggatgtggtcactgaagatgatgatgctgatttcgatgacatggatgatttcgatgatacagtctcagatggaggcatgtacgatgatgacttggatatctgaaattaggaatcggttcaaacagcttttccgtggaccatgtaagtgctgttagctggaatggtttaccgtcccttttctttgagattcgggtagctatgatggaatctccctgatgttcatacttctgcgcctctccatttgtaagaagctggagtaactgaactggttctaatcgat

SEQ ID NO: 33508 - DNA, 388 bp, Zea mays
  Clone ID: LIB3059-033-Q1-K1-B11
cacggcatcgccatccgcgcccgcgggccggtggcggcgacgcaggcccccgcgcgcggacggcaatgccgcgtgtctgcggcggcggtcggcgcgcccgccgcgcgagcccgcgtgacgcactcgatgccgccggagaaggcggaggtgttccgctcgctggagggctgggcggcgcggtcgctgctgccgctgctcaagcccgtggaggagtgctggcagccggcggacttacttccggactcctcgtccgagatgttctggcacgaggtccgcgagctgcgcgcccgtgccgtggggcttcccgactagtacttcgtcgagctcgtgggcgacatggtcactgaagaagcgctagccacgtaccagaccatgatcaacacgctcg

SEQ ID NO: 33509 - DNA, 463 bp, Zea mays
  unsure at all n locations
  Clone ID: LIB3059-033-Q1-K1-C11
ccggaattcccggtgtcgactccacgcccgtccgaagatactgaactcaactctattgnngtgtggatagttcaaatccgttggaatttcaaccactttaactgtgggtagagatcaagtgttctaagctgctgggatactctgcagggcaaggagaagatttggtggccctcagtggataggatacctatagtccatggccaagtgtgtcgatcatncatcgtttgatgtaactctcaagggcttacttacacagaatggttcctaacgtggcatagggacactgtgcagtggtctgtgaaaaccatactcattgtcctctgcggtaataaggttgatgtgaagaacaggcaggtcaaagccaagcaggttactttccacaggaagaagaatcttcagtactatgaaattactgccaagagcaactacgactttgagaaacctatcctgtaccttgcaagga

SEQ ID NO: 33510 - DNA, 402 bp, Zea mays
  Clone ID: LIB3059-033-Q1-K1-C2
tcgttggtattgatattgacccacagtcacttgaacttgctcaagaaaatgctgctggtctggagctggacatcgatttagtttggtctgacataaagaacttaaatctgaaaggcgtccatgttgatactgctgtcatgaatccttcctttggtacacgaaggaatggagcagacatggagttcctctctatggccttgcaagttgcttctcaagctgtctattctctacacaagacttccactagagaacatatcaagaaggcaaccttgcgtggcttcaatgccatcagtgctgatgttctatgcgagctgcgttacaatctaccgcggacgtacaaattgcacacgacaaaagagactgacattgcaaacgatctgtggctcttttgatctaacgccc

SEQ ID NO: 33511 - DNA, 359 bp, Zea mays
  Clone ID: LIB3059-033-Q1-K1-C5
cccatgcagccttctcctaccactgaacatcataatctctttcgagagcatctaccaagagcgcggtcttcctagtgcaagctccatatagtattgacaactgtcgaccaccgatgattatgtcctcagactgcacacatccaactcaaccacttcatcgaccactacttcgacaaccaaccataagtccttcattgcaaaatcatcctgtatcctgacacgcaaatgatccgcatcttaggctttactaccatctgcacatatgatgtgattcaggacgctatccaggtcattaaccccactgaactgaacagtctcatcatcaacgttgacatggcccacatccgcctttatcatct

SEQ ID NO: 33512 - DNA, 256 bp, Zea mays
  Clone ID: LIB3059-033-Q1-K1-C7
ggaattcccgggtcgacccacgcgtgcgcccactcttcacgaccacgcgttcgatggtcttgccgagcatgatgttgcataggatggtgccacatatgtcactgccactccttcttgcagatcatgctgcaacaataattaccatctatgaataaccaaattgccatgactaatctacccatgctcttacaggaacatttaccattagctgcatattagatagatatatttgtgtcgtaccaaataatagatttga

SEQ ID NO: 33513 - DNA, 412 bp, Zea mays
  Clone ID: LIB3059-033-Q1-K1-D1
ccggaattgccgggtcgacccacgcgtacgatcagcaaagcggcagtgcgtagagaggatcgtcgaacagaacagcatgaagatggtgatcggtctcgtcgtgtgcctggctctgtcagctgccagcgcctctgcaatgcagatgccctgcccctgcgcggagctgcagggcttgtacggcgctggcgccggcctgacgacgatgatgggcgccggcgggctgtacccctacgcggagtacctgaggcagccgcagtgcaacccgctggcggcggcgccctactacgccgggtgtgggcagacgagcgccatgtaccagccgctccggcaacagtgctgccagcagcagatgaggatgatggacgtgcagtccgtcgcgcagcagctgcagatgatgatgcagcttgagcgt

SEQ ID NO: 33514 - DNA, 425 bp, Zea mays
  Clone ID: LIB3059-033-Q1-K1-D11
ttgagaccaactagcaacatagaaagcacaatagtgtaccaacaatggcagccaaagagattgtgcttccttatgctccttggtctttctgcaagtgctgctaccgcaaccattttcccacaatgctcacaagctcctatagcttcctttcttcccccatacctctcaccagcggtgtcttcagtatgtgaaaacccaattcttcaaccctacaggatccaacaggcaatcgcagcaggcatcttacctttatcacccttgttcctccaacaaccgtcagccctattacagcagttacctttggtgcatttgttggcacaaaacatcaaggcacaacaactacaacaacttgtgctaggaaaccttgctgcctactctcagcaacagcagtttcttccattcaaccaactggctgcattgaactc

SEQ ID NO: 33515 - DNA, 276 bp, Zea mays
  Clone ID: LIB3059-033-Q1-K1-E2
ccggaattcccgggtcgacccactcgttcgggtctcgctcaccaagccaccactacttcacttcacaccacaccaccgtcagcatccgctcgctagccaagtacactaaggccttttctacagcgctgaaccgtgcgctccaacttctcgccgcctgcgccgatgcgttcaagccagcttctcgtgtattccatgccaacggcctcaatacaatgcaatggcatggccactaggagccatactacatccatgccaagcacatgcataactcgcaca

SEQ ID NO: 33516 - DNA, 378 bp, Zea mays
  Clone ID: LIB3059-033-Q1-K1-E3
ggaattcccgggtcgactcacgcgtccgcgaaggtcatctggatacctcgtggactttatggtgatgaggatacaaacggccacggggacgacatgtgctgcttcatcaaaccctgtgtgatcctgctgtcgtggaccgaccacgtgaaggaccatcattacgaacggtctgactaggcactgactgttctctaccagtccttttactcaaaagggcggcagctccaagtggtgaagatccacgtccccgggcctctgtacatgacagaggaagaggcacaaggcgtagtttcatcgggacattctgtgccgaggccagctggcacgagataggccgactcgtatcgtaacttctacatcgacaatggcgggatcata

SEQ ID NO: 33517 - DNA, 241 bp, Zea mays
  Clone ID: LIB3059-033-Q1-K1-E4
ccggattcccggtcgacccacgcgttcgaggaattccttcccctagccgccgtctccgttgctcgtctccctgagaggtgcctgtaccgaggaactggccgagtactaggtagagaatcggtttttcttgtctcagcccggggtctgctgcgtctggtggtggtgaacgggagaattttgtgagatctgttttggatcatgcgtaccatctcgggaatcacgggtgtcacacgtatcttcg

SEQ ID NO: 33518 - DNA, 399 bp, Zea mays
  Clone ID: LIB3059-033-Q1-K1-E6
ccggtccggaattcccggtcgacccacgcgtgccggacgctggcggcgcttttgcttgcttacatcctcatgacgcgggatcgctgcgtccccgaccccacttgaaggcccgctaaaagaacttgcgggcttgccgccggaagtgcagagggattcgccgtcacccttgtcacggagccgagtgcaaccttggcaccatcagcggcgtcgccgaatgcccctggattctcggcggcggaacgatgccctccaagtaactgcgaagagcatagtgcatgaggaatgagcttgtagctagctcatatgtctgaataataagcacagcaagaagatgaatgcatttctcggatcgttcatccggaacaataattaaaggggatccggatttgttcttgtgat

SEQ ID NO: 33519 - DNA, 177 bp, Zea mays
  Clone ID: LIB3059-033-Q1-K1-E7
acagcagttaccattcatgttcaacccaatggccatgacgattccacccatgtgcttgacagcaaccctttgttggtgctgcattctagatagaaatatttgtgttgtaccgaataatgagttgacatgccatcgcgtgtgactcattattaacaataaaacaagtttcctcttatt

SEQ ID NO: 33520 - DNA, 428 bp, Zea mays
  Clone ID: LIB3059-033-Q1-K1-F6
tcggttctgaattcccgactcaacccacgcgtgcgccgacgcctgctaccactcttcttaccactcgtatgagccttcgccgcatagggatggactatctcatcaatcgccacatcacatctatctctcgatcttacccatagtggatgtacaacaactacaacacacccctaagctgttcatacgttgtacattcgatcatctacatgtgaacgacatatccctgaacgactaccttgctgctaactcgacgaatcacgcaatgtacctgccacacaccccagaacattactccaagaatcgactccccattgctcagtgcacgatcgtgcagcgccttacaaactccctcatgattcacggactcaacaaccgcaagaaggtcatatctgtccgcatcatcaagcataccctgtagatcatttaaa

SEQ ID NO: 33521 - DNA, 431 bp, Zea mays
  Clone ID: LIB3059-033-Q1-K1-G12
ccggattcccgggtcgacccacgcgttcgcgtacgcgtgggcggacgcgtggggcttcggcgaccctgtcgagctccagctccgcgacgcctggctcaaccgcctggtggtgcaggcgcgcggcatggagcgcgcgtcgtgctacgtgctttccacctgccgcgtgcgctcctcggccgggttctgcacgcacttctgcctcgcgcgggcgcagtgcttcggcgaccctgtcgagctccagctccgcaacgcctggctcaaccgcctggccggccgacggtagccgcccgtcggcagctgctgctactgatactactaataggattcgatgctccaaggaccaaatgcaatgatgcctgctcttcgctggcaagaacgaggaagagaagcttgcagattggatttgaagcatgggaggccaacatatcttt

SEQ ID NO: 33522 - DNA, 335 bp, Zea mays
  Clone ID: LIB3059-033-Q1-K1-G3
aattcgcgggtcgacccacgcggtctgtggaattcacatgtgtttcctttagtttggatactctgggacatttaagccgcatggatttgcaagaaacatgatatggtccctggatgatgagcagccaccactgaatcataatgataacggaagcaaagtttctgttgaccttattctaaaaccatctgaagatgacctcaagtgctggccacattgttttgagttccgtctgaaggcccttttttcaaaagatggggacttgtcattgatatcacgcatcaagaatgtcaatggcaaaccattcaatttctcatttgttaatacacatatctttc

SEQ ID NO: 33523 - DNA, 420 bp, Zea mays
  Clone ID: LIB3059-033-Q1-K1-H11
ggaattcccgggtcgactcacgcgtccgcggacgcgtggggcaacatagaaagcacaatagtgtaccaacaatggcagccaaaatggtttgcttccttatgctccttggtctttctgcaagtgctgctaccgcaaccattttcccacaatgctcacaagctcctatagcttcctttcttcccccatacctctcaccagcggtgtcttcagtatgtgaaaacccaattcttcaaccctacaggatccaacaggcaatcgcagcaggcatcttacctttatcacccttgttccttcaacaaccgtcagccctattacagcagttacctttggtgcatttgttggcacaaaacatcaaagcacaacaactacaacaacttgtgctaggaaaccttgctgcctactctcagcacagcagtttct

SEQ ID NO: 33524 - DNA, 82 bp, Zea mays
  Clone ID: LIB3059-033-Q1-K1-H12
ccggttcggaattccaggctacgactcacgcgcacattgcaccaagaaatccatcgtgaggccttctacaggggaattaatg

SEQ ID NO: 33525 - DNA, 425 bp, Zea mays
  Clone ID: LIB3059-033-Q1-K1-H3
acggtccggattcccgggtcgactcacgcgtccgggacaagttcgggcatgtttcttcaaagaggaagggacaaggttattcgagtaattgagaagaggattgcagattataccttcatacctgtagatcatggagagggactccaagtactgcattatgaagtcgggcagaagtatgagcctcactttgattattttcttgatgagtttaacaccaagaatggtggtcagaggatggctactcttctgatgtatctatcagatgttgaagaaaggggcgagactattttccctgatgcaaatgtgaacgtcagttctttaccatggtacaatgagctttcagagtgtgccaagagaggcctttctgtcaaaccaaagatgggagatgcacttcttttctggagcatgaaaccagatgccaccct

SEQ ID NO: 33526 - DNA, 100 bp, Zea mays
  Clone ID: LIB3059-034-Q1-K1-A10
tttaagttaagtttcatttttagtttttttttttaatctattttttttttttttattttataattctcaacatctactataccattttttcccttttttt

SEQ ID NO: 33527 - DNA, 430 bp, Zea mays
  Clone ID: LIB3059-034-Q1-K1-A11
cggtctcggaattcccggctacgacccacgcgttcagctctacgccaccgtcatgagtgccttcaggccggatcaccgtcgccgccgcccggcgttcctgcgggacctctcgtccccgatctcctcgtcgtttcgcctcccaccggcctcgatgcggcgagaggcgcaggcctccaccccgccgccgcctccgccgctgctctccctcgacgacctctcccacctctccccctccaggcagccggccacgcctccgcaggcgacgacgaccccctcgcctcagcccccgcgtggagccgttctcttctcctcgccgctgcggtccaacggctcgccggggccctcggcatggtggaccccctcgagggaggagaatcccagggagggatcaccgatggatggcgtcgtgcagtaccagcagcagtccccg

SEQ ID NO: 33528 - DNA, 436 bp, Zea mays
  Clone ID: LIB3059-034-Q1-K1-A4
tggatttgtgagccttcttacttcagatggcaacactaaggatgatcttagactccgagctgatgagactcttgtggcccagattaaggaagggttcgaaagcgggaaggatcttgttgtgactgtccagtctgcgatgggggatgagcagatctgcgcgttgaaggatgttggccccaagtaacttccttggctttggagacggaaccctactgtatctcaacttaaatcggaaaagaagtgtatcaccaaaggattgctaccgagacattcacctggcttgagctggcttttgctatagcgtgcaaggggttgctgggtgtcgtacctacctgacttatcattatctgtggttacattctggaccctgtattttctatgctttcatgtctctctactttctagtattaattatcaataagttggtttggaatgg

SEQ ID NO: 33529 - DNA, 542 bp, Zea mays
  unsure at all n locations
  Clone ID: LIB3059-034-Q1-K1-A6
gtaccggttctcggaattcccgggntcgactccacgccgtnctcgagcgcagctanngctactgcnctnnactctcaactnnnacaacaacntntgcttcccatttttaacnncagattggggcnnngcactgannnaccccgnnctgcttaaatttgcagcnanngcaaatacctttactaccanntttagccagcttanngctacagcaannngccgtgccttnnccttctnntgacacnnaacaacangnnttgctgcnncgttctaaaccagcagtnnttgcggctttaaccccnnngcaaccctttcttacccaactacccaacaattnnngttgcccttttggtcnccaacttggcnntttgacanannacccagnncagcctcctttaccaaccaacccacatcattgnngtggtgcccttcttttagaattggcttaattagatgtnaattcaatananntaaagttttttgggatgaaatgtatgtggccatannncagaaataaaaaggttacaaatttccagaattcttaa

SEQ ID NO: 33530 - DNA, 134 bp, Zea mays
  Clone ID: LIB3059-034-Q1-K1-B6
aaaaaaaaaaaaaaaaaaaaaaaaaaataaaaaaaaaaaaaaacaatataaaaaagggcgagcttaaaaacacaaacatacaacataataaaatcaactatgatgtcacctaaatgcaattaactgtccgctga

SEQ ID NO: 33531 - DNA, 433 bp, Zea mays
  Clone ID: LIB3059-034-Q1-K1-B7
tgaaattattgtttctcctcctgttgtgtccttccgtgaaaccgttcttgagaagtggtgccgcactgtcatgagcaagtcacctaacaagcacaaccgtctgtacatggaagcgcgccccctggaggagggtcttgctgaggcaattgatgatggccgcattggcccacgtgatgatcctaaggtgcgctcccagatcctctctcaagagtttgggtgggacaaggatcttgccaagaagatttggtgcttcagacctgagaccaccggtccaaacatggttgttgatatgtgcaagggagtgcactatctcaatgaaatcaaggattctgttgtggctggtttccagtgggcatcgaaggagggtgcactggctgaagagaacatgcgcgggatctgcttcgaggtctgcgatgtcgttcttcatgctgat

SEQ ID NO: 33532 - DNA, 86 bp, Zea mays
  Clone ID: LIB3059-034-Q1-K1-B9
tccacgcgtacgctttccaaaaattaataaagtacatttctagaaaaaaataccaagagataaggcctacttgaacttcttagagc

SEQ ID NO: 33533 - DNA, 372 bp, Zea mays
  Clone ID: LIB3059-034-Q1-K1-C1
ccagaaagtaactgaggagtgataaaacgacaattttgagcttcaacgctttgctaggttggcaaaaaacttaaagcaacagagtgttcaagctaatgttttggtgctagaaaaggctttaatgcatcaggcttgtgttcctgtgttggataatgcttagagaagtttagcagtgataatgcttcactattcgaaaatcagtaaaaagtttagaccatttatgtgacatttttggatagttcctatgttgtgttgcaaccattaactatattaactgtatattttcacatggtgggacagatagaggacttcatagtgttcattcgaaaaaaaaaaaaataaatatgaacaattaatataaaaaatatggat

SEQ ID NO: 33534 - DNA, 163 bp, Zea mays
  Clone ID: LIB3059-034-Q1-K1-C3
tcgagagctactcaggtgattttgtcgtgggagcaccaaaagcagaaaagaactggtgttgtcttctctctctctagattctgacgagtggtggtctgcactcgtcgtaatgtcgtttgcctaaactgattttgatggaacaggaaatcttgctggtcttgcc

SEQ ID NO: 33535 - DNA, 394 bp, Zea mays
  Clone ID: LIB3059-034-Q1-K1-C9
tcccgggtcgacccacgcgttcgacgcattcgatgtttcgcaaaatcgtactaagtcacgtcacctgcaagaaaatatgggtagggttgggagagaaccgggtcgtgtgtcgcctgaaccagctaaaggaaacgattccttggatctgtggattaccagcaacttcaaggaatctaagagcaatgatgttgcgagaactaatgcctgatgtgatggatggcaggattttgccagttttgatcaagctcacagaattactaaagctcatgtggaaggacatgttctaaaagatccttcaggcgctgaaactttggacttatgggcctcaactcatgttaatgaaaagaaccttgaacagatacgtgaacataatgatctattcgatgactggcat

SEQ ID NO: 33536 - DNA, 421 bp, Zea mays
  unsure at all n locations
  Clone ID: LIB3059-034-Q1-K1-D11
cccgggctcgacccacgcgtttcgccaatgctngtatttgtagccctcaagcatgatggtccaagtgtgtacccaaggcacgtgagagtacgtggcttgctgcttgatgtaccgcggtgatgttgttcctaaggatgtcaacgctgcagttgcaaccatcaagaccaagagaactgtccagtttgtggactggtgccccactggattcaagtgtggcatcaactatcagccaccctctgttgtccctggaggtgacctggcaaaggtccagcgtgccgtgtgcatgatcagcaacaacaccgccgttgccgaggtgttctcacgcatcgaccacaagtttgaccttatgtacgccaagcgtgcattcgttcactggtatgtcggtgagggtatggaagagggtgagttctcagaagcccgt

SEQ ID NO: 33537 - DNA, 418 bp, Zea mays
  Clone ID: LIB3059-034-Q1-K1-E1
ggttcggaattcccggctcgacccacgcgtgcgccgacgcgtccggaccatacatctcacttcgccaaaaaaatttcgtcaacagtggaaggtatacccatggcaaaactactcttgggtttgctccttgcccttgctattctagggacaacatcggctgctggttgtgtacaagacgcggaagacatgaaacgagagtgcaagcagtttgagctattcccagcgaacccaaagttgccaccgtcggcagcatgttgtgctgtgtggaagatggcagatgttccatgcctatgcaaatatgttaacaaggaagtagagaaggtatggtccatggagaaagttgtgtacgtatccaactattggaagaggccgtttcaaccttgctacaagttctgtaattattcaatttcttttatta

SEQ ID NO: 33538 - DNA, 401 bp, Zea mays
  unsure at all n locations
  Clone ID: LIB3059-034-Q1-K1-E10
cccgggtcgacccacgcgttcggccgagccttccgccaagccttccggtcaaaacaaaagttaacgggggcccaaacccgcaaaggccatttccatccaaatcgccgagaaggggaagccaaatcgatggcggcggcggcggccggcggcgagaacagcggcgcgggcgcggtcgcgggcgagggcgagttctacctgcggtactacgtggggcacaagggcaagttcgggcacgagttcctcgagttcgagttccgccccgacggcaagctccgctacgccaacaactccaactacaagaacgacaccatgatccgcaaggaggtcttcgtcttccccttcgtccttcgcgaggccaggaggatcatncaggagtccgatatcatgaaggaggacgacag

SEQ ID NO: 33539 - DNA, 401 bp, Zea mays
  Clone ID: LIB3059-034-Q1-K1-E2
cgctcttcacggccgtcctactcgtgaggcggctgctgctgtccgcaaaggtcgggccggtggcggtggccgaggcgcggacgtgccagtcgcagagccacaggttccggggcccctggctgcgccggtccaactgcgccaacgtatgcaagaccgaggggttccccggcggcaggtgccgcggcttccgccgacgctgcttctgcaccacgcactgacactgattcgctcgcccagcggccggctggcgtcgacgtcgatcgcgcgcgtcgcgaccagtccatggctgcatgcatgaataacaagggtgtgcagttcgtgatgccaaattgtatgctctcgtcacgtgttgaagcgttcgatcgtcggtctagtagcgtgcctgtgagcagcggcgtgct

SEQ ID NO: 33540 - DNA, 442 bp, Zea mays
  unsure at all n locations
  Clone ID: LIB3059-034-Q1-K1-E6
accggttctcggaattcccgggtgcgactccacgtcgnttccgcaggatcacctcgtgaaaattacttctccagtgttggaagtatttcccacttgggaaatgagaaggtgttccattgangaattgagatnttggtccaaaagatctggcaaacaaacaaggtgcgtgttgtccgccgggacaactggtgcaaaaggttgacattccctgtgaccaatttggttgaagaggttaaagtgttactggatgagattcaaaaaaatctgttcaaaacagcccaagaaaagagagatgcctgtgttcatgtcgtgaacacttgggatgaattcacaactgctctgaataacaaaaagttgatcttggctccatggtgtgatgaagaggaaattgagaaagatgtaaaaactcggacaaaaggggaaacttggagctgcgaaaaca

SEQ ID NO: 33541 - DNA, 68 bp, Zea mays
  Clone ID: LIB3059-034-Q1-K1-G11
cccacgcgtccgagcatgtgcacttttatctatttatttggtaccatcttgctaaaggaaaggaaaaa

SEQ ID NO: 33542 - DNA, 402 bp, Zea mays
  Clone ID: LIB3059-034-Q1-K1-G7
aatctcatcaattttcttgtaaaaattcctatggattgctttcctccgtacaagttagagaaaaataacaaaaggattgcaattcacagccacctctaattcgagtacggaagaagccacctgcagctgcagagatcctgaagctcaactgcgatgcttcacaatcggcgtgattggttcctacacccataagagccgggctcgcgccgacctgcaccccagtcaatgcttccactaagcctgcgcacagctagccaagctatcaatcatgcgatatatgcgttcattacaacataacactgttcattacaacataacactctgaacatatgcaagccatcagttttcaccgtttcaccatcctaatgtgggtctttattgacccgagtgtactggactaag

SEQ ID NO: 33543 - DNA, 371 bp, Zea mays
  Clone ID: LIB3059-034-Q1-K1-H11
cacgcgtacgatgacatacaaatccctggtatgataaattcttcgactagcagcgcagagttcctgcgcacggtgacagtgaattattggagctgctaatactgtgaagggcattatctgaactgacatggccagcaactctgaataagagagacatattcagggaagtactcatggatattgacccattatcactctcaaaattaagtgacaataagattatagtacctggaagccatatcataccattgatatccgtacataatctgagccgtgttattgatatcgcacacccactactgatgatcatatacgaatacgcatcgcctgacacatactgccgtatcctactgaatcacatgcttatattg

SEQ ID NO: 33544 - DNA, 471 bp, Zea mays
  unsure at all n locations
  Clone ID: LIB3059-034-Q1-K1-H2
taccggtaattcccgggtcgacccacgcgttcggcctcagatcgctccctgcctctggtcacctcgcttccgctcccggctcccctccgggcaggcacacatcgtccgttcgctcgccaagagacaggaccggagaccatggcggaccagctcaccgacgaccagatcgccgagttcaaggaggccttcagcctcttcgacaaggacggcgacggttgcatcacaaccaaggagctcggaactgtcatgcgatcactgggtcagaacccaaccgaggctgagctccaggacatgatcaacgaggtcgatgcggacggcaacggcaccatcgacttcccggagttcctcaacctcatggcccgcaagatgaaggacaccgactccgaggaagagctcaaggaggcgttcagggtgttcgacagggaccagaacggcttcatctctgcggcggagctncgncacgtgatgacc

SEQ ID NO: 33545 - DNA, 415 bp, Zea mays
  Clone ID: LIB3059-034-Q1-K1-H9
tagaaagcacaatagtgtaccaacaatggcagccaaaatattttgcctccttatgctgcttggtctttctgcaagtgctgctacggcgaccattttcccgcaatgctcgcaagctcctatagcttcccttcttcccccgtacctctcaccagcggtgtcttcggtatgtgaaaacccaattcttcaaccctacaggatccaacaggcaatcacagctggcatcttacctttatcacccttgttcctccaacaatcatcagccctattacatcagttacctttggtgcatttattggcacaaaacatcagggcacaacaactacaacaacttgtgctagcaaaccttgctgcctactctcagcaacagcagtttcttccattcaaccaactagctgcattgaactctgcttcttat

SEQ ID NO: 33546 - DNA, 451 bp, Zea mays
  unsure at all n locations
  Clone ID: LIB3059-035-Q1-K1-A10
accggttcggaattcccggctcgacccactcgtccgagcaacatagaaagtggaatacagtatcaacaatagagcaacaatggcggccaagatgttttccatccttatgctccttgctctttctgcatgtgttgctaacgcgaccatttttcctcaatactcacaagctcctatagctgcccttcttcccccataccttccatcaatgaccgcttcagtatgtgaaaacccagcccttcaaccctacaggctccaacaagcaatcgcaacaagcaacttacctttatcacccctgttctttcaacaatcgccagccctatctttggtgcagtcattggtacaaaccatcagggcacaacagctgcagcaactcgtgctaccagtgatcagccaagtagctctggcaaacctttctccctactctcagcaacaacaatntcttccattcaac

SEQ ID NO: 33547 - DNA, 360 bp, Zea mays
  Clone ID: LIB3059-035-Q1-K1-A5
acccacgcgtccggaccaaggagatgaaaagatagaatcacgaggcctgcgcagagtcctgagccgctgcgaccgtacgtgactgtactacggtcttgcatcggacggagctggcatgcactggctgcctatactactctggaccgctaacgtcccacggttacaatcgatttttcgtttggatacgtggatgcatccgtcagagtctctaactacttagacgtatgaacctactgacgaggctactgagcacactcattaccgcaggcatttcaggtacgcatgtactacatactgcatgtacttagacacatatgacagtcactatcttgagagcgagggctatactgtgctgacata

SEQ ID NO: 33548 - DNA, 410 bp, Zea mays
  Clone ID: LIB3059-035-Q1-K1-B10
tgaaagcttcagcttcggcttgcaaggatgagtgggtggtctgtcgtgtgttcaacgggaccaccgggatcaagaagacggctgcgccggcataccaggtggccatggccggtgctgagatggatcagaatcagaacaacattccggccatccccatccccatgccgctgcagctgccactgcccgtgcccatgcagatgcaatttcccatcctgccagattttgtcatggacccggtggccccctactaccccaacccaaatgccggcgccgggatgatgccgcctatggcggccggtattggcggcgccggcgggctccagatcaacggcgccctgttcggcaatccgatgcccgcgccgttgccgatgaacttctaccaccaccagatgggcatgggggcagcagct

SEQ ID NO: 33549 - DNA, 447 bp, Zea mays
  unsure at all n locations
  Clone ID: LIB3059-035-Q1-K1-B6
aagcacaatagtgtaccaacaatggtagccaaaatattttgcctccttatgctccttggtctttctgcaagtgctgctacgacgaccattttcccgcaatgctcacaagctcctatagcttctcttcttcccccatacctctcaccagcgttgtcttcagtatgtgaaaacccaattcttcaaccctacaggatccaacaggcaatcacagcaggcatcttacctttatcacccttgttcctccaacaatcatcagccctattacatcaattacctttggtgcatttattggcacaaaacatcagggcacaacaactacaacaactcgtgctagcaaaccttgctgcctacgctcagcaacagcagttacctttggtgcaattgttggcacanaacatcagggcacaacaactacaacaactcgtgctagcaaaccttgctgcctac

SEQ ID NO: 33550 - DNA, 74 bp, Zea mays
  Clone ID: LIB3059-035-Q1-K1-C8
taccggtctcggaattacccgggtgcgactccactgccgtctcgcccacgcctgtccgcctcacgcctgtccgc

SEQ ID NO: 33551 - DNA, 490 bp, Zea mays
  Clone ID: LIB3059-035-Q1-K1-D8
accggttcggaattcccggctggacccacgcgtccggattgaggatcgggttgaggaggaatgttacagtgaggcttcagaaggagatgatgaggcagatgatgcttataggcagtaggaggccatgggaatgcagtgttgttagtggctcttctgcttgtagttccatttgtccctggtcaagtgttgcctggagaactggcagagaaatttggttgacatcgaacaatctgacttcgtgcggctcctgaccctggttggaagtgttcgcttcagctaaaacagctccagctgcggcctctctctgcagatcattgtagcatcagcagcgctgccaagggattagttgttgcatcctatgatgcaaccataatatgttcatgcagcaactcagttcagttgtactgtttgactcgagaaatgtaacacgctgtactgttaaaccaggtgatcctattggtgtctcggcgtcccaagttctgtgacactg

SEQ ID NO: 33552 - DNA, 407 bp, Zea mays
  Clone ID: LIB3059-035-Q1-K1-E10
tgcagtcacgaggatccgaagaatcaccctggtaaccggaatctcaagtgccagacgggttgtgcccttgatcacatttatttttctaataatgttctttataattatttattcatgcataggcttaattttgatgggtcccaataggtcccaatagggtagttttgctattgcattatgtggttttgggattaatattacattatatccatgttccaattattatgttatgttatttatgttcatgtcaagatcattatctttaattggaacgtggagcttaacttgggaaacatgtgccaccacaagggtggaatgggacgcccttggctaactaattaggaaagctagtggaagactaccttacccgaaaggggcaagggcagtaggggagttgcacgcaagga

SEQ ID NO: 33553 - DNA, 498 bp, Zea mays
  unsure at all n locations
  Clone ID: LIB3059-035-Q1-K1-E7
accggttcggaattcccgggctgctgtcttcaataggtccagcagatttgggaagcttcagggtattcagtgtgcactagcaggtaggaaccttgacatgaggttcacttgtagtactggagatgccatgggaatgaatatggtgtcaaaaggtgttgaggatgtcttgggctacttgcagaatgatttccccgacatggatctcatcagcctatctggtaactattgttcagacaagaaggctgcagctgtaaactggatagaaggtcgcgggaaatctgttgtttgtgaggccacagtcaaagggggagttgtgcagagtgttcttaagacttctgtgcaaaaacttatcgagcttaatattgtaaagaatctcgctgggtcagctgtagccggagctcttggaggtttcaatgcccatgcaagcaatatcgtaactgccctgttcattgctacggngcaggatcctgcccaaaatgttgaaagctcgcagtgcat

SEQ ID NO: 33554 - DNA, 451 bp, Zea mays
  Clone ID: LIB3059-035-Q1-K1-F7
ccacgcgtccgctgcattatacctgacgcggtgtatgcttccacttaccctcctctcccccaggcggctgcaccatcggcggggtagcatctgtgctacaagggctattgcaatggcctcttcacagttcgtcggcggcaacgcgttccgtctctcggtcgcgcccatggacctcttactgaaactgcacaagggcgacatcaccctctggtccgtccactgcgccaccgacaccatcgctaatgctgctaatgagccaatgttaggtggcctatgtgttgatcgaactatacatcacgctgctggaccatagctagtgcaagcatgcctgaaagttccaaatgtcaaaccaggagtccgtttgcctactggagaagctcggattacttctgctacagagcttgctgcctctcgactgattcacactgttggacctatatatgatttggac

SEQ ID NO: 33555 - DNA, 123 bp, Zea mays
  Clone ID: LIB3059-035-Q1-K1-F9
accacacatacgaaaacacataaaaattttaaaacgcaagcaaaacaatatagagaaggcgagcttacaaacgacaggcatgcaacacaatacactataatataacgaaacctaaattcattt

SEQ ID NO: 33556 - DNA, 479 bp, Zea mays
  Clone ID: LIB3059-035-Q1-K1-G3
cccggacttactggctggacccacgcgtgcgtacgatcagtacaatcccttcagatttggccaaaaatgtgaagatcttgcaccctgatgtggggaataactttattgagaggagttcagatttgaaggtactttctgaattgcgctacttgaggaaccttaatttgcagggaaatcctgttttcaagaaagacagtcttgtcaaaaaggttaagaaatctgtgccaaccttgcgcatactgaacgcaaagcccctagaggccacctccaagagtgatacgaggtctacaaaagagaatcctcctagcaaagatgaagaccccattgggattgatgcaaagaaagataaaaggaagggatctaaacaagaggtaaagggccttgaagagcttgaagtccagagtgtttctacaggtatcaccacttcgaaccctggtaaacttgaagtgccagacggtaaggaaaagaaaaaggtcaag

SEQ ID NO: 33557 - DNA, 437 bp, Zea mays
  unsure at all n locations
  Clone ID: LIB3059-035-Q1-K1-G8
ggttcggaattcccggctggcgggacccacgcgtccgcggacgcgtgggcggacgcgtgggttacaacaaccaatttcccagttgcaacagcaagccttggcacatctaacaatacaaaccatcgcaacgcaacagcaacaacaattcctaccagcactgagccacctagccatggtgaaccctgccgcctacttgcaacagcagttgcttgcatcaaacccacttgctctggcaaacgtagttgcaaaccagccacaacaacagctgcaacagtttctgccagcgctcagtcaactagccatggtgaaccctgccgnctacctacaacagcaacaactgctttcatctagcccgctcgctgtggccaatgcacctacatacctgcaacaacaattgttgcaacagattgtaccagctctgactcagctagttgtgc

SEQ ID NO: 33558 - DNA, 438 bp, Zea mays
  unsure at all n locations
  Clone ID: LIB3059-035-Q1-K1-H2
taccggtccggaattcccggctcgacgcatgcgcggacgcgtgggttcggcctctgtcccttgcaagttcaatctcacctccaaccatgggtgagagagaagtcccacatcaacattgtggttattggccatgtcgactctggcaagtcgaccaccacaggacaccttatctacaagcttggaggcattgacaagcgtgtgatcgagaggtttgagaaggaagctgctgaaatgaataagcggtccttcaagtacgcgtgggtgctcgacaagctcaaggctgagcgtgagagaggtatcaccattgatattgctctgtggaagtttgagaccaccaagtactactgcacggtcattgatgcccctggacaccgtgacttcatcaagaacatgatcactggtacctnccaggctgactgtgctgtccttatcattgac

SEQ ID NO: 33559 - DNA, 426 bp, Zea mays
  Clone ID: LIB3059-036-Q1-K1-A10
tccacattcattggtggcccatcaaattggtagtgattggtctgatgttttgtttcccagtttctagatatttagcataaacatttgctcgacacaagttttttttgccaactggtccttttttttttgccatgtagggacccatattctaaaggagttacattaagatccctcaaaatttctgatttgccgggtactgttaacattgtttacatgttatgggttttcttcttgcatgctaactctcagtaacacctctgtgatgtacttgcagtcatttttttggttggcatttttggtgctcattgatgattaaaatatggcatgccattctccactgtttctgctttatagccatgtttttaggagggcagacctagtgccggagaggctcccacatgaagtgggtctggagaagggataaac

SEQ ID NO: 33560 - DNA, 419 bp, Zea mays
  unsure at all n locations
  Clone ID: LIB3059-036-Q1-K1-A6
aagcaaggagggaaggccaagccgctgaaggcgcccaaggccgacaagaaggagtacgaggagacggatcttgcatatctgcagaagaagaaagatgaggaaaaagcactgaaggagcttaaggccaaggcacagaagggcgcgattgggggctcgggtctgaagaaaagtggaaagaaatgagactggtcacccgtctccaatacctagaggatgataaggcagctgtctatctgtgttgcgcttcactaagtgtgattgtaacagtggtacctcttgtgttctgtgttccgcgatgttgcagttggttgcttgatcgaaagatgtttcaacctcccatctgctagctatgatacagatggtcccctgataataatgatgacatattctgtgatggatgccacagcattntttgtttt

SEQ ID NO: 33561 - DNA, 446 bp, Zea mays
  Clone ID: LIB3059-036-Q1-K1-A7
tagcaacatagaaagcacaatagtgtaccaacaatggcagccaaaatattttgcttccgtatgctccttggtctttctgcaagtgctgctaccgcaaccattttcccacaatgctcacaagctcctatagcttcctttcttcccccatacctctcaccagcggtgtcttcagtatgtgaaaacccaattcttcaaccctacaggatccaacaggcaatcgcagcaggcatcttacctttatcacccttgttcctccaacaaccgtcagccctattacagcagttacctttggtgcatttgttggcacaaaacatcaaggcacaacaactacaacaacttgtgctaggaaaccttgctgcctactctcagcaacagcagtttcttccattcaaccaactggctgcattgaactctgctgcttatttgcaacaacaactaccattcag

SEQ ID NO: 33562 - DNA, 250 bp, Zea mays
  Clone ID: LIB3059-036-Q1-K1-B2
agaagagacgctgatctacttataggtcgcagttgacggtgtagctggtggttttgccgggaggaactcttggtagtttgagctgtgcgaaagcttttaagtttacatttactcaccactccatgaacggcaacgaagtattcatcagttagaaaagtgcacctataattttggttgcttataactttctatttgtcagagatttaactcgaaggacctgtaactaggaaagttaattttgcttggaaaa

SEQ ID NO: 33563 - DNA, 440 bp, Zea mays
  Clone ID: LIB3059-036-Q1-K1-B8
aagcaacatagaaagtggaatccagtatcaacaatagagcaacaatggagaccaagatgttttccctccttatgctccttgctctttctacatgtgttgctaacgcgacaattttccctcaatgctcacaagctcctatagcttccctttttcccccataccttccatcaattatagcttcagtatgtgaaaacccagctcttcaaccatataggcttcaacaagcaatcgcagcaagcaacatacctttatcgcccttgttgtgtcaacaatcgccagccctatctttggtgcagtcattggtacaaaccatcagggcacaacagctgcagcaactcgtgctacctgtgatcaaccaagtagctctggcaaacctttctccctactctccgcaacaacaatttcttccattcaaccaactgtctacactgaaccctgct

SEQ ID NO: 33564 - DNA, 429 bp, Zea mays
  Clone ID: LIB3059-036-Q1-K1-C10
cccacgcgtccgtacagtagcaacaaaagtacaacaatggcggccaagatattttccctgcttatgctccttgctctttctgcatgtgttgctaacgcgaccattttccctcaatgctcacaagctcctatgtgaaaacccagctcttgaacctacaggctccaacaagcaatcgcggcaaacaacttaccattatcacccttgttctttcaacaatcgacatccctatctttggtgcagtcattggtacaaaccatcaaggtacaacagctacaaaatctcgtgctacctgtgatcagccaagtagctctagcaaacctttctccctactctcagcaacaacagtttcttccattcaaccaattgtctacactgaaccctgctgcttatttgcagcaacaacaactactaccattcaactagctagct

SEQ ID NO: 33565 - DNA, 475 bp, Zea mays
  Clone ID: LIB3059-036-Q1-K1-C5
aattcccgggtcgagacacacgcgtgcgccgacgcgtacgattgacaccaactagcaacatagaaagcacaatagtgtaccaaccgtggcagctaatatattcagcttccttatgcttctagatcactctgctatagctgctaccgtaaccattatcccacactgctcacaagctactatagcttactttcttcccccatacctatcaccaaccgcttcttcataattacgaaaacccaatcctttaaccttacacgatccaacatgcaatcaatacaacgtatttcacctttatcaaacttgttcctccaacaataccaagtcttactacagtagctacctcaaacccatttgcctactcacaacatctggttacattaaatccactaactatggctaactatgctgcgtacctactacaacgaccacaggtacttaatacattggcaattgcttacccataactctgctgctt

SEQ ID NO: 33566 - DNA, 445 bp, Zea mays
  Clone ID: LIB3059-036-Q1-K1-C7
tcgtctcctgctcttgctcaactatgcatccttgctttcataaaagtgcccaagcctgggggataactttgttcaggaagcaccaaattttttaagtaaatgtttgttcagtacctcaaatcattcccggccatgatccaagaaccttattctctcttgggggagaattcaaaggacacaggagacccgaaatgttctctatatggactctctggtgaatccagacacagagtgtcatatacactatcatgctctaggaaaagctcttgcccctctcaagagacgcgagatatgacactctagagagagggacacctctctgaacctggaacagttccaggacaaggcaaagaaggaaaggctgcggatttggcagtacggagatgttgaatcggacgaggacgagcaggccccgcctgcaaggaagcctggaggtcgtcggtag

SEQ ID NO: 33567 - DNA, 350 bp, Zea mays
  unsure at all n locations
  Clone ID: LIB3059-036-Q1-K1-E5
acccacgcgtccgatgatccagaggagcaacacaacaaccatgttgtagattgcttggtgaatgtatggggctcaatctgcctaagatcatgacaacattgttgctgcaatacctggcagctacttggttgtatcaaacgtgattggagaaaaggcattaccaaagggctgcactgctgccttaggaattcatgacaatttttttagatttgagctactgctatagtacttatagctgcaccttgtactctgtcgctgctcctggcaatgacattgatgctgttgtgatttttcctggccctgctgatattgctgangctgntgtggatgctgctgcttgtcatgaccct

SEQ ID NO: 33568 - DNA, 425 bp, Zea mays
  Clone ID: LIB3059-036-Q1-K1-F6
ggaattcccgcggggagccacgcgtccgcgggcatgcttcatcacattgttgacttcataacgaaacacatcgtcttcggatcttgcatgattagttccgtcgtgcggggatgctgctgctaccagcagcatccagaagaagacgtcgtggccggaggtggtccgcatgtgcataatggatgcgacggatactattctcaaggacatgcgcaacgcgtacatccatctgctatcctgctggataccccgtgacgctgaaccttcggccttaccgcgttcgtatcttcgtagacacagatgacctgactcctacagttgaacgatacataccatgggcaatctacataccctactttccattgcatgtttccacttaatactaaacaacgccttaacttcttacttgtgcttacttggaaggcgtt

SEQ ID NO: 33569 - DNA, 406 bp, Zea mays
  Clone ID: LIB3059-036-Q1-K1-F9
tccgcgcttcctccggactgtggtccgtttcgctcactcctgtgcccccgccgattccggtcatcctttgttggaaggaacgatggagcagaccttcatcatgatcaagcccgactgcgtgcatcggggcctgatcggcgacatcatcagtcgcttccagaagaaagggttctacctcaaggggatgaagttcatgaacgtggacaggtccttcgcgcagcagcactacgctgaccttttcgacaagcctttcttcctcgggttggtggagtacatcatttacggccccgtcgttgcgatggtgtgggaggggaaggacgtcgtgttgactggccgcatgatcattggggccaccaggccttgggaggcagaccccggtaccattcgtggggactacgccgtggaa

SEQ ID NO: 33570 - DNA, 446 bp, Zea mays
  unsure at all n locations
  Clone ID: LIB3059-036-Q1-K1-G12
accgtccggaattnccggtggacacgcgtccgagcgtggattcgagcgccaagggccgcttttccccagcctcgggggaaagccgtagtggaccgttaccatgtgctcgtcgggacaggctccactcagctctttcaggccgtgctgtacgcgctctcacctgcaagtgacggcacacccatgaacgtcgtctcaccggcaccgtactactcgtcttacccatctgtgaccaactatctaaactctgcgctctaccgttgggctggtgatgccaatacatttgatggcgacacatgtattgagctcgtctgctccccaaacaaccctgatggcggcctccggaagcctgtcatcaaatccaagtctagcacgcctgtatatgacttcgcctactactggccgcagtacacacccatcaccgaggcagctgcccatgacatcatgct

SEQ ID NO: 33571 - DNA, 467 bp, Zea mays
  unsure at all n locations
  Clone ID: LIB3059-036-Q1-K1-H4
cggttcggaattcccgggtcgacccacgcttcggtcgtgcccgcacgtgagcgggctcgccgcgctgctccgcgcggcgcacccggagtggggcccggcagccatccggtcggcgcttatgacgacggcgtacaacgagtaccccggcggcggcaacggcatcctggacgtggccacggggcggccggccacgccgctggacgtgggcgccggccacgtcgaccccgcgaaggccgtcgacccggggctggtgtacgacatcgcggcggcggactacgtggacttcctctgcgccaacaactacgaggcggcgcagatcgcggcgctcaccaggcagcacgcgtccgaagggtgcagcgccaaccgcacctacgcggtgaccgcgctcaactacccgtccttctccgtggcgttcccggccgncggcggcacggcgaagcacacccgcacggtaaccaacgtcgggc

SEQ ID NO: 33572 - DNA, 409 bp, Zea mays
  unsure at all n locations
  Clone ID: LIB3059-036-Q1-K1-H6
aaatcaaaatatatccatgagcattcatgcaaaaacatcttgaattccttttactatcacatgctgaaaatgagggataccaagagaacagttcgtacgtgctcatcttgacaagtgtattacaccagtacacatacagtctcagctttgagagcgttgcgacacacacatcacagctagcacggcggtgccaactgccaagtcacttgcctagcactgcgaactcttgctaatactcgctatctacctttgagttcttcttcaaacatgcgcattttctcctggatcggcgccaaaaaggacttgagatccttgcagatccgtgttctatcatcagacgcgaggcccttgtcatcgccgaaccttacttgtacctncaagtcatcgatctcgccgaatgaaaactcgg

SEQ ID NO: 33573 - DNA, 481 bp, Zea mays
  Clone ID: LIB3059-037-Q1-K1-A3
taccggtctcggattcccgggtacgacaccacgcgtgcggacgcgtcctccggacgcgtgggcggtctcgttggctctcggtgctcttctacacccaggtccctcctaacatcttctgcaaccgcggcaagctctacgagttctccagcacgcagagcatgccaaaaacacttgaaaagtaccaaaaatgcagttttgcagggcctgaaacagcactccagaatagagagaatgagcaactgaaaagtagccgcaatgagtacctcaaactgaaggcacgtgttgataatttacagcggactcaaaggaacttgcttggtgaagatcttgagtcattaggcataaaagagctggagcacctggagaagcagctcgattcgtccttgaagcacataagatctacaaggacacaacacatggttgatcaactgacagaacttcagaaaaaagaacaaatgttttgtgaagcaaataagtgtct

SEQ ID NO: 33574 - DNA, 444 bp, Zea mays
  Clone ID: LIB3059-037-Q1-K1-A4
tgctcaagtactaccagggcgtgattgacaacatgtacaaaagtgctaagtgaactcagggtacagtacacatcccgatgaagattcccaacgttgaatcttgtttgagcagccagaagttctgctttgtatatgctcgtagtttgtatgcgagaattctttcctgtatcagttttttcagaaacgatttgccttgggcatatatatagcaaaaccggcaatgtggccagcagccaagtggagacaccgtttcaaattgattgaactatggcgaatactgattgacagaagggttagggcatgcttggtacctttaccaggtactattctacctggccgagcaaattgattaaggccaactgtttggatccaatttaggccttctttgaaatgtgggatttttttcccatttcctatgtatttcctgtgaaaataaactgattc

SEQ ID NO: 33575 - DNA, 322 bp, Zea mays
  unsure at all n locations
  Clone ID: LIB3059-037-Q1-K1-B3
cgttcggaatcccgggtcgacccagcgttcgcccgatgacctacagctatgatgccgtcttagtcgaaccttgcttattggcctcccggggctcgctgtnaccatcctctgcatcctagtccggtccgncttcgcggagttctggctcgacgagttcaccacggacggcgacgtncgcagagactacgaccgttctggccggcaggtggcgtcgcttgtcctcgaccagcgttctggcgctggcttcaactccacgcgcaagtacctcttcggcgagttcagcgtggagatgaagctcgtcggcggcaactccgctgggact

SEQ ID NO: 33576 - DNA, 444 bp, Zea mays
  Clone ID: LIB3059-037-Q1-K1-B5
tattgagaccaacaagcaacatagaatgtggaatccagtagcaacaacagagcaacgggggcgaccaagatattttccctccttatgctccttgctctttctgcatgtgttgctaacgcgacaattttccctcaatgctcacaagctcctatagcttcccttcttcccccataccttccatcaatgatagcttcagtatgtgaaaacccagctcttcagccctataggctccaacaagcaatcgcagcaagcaacatacctttatcacccttgttgtttcaacaatcgccagccctatctttggtgcagtcattggtacaaaccatcagggcacagcagctgcagcaactcgtgctacctgtgatcaaccaagtagctctggcaaacctttctccctactctcagcaacaacaatttcttccattcaaccaactgtctacactg

SEQ ID NO: 33577 - DNA, 371 bp, Zea mays
  Clone ID: LIB3059-037-Q1-K1-D10
ggagattcttcactgccgatggtagcttgggttccacgctgtggcttgtgctgaggcgattgatcccggtaatagtattggttgcagtttgtgtgggttacttcatgcacagcagtgttgaagagatagactgcatcaactgttagttgagcagggtatctgtgctcaccttctgtcctttttcaggtgagtgtttatcgttgtatagatctgatgagtactacacgtatttgttggttgtgtgggttgaggacttgagggcgaagtattcacgtgtactgtactgttaaacttgacttgtctaatagttgcttccactgtctcaaaaaaaaaaaaaaaaactaaatataaaaaaataaccgaaagtttac

SEQ ID NO: 33578 - DNA, 429 bp, Zea mays
  Clone ID: LIB3059-037-Q1-K1-D11
taccgcgaccattttcccgcaatgctcacaagctcctatagcttcccttcttcccccgtgacctctcaccagcggtgtcttcggtatgtgaaaacccaattcttcaaccctataggatccaacaggcaatcgcagctggcatcttacctttatcacccttgttcctccaacaatcatcagccctattacagcagttacctttggtgcatttattggcacaaaacatcagggcacaacaactacaacaacttgtgctagcaaaccttgctgcctactctcagcagcagcagtttcttccattcaaccaactagctgcattgaactctgctgcttatttgcaacaacaactaccattcagccagctagctgctgcctacccccaacaatttcttccattcaaccaactggcatcattgaactctcctgctt

SEQ ID NO: 33579 - DNA, 302 bp, Zea mays
  Clone ID: LIB3059-037-Q1-K1-E10
cgacccactcgtccgggggtttcaatctctgcaaccactgtctaacaacaaagacaatgatgaaattttcattaagctcttttatgacaaggatgacaagaaggaaaatgcttagcttaatgagcgtgccaagaactctgtcatcattaacaaattccttaaacctactgaaggatatatgtactacggcagacttcatcgtctaatgctccgagatcatcgtcatacatttagatgcctatactaaaaggcatacattcatgctccatctactgctgctccatacattgaatatcaacctc

SEQ ID NO: 33580 - DNA, 470 bp, Zea mays
  unsure at all n locations
  Clone ID: LIB3059-037-Q1-K1-E3
ttcccgggtcgacccacgcgttcgcgagaaagggcaaactgggggggacctacccgaagtccgaggcagggcaaaaaggccggtgcccncctcccggcggttggcgggctcgtgccacggtgcggtagccccgtcgacgccggcggacagcgtgcactatgggttgcttcttcttcgggccagctaggaaatactgaagggctgaacactatcagcaacgatagctctccagacgccagttcaaaggacttgcgtgctaagttggtattgctgggagactcaggtgttgggaaaagttgcattgttcttcgttttgttcgtggtcagtttgatcctacttccaaggtaactgttggcgcatcttttttatcacaaacattggcattggaggattcaacaatagtgaagtttgaaatttgggatactgctgggcaagagaggtatgctgccttggcgccactttactacaa

SEQ ID NO: 33581 - DNA, 443 bp, Zea mays
  Clone ID: LIB3059-037-Q1-K1-E7
tacaacacaaacagtgagaaattattagtaaagtgtgcattgtggtgcggccactgtgccatgtccgaaccaccgggcaagggcccgtgccctttcgaaccttcccggtcccggattgccttcaacccgaaaggccaagccttaagaaccaacagttccaagccgccgatccgaagaacttcgcaatccgtactctgttccggccttgaaggaaggggatggtcgccgattttatgccaatttactcgcgccccacgccgcgagtctttgatcgatgtgtttgtacagtcgaaagagcattgctttacataggaccattcatatatatatattgatcttccctcccttcctcttcccgcgggccgtcagaggcaatttcgccctcgattcgaccccgattcgttcgcccgcgaccgggattcccttcggcaagcgcggatctg

SEQ ID NO: 33582 - DNA, 439 bp, Zea mays
  Clone ID: LIB3059-037-Q1-K1-F5
tgtgaccctacgtcagccgcgtcgcgtcgcatcctacgatccaaagctctctctgctgggaggtcgcagccatggcgaagaactacccgaccgtgagcgccgagtacagcgaggctgtggacaaggccaggcgcaagctccgagccctcatcgccgagaagagctgcgccccgctcatgctccgcctcgcgtggcactccgcggggacgttcgacgtgtcgtcgaggaccggcggtccattcggcacgatgaagcatcagtcggaattggctcacggcgctaacgcggggctggacatcgcggtgcggctgctcgagcccatcaaggaggagttcccaatcctctcttacgccgatttctaccagctcgcgggagttgtggccgtggaggtcaccggtgggcctgagattcccttccaccccggtagggaagacaagcc

SEQ ID NO: 33583 - DNA, 122 bp, Zea mays
  Clone ID: LIB3059-037-Q1-K1-F7
aatcaaaggatgcgccaaatgcttgcagactccagtgagcaggactgcagtatacactgacattgaggcagtaatattaatgttgatagagagaattaaatacatctctttgtttttgaact

SEQ ID NO: 33584 - DNA, 461 bp, Zea mays
  Clone ID: LIB3059-037-Q1-K1-G10
cggtttcggattcccggtgtggacccacgcgtccgcccacgcgtccggtcgaaactgctgcatatcggcaccctggagttgagcagtacgctggcaggtcatttgctgatgcattagatgctgttccactagccttggctgaaaacagtggtttgtcaccaattgataccttgaccgcggtaaaagctcagcaagttaaggagagcaacccccactgcggcatagactgcaacgatgtaggcaccaacgacatgaaagagcagaacgtctttgagaccctgattggcaagcagcagcagatcctgctagcaactcaggtggtgaagatgatcctgaagatcgacgacgtcatctcaccgtccgagtactgatgaagcctgaaggaaggaggaaaaaaaaagagaggaacaggtggctatgctggatgagagtttagtaggcagcattgctgatgtgttgat

SEQ ID NO: 33585 - DNA, 439 bp, Zea mays
  Clone ID: LIB3059-037-Q1-K1-G11
ccggttcggaattcccggctcgacccactcgtcctcggactcgtgggcggactcgtgggcgttctcgtgggaaaaaaaaaaaaaaaaaaaaaatggaaaataaaaaaattaaaaaaaaaaaaaaaaaaaaaaaaaaaaaaaaaaaaaaaaaaaaaaaaaaggccggccttttttaaggttccaacttttcttccccttccttccaacttcttaccttttttttagtgtcccctaatttcatttcattgcccttctttttacaacttcttgactggaaaaaccttggctttacccaacttattccctttgcatcacttccccttttccccagttggcttattaccaaaaagccccgcaccattcgcctttcccaacatttccccagcctaattggcaatttgaaccccccttttaccgtccctttaaccccggcggtttt

SEQ ID NO: 33586 - DNA, 406 bp, Zea mays
  Clone ID: LIB3059-037-Q1-K1-G5
atagaatgatcgtcattatgttcatcgccaacactgatgcttccataaacataacagcacaagcaaaagcatccaactacagccggctgtaggtttccagtagtttcagattatccggagttcttagcatgtaacatcattaaaaaaaaacaaaactctatagttaatagggtggtattgtgccgaaacccgcttggcaagaagcttccgaaggaccaacagaactagcgcagaaagcagtatctgcgcaagcatataatcgaacaaatctaggactggatggtccaaaacctcgagagatacatcggcatcaaacgcagataatgcaaccacaacacatcttatcaggaagcaggtaacacaaattgctgtcacagtcccaacctcataaagcttcttttgccgc

SEQ ID NO: 33587 - DNA, 470 bp, Zea mays
  Clone ID: LIB3059-037-Q1-K1-G8
cggaattcccggctcgacggaccacgcgtccgcaccgctgcctccaccacctagtttgccacctttacctccaaggcctccaatgcagtgcggatatgctagctcctggagtcatgagatttccaccacctccgccaccaccagattcaaggccatcgcttatggcggctggagttaacaggccccctccacctcctccaggatttccaccgtctcaaatgccaatgccaccgtatggtgtgctccctggtccgccgccgatgcttaggcctccatttttgccaggacctcctatgcaactagatgagtttgctgcctttgccccaaggcctcagttacctcagcagccatcatacgtgaagtcggctgccccaacagttgtgaagagaccattagcacagcacactcctgagctgacggctatgggttctgcatcagtccgtgtcaagagagaatctgctctccccaag

SEQ ID NO: 33588 - DNA, 429 bp, Zea mays
  Clone ID: LIB3059-037-Q1-K1-G9
ttggcttctcctccccctccggttcgggttcgggttcgtgaggttctccggggttcgggttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggtgggtacggtggtggccgtggaggcggcggctacggcggtggcaggcgccgtgatggcggtggct

SEQ ID NO: 33589 - DNA, 250 bp, Zea mays
  Clone ID: LIB3059-037-Q1-K1-H10
tcccggctcgagacccacgcgtccggtgtcgaaaaggtcctagggagatcagtgcagtgaaggagaaagttcttagcgagaacgaacatttcaaattttctaggggccacatatattattggtccatccttattcaacagtttcacaattttattttatacacactacacaatgccttcgatacaaaatattacttttccaagttgatacatcctattcatttcctgtccaattgacctctccattctct

SEQ ID NO: 33590 - DNA, 389 bp, Zea mays
  unsure at all n locations
  Clone ID: LIB3059-038-Q1-K1-A10
cggaattcccgggctcgactccacgtcgtctcgtaatgcgcatcgagaaagggccgtcgacaggggggatattaatgggtcgtcgnntcgtctagccagtcagctcacgcgtccgcgctgcaaatcctcgtcagctcgtccgtccctggctcnttccgtgccctcgtcggctggtccatgcgtccatgcgtccgggacccctcctggtcgtgtccggggtggggccccatcccgcatcaactctcgtctcccgagtctgccccgctggtacccgtgactcagccccggaccctgcgntngcatcgggcccgtcgccctttcccgtggccccggagccctgaagaaggagatgcnttngccgggagcctgtngcggacatcnnccggcgt

SEQ ID NO: 33591 - DNA, 422 bp, Zea mays
  Clone ID: LIB3059-038-Q1-K1-A12
cggatccagccgaaccccctcgcagtcgcagccccctcacgccacgcgacatgggcaagatcaggatgcccgtgccgtccctgttccgccgccgctcctccaagccgccgccgccgcagccgcagcagcaggcgcctgccgcgggcgacggcgacggcagcgggtccccggagcgggcgacggcggaggaggagatggcgcgcgtgttccgcaagttcgacgcgaacggcgacgggcggatctcgcggtcggagctggcggcgctgttcgagagcctgggccacggcgcgtcggacgacgaggtggcgcgcatgatggccgatgcggacgcggacggcgacggcttcatcagcctgcccgagttcgcggccctcaacgccacggtggccggcgacgcggccgctctagaggatccaagctta

SEQ ID NO: 33592 - DNA, 403 bp, Zea mays
  Clone ID: LIB3059-038-Q1-K1-A3
cacgcggacgcgtgccaaataaaaggaaaaagtgaggcatccccagaagaatgtgatcaggctgtggagtgcctcagcactgcaaaagctaaggctaaagctaaacaggtacaagaatctctgaaggttggccaatcaattatacagaaattttgggcaagagtactgtgtgtcggccctgctcttcatgctgatgcttcaatgagcagggctgattgtgcagcaaaacttaagcattggacggatgaattcgcttgtacactgcagcactactggttagggacaaaactactctgcgcagatgttaggatctcatcaagattgctggtgaaacttgctgggggaaaagcctttcaagattagacaggccacaatttgacacgcacaacagcatatatctcca

SEQ ID NO: 33593 - DNA, 243 bp, Zea mays
  Clone ID: LIB3059-038-Q1-K1-A5
tttgcatgcatatgcattatcatatacgcagtcgcgtagcaggttttcttatggttagcgcttgagctgaggggggagggaaggagctgtttgcttttgctgaagaataatggtgtagtcggctggggtgaggcgatgtgcgttgccagatacagttttgtcttgttgactctacttatctgattatcatttgtaagcgatttgctcaagttatttgtcgtttatgaataacttgctttcctc

SEQ ID NO: 33594 - DNA, 236 bp, Zea mays
  Clone ID: LIB3059-038-Q1-K1-A7
agatgcgaaccaagtcctttttttaaaaaaaagtgacaatgaactacctgtgtattaggagatacattattttcagcttaactctaatattatttacatctcatgtaggctcttcccaaacttatacagcagagctgaagacaagaaatgaccgtgaccgtgaagacataatgataacatcctagtttacatttacactattctgcactctatgccatgtatacagttccagtaaa

SEQ ID NO: 33595 - DNA, 294 bp, Zea mays
  Clone ID: LIB3059-038-Q1-K1-A8
ctatttcggttgctttttttttgtagaatctggaaatgtaacttcttatttatgcatggccacatacataatccaaataactttattattgaattacaactaataagcaatttaaaatacggcaccaccaatgatgcattgatgttagcaagcctacttgtttgtcaaagcaagttggacaaacggcatcaattgtcgtatttctaaataaccagcgcagagagccacacgtatcatgtcaccatttgtgcttaagcaatattttctaatagattatcatctgaatcttggaac

SEQ ID NO: 33596 - DNA, 221 bp, Zea mays
  Clone ID: LIB3059-038-Q1-K1-B1
tttttagtccacaacagggtgcggcattagatcactaaccatcccttatctgataatacagccgaattgcaaatagttcatgacatatgctacataattgacatctaacattaaaagtgcctaaaacacaaatagcctacctttgaaatggcaaccttagaaaagaactcttattgacctgataggaaaagttcccaatagttaacactataggcaaaagg

SEQ ID NO: 33597 - DNA, 436 bp, Zea mays
  Clone ID: LIB3059-038-Q1-K1-B10
cggattcccgggtcgaccagcgttcgatccgcacctataatatctgggctttaaaaaccccactaaccgaacgcactagcggcgcccgtacaacaatggctaccaagatattatccctccttgcgattcttgcccttttagtgagcgcaacaaatgcgttcattattccacaatgctcacttgctcctagtgccattattccacagttactaccaccagttacttcaatgggcttcgaacacccagttgtgcaagcctacaggctacaacaagcgcttgcggcgagcgtcttacaacaaccaattgcccaattacaacaacaatccttggcacatctaacaatacataccaatcgaacgcaacagcaacaacagttcctaccaacactgagccacctagccatggtgaaccctgccgcctacttgcaacaacaact

SEQ ID NO: 33598 - DNA, 442 bp, Zea mays
  Clone ID: LIB3059-038-Q1-K1-B2
ccgggtcgacccacgcctacgaaagaagccaagccaggggctggtcacttaatcctgcgcaagaacttgcttttggagaaaaaaaccccggaagccattatggaaggaggtgcccgtgccagccaaaaaaggaccgtgcttgtcaccggggccttcggcttcgtcggctcctggctcgtcatgaaacttctccaagccggctacaccgtccgggcgaccgtgcgcgatcccgcgaacgttgggaagaccaagcccttgatggaccttcccggagcaacggaacgcctgtccatatggaaaagccgacctgcggaagaaggcagcttccacgacgccatcaggggctgcaccggcgtcttccacgtcgccacgcccatggacttcctgtccaaagaccctgagaatgaggtaatcaagccgacggtggaagggatgataagca

SEQ ID NO: 33599 - DNA, 52 bp, Zea mays
  Clone ID: LIB3059-038-Q1-K1-B4
gaattcccgggtcgacccacgcgtacgcccacgcgttcgcccacgcgttcga

SEQ ID NO: 33600 - DNA, 366 bp, Zea mays
  Clone ID: LIB3059-038-Q1-K1-B8
gtctctccaccaagcttttcgtggtcctcctcctgctcgtttgttacaccgggacgcaaggcgggccggtgactatggtgtcggcgaggaagtgcgagtcgcagagcttccgcttcaagggaccttgctcgagggacgccaactgcgcaaacgtctgcctgaccgaaggtttcaccggcggcgtgtgcaagggcctacgccaccgctgcttctgcaccagggactgctagtactgcctcgcctcgtgtcctgcgtgtgcatatatagccgcagcggatcagtaaaacatgcatgcatgcgttaccaaatatttggcagtaccagcaagttaatgaattaaaatattaaataatatgtcatggaaaa

SEQ ID NO: 33601 - DNA, 453 bp, Zea mays
  Clone ID: LIB3059-038-Q1-K1-B9
ccggaattcccgggtcgacccactcgtccgcccactcgtccgagaccaacaagcaacatagaaagtggaatccagtagcaacaatagagcaacaatggcgaccaagatattttccctccttatgctccttgctctttctacatgtgttgctaacgcgacaattttccctcaatgctcacaagctcctatagcttcccttcttcccccataccttccatcaattatagcttcaatatgtgaaaacccagctcttcaaccatataggcttcaacaagcaatcgcagcaagcaacatacctttatcgcccttgttgtttcaacaatcgccagccctatctttggtgcagtcattggtacaaaccatcatggcacaacagctgcagcaactcgtgctacctctgatcaaccaagtagctctggcaaacctttctccctactctcagcaacaacaatt

SEQ ID NO: 33602 - DNA, 71 bp, Zea mays
  Clone ID: LIB3059-038-Q1-K1-C12
ccgctccggaattcccgggtcgacccacgcgttcgcccacgcgttcgcccacgcgttcgcccactccttcc

SEQ ID NO: 33603 - DNA, 378 bp, Zea mays
  Clone ID: LIB3059-038-Q1-K1-C5
ttgttttggtttttttttttttttttttttttttttttttagctaagccgccaaaataagaatttgggggagcaataatgtcaaaagcgtcttttttttattggaggcagtactttattgacctccgtgaacaaaaaatgatcccaccagaggactggtaagaggattccatcataagtcactgactaactggggtgaggagctttacaacatgctaccatgtattgcaatcgcttttccccacaggaggttcctaaactgggctcgcattatataagaagttagccaactttcctatgcagcagaagagttcaaccttagcatgcgaacttcccatgcatttatgctatgtataactcgtttaatacccaaaattaa

SEQ ID NO: 33604 - DNA, 367 bp, Zea mays
  Clone ID: LIB3059-038-Q1-K1-C8
cgacccacgcatccgaagacgcttgctgatctagctatgaatagctgatagctccttcaaagagcaggacagcattgatctgaccctagactacgcgaacactatagcactttctattattaagcaaattatagaggataagatcacccctatcaacgtcgatatctccaaggttgcttccaagtaccacctctacacccatgccgacgtcgaatcctagatctctaagctgtgaaacgctttcgtagctcgcgatatacatgtcatcaatcacctatagacgaaccttttacaaatcgtagacatcctatgatcttgattatacctgtcatcttactctgttgttaactcctcaatgacaatctat

SEQ ID NO: 33605 - DNA, 78 bp, Zea mays
  Clone ID: LIB3059-038-Q1-K1-D12
gaggggggaaatgcacgcctggattccgggtcgacccagcgtccgcggtcgcgtgggcggacgcgtggggcaaattct

SEQ ID NO: 33606 - DNA, 457 bp, Zea mays
  Clone ID: LIB3059-038-Q1-K1-D4
gaattccggtcgacccacgcgtacgctcagtccttgtctctggacccaaactgcgtgtttcaaatgcaggaaaggcatttggggctggggtagatgccattggctattcctatgccgtgatgccatccgccaaggatcttgtgcctgaaactcaccctcactttatcggcacctactggagcatccacagcaccaccttctgtgcgtagattgttgagtacgcagatgcctacctctttgcacgccccattttgaatgactacagctctgttggctactcattgctactcaagaaggaaaaggccatcatcatacaacctgagcgcgtgataatggcgaatggtccggcattctgatgtgtgatgatgaaagagttcttgtctgaattggctaacaggtgtaataagaacaccactgactatgagaattaccagaggatctttgaatctgatggcca

SEQ ID NO: 33607 - DNA, 431 bp, Zea mays
  Clone ID: LIB3059-038-Q1-K1-D6
aagcaacatagaaagtcgaatacagtatcaacaatcgagcaacaatggcggccgagatattttccatccttatgctccttgctctttctgcatgtgttgctaacgcgaccatttttcctcaatactcacaagctcctatagctgcccttcttaccccataccttccatcaatgaccgcttcactatgtgaaaacccagcaccttcaaccctacaggctccaacaagcaatcgcaacaggcaacttacctttatcacccctgttctttcaacaatcgccagccctatctttggtgcagtcattggtacaaaccatcacggcacaacagctgcagcaactcgtgctaccagtgatcagccaagtagctctggcaaacccttctaactactctcagcagcaacaatttcttccattcaaccaactgtctacact

SEQ ID NO: 33608 - DNA, 450 bp, Zea mays
  Clone ID: LIB3059-038-Q1-K1-E4
tccggaattcccgggtcgacccacgcgtacgcccacgcgttcgcccacgcgtccgtccacgcgttcgaccacgcgttctcttacgaaagggctgttgcacaggaaaaaaccgagcaagaaacaggtgcacgggtctcaatcagtgatggtacagtcactattgttgctaaaactcaagaaattatggataaagctattgagaaggttgagttcctcgtgggacgtgaaattgaagttggtcgtacatacaaaggaattgtttcttcgattaaggagtatggcgcttttgtggagttcaatggtggacaacaaggcttacttcatatttcggagtagtcacatcaaccggttacgaaagtcttggatgttgaaactcttgcgcaatatctgtctatgagatgcattggacaggacatgcgtggtaacattaaaattttacttaaagcaacc

SEQ ID NO: 33609 - DNA, 178 bp, Zea mays
  unsure at all n locations
  Clone ID: LIB3059-038-Q1-K1-F12
ggaattcccggctcgacccacgcgttcgcccacgcgtgcgtccacgcgtncgactggaccctggtggttatttgcagcaacaactattaccatgtaaccaggtaggtactggctaattttaagaacaaccacttgttgcatttaacccattgggcggaatggaacccggtggttattt

SEQ ID NO: 33610 - DNA, 122 bp, Zea mays
  unsure at all n locations
  Clone ID: LIB3059-038-Q1-K1-G11
cccacgcgtnccgaaaaaaaaaagaaaatttaaaataaagggccggcggtttaaagggtcccagcttaccttcccctgcatgccaagtcataactcttctataggggcacctaaattcaatt

SEQ ID NO: 33611 - DNA, 102 bp, Zea mays
  Clone ID: LIB3059-038-Q1-K1-G5
accggtctcggaattcccgggtacgacgccacgcccgtccggtctacagcttacagtgcctatcacgcaccaagtgggcctacatggagaagggctctcgca

SEQ ID NO: 33612 - DNA, 270 bp, Zea mays
  Clone ID: LIB3059-038-Q1-K1-H12
cggttcggaattcccggctcgacccacgcgtaccgggggtacaatgccgttgttagctcgtttagaagagtatcggctatgtgcaagggatggcgatatgcattcaaccaacttgctttgacaaacccagcagcgttctaccaacaacccatcattggtggtgccctcttttagattgcttatgagttatagttcaataataaagttgttgtgatgatgtttgtggcttaccagagataagaaagtacagctctagatgcttatgtgcaa

SEQ ID NO: 33613 - DNA, 394 bp, Zea mays
  unsure at all n locations
  Clone ID: LIB3059-039-Q1-K1-A1
ggaattcccgggtcgacgccacgcgtccgggaggagcaaggagcacgactcgatgggtcactccaacgtttggaactcgcaccctaagaactacggccctggctcccgcgtctgccgggtctgcgcgaaccctcacggtctgatcaggaagtacgggctcatgtgctgcaggcagtgcttccgcagcaacgccaaggacattggtttcatcaagtaccgttgaagaggccactgtgctgctgtggagaacttcctacatcaaagaaatgggtccttcattagaaggcctaatttatgcgctntagctttttgttcagaacttgagactcatgtgttaaactcgacttgttaaagttttgatggctactttgtgcttgttggaccagctttaatc

SEQ ID NO: 33614 - DNA, 331 bp, Zea mays
  Clone ID: LIB3059-039-Q1-K1-A11
aattaccggctcgacgcacgcgtccgcaggcacacagcaacagagactcgaactttgaaggatcctccataacaagcagccttggatccacctaaatgggtgctcatgcaaactcaatacagccaggcttctttcctattccaaccacttatattaaccattacttgatctctgatgctacaactggaatagcgtatggacttgcccacatagaatatgcctatacacctgccactatcacctgcaaatttaaccattcaagatccacagatatacacaatgttggtcctcatgaatatcagaatggtccttcaacgatctgtcgacgacc

SEQ ID NO: 33615 - DNA, 190 bp, Zea mays
  Clone ID: LIB3059-039-Q1-K1-A2
cccacacgtacgagaaaaaaacaaaggttaactttaacgctaggaactcacacactgagaacgagcaggcctggctgtctagagggcccaagcttaactaaccctgcattccaagtccttagttttccaacggaggatctgaaatcaattaagtggccgtaactttacaaacataggaccgggaaaaacc

SEQ ID NO: 33616 - DNA, 179 bp, Zea mays
  Clone ID: LIB3059-039-Q1-K1-A3
cggaattcgggtcgacgccacgcgtccggcctggtcgagatgtacggcaagaactctcgcctgagggagctggcgaacctcgtgagcgttgccggcgaccacggcaaggagtccaaggacagggaggagcaggcggagttcaagaagatgtacagcctcatcgacgagtccaagttgaa

SEQ ID NO: 33617 - DNA, 460 bp, Zea mays
  Clone ID: LIB3059-039-Q1-K1-A4
cggaattcccggctcgacccacgcgttcggagaccaactagcaacatagaaagcacattagtgtaccaacaatggcagccaaaataggttgcttccttatgctccttggtctttctgcaagtgctgctaccgcaaccattttcccacaatgctcacaagctcctatagcttcctttcttcccccatacctctcaccagcggtgtcttcagtatgtgaaaacccaattcttcaaccctacaggatccaacaggcaatcgcagcaagcatcttacctttatcacccttgttccttcaacaaccgtcagccctattacagcagttacctttggtgcatttgttggcacaaaacatcaaggcacaacaactacaacaacttgtgctaagaaaccttgctgcctactctcagcaacagcagtttcttacattcaaccaactggctgcattgaactctgctgctta

SEQ ID NO: 33618 - DNA, 220 bp, Zea mays
  Clone ID: LIB3059-039-Q1-K1-A7
cgacggcacgcgtccggccgacgcgtacgatcgtatgccaaatcttactgctacaacgctcaccaatacacaaagggtgcatggccacgcgccgccactgtcaaccactgctactgctaccatccgtcgccattgccgacaaccctgcttacgcggcgctgttccgccatacctgtcatcagctgagcgtttagaacctgaaaaccgacttgatcaactc

SEQ ID NO: 33619 - DNA, 390 bp, Zea mays
  Clone ID: LIB3059-039-Q1-K1-B8
aactactaccattcagccagctagctgatgtgagccctgctgccttcttgacacaacagcagttgttgccgttctacctgcacgctatgcctaacgctggcaccctcttacaactgcaacaattgctgccattcaaccaacttgctttgacaaactcaacagtgttctaccaacaacccatcattggtggtgccctcttttagattgcttatgagttatagttcaataatgaagttttttggatgatgtttgtggcgtcccagaaataagaaagtacatttctagattcttatgtgcttctagtctccaaatgtggtcgatagttattttgctctaagatcgggagtaatgaagtaaaaaaaaagatataacagaagacaaacactgaag

SEQ ID NO: 33620 - DNA, 333 bp, Zea mays
  Clone ID: LIB3059-039-Q1-K1-C1
attcccggctcgagccacgcgtccggcgctagcagaacagaatgaggacggtttttccatccttttttatttgcaaaaaatcgtgcccagatgaatggaaaaattttcttgaaagggtgcattgcgagagtgaagatcaactccacgagactgagcattctgaagagcagcttcgcctttgggcatcataccgatgacaaactttgacaagatctgtaagagggatgatgtactacagacaagctatagtgcttcaggcttcccttgatatggccagagatgatgaccttatggagggttttagagcagctgacctgttatctgaatctgatg

SEQ ID NO: 33621 - DNA, 440 bp, Zea mays
  Clone ID: LIB3059-039-Q1-K1-C4
cggaattcccggtcgacccacgcgttcgctggacactctagtaaagtgaaaaattcacttatattcaacacatttgtattgtgccgggtgtgtaatgaggtcaattctcgtaaaccagaagaactgaacatcttttccggagtttcaagaaatcatcttttcttggcagtagtgagcataactgttgtgatgcaagtgataattattgagttcctcgggaaatttacatcaacagtgagactcaactggaagctttggcttgtttctgtagttattgcttttctaagttggcccttggcttttgttggaaaattcattccagttccgaagactgaattgaaagatctcattgtaaggtgttggcctaaacgtggcgagagtgcatcacaacagactcatgatgacagaatggaagtaccagtgtgaaacttgtcttgagc

SEQ ID NO: 33622 - DNA, 411 bp, Zea mays
  Clone ID: LIB3059-039-Q1-K1-D1
gaattcccgggtcgacccactcgtccgtgatgctgaactgaagctggtcggtgtgtatggtctgaggtgcaagcgtgagctttggagggtccagtatgcactgagcaggatccgtaatgctgcaaggcacttgctcacccttgacgagaagaacccccgtcgtatctttgagggtgaggcgcttcttcgccgcatgaaccgctatgggctgcttgctgagggtcagaacaagcttgattatgttcttgccctcaccgctgagaacttcctcgcaaggcggcttcaaacacttgtcttcaaggctggcatggccaagtccattcaccatgctcgtgtcttgatcaagcagcgtcacatcaaggttggcaagcaaattggcaaacgtccatcattcatggtgagggtggaatc

SEQ ID NO: 33623 - DNA, 237 bp, Zea mays
  Clone ID: LIB3059-039-Q1-K1-D11
tattgactgaggttggtttaaccatgcgtgatacatgcagccttgagcatacagataagataggcttgtttgttcttcctgtggttgtttatgatgtatccagtgagtcactcaacaactttggcgaaagcccagatgttttcttgcaatttttgaaaaatattccgcgccctgaaaaaaaaaaaaaaaaaaaaaaaaaaaaaaaaaaaaagggcagacgatctaaaagatccaaac

SEQ ID NO: 33624 - DNA, 91 bp, Zea mays
  Clone ID: LIB3059-039-Q1-K1-D12
agcaaatcgagttaagatgttgccggttgtcattatatagcaagaattccatgacaaagattgcttggcacttgattgctgctttggttgc

SEQ ID NO: 33625 - DNA, 154 bp, Zea mays
  Clone ID: LIB3059-039-Q1-K1-D2
ccggctcgagccacgcgtccgcctgcctctgctgctccagagctcgttttcacctgtcaccggcaccctcgatcacgcggtgcggcgaggtaaggtcagcatggtgagggtcagtgtgcttaacgatgcgctcaagtgcatgtacaaacctgag

SEQ ID NO: 33626 - DNA, 416 bp, Zea mays
  Clone ID: LIB3059-039-Q1-K1-D9
gacgcacgcgtgcgagggaacctcattagcaacattttaacttcaatggctaccaagatattatgcgtccttgcgcttcttgcactttttgcgagcgcaacaaatgcgttcattattccacaatgctcacttgctccaagttccattattacacagttcctcccaccagttacttcaatgggcttcgaacacccagctgtgcaagcctataggctacaacaagcaattgcggcgagcgtcttacaacaaccaatttaccagttgcaacaacaatccttggcacatctaacaatacaaaccatcgcaacgcaacagcaacatcaattactaccaacactgagccacctagccatggtgaaccctgccgtctacttgcaacagcaattgcttgcatcaaacccacttgctctggcaaa

SEQ ID NO: 33627 - DNA, 361 bp, Zea mays
  Clone ID: LIB3059-039-Q1-K1-E1
aattcccgggtcgacgcactcgtccggggttggcttctcctccccctccggttcgggttcgggttcgtgaggttctccggggtgcgggttcgtgggtgagcggatcgagatggcggcgtcggatgttgagtaccgctgcttcgtcggcggcctcgcctgggccacggacgaccactcccttcacaacgccttcagcacctacggcgaggtcctcgagtccaagatcatcctcgatcgggagacgcataggtcccgcggcttcggcttcgtcaccttctccacggatgatgcgatgcggaacgccatcgagggcatgaacggcaaggagctggacggccgcaacatacccgtcaacgaggcc

SEQ ID NO: 33628 - DNA, 454 bp, Zea mays
  Clone ID: LIB3059-039-Q1-K1-E4
tcccgggtcgacccactcgtccgcagctagcaacatagaaagcacaatagtgtaccaacaatggcagccaaaatattttgcgtccttatgctccttggtctttctgcaagtgttgctaccgcaaccattttcccacaatgctcacaagctcctatagcttcccttcttcccccatacctctcaccagcggtgtcttcaatgtgtgaaaacccaattgttcaaccctacaagatccaacaggcaatcgcaacaagcatcttaccattatcacccttgttcctccaacaaccgtcagccctattacagcagttacctttggtccatttggtggcacaaaacatcaaggcacaacaactacaacaacttgtgctagcaaaccttgctgcatactctcagcaacatcaagttcttccattcaaccaactggctgcattgaactctgctgcttatttgc

SEQ ID NO: 33629 - DNA, 284 bp, Zea mays
  Clone ID: LIB3059-039-Q1-K1-F1
ctcggaattcccgggtcgacccactcgtccggatgcggatgctgcagcagcagcaccagtaggcctacgacgaggatgaggacatgccggtcggctcgcatagggtgcaatgcgcacagcattatgcagcagtttggtagcggtgataaaatatttgacggcggcgtaaaaatttgtgcgactactgttaggtccaaccgtccaattttacacgcgcgtattaatgttatgatcatacttgtctttgtttaaaaaaaaaaaatactaacaaacaactacacagc

SEQ ID NO: 33630 - DNA, 417 bp, Zea mays
  Clone ID: LIB3059-039-Q1-K1-F10
ttgtcgtgtaaagaattgttttcgctttgtttgattgtcagaatttggcagcgaagaattgaatcgatgttgaataccaaatcagtttagatattgaaatgggcatcaaatcaaattcttgtttggatggacaagaatttggtatgtaaaatcatagggaattttccaattccaatggatgggctagacaggggtccggcgtgaactgcacgattggaaaaaggtcagccgattccacccaaaaggagtgcacggcctctgaattgtgcgcggccatggctactaaaatgaacagtagtgtggaattggattgcaatgtattgcaattcagaataaaacatcagcatttgcttcagccaataccatttcctggattctgagtgccaatcatccaacggtgtgttaatatgctcctgt

SEQ ID NO: 33631 - DNA, 227 bp, Zea mays
  unsure at all n locations
  Clone ID: LIB3059-039-Q1-K1-F8
cggttctcggaattcccggctcgtacccacgcgtctcgcaccaacgtcaaattgcacccaagaaatccatcngagaggctcgtcgacaggggcaattaatggtcgtcgtcgtctagcagcagctcacccggcgtcttattctcgcagacgccgttctggtcttcgtgctctcgggtgtcagagccagcgcccggacctcctgcgtgccccggtgggccataccgcac

SEQ ID NO: 33632 - DNA, 224 bp, Zea mays
  Clone ID: LIB3059-039-Q1-K1-F9
cggtaggaagcatgagctggctgtgcttactcctgctggcagtggcagctaccaacaaggtcaagctggcagcgcccaacagtaggcacaacctcagagtgatctgcctgaataagtactcgtagactgtaataattaaacaaagcttgctcatggttaaactgcgtgttgattagtctttcaactacatagctctaaagtttgtgataaaaaaagacagacct

SEQ ID NO: 33633 - DNA, 362 bp, Zea mays
  unsure at all n locations
  Clone ID: LIB3059-039-Q1-K1-G1
cgaattccgggtcgacgcactcgtccgcgcagacccaacaaccgaggaggaaactcgagcttcaaataggaaattttgggaaactgctttggggaccgttgctggctgcgtgattttgtacatcatagccatgggttggggaaagagaagtggattactgcaatgatgcggaagcatgactgcatgagtgttctgtacccagtgaatactgggttcacaaaaatctccaaaatgagagattcagcttgttcgctgcggcttgctgcggctgcaatccggctgcagctgcggcttctacagtatttttctctctatggatngcagctgcagcagtccaaacagctgcaacagtgtcggcttgt

SEQ ID NO: 33634 - DNA, 234 bp, Zea mays
  Clone ID: LIB3059-039-Q1-K1-G10
aagaaaaaaaaaaaaaaaaattaaaaattaaaaaaaaaaaaaaaataaaaacggaaaaggggaaatactaaaattaaaaacaaaggggctgccgttctagatgatccatgcttacgtacacatccatgcgactgtcatagcatcttctatggtgtaccttaaattcaattcattggacgtctttttccatcgttgcgactggaaaaaccctgtctttcaccaaacttaatcgct

SEQ ID NO: 33635 - DNA, 174 bp, Zea mays
  Clone ID: LIB3059-039-Q1-K1-G4
ggattcccggctcgacgccacgcgttcgcagcatagaaagcacaatagtgtaccatcaatggcagccaaaatattttgctttcttaggctccttggtcttttttgcaatgctggtaccgcaaccatttatccacaatgctcacaaagctctatagcttactttattcccccata

SEQ ID NO: 33636 - DNA, 343 bp, Zea mays
  Clone ID: LIB3059-039-Q1-K1-G6
accggttcggaattcccggctcgacgccacgcgtccgatgatcttaggcagattgagccacaatacattcaccaagcaatctacaacatggttcagtccataatccaggaggagcaacaacaacaaccatgtgagttatgtggatctcaacaagctactcaaagtgcggtggcaatcttgacagcagcacaatacctaccatcaatgtgcggcttgtaccactcatactaccaaaataatccatgcagcagcaatgacattagtggtgtttgcaattgaagaattgtgtctacctagccgttatactcctataacggtgttaagcaataaagtaccatacatt

SEQ ID NO: 33637 - DNA, 354 bp, Zea mays
  Clone ID: LIB3059-039-Q1-K1-G9
cccacgcgtccgcccacgcgtccgcggtactcgtgggctcctgcctatgtacaggagcaggaactactaccattcagccagctagctgctgtgagccctgctgccttcttgacacagcaacaattgtagtcgctctacctgcacgctgcgcctaacgttggcaccctcttacaactgcaacaattgctgccattcaaccaacttgctttgacaaacccagcagcgttctaccaacaacccatcattggtggagccctattttagattgcttatgagttatagctcaataataaagactttttgatgaaaaaccaacaacacataattggtggtgccctcttatagattgctaat

SEQ ID NO: 33638 - DNA, 468 bp, Zea mays
  Clone ID: LIB3059-040-Q1-K1-A11
ggaattcccggtcgacggacgcgtccggaattccctgttcgaaccaatcagataccaagagaaatccctacgaagaagtactcagtgctcgtcatacttggtgctggaactctaccttttggaacactcttcatcgagctcttcttcattctttctagtatttggcttggaaggttctattacgtgtttggcttcctccttgtcgtgcttcttttgctgattgtggtgtgtgctgaggtatcacttgttcttacctacatgcatctctgcgcggaggactggaggtggtggtggaaagctttctttgcttctggaacagtggccctttatgtgttcctttactctatcaactacttggtgtttgatctcagaagcttgagtgggccagtttctgctattctctacattggatactctttcgttgactcccttgccattatgctagcgactggtaccgttggctttctg

SEQ ID NO: 33639 - DNA, 334 bp, Zea mays
  Clone ID: LIB3059-040-Q1-K1-A2
ttcccggctcgaccgacgcgtccgggagaagaagaaggcccgacgccctcgttgctgccaccaaaatcgcacgcgagcccgaggtatccccaaacgctacacgcgcccgccggcgcactcggggaccgtcgaatcgagcaggttgacggatgagaggaagcctcgaagatgttccggaaccagtacgacaccgacgtgacgacatggagcccccaggggcggctgttccaggtggagtacgccatggaggccgtcaagcagggctcagcctgcgtcgggctccggtccagcacccacgccgtcctcgccgccgtcaacaagcccgacttcgagc

SEQ ID NO: 33640 - DNA, 458 bp, Zea mays
  unsure at all n locations
  Clone ID: LIB3059-040-Q1-K1-A3
tccggaattggctcgagcgacgcgtccggctccgacgtcgttaccctcttcgcgcctctccgcgcggccccggcccgagagggcccccacgcttttcagcccggcgccgaatccttctncgccggcgacgcttccgcacatgtggagccacaggtggacggaactggctccggcaccaccgtcgacttcaagttctgcgcctcctgctcgtacaggggaactgcaatgaccatgaaacggatgctggaaacctnctttcctgggatccatgttgtcttggaaaattatcctccgccgttccccaaacgcgctctcagtaaagctgtaccccttcttcagttcggcgcgatggcaacattaatggccggtgatcagatcttccccaggtttggaatggtcccgcctccttggtactactcactccgcgctaatagatttgggaccatggcgtcaatctg

SEQ ID NO: 33641 - DNA, 430 bp, Zea mays
  Clone ID: LIB3059-040-Q1-K1-A7
tgcttcttctatgtgcactcggagacccgcgacatctgcggagagacttcctggcggcgaccggcgacttcgtgctgtcccaccagcagacgctgccaggcttcactccgccgggctcctacacgatctacatgaagattgtcggggacgacaacgaggagctgagctgcatctcgttcgggttcagcatcggcttcgtcgcgtccagctgaacacgtccgagcccgggcacgagaggcatccagctcatggatgtaattacgtgaagcacactctgtatcctatgactttttgtgggtgtctgtgttcaactgagacgtttttatccggagttgaacatcacagtaaagcaaagtcactgataccatgtaatggaactctgagcgcttgatggggcccgtgttttttagactcacaataaagccggttt

SEQ ID NO: 33642 - DNA, 311 bp, Zea mays
  unsure at all n locations
  Clone ID: LIB3059-040-Q1-K1-B1
cggttcgtgaattcccgggtcgagccacgcgtccgccgacgcgtccgggcgcgcaagctgggcctgcagcctcgccaggtggccgtctgggggggaaccgccgcgcccggtggaagaccaagcagctcgagcgcgacttcgaccgcctcaaggcctccttcgacgctctccgagcggaccacgacgcccttcttcaggacaacaaccgtcttcgctcacaagttgtgtcgttgaccgagaaactgcaagagaaggaggatgcgacgganggcggcgccaccgctgacaccgncgcngccgcggtggacgtc

SEQ ID NO: 33643 - DNA, 357 bp, Zea mays
  Clone ID: LIB3059-040-Q1-K1-B10
taccggttcggaattcccgggcaaaatgttcgcttatctcttgtttttgcttgcctcagtctacttgcaagatctgtgttcagttgactggggtgcttctcagcttctttgatgtgaggagattggcgcacgaaatcacgtagcagtagctcttattccccactcgcgttttaacctgagctgcggcagttggcattcttcattcagtcgtaatggatgggatagctcgtaataagggcggtgcttcgcctggtacaggaaagggaagggaagggaagggaagtgatgggggagtgcgaggacggcaaggagtacaggtgctgggaagagctgctgccggacgcgctggggctcatc

SEQ ID NO: 33644 - DNA, 255 bp, Zea mays
  Clone ID: LIB3059-040-Q1-K1-B11
ggaattcccgggtcgacgccacgcgtccgcccacgcgtccgcccacgcgtccgcgattcagcaaccgtggggattactgaccatgccgaggagcatttgggtgatgttgtctacgtggagctgccagaagttggcgtcagtgtatcccaggggaagaactttggtgctgtcgagagcgtgaaggcgaccagcgatatcaattcgccagtgtccggagaggtggttgaggtgaacgggaagctaagcgaggaacct

SEQ ID NO: 33645 - DNA, 315 bp, Zea mays
  Clone ID: LIB3059-040-Q1-K1-B8
gtaccggttccggattcccgggtcgagccacgcgtccgcccactcgtcctctcactcgtagtctttacgcataggccgacaagcacacgctgagtgtcctttcaaaaattttcgggctctatctaatcctactctacaccctactctcctacccgtccacgatcctggacctcgagctctccatcctcgtcaaccttcatctcctcaaatccatgatcacattcacagagctgctgcttacaaacaccatcgatcccgcctttgcgcgcttcgtccgccacctccagacccttgtcctcgcatcttcatctcacc

SEQ ID NO: 33646 - DNA, 471 bp, Zea mays
  Clone ID: LIB3059-040-Q1-K1-B9
ggaattcccgggtcgacgcacgcgtccggagaccaactagcaacatagaaagcgcaatagtgtaccaacaatggcagccaaaatatgttgcgtccttatgctccttggtctttctgcaagtgctgctaccgcaaccattttcccacaatgctcacaagctcctatagcttcctttcttcccccatacctctcaccagcggtgtcttcagtatgtgaaaacccaattcttcaaccctacaggatccaacaggcaatcgcagcaggcatcttacctttatcacccttgttcctccaacaaccgtcagccctattacagcagttacctttggtgcatttgttggcacaaaacatcaaggcacaacaactacaacaacttgtgctaggaaaccttgctgcctactctcagcaacagcagtttcttccattcaaccaactggctgcattgaactctgctgcttatttgcaacaaca

SEQ ID NO: 33647 - DNA, 475 bp, Zea mays
  Clone ID: LIB3059-040-Q1-K1-C10
ccggttcggaattcgcgggtcgacccacgcgtgcgctccagcactgaacacttgagttattcagtaggtagctagctagctgaatcaggatgggtcctaccgagttgcggccgtccactagccacgacacgacggtgacgacgaccaacgctggcgctcctgtgtggaacgacaacgaggcgctgactgtggtgcctcgcggtcccatcctgctggaggactaccacctgatcgagaaggtggcgcacttcgcgcgggagcgcatcctggagcgcgtggtgcacgcgcgcggtgccttcgccaatggcttcttctagtgcacccacgacgtgacgtcgctgacgtgcgccgacttcctgcgcgcgcccggagtgcggacgcccgtgatcgtgcgcttctcgacggtgatccacgagcggaggtccacggagacgatccgtgacctccgcaggattgtcttgaagttctacaccct

SEQ ID NO: 33648 - DNA, 461 bp, Zea mays
  Clone ID: LIB3059-040-Q1-K1-C11
ggaattcccgggtcgacgcacgcgtccgcctccggaagcctgtcatcaaatccaagtctagcaagcctgtttatgacttcgcctacgactggccgcagtacacacccatcaccgaggcagctgcccatgatatcatgctgttcactgtctccaaatgcaccggccatgccggcaccaggctggggtgggcattggtgaaggatactaaggtggctcagaagatgatcaagtttatagagctcaacacaatcggtgtatccaaggactctcaacttcgtgccgctaagattatcggggcaatatgtaatggctatgagccggtaccatcctctggtaaaacaagccaactcttccatttcgccaaggaaaaaatggcggctcgctgggctagacttcgtgcagctgtggcagcctcagacatctttactcttccttatgagctatctggctattgtagcttt

SEQ ID NO: 33649 - DNA, 466 bp, Zea mays
  Clone ID: LIB3059-040-Q1-K1-C4
ccggtccggaattcccgggtcgagccacgccttccgcgaccttaaaagggggaatccagtggcatcaacagagcaacaatggcgaccaagatagtttccctccttatgctccttgctctttctgcatgtgttgctaacgcgacaattttccctcaatgctcacaagctcctatagcttcccttcttcccccataccttccatcaatgatagcttcagtatgtgaaaacccagctcttcagccctataggctccaacaagcaatcgcagcaagcaacatacctttatcacccttgttgtttcaacaatcgccagccctatctttggtgcagtcattggtacaaaccatcagggcacagcagctgcaacaactcgtgctacctgtgatcaaaccaatagctcttgccaacctttcttcctaattttaacaaccaccattttcttccattcaaccaactgtctacactg

SEQ ID NO: 33650 - DNA, 450 bp, Zea mays
  Clone ID: LIB3059-040-Q1-K1-C9
ggaattcccggggggaggcacgcgtccgcccacgcgtccgcccacgcgtccgggatgatggacgtgcagtccgtcgcgcagcagcggcagaggatgatgcagcttgagcgtgccgctgccgccagcagcagcctgtacgagccagctctgatgcagcagcagcagcagctgttggcagctcagggtctcaaccccatggccatgatgatggcccagaacatgccggccatgggtggactctaccagtaccagctgcccagctaccgcaccacctcctgtggcgtctccgctgccattccgccctactactgattcatgatatttgggaaatctgctctatccatccctctctatctatatctgtaataatgcactaagacgacacacattatcatgtgtggtatgaccaataatatatgcatgatcataataaagttttggttttaatgg

SEQ ID NO: 33651 - DNA, 465 bp, Zea mays
  Clone ID: LIB3059-040-Q1-K1-D11
ggaattcccgggtcgacgcacgcgtccggtcccgcggcttcggcttcgtcaccgtctccacggaggaggcgatgcggaacgccatggagggcatgaacggcaaggagctggacggccgcaacatcaccgtcaacgaggcccagtcccgcggcggccgtggaggcggcggcggtgggtacggtggtggccgtggaggcggcggctacggcggtggcgggcgccgtgatggcggcggcggctacggcggtggcggcggctacggtggcggcggcggctacggtggtggtggcggcggctacggcggtggcaaccgtggcggcggctacggcaactccgacgggaactggaggaactgagcggtggggcccgcgcggccaagttatcctgttcgctgccgtgatgtttaccctagtccagagggtttatcttcgatcgtctcgtgtttgttggtgccatctgtggttt

SEQ ID NO: 33652 - DNA, 449 bp, Zea mays
  Clone ID: LIB3059-040-Q1-K1-D12
taccggtccggaattcccgggatctgccgcgtgctggcaaaattctgcctccctagaacaaccaatggcatttggtttgctggtaaattgtctcgtggctccgtgtgttccctgtggctgtctgtctataatttatgttcattattttgttccggagaccgaagaatctgaggacttgtatgtatctgggatcaagatgtgaatctcgcatgtaccagatgacagaactgttaagacttatatttgtctgacgttaaactgcaagacttttatttaagctagaactttgatcactataagatatggcatgatatagcagggctcttgagatgcattctcttgtgcgtgcttggtaactgtagtcgtgcaactgttgacggcgtttgttcagaacaagtggttgatgaatctgaagatggtttacggagtgggaatgattttgtttgtgt

SEQ ID NO: 33653 - DNA, 457 bp, Zea mays
  unsure at all n locations
  Clone ID: LIB3059-040-Q1-K1-D2
cggtcctgaattcccgggtcggcgcaacccttccggtgtctataatcctaatattcctaaagtgttggaggaattgagtagcaaaggctggaggaangaaagtgagggtgccggagttatattaattcaaggtcatcaaatccccttgatagtggttaagagtgatggtggcttcaactatgcctcgactgacttggctgccctttggtatcggctcaatgttgagcaggcagagtggatcatatacgtgacagatgttggtcagcagcagcactttgacatgtttttcagtgctgcaaagatggctggttggctgccaggtccaaacgaanagaagtttccgaanacaagccatgttggatttggtctagttcttggttcagatggcaagcggttccgaacgcgcagtactgaggttgttcgatgggtaaagctacttgatgaggctaaatctcgg

SEQ ID NO: 33654 - DNA, 472 bp, Zea mays
  Clone ID: LIB3059-040-Q1-K1-D3
ccggtccggaattcccgggtcgagcgacgcgtccgcagcatagaaagcacaatagtgtaccatcaatggcagccaaaatattttgcttccgtgtctccttggtctttctgcaagtgctgctaccgcaaccattttcccacaatgctcacaagctcctatagcttcctttcttcccccatacctctcaccagcggtgtcttcagtatgtgaaaacccaattcttcaaccctacaggatccaacaggcaatcgcagcaggcatcttacctttatcacccttgttcctccaacaaccgtcagccctattacagcagttacctttggtgcatttgttggcacaaaacatcaaggcacaacaactacaacaacttgtgctaggaaaccttgctgcctactctcagcaacagcagtttcttccattcaaccaactggctgcattgaactctgctgcttatttgcaacaacaactacca

SEQ ID NO: 33655 - DNA, 474 bp, Zea mays
  Clone ID: LIB3059-040-Q1-K1-D4
cccggttctgaattcccgggtcgagcgacgcgtccggagcattcagaaacacacctagcgaagcgcactagcaacgacctaacaacaatggctgccaagacattatccctccttgcgcttcttgccctttttgtgagtgcaacaaatgcgttcattattccacaatgctcacttgctccgagtgccattattccacagttcctccctccagttacttcaatgggcttcgaacacccagctgtgcaagcctataggctacaacaagcgcttgcggcgagcgtcttagaacaaccaattgcccaattacaacaacaatccttggcacatctaaccatacaaaccatcgcaacgcagcagcaacaagcactgagccacctagccgtggtgaaccctatcgcctacttgcaacaacagctgcttgcatccaacccacttgctttggcaaacgtagctgcataccaacaacaacaacag

SEQ ID NO: 33656 - DNA, 470 bp, Zea mays
  Clone ID: LIB3059-040-Q1-K1-D9
ggaattcccgggtcgacgcacgcgtccgcccacgcgtccgggatcaattagtgttggacatatgtgtcatatgccttgagcaagaggacaatgctgtttttgtgccgtgtggtcacatgtgttgctgtatggcatgctcttcacatttgacgaactgcccactttgccggagaagaattgaccaagctgtcagaaccttccgccattgatggtgatatatgatgcaaaaaactggcatggtaccaccacatgtactgcttctgaaaccaatttgttcttggaacttggaagtgctggctgctatcaaccaacgacatgaactgcaatactgggacgaagcagcttcaatgagtttgctttttgaacagaacagtgagtgatgcaagttgcaagctcataattggcagttgagatactctcactccctagatagtgccaatgggtgctcttgcctgtaatgtactacaact

SEQ ID NO: 33657 - DNA, 438 bp, Zea mays
  unsure at all n locations
  Clone ID: LIB3059-040-Q1-K1-E1
ccggtctcggaattcccgggtgcgagccacgcgtccgcttgctcagggcatcctccaacatgaccccttcgaggtcctggaccagaggggagtgggcgagctggtgaagtttgctacagagaggggccgcaaagctaggcctaacttgaaggtgggcatttgtggagaacacggtggagagccttcgtctgtggccttcttcgcgaaggctgggctggattacgtttcttgctcccctttcagggttccgattgctaggctagctgcagctcaagtgcttgtctgaggctgcctnctcggtgggcaaccgaatggcctgctgctgggtggatgtggtgatcaacagtattattacagagccatgctatgtgaacattactagtagcaatgctcataaaagctacaatcccatcttccttttttttccagtcatgtaaa

SEQ ID NO: 33658 - DNA, 459 bp, Zea mays
  Clone ID: LIB3059-040-Q1-K1-E11
ggaattcccgggtcgacgcacgcgtccggcattttgcacgcgccaaggaattcaatcacctatatctgatctcactgaacgactgggatttgaggatcgtgacccccctgtggttcctctggaatgctcactcgaagcaccatcatttgatgaggttgatgttcaagccctagcgcatgctgttgagttgacaagacaaggtgctgtggatagcttgaagtttgcaaaaggacatttataccaagcttttcagaacgaattgtgccggatgaagctggacctgacacttctggataaacttgtacatgagtattgtgtatacaggggaatagttgaaggcagttcacatgttctttctggaactgctgacttgaaatgtaatcaaaataatgatgttaataatgaaacacagctttattgtgaaatgaccaacaatcagaatggacattgtagcaccag

SEQ ID NO: 33659 - DNA, 473 bp, Zea mays
  unsure at all n locations
  Clone ID: LIB3059-040-Q1-K1-E2
ccggtccggaattcccgggtcgacgcacccgtccgccaaatttgaatttagaaaatcctgaggacactgtggatgtgggcatcttggtaggagcacnagaagagagatgtgaggtgaaggtggcgttatccaactcattcggcttcggtgggcacaactcatcaattctctttgccccctttaaggaactgccatcttcctcatcgtccaaatagattcatatatctggatctccacatagaagacaagtggactctgcaacttcctcggtgccatagatattacagggaggtccaaactgagcgtatctgagcgaacaaaacatcagcccccctacatgtttcatctatatcacgaagttgcagatatgtggtaactatcaaaaggatttaccgtacctgggccagtgttttcgccttcaccatacctgcccattgtcagtactatttcctagatttggagtagtcccgtac

SEQ ID NO: 33660 - DNA, 388 bp, Zea mays
  unsure at all n locations
  Clone ID: LIB3059-040-Q1-K1-E3
cggttcggaattcccgggtcgacgccacgcgtccgcagcgagggcatccaccggcgctgggagagcggctacaggataacttccacggcagccccaacgaccaagccgctttcatcctgagcatgccgaaacggaagccgatggacgagacacatgaaacgctgcggaccttcgnctttccccagctcacacgtcaaagagaaatgggccaagaacctctacatcgcttcgatttgcttcgggcggaccgtgtgctgatcgcgcgcgcctgggaaatggaagtccaaaccagggccaaccattccgtaccgtggccccttggattaagaaaatccaaaatgggccttaagtccaaaccaagtctaatgataggatcagtgtatctctg

SEQ ID NO: 33661 - DNA, 328 bp, Zea mays
  Clone ID: LIB3059-040-Q1-K1-E5
accggtttcggaattcccgggtcgagccacgcgccgctcaaccgtcacctctcaagagcctactgtagcaacattggagggtacaagaatgaagatttgttgaagtcttagctgcacagcagagcccagataatccaaactggtttcagggtactgcagatgctgtaaggcagtacttgtggttgtttgaagagcataatgtgatgaaatttctaattctgcttgccaacaactggtcccggatggcctttgaaaggtcaatcaaggccacagagaaacaaatgctgatattaccgttgctgtcctaccgatggatgagaaacgtgcc

SEQ ID NO: 33662 - DNA, 466 bp, Zea mays
  Clone ID: LIB3059-040-Q1-K1-E9
acccgttcggaattcccgggtcgacgcacgcgtccgctttcatcaaggttgatgttaaatggtaatgttgcatccgttgggtcgttaatgttgggtgagtcactcatgactataatggatacaaatgactactctgcagttccccagcagttgaaggaacagttgaatgaaaggtaccctggtgcaaggcgtgctgtactgaagactggtggtgattttcccttcctgtctcgtcctgatgaggttaatctgtaccttcagctacatctgagacgagttggtgtagagccaaggtcagacctggtccaaggctttacccgaaatggcagcgctgggagttcaaaggatcaaaaagatggaggggacagctttgataatagtggtggagacaatggccaccatggttcaggtggcagtgatcatgacaggcggcattgtgcatcagaatcacaccattccgacgagc

SEQ ID NO: 33663 - DNA, 415 bp, Zea mays
  Clone ID: LIB3059-040-Q1-K1-F1
cggtttcggaattcccgggtcgaccgacgcgtccgcggacgcgtgggcggacgcgtgggctgtacactcctgatagtttcaaatttttcacaggttctccatgggtcattttgaacagacgctttgttgagtattgtatttttggctgggagaatctccctagaacactcctcatgtacttcacaaacgtgatgctacctctagaggggtatttccattcggttgcatgcaactcggacttccgcaatttcacagtgaacaacgacttgcggtatatgatttgggacaatccacctcagatggagccccatttcctaaatgttacacattatgatgagctagtaaggaatgggggtccttttggccggaaggttaaggagaatgaaccttgttggacaagattgatgatcaagtg

SEQ ID NO: 33664 - DNA, 382 bp, Zea mays
  Clone ID: LIB3059-040-Q1-K1-F10
ggaattcccggtcgagcacgcgtccgcccacgcgtccgcggacgcgtgggagcagtttgagctattcccagcgaacccaaagtggccaccgtcagcagcatgttgtgctgtgtggaagagggcagatgttccatgcctatgcaaatatgttaacaaggaagtagagaaggtatggtgcatggagaaggttgtgtacgtcgccaactatggtaaaagcccgtttcaacctgcctacaagtccggaagttatacagttcctctaagtatgaaaaaggattggttggaacatgtggaactctttcctaaaactttaatttgaaatttgtaccatgtaaaagactattgaaattaatatgtatggagtaatatgcttccttctttt

SEQ ID NO: 33665 - DNA, 463 bp, Zea mays
  Clone ID: LIB3059-040-Q1-K1-F11
ggaattcccgggtcgacgcacgcgtccgcggacgcgtgggtgccgcctacctagaacagcaacaactgatttcatctagccctctggctgtggttaatgcacctacatacctgcaacaacagttgctgcaacagattgtaccagctctgactcagctagctgtggcaaaccctgctgcctacttgcaacagctgcttccattcaaccaactgactgtgtcgaactctgctgcgtacctacaacagcgacaacagttacttaatccactagcggtggctaacccattggtcgctgccttcctacagcagcaacaattgctgccatacaaccagttctctttgatgaaccctgccttgttgtggcagcaacccatcgttggaggtgccatcttttagattacatatgagatgtactcgataatggtgccctcatagcggcatgtgtttcctagaaataatcaata

SEQ ID NO: 33666 - DNA, 464 bp, Zea mays
  Clone ID: LIB3059-040-Q1-K1-F12
ggaattcccgggtcgacgccacgcgtccgggtattacaattgatattgccctgtggaagttcgagaccaccaagtactactgcactggtattgatgccccgggacaccgtgacttcatcaagaatatgatcactggcacttcccaagctgactgtgctgttcttatcattgactcaaccactggtggttttgaggctggtatctccaaggatggccagacccgtgagcatgctctccttgctttcacacttggtgtgaagcagatgatttgctgctgcaacaagatggatgctactacacccaagtattcaaaggcccgttatgatgagattgtgaaggaagtctcttcctacctgaagaaggttggatacaaccctgataagatccacttcgttccaatctctggttttgaaagtgacaacatgattgaaaggtccaccaaccttgactggtacaagggccca

SEQ ID NO: 33667 - DNA, 466 bp, Zea mays
  Clone ID: LIB3059-040-Q1-K1-F2
ccggtccggaattcccgggtcgagcgacgcgtccgcccacgcgtccggagaccaacaagcagcatagaaagtggaatccagtagcaacaatagagcaacaatggcgaccaagatattttccctccttatgctccttgctctttctgcatgtgttgctaacgcgacaattttccctcaatgctcacaagctcctatagcttcccttcttcccccataccttccatcaatgatagcttcagtatgtgaaaacccagctcttcaaccctataggctccaacaagcaatcgcagcaagcaacatacctttatcacccttgtttcaacaatcgccagccctatctttggtgcagtcattggtacaaaccatcagggcacagcagctgcagcaactcgtgctacctgtgatcaaccaagtagctctggcaaacctttctccctactctcagcaacaacaatttcttccattc

SEQ ID NO: 33668 - DNA, 454 bp, Zea mays
  Clone ID: LIB3059-040-Q1-K1-F9
ggaattcccgggtcgacgcacgcgtccggcaaagttgatccattggtcaatctcatgaaagttgagaaggttcctgattctacttaggatatgattggaggtcttgagcagcaaattaaagagatcaaagaggtcattgagcttccaatcaaacatccggaactatttgagagccttggaattgcacaaccaaagggtgtcctcctttatggacctccaggcacaggaaagacattgctggcacgtgcggttgctcatcacactgactgcaccttcatcagggtgtctggttctgagttggttcagaagtatattggtgaaggctcccggatggttcgggaactctttgttatggccagggaacatgcaccatccattatatttatggatgaaattgactctatcggatctgctagaatggagtctggaactggcaacggtgatagtgaagtgc

SEQ ID NO: 33669 - DNA, 435 bp, Zea mays
  Clone ID: LIB3059-040-Q1-K1-G10
ggattcccgggtcgagccacgcgtccgtgtgaagttgacaatgaaaagatggaactcctgctgtcccaactgagcggtaaggacgtcaccgagctcattgccgcgggcagggagaagtttgcttcagtcccatgtggtggcggcggtgtcgctgttgcggcagctgcacctgctgctggcggagctgctcctgcagctgaggcaaagaaagaagagaaggtggaagagaaggaagaaagcgatgatgatatgggcttcagcctcttcgactaggctgcacagtcatcacagtattgttttgggcagtgaaaccagaggaaaaccagagtcatgtttagattttaagcttgttttatgttggaaagtactggaaagactgctacttgtctttatatttggtaattcagccgtagattgctatgctggttgggattt

SEQ ID NO: 33670 - DNA, 448 bp, Zea mays
  unsure at all n locations
  Clone ID: LIB3059-040-Q1-K1-G11
ggaattcccgggtcgacgcacgcgtccgcggacgcgtgggcaagcgcaccggcgcgatgctgcggcttgccgtgatggagtcggtgctgcagcagcccttcttcaagacggagacggtgtcgcatctggtgcgggagtgcgagtccttgatggaggccgtgttcccggaggcgcgcgatcggggccaggccgccgccgcggcgctcgccgtcgcggaggcggagcagggcatcttccgcaacaccgtggccgcgctcctcaccatgcaggacgtccgcgcggggagctccaccagaggaagccactcgctgccgccgctcaacctgccggactccgactggctacggtccttcgacccgccgtttccgatcccgacccgatgacacttgttgctcgccgctcctagtaggcttgcgccagcctnctcgatctcccttccttttcggct

SEQ ID NO: 33671 - DNA, 441 bp, Zea mays
  Clone ID: LIB3059-040-Q1-K1-G12
ggattcccggtcgacgcacgcgtccgcggacgcgtgggtgacgcgggacttgcttggcgtcggcggaggaggcatcgtgcgctggatatcgacacctagaggagaccaccaaagcagcagcgatatgagctccctggaggccgagatgaagtcggcctcgtccttcaacggaggcaggatgccatgaccgacccatcggtcgagcttataaacaagacataagctcgcgcacagtaagcaagagacttgatcaagcagatgcagtgagaagagtaaggtcatcgttatatagcgtagtagcaatcaatgcaagttatcaactgagtcgcatgagtgagttcatgcatggataaagctggctagcttagctagctttcatcatccgaaaggaccctgggtgagagatcgagaggcgtctttctctgactaaaggagtaagct

SEQ ID NO: 33672 - DNA, 428 bp, Zea mays
  Clone ID: LIB3059-040-Q1-K1-G2
tgaaaatgctacagttcgagctagtgcagtcagcacattggcaaaatttggtgcctggggtgactcactcaagcctcgcatatttgtgctcctgagacgctgcctgtttgatggagatgacgaggtgcgcgatagagcgaccctttacctcaaattgttaggtggggaagctacagtgggtgagacagagaaggatgtgaatgaatttctcttcggctcacttgatgttccattagtaaacttggagacgagtctgcggaattatgaaccttcggatgtaccttttgatatttcatctgtttcgaaggaaacaaaatcccaaccccttgcggagaaaaagtctacaggcaagaaatcagcaggtccagcatctgctgtcagtggctctgtttctacagttgatgcttcgtatgagaagcttctttcgt

SEQ ID NO: 33673 - DNA, 458 bp, Zea mays
  Clone ID: LIB3059-040-Q1-K1-G9
ggaattcccggtcgcgcacgcgtccgagcaccccgatcctgggccagtgcgtctagttcctgaggcatcagtgcagcccgacggcgacgccctactgctcgcctgagtgccagtcgttgcggcagcagtgttgccagcagctcaggcaggtggagccgcagcaccggtaccaggcgatcttcggcttggtcctccagtccatcctgcagcagcagccgcaaagcggccaggtcgcggggctgttggcggcgcagatagcgcagcaactgacggcgatgtgcggcctgcagcagccgactccatgcccctacgctgctgccggcggtgtcccccactgaagaaactatgtgctgtagtatagccgctggctagctagctagttgagtcatttagcggcgatgattgagtaataatgtgtcacgcatcaccatgggtggcaatgtcagtgtgagcaatga

SEQ ID NO: 33674 - DNA, 442 bp, Zea mays
  Clone ID: LIB3059-040-Q1-K1-H11
aattcccgggtcgacgcacgcgtccgcggacgcgtggggttgcctgatgctgctgggactacgtgcggtcagcggctggagaaggtcattggtactgagcacacagacatcattcgcgttcccttcagaaatgagaatggcatcctccgcaagtggatctctcgttttgatgtctggccatacctggagacatacactgaggatgtttccagtgaaataatgaaagaaatgcacgccaagcctgaccttatcattggcaactacagcgatggcaacctagtcgccactctgctcgcgcacaagttgggagtcactcagtgtaccatcgctcatgccttggagaaaaccaaataccccaactcggacatatacttggacaaattcgacagccagtaccacttctcttgccagttcacagctgaccttattgccatgaaccaca

SEQ ID NO: 33675 - DNA, 455 bp, Zea mays
  Clone ID: LIB3059-040-Q1-K1-H12
tcggaattcccgggtcgacgccacgcgtccgcccacgcgtccgggtggcttccgcagcagcggtggttatggtggtggcggctatgggggtggtggtggtggctatggtggcggtggctatggtggcggctatggtggtggtagcggtggctatggcggcggcggcagtggtgactatggtggcggcagcggtggatatggtggcaactacggcgacagggctggtggtggctatggtggtggtggtgattatggagttgcaggtggggctgaaggcagttttgctgctggaggtagcgacagctttggcagcagtaactttgctgacagtggttttggtgaaaaccctgctggtagctttggcgcaatgggtggttccagtggcgctgatgggttctctgccggcacacctggtgacggttacaagaatgatgaaatcatggatgatctcttta

SEQ ID NO: 33676 - DNA, 339 bp, Zea mays
  Clone ID: LIB3059-040-Q1-K1-H3
ggaattcccggctcgagccacgcgtccgactggaaccccgctgcttatttgcagcttcaaatactactaccatttagccagctagctgcagcaaaccgtgcttgcgggttgacacagcaacagttgctgcctttctaccagcagtttgcggctaaccccgcaaccctcttacaactacaacaattgttgccctttgtccaacttgctttgacagacccagcggccttctaccaacaacacatcattggtggtgccctcttttagattgcttattagttgtaattcaataataaagttttttggatgatgtatgtggccaaccagaaataagaagttaca

SEQ ID NO: 33677 - DNA, 183 bp, Zea mays
  Clone ID: LIB3059-040-Q1-K1-H8
ggaattcccgggtcgagccacgcgtccgcgccctactactgattcatgatatttgggaaatctcctctatccatctctctctgtgtatatatgtaataatgcagtaagacgacacacattatcatgtgtggtatgaccaataatatatgcatggtcataataaagttttggttttaatgaatc

SEQ ID NO: 33678 - DNA, 209 bp, Zea mays
  Clone ID: LIB3059-041-Q1-K1-A1
tagcgactttattacatccttgtgcctatgtctttcggcaattatgttaaaacctttgtcaaattaatgaaattaaacagattgactctctcgttaattcaccccacatacccacaaaaatctgaactattaaccatcaatggtgatcttaccattctttttttaagaaacctcataaatctcttttataacccatatacacttaatta

SEQ ID NO: 33679 - DNA, 389 bp, Zea mays
  unsure at all n locations
  Clone ID: LIB3059-041-Q1-K1-A11
gcaaaatccccaaatccgcggcggagaggggagagccggagacaggggcgcggccagagagatcggagaaggggaagaagatggtgcgggtggcgacctacttcgcgatgaccttcggggcgttcctcttctggcagtccatggacagggtccacgtctggatcgcccttcaccaggacgagaagaaagaaaggatggaaagggagctggagataaagagaatgcaggcagagttactggcccaagctaaagagaacgaatcatgattgtcatttgtccaatggtttcaggcagttcctttatcgtatttcctctgctgtattttccatgcaatatcttgactgatgtatgctcatgctcaacacctncaataaagcgagacatgctat

SEQ ID NO: 33680 - DNA, 431 bp, Zea mays
  Clone ID: LIB3059-041-Q1-K1-C3
tgcctccttcaagctactctaatgtcctttctattcaagtctagcaatggcggcaccagtgagaaaaatcccatccccagaaaacagcgagaaaaaataaatgaattacgcaaggagcttggtgaacactcatcagaagccattaaagacttcctttcagatgcctcgttagtgcgatttcttcgagcaaggaactggaatgtgcagaaagctagtaaaatgatgaaagcagctgtgaagtggcggcttgcattcaaacctgaaaacatctgttgggatgatattgcagaggaagcagagactggaaagatatatagggcggattataaggacaaacatggcagaactgttcttgtattgaggcctggcttagagaacactacctcagcaataggacaaatcaaatatctagtctactctctggagaaagc

SEQ ID NO: 33681 - DNA, 410 bp, Zea mays
  Clone ID: LIB3059-041-Q1-K1-C7
tcctcgtccccgcccgacaccaccgcgtacgacgagctccgcctccggggcttcccgcgcggcctgctcccggccaacgtgcgggcctacacgctcgactccggctccggggacttcgccgtcgacctccgctccagctgccggatcgtgctgcccgcggggagctacctcgccgccttcagcgaccgcctcacgggccgcctcgacgaccgccgcatctcgggcctcgacggcatccgcgtcagggccttcttccgctggtggtccatcacggggatccgcgccgatggggaccagctcgtcttcgaggtcggctccgtctccgccaagttccccgcgcgggacttcaacgccagcctcgactgccccgcccaggcggcgtcctaagtcaaggaggtatcctgtcgcat

SEQ ID NO: 33682 - DNA, 128 bp, Zea mays
  unsure at all n locations
  Clone ID: LIB3059-041-Q1-K1-D1
nnnnnnnnnnnnnnnnntnttggttggttttttttttttagaatctggaaatgtaacttcttatttttggatgatgtatgtggccaaccagaaataagaagttacatttccaaaaaactttttttatt

SEQ ID NO: 33683 - DNA, 446 bp, Zea mays
  Clone ID: LIB3059-041-Q1-K1-D10
taagaccaactagcaacatagaaagcacaatagtgtaccaacaatggcagccgaaaggttttgcttccttatgctccttggtctttctgcaagtgctgctaccgcgaccattttcccgcaatgctcacaagctcctatagcttcccttcttcccccatacctctcatcagcggtgtcttcagtatgtgaaaacccaattcttcaaccctacaggatccaacaggcaatcgcagcaggcatcttacctttatcacccttgttcctgcaacaaccgtcatccctattacagcaattacctttggtgcatatgctggcacaaaacaataaggcacaacaactacaacaacttgtgctagcaaaccttgctgcctactctcagcatcagcaagtttcttcattcaaccaactggctgcattgaactctgctgcttatttgcaacaacaac

SEQ ID NO: 33684 - DNA, 386 bp, Zea mays
  Clone ID: LIB3059-041-Q1-K1-D7
acccacgcgtacgcagccatataaagcacaaaactataccttcactaccatccaaaacatcatactggctggtcctacttgcactttcttcaatacctgctacccaaacccttttaccacaatactcacattattctatagtatacctactacacccatacctctcatcacacataccttaactatcttaaaacaccaatctaaatacctacacaatccaccactatctctatacatgaatcttaccataatcacacattttccactacaacccacatacatataacatcaaacatatctaccacatttactcaaacacaacatcaggccacaccaacaactacacctctaactatcaaacacaattacctacacttaaaaccacc

SEQ ID NO: 33685 - DNA, 385 bp, Zea mays
  Clone ID: LIB3059-041-Q1-K1-E10
ggaagtgataacttcttatttctaggaggccacatacatcagccaaaaaacttcattattgaatgacaactaataagcaatctaaaagagggcaccgccaatgatgtgttgttggtagaaggctgctgggtttgtcaaagcaagttggacaaagggcagcaactgttgcagttgtaaaagggttgcggcgttagccacaaactgctggtagaacggaagcaattgttgttgtgtcaagaaagaagcggggcttgttgtagctagctggccaaatggtagtagtatttgctgctggaaataagcagaggggttcagtgcggcgaattggttaaatggaagaaattgttgctgctgagagtaggcagtagctagctggctgaatggt

SEQ ID NO: 33686 - DNA, 354 bp, Zea mays
  Clone ID: LIB3059-041-Q1-K1-E2
cggacgcgtgggcggacgcgtgggcggacgcgtgggggcgtgtggaagtactgaaaaggtggagggtggagggcaaagacatgaattcgcataaattaaatatgcatgtaatatctatatctgcattgcattttgtgaaatatgatgcatgcatggtttgtatattccgtaataaccagtagttggtaagctatgtgtgtgtatggatgtactagctagtacatgcaccgtatcattgcatgtgtggtatatgtctcgtttggtgttagtaatctgcttggttgtgctgatgactgatggttgtaagaagcaaaaaaaaaaaaaaaaaaaaaaaaaaaaaaaaaaaaaaccaaa

SEQ ID NO: 33687 - DNA, 414 bp, Zea mays
  Clone ID: LIB3059-041-Q1-K1-E3
tgaaccgaaagttcgaggtgtatgagaagcagatgaaagcggccaggaagtctgggagcaaggccgcacaggataaggttaagggccaggcgctatcaaaggctgctaaagaggccgccaagaacaaggggaaagggaagagtgctgcagatgacgatgatgaccagaaacaggtagctgtgccgcggaagtggcgtgactacagtgttgagttccatttcccagagcctacagagctcacaccacctctccttcagctcattgaggtagggtttagctaccctggtaggccagacttcaaactctcaggtgttgatgttggcattgatatgggaacacgtgtagctattgttgggcccaatggagctgggaagtctacgctgcttaatttacttgcgggtgatcttatcccaa

SEQ ID NO: 33688 - DNA, 310 bp, Zea mays
  Clone ID: LIB3059-041-Q1-K1-E7
tgacgatcggactgttggcgctgcttgccgctctgggcctcttctgcatcttccaatcggtctacttcaggtgtcagatccggagaggaccctccttcctcccgctcggctactttaacggcccatgggtgacccgcgtcgctctggttctgatcaccatctggtggggagtaggcgaggtagcgagactgagcttcttgaagcaaaagctgttctccagcttgacatggcagaggaacatatgcgatgcgtacatactttccaacctagggttcgcggagccggggatcttcttcgcattcgctttcct

SEQ ID NO: 33689 - DNA, 468 bp, Zea mays
  Clone ID: LIB3059-041-Q1-K1-G10
accggtccggaattcccgggctcactgtggaggagcgaaacctcttgtctgttgcatacaagaacgtcattggagcccgccgcgcctgatggggcatcatctcctccatcgagcagaacgaggagggccgaggcaatgaggaccgagtaacactcatcaaggattatcctggcaagattgagactgagctgaccaagatctgtgatggcatcctcaagctgcttgagacccatcttgtgccgtcttccactgcccccgagtccaaagtcttctatctcaagatgaaaggtgattactacagataccttgctgaattcaagactggagctgagagaaaagaacgccgctgagaacacgatggtggcatacaaagctgcccaggaccatgctctggctgagcttgctccaactcaccctattaggcttggactggcacttaacttctcagtgttctactatgagaatctg

SEQ ID NO: 33690 - DNA, 374 bp, Zea mays
  Clone ID: LIB3059-042-Q1-K1-A11
accggtccggattcccggctcgacccttgcgacccaccttacaaggtggaatccagtatcatccatagagcaacaatggctaccaaaatattgtccctccttatgctccttgctctctctgcatgtgctgctaacgcgacaattttccctcaatgctcacaagctcctataactatccttcttaccccataccttacatcaacgatagcttcagtatgtgaaaacccatctcttcaaccctataggctacaacaagcaatcgcagcaagcaacataccttgatcacccttgtttcaacaatcgccagccctatctttggcgcaatcattggtacacaccatcaaggctcagcatctgcaacaacttgtgctacc

SEQ ID NO: 33691 - DNA, 181 bp, Zea mays
  Clone ID: LIB3059-042-Q1-K1-A4
gaattcccgggtcgacccaagccttccgaaaaaaaaaaagcacaataaaaaaactttcataaacaaacaaaataaaaaaaaaaaggggggcggctttataagtcccaaacttccgatcccgtgaatacaacgccataattcttataaacggcaccaaaattcaatcaactgcccgcctata

SEQ ID NO: 33692 - DNA, 357 bp, Zea mays
  Clone ID: LIB3059-042-Q1-K1-A6
tttgttttttttttgacgctcaaaaaagatgttttggattagattacatccaccatctgtttaataacagtgcatccttcatctcatgattaaaatatagagagatgcaaaggaggttcaggaacaaaaaaacaacttgctaaataaaacactgctatttactaacaaacatctaacaggttctacccagtactaaaacacaagtaaaaaccgttcagatgttctaatctctctctctctctctctctctctctctctctcttttcactgagaggttagcttcggctcaatccgtcagcaagccaaacacactgaacgccgccaatcggatgcccagccatgacggccaaaacacct

SEQ ID NO: 33693 - DNA, 390 bp, Zea mays
  Clone ID: LIB3059-042-Q1-K1-A7
ggtcgacccacgcgggcggggccacgtgaactctcgctttattgcgagcgacgtgcttctggcgatccgtgacgaggttgagcttggaaagctgttggacagcgtgaccattgcttaccgtggagtgctggccaatatcaaccgtgttctgctgcccatgatgacggcggagaaggcgtccagtggcggtagcaaggaggcaaagtcgtccatgaaggccgccctgttctctactaacgcatagactgactgttcggagtgatctgatgtttagcagtaccttgttaccagaatgctgagatgcgtatgctgcagatgggacgaatgtgcttgtatgtgtatgtaggctgctgtaagttgaactttgctatttacaatggaagaagaaat

SEQ ID NO: 33694 - DNA, 448 bp, Zea mays
  Clone ID: LIB3059-042-Q1-K1-B11
tccggattcccgggtcgacccacgcgttcgtccaatgcaacggccagtggtgaccggttttcccttgggggacaaccggccggcctggcggccttctggaccccccagctggcagatctgtctaatctgtacaatgacctgctgatggtgtttcggtttcgagaagagaaaacggtcccacaactcgttaattcaaagcaacccatccgttgtggtgaacaggggaaaacttctgatttgggtgatgcatcggagtccgattcggatggggattgtcaatctggcaaagaacttgcaccaccagttcagaagcatacaagagccaaccggaagcatatagatagcattactttagttgatatagctcagtacttccatcttccaatccgagatgcatcaaagacactcaagattggggtcagcatattgaagaggaaatgccgacagt

SEQ ID NO: 33695 - DNA, 301 bp, Zea mays
  Clone ID: LIB3059-042-Q1-K1-B12
ggaattcccgggtcgacccacgcgttcgcccacgcgtacgcccacgcgtccacggttcgtgggtgagctgatcgagatcggccgcgtgggatgttgagtaccgctgcttcgtcagctgcctcgcctgtgccacggacgaccactccctccacaacgccttcagcacctacagcgaggtcctctagtccaagatcatcctcgatcgggatacgcagaggtcccgcagattcgggttcgtcaccttgtccacggaggacgcgatgctgaacgccatcgatggcatgaacgagctggaactgga

SEQ ID NO: 33696 - DNA, 466 bp, Zea mays
  unsure at all n locations
  Clone ID: LIB3059-042-Q1-K1-C10
ctctcccgtccggattcccgggtcgaccacgcgtccgcagcacaacagttacctttggtgcatttgttggcacanaacatcagggcacaacagcgacaacaactcgtgctagcaaaccttgctgcctactctcagcaacaacagtttctgccattcaaccaactagctgcattgaactctgctgcttatttgcaacaacaactagtactaccattcagccagccagctgctgcctacccccagcaatttcttccattcaaccaactagcagcattgaactctcctgcctatgtacagcagcaacaactactaccattcagccagctagctgctgtgagccctgctgccttcttgacacagcaacaattgttgtcgttctacctgcacgctgcgcctaacgttggcaccctcttacaactgcaacaattgctgccattcaaccaacttgctttgacatacccagcag

SEQ ID NO: 33697 - DNA, 208 bp, Zea mays
  Clone ID: LIB3059-042-Q1-K1-C4
tcccggctcgacccacgcgttcggagaaaataagagaagataagacgaaagcacttcttgcgttgaaagctgatgacaggggaggggaagttcacaaagatcctcgttctatgcagccactttcaaaccagaaaggaaattcttaaattctcattaagcttggttcttaccaggattacaagaatggaaattcttaaccttattaacc

SEQ ID NO: 33698 - DNA, 299 bp, Zea mays
  Clone ID: LIB3059-042-Q1-K1-C5
tcggttcggaattcccgggtctactccactcgtcctcccactcgtcctcccacgcgtccgcctactcgtccgcccacgcgtcctaaaaagaaagaaaaaaaaaaaaaaaaaaaaaaaaaaaaaaaaaataataaaaataatataaaaattattaacttcttaaacttattcatacaactttataattattatattattttatctaatttcattaatctaatctacttactcacatcttttttaaactgcttaataccttatgttatcaattttgatattatatttgtacatcataattt

SEQ ID NO: 33699 - DNA, 430 bp, Zea mays
  unsure at all n locations
  Clone ID: LIB3059-042-Q1-K1-D2
tccggattcccggtcgacnacgcgtncgaaaaccctagccggccttcatacgccgtcaccgggccgcttcctccctcgccatggggctcgttgctgccgcacgccgtgccgcgtcctcctccgtgcccgtcctcctccgtgcctccgcctcctcggggtcccaccgcagcgccgtcctgctccggcccctcgctgccgccgtggcgccgtcgaagccccgcgcgatgccgatctcctcggcgcccgcgacgagacccagcttcgacgccgagctactcagcgtcatcgactccgagatcaagtacgccgaggactgcgatgaccacgacagggttgcggagattccagaaaatgtccctttcaaaatcagcgacgagaaggggacgaatgcagctacccttaaaagaacatatcaaggtgagcagattga

SEQ ID NO: 33700 - DNA, 239 bp, Zea mays
  Clone ID: LIB3059-042-Q1-K1-D6
cccacgcgtccggaattattagctgggtagctaattaccatgatcggtttatttagttgtctgtttgagaattctttggccagaacgaagaagaattctttttttcttccttgctggtattcatcatatctgcgaggatacgaactgattaattagacctagtcgaactcatatatatacatagtgtgtaaattcaaataagatgatggaacaggttatatgcaattctttcgcttcaa

SEQ ID NO: 33701 - DNA, 467 bp, Zea mays
  Clone ID: LIB3059-042-Q1-K1-E3
accggtccggaattcccgcctcgacccacgcgtgcaccgacacttccgcccacactttctcatgtcgcattagaacaaacaataacaaccaggatgttttccctccttatgctccttgctctatctgcaatgtgttgctaacgcgacaatatttccctcaatgctcacaagctcctatagcttcccttcttcccccataccttccatcaatgatagcttcagtatgtgaaaacccatctcttcaaccctataggcttcaacaagcaatcgcaacaagcaacatacctttatcacccttgtttcaacaatcaccagccctatctttggtgcagtcattggtacaaaccatcagggcacagcagctgcaccaactcgtgctacctgttatcaaccaagtatctctggcaaacctttctacctactttcagcaacaacaatttcttccattcaaccaactgtctacattg

SEQ ID NO: 33702 - DNA, 370 bp, Zea mays
  Clone ID: LIB3059-042-Q1-K1-F10
tcccggttcgaccaagccttccgttgcctgaaggtcctgttccccggttaagggattatttctgccggctcttagttcggggggattgacggttcggggggacttgacgcctgcgaatctgtcgagtcaaaagatgagaatttgaagcgtaatgtaacgctgtagaccaatgctggctctgaacatacatatgatcagagtgatgagggtgagctctgtgagcttcagactacggaatacagataattttggaccaagtgcttggagttcacttggattggattctgctgaattttctggtagggcggccgctatagatgtatcaaacttacatacccgtgcatgctactgcttacctgtctgatagtgt

SEQ ID NO: 33703 - DNA, 453 bp, Zea mays
  Clone ID: LIB3059-042-Q1-K1-F11
tccggaattcccgggtcgacccacgcgttcgctggaactcaaaattatttcaccggagggggaaaaattaaaggagttcccttgatgggtgtgacattattgaaggtggcattggtagtgatagtgttgtgaggtatgctgaagagcagttgatgatgagaaatcagcatcgcatcatccactggcaagcaaggctctgcaagttgaatgacatagttaaaaggggcaacaagtgtgatatcatcctcaactatcacaatttgttgttccaaaggatcatcttaaacatcagtgatacatctagcatatttgtgaacaattcactgaatggaaaccaaattggaaagacatttccaaatttggatgcatctttggcattcaattttgttttcgaagccgaggagaaccaaagagttagtgatttacagtccttgcagaagaagacaatggaaa

SEQ ID NO: 33704 - DNA, 428 bp, Zea mays
  Clone ID: LIB3059-042-Q1-K1-F12
tcccgggtcgacccacgcgttcggtggacctctgatgtgactgcgccgtctgttgctcctactggtgctgattgaagggcgtggccagctccggttcctaccggtgatggctgggatcaagctgggtcccctgcacctgtggtggacggcactgtaccttctctggttgctcctactggctgggaccaagcagccccgccaccgactgcccaaggctgggagtaggcgttgtccactctgagacctgtcttctgcggctgaagttcagtatttttctgtggtctgaatgtccaaattccggtggcatcttctatagctatgctctgctttgctttgaacacttgagttttagggctatctagctgaacccgttgtgcaatattgctgacgttgaaatttttggttaatcttataactggaaatgatgc

SEQ ID NO: 33705 - DNA, 384 bp, Zea mays
  Clone ID: LIB3059-042-Q1-K1-G12
ttcccggttcgacccacgcgttcgcggacgcgtgggcggacgcgtggggcatctttgatgctaaggctggcattgccttgagcggcaacttcgtgaagctcgtgtcctggtacgacaactagtggggatacagcacccgcgtggtcgacctgatccgtcacatgaacagcaccaactaagatgaagaactcaagtcaaggtctggtgatacgagcgagttgtcttcttcccccccgggagaaaagtgcttacgagaataaattttttccatcggaatgtctgaaactatgttgggtgtatcctagtggttggttgagcattaatggctcatattttgtcaggtctatgtgtcgccgtgaaacttttaatcaaatcagttcactc

SEQ ID NO: 33706 - DNA, 179 bp, Zea mays
  Clone ID: LIB3059-042-Q1-K1-G2
aagaacacataaagcaaattatgctagctctaataagaaagaaaaaagaaaaaaaacgagaaaagagatctaataaaaaaactaagggccggcccttctaacgaatccaaccttacttcccagtgcttacgacgtcaaagttcttctagagctcacctaaattcacttccctacccctt

SEQ ID NO: 33707 - DNA, 468 bp, Zea mays
  Clone ID: LIB3059-042-Q1-K1-G8
ggaattcccagctggacccacgcgtgcgaacacacctagcgaagcgcactagcaacgacctaacaacaatggctaccaagaggttgtccctctttgcgcttattgccctttttgtgagcgcaacaaatgcgttcattattccacaatgctcacttgctcctagtgccattattccacagttcctccctccagttacttcaatgggctttgaacacccagctgtgcaagcctacaggctacaacaagcgcttgcggcgagcgtcttacaacaaccaattgcccaattacaacaacaatccttggcacatctaaccatacaaaccatcgcaacgcaacagcaacaacaatttctaccaacactgagccaactagctgaggtgaaccctgtcgactacttgcaacagcaattgcttgcatccaacccacttgctctggcaaacatagttgcataccaacaacaacaacaat

SEQ ID NO: 33708 - DNA, 443 bp, Zea mays
  Clone ID: LIB3059-042-Q1-K1-H10
gtaccggtccggaatgtctcggacccacgcgttcgagcggatccatgtccgcgtggagcatgtgcagccctcccgttgcacggaggagttgggctggaagaaagccaagaatgaccagctcaaggcggatgccaaggcccgaggtgaggtgatcagcaccaagaggcagtctgtgggacccaaacctggcttcatggttgaaggtgctacactcgagacagtcactcctattccttatgatgtggtcaacgatctcaagggcggttactagagagaatttttgtaccttaagcagttcaaacgagctggcaaacttatatgaatctttttgataattggctagttcttctgttctggtgttatgaactcatgtggctattgctgttggcgtcaaaagatttttattattgccatggttgattgcaacctggtatcttaccttc

SEQ ID NO: 33709 - DNA, 423 bp, Zea mays
  Clone ID: LIB3059-042-Q1-K1-H12
taccggtccggacttctcgacccacgcgttcgcccacgcgttcggaccaacactggcatcattgtccttgctgagggtcgtctgatgagcctggggtgtgctactggccatcctagctttgtcatgtcctgctcattcactaaccaggtcattgcccaacttgaactgtggaaggagaagagctctggcaagtatgagaagaaggtgtatgtgctccccaagcaccttgatgagaaggttgctgctctccacttgggcaagcttggtgccaagctgaccaagctcaccaagtctcaggccgactacatcagcgtgccgatcgatggtccctacaagcctgcccactaccggtactaggcagccagcacacggcttgcagctcactcgggccgttgtgtgctatgaagttcgctacactggcct

SEQ ID NO: 33710 - DNA, 452 bp, Zea mays
  Clone ID: LIB3059-042-Q1-K1-H3
cggaattcccgggtcgacccacgcgttcggccaaaccttccaattgcctgtgggggccgtctcttcccgttcggaacgccaagcccgggtggggcgaaatggcccccaagcgaggtggcagggcgccggtgccggccaagaagaagacggataaagtgacgaaccctctattcgagaagaggccgaagcagttcggcatcggcggggcgttgccgcccaagaaggacctgcaccggttcgtcaagtggcccaaggtcgtgcgtatccagcgacagcgccgcatcctcaagcagcgcctcaaggtaccaccggcgctcaaccagttcacccgcaccctcgacaagaacctcgctacgaacctgtttaagatgcttctcaagtaccggcctgaagacaaggctgccaagaaggagaggcttctgaagagggcccaagctgagaatgaaagaaaa

SEQ ID NO: 33711 - DNA, 307 bp, Zea mays
  Clone ID: LIB3059-043-Q1-K1-A1
tccacgcgttcggcagcccgttggactgatggtcctgaacaagaacgtcgacaacttgtttgcagagaatgaacagattgctttctgcccagcgattattgttcctggaattcactattctgatgataagctgctccagacgagaatcttctcctatgctgatacccagaggcaccgtcttggtccaaactatctgatgcttcctgtgaatgcaccaaaatgtgcccaccacaataaccaccatgatgggttcatgaacttcatgcacagggacgaagaagtgaactactttccttcgaggtttgat

SEQ ID NO: 33712 - DNA, 347 bp, Zea mays
  Clone ID: LIB3059-043-Q1-K1-A11
gacggtagaagaaaacacgagcaccactgagagagcgttccaggatcggcagtatcaggttgacgcggacatagttcgaataatgaatactcggaatgtcctcaaccacacccttctaataactgagctttaccagcagatcaagttccatggcaagccagctgatatcaataaaagaatagacagcttgatcgaccgggagtacatgtagcgcgacaggagtaacacccagatctacaactatctggcttgacaacgttctggtggatcgttcgcatctcattactatgagacataggcactgtcaatcaatttattctccggattatcagcatttcatgctatta

SEQ ID NO: 33713 - DNA, 296 bp, Zea mays
  Clone ID: LIB3059-043-Q1-K1-A3
ggtccggacttcctcgacccaccctttcgtccacgcgtccgccaacccttccgaatgccccttccgaaggccgccttcaaaaaccggtagaaccatactttatcttccaccccctactaccacctgaagaagacgtccgcttgctacctctgcactgtcactgtccccgtctacagcacgctgtacctgaccaacctgaacgtcgccttctgcaacgacctgccgatctccttcgccgcgccgtctggccagaccgtctggagctactacaaagttatgatcccccttggcaagat

SEQ ID NO: 33714 - DNA, 256 bp, Zea mays
  Clone ID: LIB3059-043-Q1-K1-B1
aattcccgggtcgacccacgcgttcgcggtcgctaggggctggccagacagactactggcccagtataatgccgattaaccaagacggctactagtacaatacaccgaactacagattcgtgctcgcgatttaccagacacgacatcacaacccatagcatatctgctaggatagcacgtgacatggctcttgctatctgccactcgcatgagatgacacgaaactgtctcaaagttcctctgaccaactattcag

SEQ ID NO: 33715 - DNA, 373 bp, Zea mays
  Clone ID: LIB3059-043-Q1-K1-B10
gacacagcacaaacaaatgaaaggcgcagacagatcgaacaggggcatggcccgatgctgtactgcacactcggaccacacagcacaacacatcacaacacagtctgactgctagatgagccccaggaaggacatgacaggacaggacacgacacgacacggcgccaacatctcggtacaattattcgttcccccatcagtaccaccactagagcaaggcgatggagcagatagagcgaggcatgctatgccatggcccatggcacgcggctgactgtctaactgactcgaacaaaacacagcaaacgacactgctagaatattatatactagctagagcttattaattagctagagagataaagagtccttc

SEQ ID NO: 33716 - DNA, 435 bp, Zea mays
  unsure at all n locations
  Clone ID: LIB3059-043-Q1-K1-B8
cgtaccgtccggattcccgggtcgactacgcgtccgctcgggcgttgctgctctgcgacacgtagctccgaaggccgcagcatcaggcgcgggggccctcgcgtgtgaccgagatggcgctgccgaatcaggggaccgttgattaccccagcttcaagctcgtcatcgtcggcgatggtggaactggtaaaactacatttgtgaagaggcatctcactggagagtttgagaagaaatatgaaccaaccattggtgtggaagttcatccgttggatttcaccactaactgtggtaagatcaggttctactgctgggataccgcanggcaagagaagtttggtggcctcagggatggatactatatccatggccagtgtgcgatcatcatgtttgatgtaacttcaaggcttacttacaagaatggtcctacgtggc

SEQ ID NO: 33717 - DNA, 427 bp, Zea mays
  Clone ID: LIB3059-043-Q1-K1-C10
aagcagaccacaacaagaagaagcgtagtcgtcgccggaaggaaaggcgcggagcaagatgtcgtggcaggcgtacgtcgacgagcacctgatgtgcgagatcgaaggacagcatctcagcgccgccgccatcgtcggtcacgacggcagcgtttgggcgcagtccgagagcttccccgagttaaagcctgaggaggttgctggtatcataaaggactttgatgaacctggtactcttgcaccaactggtcttttcgttggaggtacaaagtacatggtgatccaaggtgaacctggagttgtcatccgaggaaagaagggcactgggggcattactatcaagaaaaccggcatgtccttgattattggtgtctacgacgagccaatgactccagggcaatgcatcatggtggtggagaggctcggc

SEQ ID NO: 33718 - DNA, 407 bp, Zea mays
  unsure at all n locations
  Clone ID: LIB3059-043-Q1-K1-C3
tgaaaattgactgacaagcctacagtttgggaaggtagactcaactgctttgacaccagtggagaagtttgaaacttggaaggagattaaaattatgagtatggtatttcttatattatctacgctatgcatgacttgctgggtctattcattgtctaattataaatatgcatttctaacaatgttattgttcttgtggcttttctctgatttcttacgtttcagaaaaatagtttctgcaatgtgggcaatgacattgcttagcttgtatgttagagttcatgtcaccatattaggtacccatctctactaggattttgcccagtgtacaaatggtgcacagttacaagtacatctatgctccagcctnctcattctatgctcaagcattatcgtatgaatggctt

SEQ ID NO: 33719 - DNA, 415 bp, Zea mays
  Clone ID: LIB3059-043-Q1-K1-C9
tttacttttacagaagtaaatgcaaaacgtgtactttcaaaggcaaaggtcatttgtgtttcttcctagatctgattgtaccatataaatctgtcacaagtcttgcctctctcacctgatcttatttgtagtctgcatgctccatgtcccttggccttggggagagcaccataagcgcttcatcggtgcttgccatgcctatggtctcgtcaagaacaaccggcttcagaggaatcgaaaatgaccgtccaaagtatgtccctttaagaaccactgattggagtaacctatagctgatggtaatatataggtacacaggaaaggtctttgtttttttatgttgcctagcggatggcagtgaagttttttgttgcttccagaggcgcaactgtttgttgtgatcgtagctagctat

SEQ ID NO: 33720 - DNA, 403 bp, Zea mays
  Clone ID: LIB3059-043-Q1-K1-D3
tgacgatagcgctggacccgtctctgtacccagagaatccactcatcatctgggagaatgcacgggcagctgcccagcaggaagggtttgaggtaaagaggaaaggggataaggagtttgttgcaaacattcggctggagatgaactacagccctgagaagttcaagttatcacagccgcttatggaggtgcttggggtggaggtggacactcgtgcacgggtgattgctgccctctggcagtatattaaagcaaagaagcttcagaacccaaatgatccttccttcttcatgtgtgaccctcaattgaagaaggtgtttggggaggacaagctcaagtttgcaatgttgtcacagaagatatcttaacatctgtatgccccaacaaccattaatttggagca

SEQ ID NO: 33721 - DNA, 417 bp, Zea mays
  Clone ID: LIB3059-043-Q1-K1-D4
tcccgggtcgacccacgcgttcgttggcatcgattaatctcgggacattgtcatagagagtgcacgcaggatgttcatcgagacggttgcagcccagcatgaagagcggtaagaagaggatagtgactaagcttatattgtttgtgtttgcattcctcagctggcagattcaatttggttccaacgttcactgatactatgtgatattgtgggtcaaattttccagggttttcttattacctggttgagcgcttgaatctgtcaacagtttatggatcatattgcattacagttagagatgtctgcgtgggtcagcaaaatcttggtgttagtaaccttttgagctgtgacataacttctttatcttatttaacacatcaaagatgattagtgcacttatatcgttgcatgataaat

SEQ ID NO: 33722 - DNA, 231 bp, Zea mays
  Clone ID: LIB3059-043-Q1-K1-D6
cggacgcgtgggtgtcgttctacctgcacgctgcgcctaacgttggcaccctcttacgactgcaacaattgctgccattcaaccaacttgctttgacaaacccagcagcgttctaccaacaacccatcattggtggtgccctcttttagattgcttatgagttatagttcaataataaagtttttttgatgatgtttgtggcttcccagaaataagaaagtacatttctaa

SEQ ID NO: 33723 - DNA, 336 bp, Zea mays
  Clone ID: LIB3059-043-Q1-K1-E1
tcgacccacgcgttcgggctaatcagagaaggctagtggccgtttcataagagcattagtcgcactcttgttagacgtctgatctgaatgtctaatcccacatgacacattttgtaaaaaggctgtagcttctttagccttattagactgctaatacactcatctgaatgatgtccagttccatcaacaaggctttaccgatactgtcgagtgactgatcaggatcatgtttcttgtttcacgtcttgcttctgtgcatttgcctaataaacccattcgttgtaaacaagccagttctaactttaaaataaagggcctgtgcatggcgctctaaaa

SEQ ID NO: 33724 - DNA, 186 bp, Zea mays
  Clone ID: LIB3059-043-Q1-K1-E9
cccactcgtccgcccacgcgtccgaaataaaaaaaaatactaaaaaaaaaaaaagggggaaacaaaaaaacaaaaaaaaaaacaaataggctcccgatctagacaatcaccaccttactaacgctttcatcctatctcatagtctctctatcgtctgacctaagtttaattcaatgaccacctcta

SEQ ID NO: 33725 - DNA, 213 bp, Zea mays
  Clone ID: LIB3059-043-Q1-K1-G1
ccttattcccgggtcgacccactcgttctctgactcgtggtctgactcgtgggataaaaaaaaaaaataaataaataataaaataaagaagagatttctaactatctaaaaaatccaaaacttacatacacatacatacaacatcataaactcttctataatatcacctaaattcaattaactaaaccatatatttacaacataataacttaa

SEQ ID NO: 33726 - DNA, 385 bp, Zea mays
  unsure at all n locations
  Clone ID: LIB3059-043-Q1-K1-G3
tccggaattcccgggtcgacccacgcgttcgcccacgcgtccgctatgaaatcatttgacaacctgaacaactggcgagaagagtttcgagtgcangctagcccatcagatcctgataatttcccttttgttctgttgggtaacaaagttgatgtagatggtggcaacagccgcgtggtatctgagaaaaaggcaaaggcatggtgtgcttccaaagggaacattccgtactttgagacgtctgctaaggacggaacgaacgtggaagacgccttccagtgtatcgtgaagaacgctctgaagaatgagccagaggaagaactgtatgtgccagataccgtggacgtggtgggtggcaaccgggcccaaagatcatctggttgct

SEQ ID NO: 33727 - DNA, 385 bp, Zea mays
  Clone ID: LIB3059-043-Q1-K1-G4
cccgggtcgaccaacgcgtccgccaacgcttccgccaaaatttattaaagaaagagctgaggttgttggtccaattgagttggataatctgggaacgctacacggtgataaggcaagccgaagcattcacatcacatcatttgaaaatcttggtagcgcgaaggttgttgaagcttcctccagttcagacaagaacatggcctgtgatccttcatggacagcatgaatgcctgttatcgaggcacctgatcctgctttgcaggtgaatgctcggaggcacggaaccagaaacaggacttccaccgtgaaagctttagaagctgatgcgtttggacttcttggaagcgggaagcgtaagggtgacatgaagaacagggcgacaagc

SEQ ID NO: 33728 - DNA, 402 bp, Zea mays
  Clone ID: LIB3059-043-Q1-K1-G6
tgcagttcaaggatgtttgtgttaaagttgcaaatgttgagctatactacaaggcaggtcacttctatttgcaggagcatcctgatctcatcaatgatatgctgaatgtgcttgcacttcgtttagatcataccagagttgtagacataatgcgcaaggctggtcaattgcatcttgtgaaaccatatatggttgcagttcagagtaacaatgtctctgctgtgaatgaggccttgaacgaactttatgttgaagaggaagactacgagagactccgtgaatcagttgatatgcatgacaactttgaccaaataggtcttgcccagaagcttgagaagcatgaattgctggagatgaggaggattgctgcctacatttacaagaaggctggcaggtggaagc

SEQ ID NO: 33729 - DNA, 390 bp, Zea mays
  Clone ID: LIB3059-043-Q1-K1-G8
tgcagccctacggcgactccctactgctcgcctcagcgccagtcgttgaggtagcagggttgccagcagctgatgcaggtggagcctcagcaccggttccagacgatcttcggatcggaccttcagctcattctgcagcatcagccacatagaggacagctagtggcgctgctggctgcgcaaatagcgcagcaactgacggcgatgtgcggactgcagcatacgactacatgcccatacgctgctggcggacgtgaaccgactgaagaaactatgtgctgtactatagccgttggctagctagctagcagagtcatttagcggcgatgatcgaatcatgatgattgacgcatgatcatgggtggaacgaacagtgtgaacaatagcctg

SEQ ID NO: 33730 - DNA, 301 bp, Zea mays
  unsure at all n locations
  Clone ID: LIB3059-043-Q1-K1-H4
ggaattcccggctcgacccattcgtaccatcataaccgacctgatgttccttgccttcgggtttgcaattttcttggtccggaaggcactcatctggggcaagaaatcctaaggcgccgtgccattaaccaccatgtttgctctggtactcctctggttcggcatctccgtgccattggtctttatcggcagctacctcggcttcaagaaacctgccatggangacccagtgaggacaaacatgatagcacgggcaataccggagcagccatggtacatgaaccccgtcgtctcggtgctg

SEQ ID NO: 33731 - DNA, 427 bp, Zea mays
  Clone ID: LIB3059-043-Q1-K1-H6
gaattcccgggtcgacccactcgtccggtgtatcacaagagacatctaggttgacctcactcttcttagtgttcatgcccggtaggcaagacatcaccgcatctccgatggagttggaagatttcatcagtttcgattggatctggatgagatggactctgcttgtaaggagagagagagagtgcatggcttgcgaggagcatatttttgttcatccttttcatgagtcatgttacctgccatgtcagattatgtaacttcagatatttctgtttttgttagaaaagtaccaaaatagtttcacttcatggctactctcagatgtgttattgctgctgccactaatcatataagggtaacattgtatttgatagccaacaatttttgagatattaaagttggggataatataattgctggttgtttc

SEQ ID NO: 33732 - DNA, 203 bp, Zea mays
  Clone ID: LIB3059-044-Q1-K1-A12
atgcattcattcaatcacatcggtatggtttttaataaatatgcaaaaattcctctaataactcttatttcaactctgcactatttctaaccatatcccatggaacttgccacaactactgatgccatttactaccatgaacccatggattcaatactccatgaagcaacatcctgttgccaacttgctaacgtaaaccaccc

SEQ ID NO: 33733 - DNA, 456 bp, Zea mays
  unsure at all n locations
  Clone ID: LIB3059-044-Q1-K1-A5
cgggtcgacgcacgagccacgcgtccgcgctgtagggttttctggtcctggtaggcgagctggggaagacgcaaggtactgcgggtgcgcgcgaggggtcgtcggacgaccgacgaggacgagcggcataggcgcgtgcatggcgctcacgaacttcatcctcacggtggtgggggtgggcgcggcggtgatgctgctgcggaaagacgtcaagcagtcggccaccgtcttccgccgcaacgtgcgccacatccgcaactggctcgaggaggagtccgccgccgccgtcaaatctactgaacagtcttcagtgaaggagttggagtcccaagctgccaagaaagacgctgtgcccaaggacgacaaacattagatgatcttacaccctggttcttgtaatgcgtnggcagtttgaggtccaggattttgaattggtcctttaaaaaaatgtatgtg

SEQ ID NO: 33734 - DNA, 450 bp, Zea mays
  Clone ID: LIB3059-044-Q1-K1-A6
tcccgggtcgacccacgcgtgcgcggacgcgtgggtttggaaacaagtatcatctggatctaatgatcttatgtggggtacggatacaaaatagacatcgacgagtggaacgcaacatgagaacgacgaatccacacggagtgtaagaaccgcttcttctcctctagtcctctgaggagatcggtcggatcagaagactgacgagacgatcgcagagaccacggcgagcgcgacgctgcctcggaccccagcctggagcctgataacggcgctgtcgctcgccgggctgcctccggctgatggcgtgatcttgggaggctttgccaaaaagcccgtagtctggcgagcccggtttcaggttaaccaggttgatgcaaaccgagacgttggcgttggggaggctgcaggcggcggggagcgccaggaggcggtcgaagcgcaggccgagcg

SEQ ID NO: 33735 - DNA, 431 bp, Zea mays
  Clone ID: LIB3059-044-Q1-K1-B11
cgacccaagcgttcggccaagcgttcggtcatgcccgcgctttgtgattaccttggtggtaaaggccatgcgtgtgttggaggaacattcgtccgtgaggaccaaaggattcttggcagtggtgtgcatgttgttgttggtacacctggtcgtgtgtttgatatgctgcgcagacagtccctccgccctgataacatcaagatgtttgttctagatgaagctgatgaaatgctttctcgtggtttcaaggatcagatttacgacatcttccagcttctcccagccaagattcaggttggagtcttctctgctaccatgccccctgaggcccttgagattacccgcaagttcatgaacaagccagtgagaatcctcgtgaagagagatgagctgactcttgagggtatcaagcagttctatgtgaatgtgga

SEQ ID NO: 33736 - DNA, 454 bp, Zea mays
  Clone ID: LIB3059-044-Q1-K1-B12
cggaattcccggtcgacccaagcgttcggaggtttacactggatctgccggaaacattcaccggccggtttaaccggttggcaggggcaggcttggttggttgaaaggatcctctgaatccatgggggcctatctccggagttgaacaagcttgagcaaatactcaacctgaatcgccccacagacgtgcctgatactggattgctctgtgatcttctttggtctgatccttccaatgaagcaacaggctgggccatcaatgatcgtggtgtttcattcacatttggtcctgataaagtttctgaatttcttgagaagcatgatttggaccttatctgccgagcacatcaggttgtcgaagatggatacgagtttttcgctagccgtcaactcgtaacaatattttcagcccctaactactgtggagaattcgacaacgctggtgccatgatga

SEQ ID NO: 33737 - DNA, 455 bp, Zea mays
  Clone ID: LIB3059-044-Q1-K1-B3
ggatttcccgggtcgacccacgcgtacgaaaagcctgacggctgtaacaatgaccttaagtttcatagtccatgctaagagactccggggtgtaaagaatgcggactcaatgctataaatataagcttagatacactagtacctgcaaagtttgacttcatgacacggcgtcaaggacactcagaggtcttgtaatcaatagatgctgctgtaaaacttgggtatagccctgttaaggtcaactgtgtcatcatgcatggtataaatgatgatgagatctgcaattttgttgaattgacgagacacaagcccatcaacgttagatttattgagtttatgccatttgatggtaatgttaggaatgtgaagaagctagttccttatgcatagatgttggacaaagtgcggcaaaggtttaaaggagtagagagacttcaagatcaccccacagacac

SEQ ID NO: 33738 - DNA, 418 bp, Zea mays
  Clone ID: LIB3059-044-Q1-K1-C2
tgattgtcttctgcccatgggaattacttctaaaaatgttgcccatcgatatggtgtaactaggcaagagcaagatcaggccgctgctgagtctcataggagagctggtgcagccacggcctctagaaaattcaaggatgagatcgtccccatgccaacaaagatcgttgatcctaaaactggagaggagaaggaagttgtgatattagttgatgatgggattaggccatctacttacctgctatattttttctgagcaaagtcggttaaacttgtgattctttgtatgttcaggtgcccggtgcgtggctactcttctaaatgaaatgaactgccggggcagagactgcagaattggtgttgtcaccatgtggattggatctggaatgggggcaacaggtgtgttcgaagtgtgttc

SEQ ID NO: 33739 - DNA, 414 bp, Zea mays
  Clone ID: LIB3059-044-Q1-K1-C4
ggaattcccgggtcgacccacgcctccggatcatggtccctgagatgattggaagctttgttggtgtctacaacggcaagaccttggaccaggttgagatcaagcctgagatgatcggccactaccttgctgagttctccatctcctataagccggtcaagcatggcaggcccggtatcggtgccacccactcctcgcggtttattcctctgaaatgagctgttacccggctctgtagtctcccaagagtcagttggcaatgttcgttcagcttttctacttgttttgaacaagttaaatgcccaagatattttgttttgttccattccagctcaagaattcaaagctaagcattgcacaattatgctgttttgttggaagtttttgagttaatcatatctaagctgagttgct

SEQ ID NO: 33740 - DNA, 418 bp, Zea mays
  Clone ID: LIB3059-044-Q1-K1-C6
cacatttgaaggtgctactaccctaacctcgctcaggttcatcaccagcaccagagcctggggcccatggggcaccgagaacgggacacgcttctgcatcaccgcgcccatcggcagcagcgtcgtgggattctacggacgcgcgggaaccaggctcgtcgacgctatcggtgtctacctgcgtcaactttgatttcaacggcatgatgcttgatttcaaatagatatattaattagttcctcgtcacagtcgatcctgtgtcaaataataaagaagctcttgtatgcatgtgtatatgttagtccttcgttctgtatgtgtcaaataaaggttgatcaaaaagacctaaaaaacaaaaaatacagctgagcatattaagacacgtataataaagacgagatatatagaacaatgaat

SEQ ID NO: 33741 - DNA, 459 bp, Zea mays
  Clone ID: LIB3059-044-Q1-K1-D1
tgattaccaaggctgcgaagaagggccagatgccgtcgcagattggtgttctgctccgtgaccagcacggcatcccgcttgtcaagagcgtgactggtagcaagatcctccgcatcctcaaggcccatgggttggcgccggagatcccggaggatctctacttcctcattaagaaggccgtggcgattaggaagcattctgaagagggaaccaggaaaggaccaaggacttccaaaattcaagacctcaattctttggttgaaaagccaagaatccaaccggctctggcccggttcttccaggcgtaccaagaagctcccacccacctggaagtacgagtcaaccacggcgagcactctggtggcctaagtgatatcctctgatggcttggtctttagcacctatgagcttgttctagatatgaatttatgtaattcttgttatgtctggagctggtta

SEQ ID NO: 33742 - DNA, 454 bp, Zea mays
  Clone ID: LIB3059-044-Q1-K1-D4
tcccgggtcgacccacgccgtccggccaagccttcggaaaccggttggaccacaagccaattctaagggggtttacattggcccgaccgggatttaccggttccttgacctacttaaggggaaagtttggaatccaaacatctacataacggaaaacggaatggaccaacctggaaacttgacccgagaccagtacctgcgcgacgccacgagggtgcggttctacaggagctacatcggccagctgaagaaggccatagaccagggagcgaacgtggctggctacttcgcctggtctctcctcgacaacttcgagtggctggcagggtactcgtccaagttcggcatcgtctacgtggacttcaacacgctcgaacgccacccgaaggcgtcggcctactggttcagggacatgcttcagaagcattgagatctccagagccgagcctgagca

SEQ ID NO: 33743 - DNA, 401 bp, Zea mays
  Clone ID: LIB3059-044-Q1-K1-E5
cccacgcgtccgcggacgcgtgggcaacagttcgacatagtcagttggttgaatggaagcagctgttgcaagtaggcagcagggtttgccacaactagctgagtcagagctggtacaatctgttgcaacaattgttgttgcaggtatgtaggtgcattggccacagcgagcgggctagatgaaagcagttgttgctgttgtaggtaggcggcagggttcaccatggctagttgactgagcgctggcagaaactgttgcagctgttgttgtggctggtttgcaactacgtttgccagagcaagtgggtttgatgcaagcaactgctgttgcaagtaggcggcagggttcaccatggctaggtggctcagtgctggtaggaattgttgttgctgttgcgttgc

SEQ ID NO: 33744 - DNA, 416 bp, Zea mays
  Clone ID: LIB3059-044-Q1-K1-E8
cggacgcgtgggcggacgcgtgggcggacgcgtgggcggacgcgtggggagagaccgaggcgcccgcggttctgctttccttccttgccccgttcacgagagaattttctggagtcttcgactcgagcagggttccgatggcgctgcaatggatgatcctggcgtgcgtggtggcggtggaagctgcggtggctgcgctggtcacgctcccggtgccccgcgctgtgcggggccagatcgtcgcgctcacgtccttgttcctgcagcccctgtccagtgtgatacccttcggcgccttccagatcctcgatctctactggaagaaggagcacagactgatgtgcacctcggagatttgcaccgccgaagagcgcattcgcttcgagaaatctatgtttaaagctcagagaaatgtc

SEQ ID NO: 33745 - DNA, 430 bp, Zea mays
  unsure at all n locations
  Clone ID: LIB3059-044-Q1-K1-F9
tggcgtcgtcgtctagcagcagccaccggcgnctcatcctcgcagccgccgtcctgctctccgtgctcgcggctgccagcgccagcgccgggacctcctgcgtgccggggtgggccatcccgcacaacccgctcccgagctgccgctggtacgtgaccagccggacctgcggcatcgggccgcgcctcccgtggccggagctgaagaggagatgctgccgggagctggcggacatcccggcgtactgccggtgcacggcgctgagcatcctcatggacggcgcgatcccgccgggcccggacgcgcagctggagggccgcctagaggacctgccgggctgcccgcgggaggtgcagaggggattcgccgncaccctcgtcacggaggccgagtgcaacctggccaccatcagcggcgtcgccgaatgccc

SEQ ID NO: 33746 - DNA, 116 bp, Zea mays
  Clone ID: LIB3059-044-Q1-K1-G12
tccggatttcccgggtcgacccacggttccgggaccccttggcaccaaccccaattttacctataaattcattcagagagccctccagcgggggattaaatggcttcttcgctaac

SEQ ID NO: 33747 - DNA, 300 bp, Zea mays
  Clone ID: LIB3059-044-Q1-K1-G2
tcccgggtcgacccacgcctccggaggaattttcctttattttaaaagggttgttaccggaagaatgccaccttcaaccttgcggggatggaagcctgttaacgtgtcaactctggatgtgacctcaaggcctccgtgatgatgggagcggacacctatgaaactgaagaagaagcttcaaagctactgttagctgggaaggtcccagttggaataggaaggaacacaaagataaggaactgtatcattgacatgaatgctaagattgggaagaacgtggtgatcacaaacagtaagggc

SEQ ID NO: 33748 - DNA, 185 bp, Zea mays
  Clone ID: LIB3059-044-Q1-K1-H5
aagaaaaaaaaaaaaaaaaaaaaaaaattaaaaaaaaaaaaaaaaaaaaaaaaaagaaggggaaaataaaaaaaaaaaaaaaaaaaaaaaaaaaaaggccgcccgttctagaggtcccaggtttacgtacgcttgcatgctacttcatagctcttctatggggtcacctaatttaaattgattgc

SEQ ID NO: 33749 - DNA, 383 bp, Zea mays
  unsure at all n locations
  Clone ID: LIB3059-044-Q1-K1-H8
tccgggtcgactcacgcgtccgcccacgcgtccgcccacgcgtccgcacacagaagcggcggcggcggagcaaacgcaggcgaaggcgagggtgtgagggaaggagcaccagccatggtgcacgtcaacttctaccgcaactatggtaagacgttcaagaaaccaaggcgtccttatgagaaggagcgtcttgatgctgaactgaagctggtcggtgagtatgggctgaggtgcaagcgtgagctttggagggtccagtatgcactgagcaggatccgtaatgctgcaaggcacttgctcacccttgacgagaagaacccncgtcgtatctttgagggtgaggcgcttcttcgccgcatgaaccgctatgggctgcttgctga

SEQ ID NO: 33750 - DNA, 432 bp, Zea mays
  unsure at all n locations
  Clone ID: LIB3059-045-Q1-K1-A11
accggttcggaataccnggcggggaccaagcgtccgcgcacgcgtccgcggacgcgtgggttttgttttcaatttccatcccaagaaaacttgcgagggctacaaagtgggatgcgatttgcctgggaaatacagagtagccctggactctgatgctctggtcttcggtggacatggaagagttggccacgacgtggatcacttcacgtcgcctgaaggggtgccaggggtgcccgaaacgaacttcaacaaccggccgaactcgttcaaagtcctttctccggcccgcacctgtgtggcttattaccgcgtgaacacatcaggtgatgatgcacttaccaatgcattggagatattcaatacatctagtggagctcttcacttcattgcatctaacaatgactgtagtggtagagagtatgatatggaaag

SEQ ID NO: 33751 - DNA, 413 bp, Zea mays
  Clone ID: LIB3059-045-Q1-K1-A2
aagcaacatagaaagtggaatccagtagcaccaatagagcatcaatggagaccaagggattttccctccttatgctccttgctctttctacatgtgttgctaacgcgacaattttccctcaatgctcacaagctcctatagcttccctttttcccccataccttccatcaattatagcttcagtatgtgaaaacccagctcttcaaccatataggcttcaacaagcaatcgcagcaagcaacatacctttatcgcccttgttgtgtcaacaatcgccagccctatctttggtgcagtcattggtacaaaccatcagggcacaacagctgcagcaactcgtgctacctgtgatcaaccaagtagctctggcaaacctttctacctactcttcgcaacaacaatatcttccattc

SEQ ID NO: 33752 - DNA, 442 bp, Zea mays
  Clone ID: LIB3059-045-Q1-K1-B4
ttcccgggtcgacccacgcgttcgtcgcaatctccctagcaatctctagcagcagatcctcgtgcgaagcaaagcgctagggccgttcgtactgtcccgatggcccgcacgaagcagacggcgaggaagtccactggcggcaaggcgccaaggaagcagctggccaccaaggcggcgcgcaagtctgccccggcgaccggcggagtgaagaagccccaccgtttccgccccggcaccgtcgcgctccgggagatccgcaagtaccagaagagcacggagctgctgatccgcaagctgccgttccagcgcctggtgcgtgagatcgcccaggacttcaagaccgacctccgcttccagagctccgccgtcgccgcgctgcaggaggcgtccgaggcctacctcgtcgggctcttcgaggacaccaacctctgcgccattcacg

SEQ ID NO: 33753 - DNA, 411 bp, Zea mays
  Clone ID: LIB3059-045-Q1-K1-B6
tgtagatgctgctaacatgcacatggagattggtagacgcatatacagagagaggttggaaacgagtgatcgtgatgctgacatggaacaaagacgggcatttcagaagttaatttatgtgtccaatcttgtctttggagatgcatctgtattcctacttccttggaaacgtctgtttggggtgactgattctcagattgacattgctatgagggaaaatgccaagaatttatactcggtgcagctcaagtctattggaagaggtcttgacatatgcacactcattgaagtaaggagagcacaacttgcatataaactgtctgatgagattgctgctgagatgttccgtgagcacgcgaagcagctagttcaagataacatttcatcagcattagacatcttgaagtcacg

SEQ ID NO: 33754 - DNA, 351 bp, Zea mays
  Clone ID: LIB3059-045-Q1-K1-C10
cacggctctcgctctggccatccttttcatactctacttcaagctcgctcattaaggttgcctgcaggtaggttccttccacatatctgtgctcagtaattgtgtgataagagttgtctgaatgctgtgtattgagcgacacacggctcttgaagcatcatttattccctcccaaacctgtaaacttaacgtggttcatgttgtgtacagtcagatacgtccaactatgtaaacctaacgcacgttgttctgtcgtgctaactaaactagagaggttagtaaagcagtacttcgtatgtaactgttgtgtgtgcatcggtctattcgaactgctgtggctgtgggccttgg

SEQ ID NO: 33755 - DNA, 179 bp, Zea mays
  Clone ID: LIB3059-045-Q1-K1-C6
tgaaaacgaaaattatacctctctcttgtattattattgatatatttttgtgggtacgaaactcgatcagatgaaacacatccgagttagatgacgcagtcagatgactgagtgttggtgtctgacatccaaggtgaaagatgtatacgtctgcaacgtctatgtagatgtacttaatt

SEQ ID NO: 33756 - DNA, 439 bp, Zea mays
  Clone ID: LIB3059-045-Q1-K1-D3
attcccggttcgaccaagccgtccggcctctcaggaaattgaccaggaccatgaacctggttaaaaggcttgccaagaagtgccatgctttcttggcatcagaggccatcatcaagcagattccccgtctccttggtcctggtctcaacaaggcaggcaagttcccgaccctggttactcaccaggaatccctcgagtccaaggtgaacgagactaaggcaaccgtcaagttccagctcaagaaggtcctttgcatgggtgtcgccgtcggcaacttggcgatggaggagaagcagatccagcagaacatccagatgagcgtcaacttccttgtttcccttctgaagaagaactggcagaatgtgagatgcctgtacgtcaagagcaccatggggaagccatacagggtgttctaagtatgctcttttgtgaagtctgc

SEQ ID NO: 33757 - DNA, 417 bp, Zea mays
  unsure at all n locations
  Clone ID: LIB3059-045-Q1-K1-D4
tcaacccgtccggatttgacctgggtgatgcaaactatcttaggtatcatggtatggaagagtttgatcaggcaatgcaacatcttgagcaaaaatatgaattcatgacatctgatcaccagtatatttcccggaaacatgangaggataaggtgattgtgttcgaaaagggagatttggtatttgtgttcaacttccactgcaacaacagctattttgactaccgtattggttgtcgaaagcctgnggtgtataaggtggtcttggactccgacgctggactatttggtggatttagcaggatccatcacgcagccgagcacttcaccgccgactgttcgcatgataataggccatattcattctcggtttatacaccaagcagaacatgtgtcgtctatgctccagtggagtgat

SEQ ID NO: 33758 - DNA, 389 bp, Zea mays
  Clone ID: LIB3059-045-Q1-K1-D8
cccacgcgtccgtccacgcgttcgattacgcgtccgcggtgtttctaatgtgaagaggtggaacctgccactgatggtgtccaaataagataaatatgaccacagattacagatttgatatccagggactttctaatcagcctattataatctgaagataaatcttgtatcacctgtccggtgacccatagtaatattatgttactcttgctgtaagcagaggttaacactagaaaaagtattgtgattggtctgaactttttgtgcggtataaagcatgtgattcagctcaacttgacttttccaactttaccgagcatatacaattgtgattaatatagaggctcttaaggtgtttaaataaccaatccaagcatgacaagcaaacc

SEQ ID NO: 33759 - DNA, 412 bp, Zea mays
  Clone ID: LIB3059-045-Q1-K1-E1
tccacgcgtccgattgagaccaacatgtcacatagaaagtggaatccagtagcagcgatagagcaacaatggagaccaagatattttccctccttatgctccttgctctttctacatgtgttgctaacgcgacaattttccctcaatgctcacaagctcctatagcttccctttttcccccataccttccatcaattatagcttcagtatgtgaaaacccagctcttcaaccatataggcttcaacaagcaatcgcagcaagcaacatacctttatcgcccttgttgtgtcaacaatcgccagccctatctttggtgcagtcattggtacaaaccatcagggcacaacagctgcagcaactcgtgctacctgtgatcaaccaagtagctctggcaaacctttctccctactc

SEQ ID NO: 33760 - DNA, 292 bp, Zea mays
  Clone ID: LIB3059-045-Q1-K1-E3
tcccggttcaaccaacccttccgcgacacccttggtaaaaaaacaaatatttatttaaaacaaaaataaaaaccaacaagggtaagcttatcaactatatccaaaaaaaaagcaaactaactttctaactgttcaatactcttgacattctttgagtaaactttagatatcctctcatacattcattatccagtacctgattgtccattgtctctatattctttactgtgacattatatggttgactcgcatttcccatttatccagtttctgttatactaccattgcttct

SEQ ID NO: 33761 - DNA, 420 bp, Zea mays
  Clone ID: LIB3059-045-Q1-K1-F12
tgcaatcgttccaaaaccagtatgtttttgttgacgaagaatatagaacagcagcggattttgttcgtcaaaaactggactcaagcgcggcagacgaggtggatgaatctgcttgtgtgataaaaaaatgttctgaatacgctgaaagatatttcaatgaaactgcacaagatgtggtagtacttgagtcagaaagcactgatgaatctgaagtttgcgactgtgagaccattgcttgcacattctctaaccttgataatcatgctgggaaaattgaaactccaggactgcacagaaagcggctccctagagttttccctggagatacaactactacacatgacatcatcaagcttcatgggaaagagaaactgccagtacaatacctgccacagaggagacgaaatggtgaaaaggaga

SEQ ID NO: 33762 - DNA, 448 bp, Zea mays
  Clone ID: LIB3059-045-Q1-K1-F3
ggtccggaattcccgggtggaccaagccgtccgaagcattcggatctgaaatcctaaccggaggtgagacccccaatcggtgatccaccgcttgcccgtcggtaccatgtccgctggaagcgagaggccgtacgccttctcgcccccgtcggcggtcccgggccccttctcccgcggctccggctccgctcccaccacggccgcgacagatagcactgggaggagctcgtcctccgtggcgccgacgaagagccgaaagccaccgttccggcccgccgtggacgacacaaagcccgtcctccgcgatccgatatcacgctcggacctggcggtcaccgagcaggtcgtgctgcggctgccgccgttcccctaagttcgcgccacccaatgttctttgctcaaccatattaatctaaagatggtgccctttctgcgcatgttcgtcaac

SEQ ID NO: 33763 - DNA, 203 bp, Zea mays
  Clone ID: LIB3059-045-Q1-K1-F5
tcggtccggattcccgggtcgactccacgcgtccgcccacacatacgaacacaagttcagttttatcataatagaactataattcttctagggaactacaatctgttctattccttctaattactcaaatgaactctactacatattgtcatcaatttccactcacattgacccagctatattcactttaatattatcaaaaa

SEQ ID NO: 33764 - DNA, 298 bp, Zea mays
  Clone ID: LIB3059-045-Q1-K1-F9
ggattcccggctcgactcacgcgtccgcccacacgtcccaatacgcgttgaatttaaaacaataaaaacatatcttcgggaaagagatcaaaatggcaaataccataacgaatctgaaaaaccacctaaagctcgcacgatactacactctcaaacatctctaccaaacttgcatgatcttctttgaagtccacatttaacagatcaatattcatctaactactttggacgatactctgatttgaactaaatgtattaactgtaacatagcaatctctgaagacgtacaacattgaaa

SEQ ID NO: 33765 - DNA, 89 bp, Zea mays
  Clone ID: LIB3059-045-Q1-K1-G8
cggacgcgtgggatcgcgagctgattgtctaacgattatttcttggctgcggaatggcgcctgtaagagataatatggcatatttgcag

SEQ ID NO: 33766 - DNA, 134 bp, Zea mays
  Clone ID: LIB3059-045-Q1-K1-H12
agaaatgtactttcttatttctgggaagccacaaacatcatccaaaaaacttcattattgaactataactcataagcactctaaaagagggcaccgccaatgatgggtcgttggtagaacgttgttgggttcgc

SEQ ID NO: 33767 - DNA, 290 bp, Zea mays
  Clone ID: LIB3059-045-Q1-K1-H4
cggtccggaattcccgcgtcgacctacgcgtcacccgtccgaccagctgctctcgctcatcatcaacaccttctactccaacaaggagatcttcctcagggagctcatctccaactcctccgatgccttggacaagatcaggtttgagagtttgacggacaagaccaagctggatgcacagccagagctgttcatccacattgtccccgacaaggccaacaacacgctgacaatcatcgacagcggcattggtatgaccaagtcagaccttgtgaacaaccttggtacca

SEQ ID NO: 33768 - DNA, 416 bp, Zea mays
  Clone ID: LIB3059-045-Q1-K1-H5
cccacgcgtccgcccacgcgtccgtatcaacatagaaagcacaatagtgtaccaacgatggcagccaaaatattttgcctccttatgctccttggtatttctgcaagtgctgctacggcgaccattttcccgcaatgctcacaagctcctatagcttcccttcttcccccgtacctctcaccagcggtgtcttcggtatgtgaaaacccaattcttcaaccctacaggatccaacaggcaatcgcagctggcatcttacctttatcacccttgttcctccaacaatcatcagccctattacagcagttacctttggtgcatttattggcacaaaacatcagggcacaacaactacaacaacttgtgctagcaaaccttgctgcctactctcagcaacagcagtttcttccattcaa

SEQ ID NO: 33769 - DNA, 430 bp, Zea mays
  Clone ID: LIB3059-046-Q1-K1-A11
cccggttcgagccacgagtcacgcgttgacacactagagaggatttgatgaaagcccttgatgttatcagcagagttggtgatcttgtgggcatcaaatacttccctgcagaaccaccaaagattgctgaagctggtcatggtaagcgggagtaggagcgaaccctgaatcgccccatgagtgattgaagttgttagaatcccttccggagttatcaacagatcattatggaagcaagcatatatggagccgtattaggcagctgacagttatttggtgattgtacaactgttcttgcaattgtgtatagctggttgaaatttagttgttctgttgctaatctgttccaaatacgtagtagattcggaggcaatataaactttcagcagagcattactgagtttcccctcgcagaccactgacgacaatg

SEQ ID NO: 33770 - DNA, 308 bp, Zea mays
  Clone ID: LIB3059-046-Q1-K1-A2
ttggttttttttttttttttttttttttttcacattaaaatgtggaaaggtaactttttatttttggtgggccacatactcggatcattttgctaccatatggacaaaggtagcaaaagaaacaaaaggatatgcaaacagcagcagttgaagtaggatgtacatattcaggggaatttgacctgttactgtgcaccgggaatagctacactcattgaaaatcatgccactggcttatacacaaacgggaccacactcttcattcccgaaggatacatttctatggattttcctggggattggtatct

SEQ ID NO: 33771 - DNA, 375 bp, Zea mays
  unsure at all n locations
  Clone ID: LIB3059-046-Q1-K1-A9
tcttcaccaatctcaccgagagcggcggccggctgcagctgatcgacctgtactacgactggcccaggggccgcaacctcaacctcatccgggaccagctctccagcgacccgctctacgacgtcgagtggaccaacggcacctnctacttcttcgactccgggtcctgccgcaccatgcgtttccccgtggggatcctgccgcctgactggctcgccgccggcgccgtctatctcggccgcgagcacgtcgacggcttcgactgccacctgtggaccaaggtcgacttcgtctggtactacgaggaagtcgccaccggccgtcccgtccgctggaatttcttcaatgggatgcagcagcatgtgatgagctttg

SEQ ID NO: 33772 - DNA, 335 bp, Zea mays
  Clone ID: LIB3059-046-Q1-K1-C6
cccggatcgacccaggcgtccggaccagctggccaaattctaacacctaggcgctcggccgagatggcccccaagcgctctgcgccacctgcgccgcctccgcccacggctgactcctccgaggagaccgcctctggttcgggctccgaggaggaggaggaggaggaggaggaggaggatgatttggagaccgtccactcaccgtcttccgtcgctcccaagagcgtagctccgatgccgcataacgtccaagagcccgaagcgtccgacgaggatgagtatgacgatgaagatgacgagccgtataaggtacaagaacccgaaacgtccgatga

SEQ ID NO: 33773 - DNA, 430 bp, Zea mays
  Clone ID: LIB3059-046-Q1-K1-D6
tagcaacatagaaagcacaatagtgtaccaacaatggcagccaaaatattttgcctgcttatgctccttggtctttctgcaagtgctgctacggcgaccattttcccacaatgctcacaagctcctatagcttcccttcttcccccgtacctctcaccagcggtgtcttcggtatgtgaaaacccaattcttcaaccctataggatccaacaggcaatcgcagctggcatcttacctttatcacccttgttcctccaacaatcatcagccctattacagcagttacctttggtgcatttattggcacaaaacatcagggcacaacaactacaacaacttgtgctagcaaaccttgctgcctactctcagcaacaacagtttcttccattcaaccaactagctgcattgaactctgcttcttatttgcaac

SEQ ID NO: 33774 - DNA, 317 bp, Zea mays
  Clone ID: LIB3059-046-Q1-K1-E9
gaattcccggctcgacccactcgtcctaaaaaaaaaaaaaaaaaaaaaaaaaaatttaaattaaaaaaaaaaaaaaaaaaaaaaaaaaaaaaataaaaaaatacaaataactacaaaaatcaacaaataaaaaataaaaaaaaaaaaaaaaaaggccaccctttttaaaggttcaaagtttacttccccttacttccaacttattaccttttttatagggtcccctaaattaaattaattgcccgtttttttaaaacttattaactggaaaaaccttggctttaccaaatttaatcccttttaaaaaaatccccttt

SEQ ID NO: 33775 - DNA, 455 bp, Zea mays
  Clone ID: LIB3059-046-Q1-K1-F10
accggtccggaattcccggggtgggtacttggggtccctagccttcttcagggtcgtggggcgttgaagaagattgaagataacaacactctggtcttcattgttgacctcaaggcagacaagaagaagatcaaggctgccgtcaagaagatgtatgacatccaggcaaagaaggtcaacaccttgatcaggcctgatgggaagaagaaggcttacgtgaagctgactcccgactatgatgctcttgatgtggccaacaaaatcggcatcatctaagtgctgcattaggcatcctagttcatctgttgtgtcctagttctatgtgaaaccagagttttgtagctatggctctcaatcgttccattaccatgtgttatgcacacttctgaatttgatatcatccaagtgaccttttgaactagtttgcgttctgcacttcattacacttggacacc

SEQ ID NO: 33776 - DNA, 396 bp, Zea mays
  Clone ID: LIB3059-046-Q1-K1-G4
cgattattactcaatcatcgccgctaatatgactcaactagctagctagccggcggcgatactacagcacatagcttcttcagtgggggacaccgccagctagctagctagttgagtcatttagcggcgacgatcgagttctcatgcgcgacgcgtgagtcgccccgggaattcaggaccggcacatgctggcgtacaagctgtccctattgtgagacgtattagctcactgtttaattcagttcaagtcttatgtgtatcttgccttgctatccgagtaataatactgaggatgtggtagtcatgatatatgtttattctctgttggttcctatcttatgcaattattcataagagatgctgccaaaattttattattgtaccattgtaagtatt

SEQ ID NO: 33777 - DNA, 394 bp, Zea mays
  unsure at all n locations
  Clone ID: LIB3059-046-Q1-K1-G5
tcccgggtcgacccacgcgntccgcatcntttcgtaggttcatgggaacaattttatggccttggtattggtctcaatggaacaattggttggggcttgtggacctatgatgtatttagcagaacatgtgagctccgggtatctattgcctttgttttgttaagccattgagtcaagctgcaattcttaatgaccattttacttcaatcccgttttcttcagttctgtgtttgttctgactaacgatttgtattcaatgtttttttctgtctttcctaaaactcttaaaggcaagaaaaaattgcacaaggaaaaacacaagtctcgatctgaaaggcctcaccgccaatctaatatcaccgaactggataaaggcaaaaaacgacctgcacaa

SEQ ID NO: 33778 - DNA, 158 bp, Zea mays
  Clone ID: LIB3059-046-Q1-K1-H1
ctggaagactgcccctcccgcgcatataggtcgagcgagtggttgatataccggctgagctctgaatgccacagccacctgcttgtatcaatctatgatgttggcagtcttgagaacaccactgtgacttgttaaatctgtatgcttattcccaaaaa

SEQ ID NO: 33779 - DNA, 140 bp, Zea mays
  Clone ID: LIB3059-046-Q1-K1-H3
aagaaactatgtgctgtagtatagccgctggctagctagctagttgagtcatttagcggcgatgattgagtaataatgtgtcacgcatcaccatgggtggcagtgtcagtgtgagcaatgacctgaaggaacaaagatat

SEQ ID NO: 33780 - DNA, 386 bp, Zea mays
  Clone ID: LIB3059-046-Q1-K1-H5
ttttgagcattcagaaacacacctagcgaagcgcactagcaacgacctaacaacagtggctaccaagatattatccctctttgcgcttcttgccctttttgtgagcgcaacaaatgcgttcattattccccaatgctcacttgctcctagtgccattattccacagttcctccctccagttacttcaatgggcttcgaacacccagctgtgcaagcctacaggctacaacaagcgcttgcggcgagcgtcttacaacaaccaattgcccaattacaacaacaatccttggcacatctaaccatacaaaccatcgcaacgcaacagcaacaacaatttctaccagcactaagccaactagctgtggtgaaccctgtcgcctacttgc

SEQ ID NO: 33781 - DNA, 451 bp, Zea mays
  unsure at all n locations
  Clone ID: LIB3059-046-Q1-K1-H7
ccggaattccgggtcgacctacgcgtccgcccacgcgtccgcccacgcgtccgcctacgcgtncggtaacctttcaataggcgtcgcccaagaactagtaaacatggcaaaactgttgagcctgttcttagccctctcctttgtagcagctatgtttgccataggctctcatgctgatggagactgtgagaatgacctccaaagcctgataagtgactgcaagacatacgtgatgttcccagctaatccaaaggtccctccttcggatgcttgctgtggtgtcatcaagaaggcaaacgtttcttgcttgtgctccaaggtcaccaaagaaactgagaaggttgtgtgcatggagaaagttgtgtatgttgctgagcagtgtaagaggccatttgagcatggcttccagtgcggaagctacaaggttccagcaaactgatgatatcacaag

SEQ ID NO: 33782 - DNA, 413 bp, Zea mays
  Clone ID: LIB3059-046-Q1-K1-H9
gacagttgtgagagagaggggaagggatcgagagcgcggcggaggcgatggcgagcggagggaagggactcaacgcgactggggagttcttccggcggagggacgagtggaggaggcaccctatggcggggaaccagctgcgccacgccacacccgggctcggcatcgccatcgtcgccttcgggatctacctcgtcggcgaggccgcctacaaccgcctctaccgcccctccggcgacaaccaccactagatcgccggcaggatccgtgactcggtcaagaagctggagccaactttaccaagcactggtgctgttgatgtttttacagttttgagctcataaggtcagccatgaccatattgtaatctgtgaccaggtagacttgcccactggtccgtccaactattgtct

SEQ ID NO: 33783 - DNA, 424 bp, Zea mays
  Clone ID: LIB3059-047-Q1-K1-A2
aagcgccacacgccgacgcgaaccaaccaggcaaccagatggtagtcggttagctaagctcgggatcggaggagaggtgccccgcgaccctgacgatgacgatgcctcgccgcgcccttctcttcgccgtggcgctcctcgcggcctacgccgccgcggtctacgggttccacctcgccggggacgagagcggcctcgtgaggggcgtgctcacagcggtccgagagcgggccgaggccgaggccgaggacgccgcgcgcttcgccgtcgcctaccacatcaggaaccagcgtgctgctccggagttcactagggtgctcaaatcgaagcggcaggttgtgaccgggaccctgcatgacctgatactggacgcagctgatgctggacaaaagagtctgtacagagcacaagtctgggtgaagcc

SEQ ID NO: 33784 - DNA, 441 bp, Zea mays
  Clone ID: LIB3059-047-Q1-K1-B4
cggattcccggtcgaccacgcgtccgtgacttcggaggctccgaaactagtttcccgtgcagggagcccttaacgaccggggaccggtgccatgtacacgtgcgagactgcctctactagaacacaaggactactgctggctataacaaacgcctagtacagtggctgcagaccatgcacccggtgatgaacgaatgcacctttctccagaagcagcactgtctgtactgctacttgggatacaaatggcgacattccgtctataccttgtatgtcgatagtcaagctatgactatgaaccttactgacaaagctatgaggctcctaagagctgatgaaccctatgatgatcttgcctgctcgtgtacacaaatgcgctcacttgctgtgtacgacaagacatcttttggatactgcgccttgaatcatgtaccagggatt

SEQ ID NO: 33785 - DNA, 445 bp, Zea mays
  Clone ID: LIB3059-047-Q1-K1-B8
tcccgcgtcgacccactcgtccgcccacacgtacggccacacatttcattaaacaaaatgcctgtatctaactgtgatgagcatcagcgacaacctcatccattcagccacctagctactgactaccagaaccaatgccttgcattaaaccaactgactgacatgaactctgctgctcatatacaacagcaacagctaccaccattcagccagctagctgatatgatccatgtcgccttcttgacacaacaacattatgctacaatctacctacacgctgctcctaactctcacaccctataacaactgctgcagtatctgccattcaaccaacttgctatgacaaaccctacaactttctaccaacatccgatcattgacggatccctaattaatatcgtatacaagtaatagctcactaatgaagattaccggaacatgtaag

SEQ ID NO: 33786 - DNA, 420 bp, Zea mays
  Clone ID: LIB3059-047-Q1-K1-D10
cccacgcgtccgtagggtttctttccgcttgctttccagtttgcggcatcagtcggtggcgcctgcgatggagtctctgttcggccaatcgcagcggaggaggagggcggtcggcagcggcttcgaatcgctcaagcgtctgggtcacatctcacccgctgtgcagtcccacctcaaacatgtgtacctcaccctatgctccgcgctggccttctctgcactcggcgcgtacctccacatcctcctcaacgtcggaggcgccctcacgaccgtgggatgcgtggcctccatcgccttcctcatctccctgcccgcttcacgggaccaggagaggaaccgcttggcgctgctcatgtctgccgcgctccttcaaggcgcgtccgttggtccgctcgtcgaccttgttattgacttggattc

SEQ ID NO: 33787 - DNA, 322 bp, Zea mays
  Clone ID: LIB3059-047-Q1-K1-D7
ctctgccaaacgctgtgtagtggacataaatgttacctgccgaatttcttgcataagttatggctattcttagaactctattttgttaacgggtttgtattcctaagcgaaattaatctagacgctatctgagaaaactagacatcctttaaggctgattcgctggatatggaattggagggaatcacagtccatattaagacaatacactacaaaggctacaccttacaaccgataaatggcggacgtactagacgatccaagctaacttacccgtgcatgcaacatcgtaggccagttaatatgccacctaaagtgaatc

SEQ ID NO: 33788 - DNA, 377 bp, Zea mays
  Clone ID: LIB3059-047-Q1-K1-E1
gattcccgggtcgaccagcttcgacaccgtacgaccgtactgatcctggcgccctgccgacgcgagacgagcggcgcagaattgtcaccgtgctatgagcagttaggtgcacgagctccgacgaagacaagactgactgcagcgcagtgaggagctgaagctgagctctaatcctcgcgtaggaacgtcaccggctgggcacccaaaagctctcaagataaggtggtgcgcaccttgatcgacacgtgatacagagatctcgcagaagcagaagtcggcgttgcgggaggcgtacaagatgaagaacctgctaccccctcgacctgcgccctaagaagacccgtgccattcgccggcgtctgaccaagcaccagatc

SEQ ID NO: 33789 - DNA, 270 bp, Zea mays
  Clone ID: LIB3059-047-Q1-K1-E11
taaaagcaaaataattaaagctataaaaaaataaaggcgggcccttctaaaggatccatgcttacatcatcttgcatgcgatgacataactacttatataacgcaacctaaattcaattaattggccgtggttttaaaacgtagttactgaaaaatccctgctactaccaaactttgtggcttgggtgttaattctgctttcgccagctttcctattacctacttggccccatctgactgtccttcatatacaattcgcaagcctgaatg

SEQ ID NO: 33790 - DNA, 411 bp, Zea mays
  Clone ID: LIB3059-047-Q1-K1-E3
cggaattcccgggtcgacccacgcgttcgcgggagcgcttatgccttcttactggtacaaccgcttttggcatttcatttgcaaggggtgggaaacattggtgctttcttgagacaacaacatttggtggcattttacccacaagttgtgggaaacattaatggctttttgcaacagcaacaattggtaccattctacccacagaatgtggcaaacaattgtgccttcttacaacaacaacaattgctgccatttagccaacatgctttgacgaatcctaccaccttattgcaaccgcccaccattggtggtgccatcttctagattttttatgatttatactgtaataataaagttctcatgctgatatgtgcgacctctcagtaataaagtattagagatctatatttt

SEQ ID NO: 33791 - DNA, 420 bp, Zea mays
  Clone ID: LIB3059-047-Q1-K1-E7
ttcacggttccgataacgcttagccgtatgcgcagatgaccatcctgacgacgggtaggacccgctcgaacttccaatgatcagctacgtgctggtcagcgacttcgtaggtgtacacctgccacgagcaccgatgctggaggcagtgcctggcgcagtttatgaggggatctgcttcaggaacttcagcttcagagggataaggcggcatcaggacagcaggtggcattgcgagtatgcgtatggagaggcgcatgacgttgtccctgcaccgagtgaagagctcacgagagatggatcctcctactggtgtggacttctttgaccatctactctatctagtagtaatacatactacagcgcccacaaattttgtgagtggatgatatatgatctttagattatacagacaaactcaat

SEQ ID NO: 33792 - DNA, 444 bp, Zea mays
  Clone ID: LIB3059-047-Q1-K1-E9
cggaattccgggctacgacccacgcgtgcgcaatccttcaagcgcaagctgcctccttctcgtcgtccggtcgtgagaagggagggcggtccatggcaaggctatcgacgctggctccgcgaataaggcaacgtcgaggagctccaaagccggactccagttccccgcctgcaggattgctaggtccctcaaggcgagcaagtactctaagcgcgtcagcgccggcgcccccgtgtacctcgccgccatcctctagtacctcgcggctgacgttctcgaacttgccggaaacgccgagagggacaacaagaagacccgcattgtgccgagccacatgcagcttgctgtgctcaacgacgaggagctgaccaaactgatgagtaggtgccaccatcgcgagcagaggcgttatgcctaacatccatcagcatctgctgcccaaga

SEQ ID NO: 33793 - DNA, 431 bp, Zea mays
  Clone ID: LIB3059-047-Q1-K1-F4
tcccggctcgacccacgcggtccggccttaacaatggttggcatggtcagtttatccattgacctgattgaccaatcgaggtgaggcgaaataaacaaatcgtataagatacaatacgaaattacaaataatcataaagcaacaacgaatttgcgtaatgcttcatcgatcctatctgcgtatatcaatacaaaccattataacagcgataccaaacgtcattaaataccttcaactgatccagctagctattattaacatctatcaacttcttataccattaactcctgacatacaaccgatttgctgtagccctcgtttacattaacgagcaacttcttcaacatacacaccttctaaaatctcttattaaactagtcatagtataccatagcatctacctacatcctcgacatcttatttcatctaat

SEQ ID NO: 33794 - DNA, 86 bp, Zea mays
  Clone ID: LIB3059-047-Q1-K1-G10
accggttcggaattcccggctcgacccacgcgttcgaactagcatcattgggggcacaatagtgtacgaacaacggcacccaaaat

SEQ ID NO: 33795 - DNA, 304 bp, Zea mays
  Clone ID: LIB3059-047-Q1-K1-G3
tgtacgcactagagtaacacagatgtataacaggtagaaagaccaaccatacaagcgagtatgctcccttaagatcattgaccacatcgtacgggatgggagtgacggtctcgatggtagtcccctcaaccatgaagacaggcttggggcccaacggctgcctcttggtgctgatgacctcgccgcgctcctttgtatgcgccttcagctggtcattgatcttaagggaggattctaggtatgctgcttgctgatcctacctggtcacactagagctacacagatgtagaacaggtagaaagac

SEQ ID NO: 33796 - DNA, 426 bp, Zea mays
  unsure at all n locations
  Clone ID: LIB3059-048-Q1-K1-A10
ttaccatgttgctgcttctatccaagtacagaatgaagagccttccagttgtaggagggggaggagataagattgagaacattatcacacaatcctctgtcgtacacatgcttgcagagtgtgttgggctctcctggtttgagaactggggaactaagaaactctctgaactggggcttcctgtcatgaaaccatcgaaacttgtcaagggactcttaatgatccgttgttggtcctcattggaaatctaagtagaacatttcactttcagtttttcatttctaattaacctataacagactcaagttcaagttatcaatacctaaagaaagatcaatttcatcaaagccatgctaacacgtcacttgggcctactctnttcaaggtaagcgaagatcagccagttctgaaagctttccaactgat

SEQ ID NO: 33797 - DNA, 454 bp, Zea mays
  Clone ID: LIB3059-048-Q1-K1-A11
aattccgggggggacccacgcgtccgcccacgcgtccgggcggtggtggctgtgatggcagcagcagcagcagccccaagcaggcagtcaaccctggggaagaggaggtggtggaatctggtcctgtgacagcgacgcccaacgctgcttgtggattccaagaaagcagctatggcgtggtggaggtggagctcgtcttgcctgacagccccttcgcgccccccaccaaggaggaggcctcatacgctgatgctgtcactgctgcagccgctcggaacggtagcaccagcagcagcagccctcgccatgtggcccttttcgcacccgcgtcttccaccaccctcgagctgcccccctacagctcctcctgcttctttcatgtgcccaggttttctcctgggcatgaagccattgggctgtgatgtgaggtgcacagaacaaataatggggaggg

SEQ ID NO: 33798 - DNA, 485 bp, Zea mays
  Clone ID: LIB3059-048-Q1-K1-A8
ccggtcctgaattcccgggtcgagccacgcgtccgggatcctctgggaatgtgataattgacttctactggggtatggagctgtaccctcagatgggcgagtactttgatatcaaagtattcaccaactgtcgtttcagtatgatgtcctgcgctgttcttgccgtaacctattgcataaagcagtatgaaatgaatggcagagttgctgattctatgcttgagaatactgcacttatgttgatctatatcactaagttcttttgttgggaatctgcatattggtgtactatggacattgctcatgatagacctggtttctatatctgctggagatccttggtatgggtcccatccatatatacttcccttgaaatgtacctggtaaacccccttttgaatttggcccccaagttaccactttaaatcctcttacctggattgtggtccatatccttaaactatgatggtaaccttaaaccccaa

SEQ ID NO: 33799 - DNA, 402 bp, Zea mays
  Clone ID: LIB3059-048-Q1-K1-A9
cccacgcgtccgtagcaacatacatagtgaagtacactagcaacatcttagcaggagtgggagccaagatttttgccctccttgccctccttgctctttcagcaagcgctgctacctcgacttttattccacaatgctcacaacaatacctctctccggtgacagccgcgggatttcaatacccaactatacaatcctacatggtacaagaggccatccaagcaagcatcttacggtcattagcattaaccctccaacaaccatatgctctattgcaacagccatccttagtgcatctgtatctccaaagaatcgcggcacaacaactacaacaacagttgctaccaacaatcaatcaagtagttgcagcgaaccttgctgctaacctccagcaccaccagt

SEQ ID NO: 33800 - DNA, 446 bp, Zea mays
  unsure at all n locations
  Clone ID: LIB3059-048-Q1-K1-B3
ggaattcccgggtcgactcacgcgtccgggagggcgcagcggcgacgagctcagcgatacagcggcaccggagagctagccgcggcctccaggctcgcggggatctgaactagtgccgctgcccaatcgcgccgacgactgaggcgcccactcctcatatcccatttccatcactcgtttctccatttcccaccttcctaaacgccacttaaaagagaaaggagagcatcgcagtggcacacgcgcaatggaaggctcgccggtgacgcgcctnccggaggctaactccctccccgacggcttcgttcctgactctgagagccctggcacggacgcgacgtttcccttctccgcgcccatcgttgatgatgcgctcaactccgatatccccggcgcgaccaacccangcngcgaggaaaccctaaacgatcccnccctccctgcgt

SEQ ID NO: 33801 - DNA, 467 bp, Zea mays
  Clone ID: LIB3059-048-Q1-K1-B8
accggtcctgaattcccgggtcgagccacgcgtccgcccacgcgtccggagaccaacaagcatcatataaagtggaatccagtagcaacaacagagcaagaatggcgaccaagatatgttccctccttatgctccttgctctttctgcatgtgttgctaacgcgacaattttctctcaatgctcacaagctcctatagcttcccttcttcccccataccttccatcaatgatagcttcagtatgtgaaaacccagctcttcagccctataggctccaacaagcaatcgcagcaagcaacatacctttatcacccttgttgtttcaacaatcgccagccctatctttggtgcagtcattggtacaaaccatcaaggcacaagaacttgcacaactcgtgctaccttgtatcaacccaataactttggcaaacctttcttcctaatcttaacaaccaccatttctttca

SEQ ID NO: 33802 - DNA, 190 bp, Zea mays
  Clone ID: LIB3059-048-Q1-K1-C11
aaaaaaaaaaaaaaaaaaaaaaaaaaataaaaaaaaaaaaaaaaaaaaaaaaaaaagagtaaaaataaaaacaagggtcggccgttcattaggttccaagcttacttccccttacttgccacgtcttaacttttctataccttcacctacattaaattaactgtcacttagttcttacaacgatcacatt

SEQ ID NO: 33803 - DNA, 267 bp, Zea mays
  Clone ID: LIB3059-048-Q1-K1-C5
attcccgggtcgagccacgcgtccagcatgtgtaatgtataactgtaaatattggcttgatttgaacaaacttgttttttttgcgaaagaaaaaaaaaaaaaaatagaaaaaaaaaaaaaaaaaaaaaaaaaaaaaaaaaaaaaaaaaaaaaaaaaaaaaaaaaaaacaaaaaaaaaaataaaaaaaaaaaaaaaaaaaaaaaaagtcaaccattaaaaatattcaaaatttacataccaataaattcaacgtaaaaattttttaaa

SEQ ID NO: 33804 - DNA, 329 bp, Zea mays
  Clone ID: LIB3059-048-Q1-K1-C7
accggacttgaattcccgggtcgagccacgcgtccggccacgcgtccagttggcttctcctctatcttcggttcgactacgggttcgtgaggttgcggcggggttcacactcgtggatgaccggatctacatgtcaccttctgatgttgattaccgctgattattctactgcctcatctgagccacggactaccactccctacacaacgccttcatcacctacagagatgtcctcgagtccaaaatcattcctgatcggtagacgcataggtacctctgcttcggctctcacaacttttccacagaagaagccatgcgtaaccccatcg

SEQ ID NO: 33805 - DNA, 60 bp, Zea mays
  Clone ID: LIB3059-048-Q1-K1-C9
aaaaaaaaaaaaaaaaaaaaaaaaaaaataaaaaaaaaaaaaaaaaaaaaaaaaaagaag

SEQ ID NO: 33806 - DNA, 277 bp, Zea mays
  Clone ID: LIB3059-048-Q1-K1-D8
attttatgccatgattcattggtaagatccacggtatcttacaccggagcagagcaagacatggagaagtcctaggctaccgagccacggcggcgcgccggcctgacacttacaggtgggcccgcaacggttgcccccacccgtgccacacactgggggaagttcacccggggacggagcacgccatgccacgcagcagcacagctacgctgctgtcagcctcctcctccggcagcccgttagatctgcagctcgggcggagccttcacgggggcta

SEQ ID NO: 33807 - DNA, 209 bp, Zea mays
  Clone ID: LIB3059-048-Q1-K1-E1
cacgcgtgcgtaccagtgcaagtctattactgatgattggttttcttctttatcaaatgtgttcatgatgattgagttgctgaacttgaaatactgcaacaagatcacttatactgatttgggtcacctatactccctgtatgatctcacaaacctttaactgacatgcttgttcctcttaacaagcattgagatctcctcaatttcaa

SEQ ID NO: 33808 - DNA, 187 bp, Zea mays
  Clone ID: LIB3059-048-Q1-K1-E3
cttagcaggaagcgctggtcacctcagttttgtgtagacaaaatctaggcatcgataaatgatgggggactatgcatggtgttttggcagcactgttcagtaccttgccttctaaatctggtttttggtgtgtgtgtgtaagctaataaatgtcgaggcaggattgtaggaacaccattgatcaaaa

SEQ ID NO: 33809 - DNA, 197 bp, Zea mays
  Clone ID: LIB3059-048-Q1-K1-E4
taccggtgcaactctattactgatgatgggttggcagctttagcaaatgggtgcaagaggattgagtgactgaacttgtgttactgcaacaagatcactgatactggttttgggtcacctaagctcccttgaagaacctacaaacctttaacttaagtgcttggtccccgtaacaagcattgggaatctcttaattg

SEQ ID NO: 33810 - DNA, 473 bp, Zea mays
  Clone ID: LIB3059-048-Q1-K1-F2
cctctccggaattccgggtcgacgcaggcgtccgcccacgcgtccgcccacgcgtccgcccacgcgtccgagggtttccgcgtcggctagtttggacgcatggctgctgcaggagagtagagaccacagcgcgcgaggcgaggagaataagctatgggcgcgccgaagcagaaatggacgtcggaagaggaggatgcgctccgcgccggcgtgcgcaagcacggcgccggcaaatggcggaccatccagaaggaccccgagttcagcccggtcctctactaccgctccaacatcgacctcaaggacaaatggaagaatttaagtttcagtgcaagtggactgggaatcaaataactgtcggttccaaagataactggacccttatcttccccatcatttaactcgcaacctttggtttttccaacgggaaacaaatttactggagcttcactggctgcatatgctgagaaaaa

SEQ ID NO: 33811 - DNA, 293 bp, Zea mays
  Clone ID: LIB3059-048-Q1-K1-F5
agctgtatccccgagattccttaaccagcgcgaaccaatatactgttgcgtgttctcctgcaagtgagatgttctgcacctatgtttgtaatgttgtatttctgggtttttaagctatccaacttggagatacaaccggtgaggaagcagcaacaataggtagttctacttctgagtgaggaaaaacaacttgcggctgagttaatgaagcttagtagctaccaccgttgtatgacagttgctcagaaatgttatcttcattaatggctaatataaccgttagttccttgtga

SEQ ID NO: 33812 - DNA, 384 bp, Zea mays
  Clone ID: LIB3059-048-Q1-K1-F6
ctgaattcccgggtcgagccacgcgtccggcagagttttgaagctttgaaccccatagccgttgctgttgtgatagaccccatccagagtgggaatgggaaggtggttattgatgcattccgcctcattaatcctcagaccatgatgcttggccaggagccacgtcagacaacatcaaatgttgggcacctaaataagccatctattcaggctcttatccatgggctgaatagacactactactcaattgcaatcaattaccggaaaaatgaacttgaggagaaaatgctgttgaacttgcacaaaaagaaatggaccgattggctaattttgaaaaaggttgaccctcactcgaaaaccaacgagcaaactgtccatgaaatg

SEQ ID NO: 33813 - DNA, 374 bp, Zea mays
  Clone ID: LIB3059-048-Q1-K1-F7
accggtcctgaattcccgggtcgagccacgcgtccgatctgcgtctttccatccagatggtcttatccttggaacaggaactactgatgctgttggtaagatttgggacgtgaaggctcagtcaaatgtcgcaaagtttgagggtcatgtcggaccagtcactgctatgtctttctctgaaaatggttacttcctagcgactgctgctcatgatggtgttaagctttgggatcttcgtaaattaagaaattttaggactttctctccctatgatttggacacgccaaccaatactgtgaaatttgattttagtggaaactatcttgccattggtggttcagatataagggtctaccaagtacctaatgttaagg

SEQ ID NO: 33814 - DNA, 464 bp, Zea mays
  Clone ID: LIB3059-048-Q1-K1-F8
ccggtcttgaattcccgggtcgagccacgcgtccgcccacgcgtccgcccacgcgtccgtttttattaaccacacctctggcaaggagtacaagctgaggccaattggtgatgctggccctgtaattgaggcgggagggatctttgcctacgcccggaagacaggaatgattgcgtcgaaagctgctgcatgagggaaagatcagcttatgcagccgagcctctgcggagatgaagaagtaagctggagttaggactaagagttactgcacctacttgatgtcgacggtgtctcaaaataaattgggggcctaacaaattattatgaatcaattaatttgggctttggcaaaaaatcgttttttttggtaactagacctggaccaatggacctctggcttgttacggtcctaaccggttgaattacctgtctggtggccaaaaaaaaaaataattttaatagat

SEQ ID NO: 33815 - DNA, 248 bp, Zea mays
  Clone ID: LIB3059-048-Q1-K1-G1
gaattcccgggtcgacgccacgcgtccgcggacgcgtggggtgcggtggcaatcttgacagcagcacaatacctaccatcaatgtgcggctggtacgactcatactaccaaaataatccatgcagcagcaatgacattagtggtgtttgcaattgaagaattgtgtctacctagccgttatactcctataacggtgttaagcaataaagtaccatacattaaaaaaaaaaaaaacaataataataatt

SEQ ID NO: 33816 - DNA, 451 bp, Zea mays
  Clone ID: LIB3059-048-Q1-K1-G4
tcctgaattcccgggtcgacgccagcgcgtccgcctagcgaagcgcactagcaacgacctaacatcaatggcttccaagacattatccctccttgcgcttggtgccctttttgtgagtgcaacaaatgcgttcattattccacaatgctcacttgctccgagtgccattattccacagttcctccctccagttacttcaatgggcttcgaacacccagctatacaagcctatagtctacaacatgcgcttgaagctagcgtcttagaacaacctattgcccaattacaacaacaatccttggcacatctaaccttacaacccatcgaaccgcaccaacaccaaccactaacccactaacccttgttgaacctaatggcttactgccaccaccacttgtttgattccaaccaatttcctttgccaacctaacttgcaaccaaccaccaccac

SEQ ID NO: 33817 - DNA, 350 bp, Zea mays
  Clone ID: LIB3059-048-Q1-K1-G7
accggtcctgaattcccgggtcgagccacgcgtccgacaatagaaaccatcgcaacgcaacagcaacaacaattcctaccagcactgagccacctagccagggtgaaccctgccgcctacttgcaacagcagttgcttgcatcaaacccacttgctctggcaaacgtagttgcaaaccagccacaacaacagctgcaacagtttctgccagcgctcagtcaactagccatggtgaaccctgccgcctacctacaacagcaacaactgctttcatctagcccgctcgctgtggccaatgcacctacatacctgcaacaacaattgttgcaacagattgtaccagctctgac

SEQ ID NO: 33818 - DNA, 356 bp, Zea mays
  Clone ID: LIB3059-048-Q1-K1-H1
tcctgaattcccgggtccacccacgcgtccggaagaagtacagcaaggacatcagcaaggatttccgtgctcttggaaagctgaggagggaagccgagcgcgccaagagagccctcagcaaccagcaccaggtccgtgttgagatcgagtccctctttgacgggaccgatttctcggagccgctgacccgtgccaggtttgaggagctgaacaacgacctcttccgcaagaccatgggccctgtcaagaaggccatggaggatgctggccttgagaagagccagatccacgagatcgtcctggttggtggaagcaccaggattcccaaggtccagcagctcctgcgggactacttc

SEQ ID NO: 33819 - DNA, 427 bp, Zea mays
  Clone ID: LIB3059-048-Q1-K1-H11
ttcagatttgatgaagaaagcatggcggtcaccagggtatcaattatacagacaggtgtcggacagtaaaattccatctctcagatctctcaatgagataaggtctcctgaaggaaggcctccctcttccatgttatcagcctgcagcaacgacttgtcagcagcaggatcctatggtgagtcatccgatggttggtcaatgcgcacattttctgaaatggtctcaacatcccaaagagagaggtggtcacttgacagtgagctcttgggatccatttctagtaaaatgacaagatcaagtgcttcgagttctactacacgcccccctgaccaagacgtgtgcaagctgtgtttaaagctgctaaaggagagatcgacatggaacgcgcaggagctggctgttgttgctgttttgttgtgtggacat

SEQ ID NO: 33820 - DNA, 212 bp, Zea mays
  unsure at all n locations
  Clone ID: LIB3059-048-Q1-K1-H2
attcccgggtcgacccacgcttcagacgttgccttctcgtacacctactctatgcttctcatagaaatccancacactatgaaggcacgttcattatataactttacgatgaacatgaccaactactactgcatcaacacatctaccatcttctacatatctctcctattcatcacctacactgcctatttcaacacctttccagtgaactt

SEQ ID NO: 33821 - DNA, 366 bp, Zea mays
  Clone ID: LIB3059-049-Q1-K1-A5
ggaattcccggctcgagccacgcgtccgagcaggtcaggcaagcggagccggacttccggtaccaggcgaccttaggctgggcggtgcaatccatcctgcagcagcagccgcaaagcgctcagatcgccgtgctgatcgcggcgcatatcgggcagcagctgactgcgatgtacgacctgcagcagctgactttatgcccctaccctgctgccggccatatactccactgtagaaactatttgctgtactataacgcctggctagcttgctagtttaatcatttagcggcgatgatcgaggaataatgtagcatgcatcacgcatgggtggcagtgtcagctgaagcaaagtccttaatgaacaat

SEQ ID NO: 33822 - DNA, 379 bp, Zea mays
  unsure at all n locations
  Clone ID: LIB3059-049-Q1-K1-B1
aagctacaacagagactgtagatgcattgagaactggagctgcagctatgaaagcaatgcacaaagcaacagacatcgatgatgtagacaagaccatggatgaaattaatgaacagactgaaaatatgaaacaaattcaggatgctttgtcaggtcctctcggagcttctgctgatttctatgaggatgaactggaagccgaacttgaagaactggagggagcagagttggaatctcagcttctggagcctgttgcagcttctacggtgcatccagtgcatgccccagccaacaagcaaccagcgcgcactgctccacagaaagctacagctgaagatgatgagcttgctgcactgcangctgaaatggcattgtgatc

SEQ ID NO: 33823 - DNA, 471 bp, Zea mays
  unsure at all n locations
  Clone ID: LIB3059-049-Q1-K1-B9
ggaattcccgggtcgacccacgccgtccgtggttgaaggatccagggcacaaggcgattgctaccttgccgatattgctggttgggagtaagggtgaccggtctaacaggcgtccagtgagctatgaggaaggcgagcagttcgcaaaggaacatggtcttatcttcatggaggcctctgcaaagaccgcgcagaatgtcgaggaggcatttgttaagactgctggagcaatctacaagaaaatccaagatggcgttttcgatgtatctaatgagtcttatgggatcaaagttggatatgtagtccctggccaatctggaggtgctggtagctcttctcaaggtggtggctgctgcagctaatctgctaacgcccttatgtacaaaggcatatctgcggtgtagctgcgttatctctatgttgctgagcgtaaaatagttactgctccagggtgctttgntatttgatgca

SEQ ID NO: 33824 - DNA, 408 bp, Zea mays
  Clone ID: LIB3059-049-Q1-K1-C1
ggattcccgggtcgactcacgcgtccgaagctacaacagaggctgtagatgcattgagaactggatctgctgctatgaaagcaatgcacaaagcaacagacatcgatgatgtagacaagaccatggatgaaattaatgaacagactgaaaatatgaaacaaattcaggatgctgtgtcaggtcatctcggagcttctgatgatttctattacgatgaactggaagccgaacttgctagaactgcagggagcagagctggaatctcagctactggagcctgatgcaacttctacggtacatccagtgcatgctgcagtctacaagcaaccatgcgcgcactgcttcacagaaagctacagatgtagatgatcagcttgctgcactgcaagctgaaatggcatagtgatc

SEQ ID NO: 33825 - DNA, 445 bp, Zea mays
  unsure at all n locations
  Clone ID: LIB3059-049-Q1-K1-C10
ggaattcccgggtcagacccacgcgtnccgccgactcgtagcggccacgcgtctcgaatttacaatattccctcaccctgcacggagctgtggcaacgtgtaccgcggctggcgcacggcctgacgacgatgataggcgccggcgggctggacccctacgcggagtacctgaagcaaatcgcatggcaccccgttggccgctgagcgctactacgacctgagtggccagacgagcgccatgtaccagccggtccggcaacagtgctgccatcaccagatgaagatgatggacgtgcaatccgtattgcatcaactgcagatgatgatgcagctcgagcgtgccgctgccttcagaaacatgctgaaccagccagctctaatgcagcagccccagcagctggcggcagatcacggtctcaaccgcatggccatgatgatggcccat

SEQ ID NO: 33826 - DNA, 453 bp, Zea mays
  Clone ID: LIB3059-049-Q1-K1-C11
ggaattcccgggtcgacccacgccgtccgctgatcatcggttcttggccaccgaaattattgtggctggccaatacttggattaaccggttaaactagagcaggctgaaggccacctggcacacagtcaatttggtggtatgattatgccatcgcaacgaaagaaagagcaagaagagtctccactggctaatgtaacacgagatagctccaaaatcacagctgaacaggttcacggcctcatgtcacaggtcatagaagacatccttttcaactctgttcacccgtcaagcaaggcaagcacaagtgctccaccagattcatccggtcctgagcctatggttgaagcctgagttccagcggaaggggacaatggatatttgtgttatgttatctgattcagaaggtgcaaaacaagttatcttttgagtacagaatcatcatgtaattatga

SEQ ID NO: 33827 - DNA, 157 bp, Zea mays
  unsure at all n locations
  Clone ID: LIB3059-049-Q1-K1-C9
ccggaattcccgggtcgacccacgcgntccggctctgtcagctgccaacgcctttgcaatgcaaatgccctggccctgccccgggctggaaggcttgtaccgggcttgcccccggcttaaaacaataatggcccccgccggcttgaaccctaacccg

SEQ ID NO: 33828 - DNA, 459 bp, Zea mays
  Clone ID: LIB3059-049-Q1-K1-D12
ggaattcccgggtcgacccacccgtccgccaacctgggcccgataggagttccgtattaatggtggaggcagccaaaagcagcctgggaatgttaagtctaattaaccatggcaccactctctgttattccattagccaaattgggagcgagaagtccaatcagttggagatggacagtgtgatccctttacctgagggttatatttactttcgcattcacggttcatatgaaggacacattctcatatttggatacgcatttagtgaagacgcatgcttcgcacttgagatcaagactatgaagattgagagagtctgtcggaagtggcgtggtttctgtccttattttgtgttcctgccatccatgtcacaaaggaggatataatgtggactgaattcacatccaggtttggggcttcttccaatccattctgctggtgtggagttgagctaggtga

SEQ ID NO: 33829 - DNA, 370 bp, Zea mays
  Clone ID: LIB3059-049-Q1-K1-E1
tcactcgtatgctctatatgtaattcacatcatatatcaggatgatagactatctacatgaaccgtactccacaatctttcagaactgaacatctattcatatggtcacttgaaacccaaaacagccctatatatcgttatgtactgactacttctctattaatgtatatatctgcacactgtactaaacgagccgtgccgctgccattgccgcaaacgatgtacagacattagctgctaacttgccaagctatgattacgaacatgagatatccaacatacgtcgataacaggatgacgtgcatcacatactcacataatcctcaggtagacgactttgtgttatcgaagcgatccagctggttctaaa

SEQ ID NO: 33830 - DNA, 263 bp, Zea mays
  Clone ID: LIB3059-049-Q1-K1-E6
ggctaaaactaaaggagaaattttgaaaaaaaataaaaaattaaaaaaaaagtttaaaaaaaaaatttaaaaaaacgggaaaaaatttttaaaaaaaacaagaaaaaaaaaacatttttttggaaaaagggggaaatttaagtgctttaaaaaatggccccgaaaaatgaaaaaaatggacctaaaaacctttttgcaaaaaaccaaaaattttttaggaaaattttcaaaaggggcaaaatgttaaattgaaaaggggataa

SEQ ID NO: 33831 - DNA, 252 bp, Zea mays
  Clone ID: LIB3059-049-Q1-K1-E9
tcgcgacgcgttcggattcttcctgggcaagtttttggtgccctggtcattgagcactttggttgatttcagtttaggatttgaatgatgctgggttaaacaatgacttggctggcattaggtattaactaatgctaattaacctgccaaaaaaaaaaaattcaagaaattaaacggctttacataaaattaccacaaacaaaaggacaaagaaaaaaaaaggggcggccgttttagaggatccaagtttac

SEQ ID NO: 33832 - DNA, 433 bp, Zea mays
  unsure at all n locations
  Clone ID: LIB3059-049-Q1-K1-F6
tagcaacatagaaagcacaatagtgtaccaacaatggcagccaaaatattttgcctccttatgctccttggtctttctgcaagtgctgctaccgcgaccattttcccgcaatgctcacaagctcctatagcttcccttcttcccccgtacctctcaccagcggtgtcttcggtatgtgaaaacccaattcttcaaccctataggatccaacaggcaatcgcagctggcatcttacctttatcacccttgttcctccaacaatcatcagccctattacagcagttacctttggtgcatttattggcacaaaacatcagggcacaacaactacaacaacttgtgctagcaaaccttgctgcctactctcagcaacagcagtttcttccattcaaccaactagctgcatngaactctgctgcttatttgcaacaac

SEQ ID NO: 33833 - DNA, 93 bp, Zea mays
  Clone ID: LIB3059-049-Q1-K1-F9
ttgttttttttttttttttttggtttttattttttttttttttttttttattttgggtttgtttttttgccaaaattccaaagggcccctttt

SEQ ID NO: 33834 - DNA, 433 bp, Zea mays
  Clone ID: LIB3059-049-Q1-K1-G12
tagcaacatagaaagcacaatagtgtaccaacaatggcagctaaaatattttgcctccgtatgctccttggtctttctgcaagtgctgctacggcgaccattttcccacaatgctcacaagctcctatagcttcccttcttcccccgtacctctcaccaacggtgtcttcggtatgtgaaaacccaattcttcaaccctacaggatccaacaggcaatcgcagctggcatcttacctttatcacccttgttcctccaacaatcatcagccctattacagcagttacctttggtgcatttattggcacaaaacatcagggcacaacaactacaacaacttgtgctagcaaaccttgctgcctactctcagcaacagcagtttcttccattcaaccaactagctgcattgaactctgcttcttatttgcaacaac

SEQ ID NO: 33835 - DNA, 435 bp, Zea mays
  unsure at all n locations
  Clone ID: LIB3059-049-Q1-K1-G3
tttgcttgttagattgaaagggtttccacaccttgaaggttatgctgaaccatacatgaggcaactgtcagtcagtgatgttgtaactggtcctctacagacattcaatggcatagagaaggtcggccatatagttcatgtcttaaagacaactggccacaacggtttccctgtggttgatgagccaccattttcagatacccctacattgtatggtctaattcttcgagaccacctgcttgttctattgaggaagaaggatttcatccgtagttgcacagcgtctacactgaatgctttaaaccatttctcacatgctgagtttgctaaacgtggatcaggaaaacatgacaggattgaggacattgaattatgtccagaagaactggaaatgtttgtagacttgcatccattcacaaacacatctncatatac

SEQ ID NO: 33836 - DNA, 446 bp, Zea mays
  Clone ID: LIB3059-049-Q1-K1-H4
aattcccgggatcgactccacgcgtccgacaaacatatagtctgctgagtctttcatatggaacattgatggggaatcattatcgaggaatgaattagattttcaaaggagaatggattcagcaagggaacacatgttggggttatcagctgactcagaataccaggataatcaagccaatcctgatgtccaagatcgtagatcacaaagtcttggagctaacagaaattctgatgtcagcttatctttgaaagaccacgtccaaggttcagggcacgatatgagaagggacagtgatgtgactgtgagtggtaaacaagttgagcaagtgcaatctatttctgatttagagaagaaaggaactgcggaactcctcaatgaagatgacttgaacaaaaaattccaggagtacccgtttctgtttgcccgtgctggtgatctgacta

SEQ ID NO: 33837 - DNA, 399 bp, Zea mays
  Clone ID: LIB3059-052-Q1-K1-A4
tccggaattcccgggtcgacccactcgtccggggactcgtaccttgcaacccactctttgcgatccgcactatctccagcctatcgcggatggctaccaagatctcatcgctccgtacactaactgaccttctaaccagctcagctcatgcgatcatgattccacagacctcacttactcctaaagccaggattgcacagatcctgacaccacttacagaaatgggctcttaacatgcagacttgctagcactcctcctactactagcacttgcgatgctcgccctacaactacccattgtcaaacacagtcatctatgcttgacacactgaccataccaccaatgcaacacaacatcaaccacagccactgcatccaagactgatccacctacacgca

SEQ ID NO: 33838 - DNA, 428 bp, Zea mays
  Clone ID: LIB3059-052-Q1-K1-A7
tgaggacttggatgataaggaggtggtgagtccagaaattaaggacgagattgaaagcgaagatgtcaaacccgcagattcttcagcaatttccctctctagcaagaaggagcctcttgttcaggctactttgtctagcatgtttataagggcagaagaaaaaaagagatctacaaggagtcctaaagggtcccctgcaaccaaaggtgctgctgctaagaagcagcgagcaagtccaatggcaaaacagccagcagggatcaagaaggttagcggaactcggggaaagaaaaaaccaaaggtgggagaagatgaaatcgaagagctctcaagttcctcccaggataacgacgcagatgatgatagtgacgaggactgggccgaataatgcgttggtacatacggcagataggttggggaagcatatg

SEQ ID NO: 33839 - DNA, 412 bp, Zea mays
  Clone ID: LIB3059-052-Q1-K1-B11
tgagtctccaatgtgtggcttcagtgtactggctgttaaggtcttccagcaatatggcggccctgtctgtggtagagacattcttggggatcttaagctcaaagagtgtgttaaagcccacactaactggcctacatttccacaaatatttatcaaaggagagtttgttggggggtctgacatcatattaagcttgcaccagaagggtgagcttaaggatcttcttggggatattgcacaaagagacgaacaaaaagtgcatgctcacgattcatgaagcaatcaacagtaggttcttttactatgcgctatctactctgccactaaaatgttctatctcggagtctttaggcgacagcgtacgtgacattgtgaactgtccctacgcattggacatggatgaccggatgtg

SEQ ID NO: 33840 - DNA, 346 bp, Zea mays
  Clone ID: LIB3059-052-Q1-K1-C2
tcccggctcgacccactcgtccgtgaaagtcaagcgattttgctaaaaaaaaaaaaaaaaaaaaaaaaaaaaaaaaaaaggaaagaaaaaaaaaaaaaaaaaaaaaaaaaaaaaaaaaaaaaaaaaaaaaaaaaaaaaaaaaaaaaaaaaaaaaaaaaaaaaaaaaaaaataaatcaacataaaaaaaaaaaaactaaaacaaaaaaaaaaaaaaaacaacaaaaaatcgactcaaaaataataaaaaaaaatttaaccttccaaaaaaaaaaataaaactaaaaactgctataactaaaatgacttaaccaacatataccaatcacataaatactgtacaacttt

SEQ ID NO: 33841 - DNA, 321 bp, Zea mays
  Clone ID: LIB3059-052-Q1-K1-C8
agtcactgattcttgctcccatgagtatatcttgcctggtgctgaattgacgtgtggattttgagctcgtcagcatagttcaccatgatgataaaaaaaagagaaagaagtttggagtagttttacatgtggaaacaaaactgcttgtaagaagagagaatgtgcagccccagagtgtgagcaattttacatgcttgagtgtacaggggtttggagtagtcttggacttgcttattttgaggcatgtattgcagtcataggttacttctgctcaaaaaaaaatacaaaacatgaaagaaaaaaaaaatataaacaaacatg

SEQ ID NO: 33842 - DNA, 449 bp, Zea mays
  Clone ID: LIB3059-052-Q1-K1-C9
ggttcggaattcccgggtcgagccacgcgtccgcgctggaacacttgccaaatcggaattccttgatatatggtgacctttatggtatctgcaaagaagcatccaccatatatagggctactcttcgttacgaaggttttagtgagattatggtaaccctttccaaaactgggttctttgatgctgcaaatcatccactgctgcaagatactagtcgtccaacatataagggtttccttgatgaactactgaataatatctccacaattaacacggacttagatattgaagcctctggtggatacgatgatgacctgattgccagactgttgaagctcgggtgttgcaaaaataaggaaatagctgttaagacagtcaaaaccatcaagttcttgggactacatgaagagactcaaatacctaagggttgttcgagcccatttgatgtg

SEQ ID NO: 33843 - DNA, 269 bp, Zea mays
  Clone ID: LIB3059-052-Q1-K1-D2
tgaattatgacctctagttggctgtgcaaccccagaagataattggaaggaagatgtaagccgcacgatcttggttcagatcaaagggtggggcatataagatcctgttgtcatgaaatccaagatccatggaacgctgctcttcaccccatgtcactatgccagcgctcaaccgtacatacacgaggccaggctatcacaaggtgttccgtaatctcagcactttggcatgtgattgtacacttgtacacagaggtgatgcgcgatga

SEQ ID NO: 33844 - DNA, 414 bp, Zea mays
  Clone ID: LIB3059-052-Q1-K1-D3
tgcactcgtccgagaagaccagttcccctctcctgatcgtcctgttcctcacagcagcagcgatggcggccgagccggagaagcaggcggcccccgcggcacaggagacggccgtgcacatcgtgtacgttgaccgccccgaggacgccgaccctgaggagttccacatccgcaccctcacccccgtcctcggcagcgaacagaaggccagggacgcagtgctctaccactacaagaacgccgtcagcggcttctccgcgaagctcaccccccagcaggtcaaggatctcaaggagcaaccaggtgttctccaggttgtgccgagccagacttaccagctacatggtcctgggtctggcactcaccagggcacgacacacaccttgggccttatgtgaaggcgtatgagaatca

SEQ ID NO: 33845 - DNA, 406 bp, Zea mays
  Clone ID: LIB3059-052-Q1-K1-E3
cggaattcccgggtcgacccacgcgttcgtggggagcgggctcactgaagctggttctccttttgaagggacctgtggatggccgtgaggcttcagccagatgcaaattcaattatcaacgatgaagctcccgccgtggtgtttgttaataagttcctgtaagcatatcatttagtcgctatgcatgacactagctgaagcgctatctaagctctattggtatgaggtttggttgccgtgttgccgagcctgtaaacgaagcaagatttgcaaacttgttatattgtggtattgatgatactggattactggctgtgggttgttcaaaaaacaaccatactcatttgttgtacctgatccctacttttttgggagaaaggttcaacgttttggtgcatgataaaat

SEQ ID NO: 33846 - DNA, 417 bp, Zea mays
  Clone ID: LIB3059-052-Q1-K1-E8
ccggaattcccgcgtcgacccactcgtccgtcgcactcgtcctcatacgctttggttttggactcctttttgatcttcttgtgatggtacccatgatggtgcctattgatgagagccctgccttcctattgtatcaggattgtgctctgtgcttaatattcttgaaaatatcgactagactgtttatgctggatcagatggcacctttggttgatgaaagctggaggtcaaagtttgagagagttagagacgatgacttctcccgtttaaagggtctgtgggtcctccatgaaattataatgccgatcgtgaccaagctgcttactgctctctgtgtcccatacgtccttgcaaggagcatcttcccgttactgggttacccactcatcgtgaactcatcggtgtaccgttttgcct

SEQ ID NO: 33847 - DNA, 255 bp, Zea mays
  Clone ID: LIB3059-052-Q1-K1-G12
gcccactacgaggacgagtgcatgatgaggcgcacgcgggccgcgcacaccgactacatctacacccagcagcaccacggctgatccaatataatccgtcctaggttacatgcgttgctctcgtacgtgtgttcgtgtccgtccgtgctcgtgtcgtgtactcgtgtgtgtgtgtgtgtgtgtgaaacgccagcgcgtgctgcttctgctgcgtcgttattacctgcgtgtcaaataaattcttttttttgtccc

SEQ ID NO: 33848 - DNA, 411 bp, Zea mays
  Clone ID: LIB3059-052-Q1-K1-G2
tgcatatatgacttgggatagatgaatgggtagtaatacttccactatgaaatggggctaggcattcatatatgacttgggatagatggaccaaccattcaatcaagcaaccaagtgccttcatggcaactgggaatgggtgatatgtcaggttagttttggctaacttaaccacggtgtgggttaacaacaccaacatgctagaggaggaagcggatacagaaacattttctgaggggcttcttttctttgagtcatgtttttagttttgattcctgcgcgtggctagctccttttggtttttgaatgagatgtgtagtggtgattattgcggcgcatattttagagatcgtggttcttccaacataagctggaaaaagaagtctgtatacggatgaacatgtataccaa

SEQ ID NO: 33849 - DNA, 443 bp, Zea mays
  Clone ID: LIB3059-052-Q1-K1-G8
cggaattcggacggcgggcgtcgacccacgggtccggcccgtaccccgcctcccgtttcatctcaaatccctctcgcctcatccccgccagggcaaagccgccctatcgtcctgtcgtgagaagcaatggcgggccgtggcaaggcgattggcgctggtgccgctaagaaggcaacgtctaggagctccaaggctgggctgcagtttcccgtcggcaggatcgctcggttcctcaaggccggcaagtacgccgagcgcgtgggctccggcgcccctgtctacctcgcagctgtcctctagtacctcgccgctgaggtcctggagcttgctgggaacgcatcgagggataacaagaagacccgcatcgtgccgtgtcacatccagctcgccgtgcgcaacgacgaggagctgaccaagctgcttggtggtgccaccatcgcgag

SEQ ID NO: 33850 - DNA, 224 bp, Zea mays
  Clone ID: LIB3059-052-Q1-K1-H12
ttcccgggtcgagccacgcgtccgcgtcaaagcatgttggctaaatggcagcaattgttgttgttgtaagaaggcaacatgctgggacgaatcctaccaccttattgcaaccgcccaccatcggtggtgccatcttctagatttattattacagtataaatcataaagttctcatgctgatatgtgtgacctctcagtaataaagtattagagatctatatttt

SEQ ID NO: 33851 - DNA, 371 bp, Zea mays
  unsure at all n locations
  Clone ID: LIB3059-052-Q1-K1-H2
accggtccggaattcgagccacgcgtccgtgcaagcccaatggggaaagatctggatggcaacgagtgcaccgtgggaatgtcagatngcaacgacaggggtgaaggcattttgaaaccccgtggattccaaagaagatggtcatggattggaaccttgctgaaaatgttcaagaataaccgcctttccagaagattcttgaacataaactaacaataattgggtataaaccgcttctaacacggtgctaatctaatccgtttcacatggaatcggaaagtctcgctggctcaccacagttgtacgtgagatgagtccaactggcaaactgcaacttgatgtggtatatataaaagtgaagtttcagctca

SEQ ID NO: 33852 - DNA, 98 bp, Zea mays
  Clone ID: LIB3059-052-Q1-K1-H4
gacctacgcgtacgggaactcgttgaccttagtttacattgtctttatcgtgcttcccacaatggtagcggtcaaatagagtcacctagattcaattg

SEQ ID NO: 33853 - DNA, 366 bp, Zea mays
  Clone ID: LIB3059-053-Q1-K1-B3
aagagggaacgaaagcatggatcatatctgattcttttaacttcaaaggcccaaaccatgcggaatgaagtaacaaacacactaaacaaatcccaggaagtggatcatcccacttccgtgtatgtacataaccgatgcctcagtgtacatacactggagcagagccgacaaacgccgctagatatgttacgcccccaacgattattgcggaatatctcacaaggattattgcagaacatctcacatggctcacagggcaaacctggtaggtcttgggctcttggcaatccatggcaacgctgaaactgcacaaacgatgaggaacaggtggtctagtccttgtagacaagaggcttgttgacccat

SEQ ID NO: 33854 - DNA, 167 bp, Zea mays
  Clone ID: LIB3059-053-Q1-K1-C2
aattcccgggtcgacccacgcgttcgcggacgcgtgggtgctatccagctttgccgagaactacaacaatggtttccgaaaaagaccgggttacctaacagacacgtgtaccggtcaagatctgaagaaataccacaacatggatgccatcaatgtaagctactcat

SEQ ID NO: 33855 - DNA, 527 bp, Zea mays
  unsure at all n locations
  Clone ID: LIB3059-053-Q1-K1-D10
tactcggtctcggaattcccgggtgcgactccacgcctgtccgtgtatatgtctttacgttcatggattctctagatgctacgaaacagagggacttctctcttgaacctagaagtgacgatnntgaggcnnttcgaactaaagtactgaatatcagactacttacgtaggacctnnagtatgttagtatggcacattcgtgaagaaggttcattgggcctacttagctgtattaactctacttcggtatagtgttctagagtccaagaaaaggtgcattgaactttggatcatggttatgagattgagctggactttgttattgcagcacagtacanaatgcttgacgtaggttgttatattctgatggcaactccacaagtaagctgagtgtatgccttcttaatataatagacttttggtgagaccaaggttaaatctttgatactgcattgggacaaagagcaagcttcagaaatgttgaatacttttgacatcattgttgcaagtgactgcacatttttcaa

SEQ ID NO: 33856 - DNA, 416 bp, Zea mays
  Clone ID: LIB3059-053-Q1-K1-E6
tgaggaaattggtttcaggcttgtagtatatcctttatccttagttggggtatcaatgcgtgcaatgcaggatgctctagttgcgataaaagacggcggtgtacctccacctagcgtcctgccatcttttcaggagatcaaggatacattgggtttcaaccgctattataaagaagagaaacaataccaagtggacaagtgaaggaagcagctgaagtctgatcctgtggattcagtcggatcgtggccatggcttaatttccaccggacatgctgggcttccaccggacatgatgcagaccaatcgtatttatgttgagttgtaatcgaacgctgcgtagcgcagtatcccgaagaacatatatatggggtcttctcttccgtttctgctctgctgtggtttcaataatcccgaa

SEQ ID NO: 33857 - DNA, 417 bp, Zea mays
  Clone ID: LIB3059-053-Q1-K1-E8
cccacgcgtccgcccacgcgtccgtattattgagaccaactagcaacatagaaagcacaatagtgtaccaacaatggcagccaaaatattttgcttccttatgctccttggtctttctgcaagtgttgctaccgcaaccattttcccacaatgctcacaagctcctatagcttcccttcttcccccatacctctcaccagcggtgtcttcagtgtgtgaaaacccaattgttcaaccctacaggatccaacaggcaatcgcaacaggcatcttaccattatcacccttgttcctccaacaaccgtcagccctattacaagagttacctttggtccatttggtggcacataacatcagggcacaacaactacaacaacttgtgctagcaaaccttgctgcatactctcagcaacatca

SEQ ID NO: 33858 - DNA, 413 bp, Zea mays
  Clone ID: LIB3059-053-Q1-K1-F2
tattggtttaagttaaggattccatttgtaaaaaagaggattcccttgaactaggtgacgttgaggcttcgaacaaatacaatatcgacactactggactagtatgttgttggccatcggaagaggttcttgcctactactgtattaaccactcggatgtgttcaggtccaagaaagtgcttgaacttggatctggttatggattggctggacttgttattgcagccagtacaaatgctgacgaggttgttatttctgatggcaacccacaagtagctgagtgtatccttcttaatataatagacttttggtgagaccaaggttaaatctttgatactgcatttggacaaaagagcaagcttcagaaatgtggaatacttttgacatcattgttgcaagtgactgcacatttt

SEQ ID NO: 33859 - DNA, 430 bp, Zea mays
  unsure at all n locations
  Clone ID: LIB3059-053-Q1-K1-F4
ccggaattcccgggtcgacccacgcgntccgcgtgctnaatcgtcccaagtcgncgtcgncgtctcttgccgtggggctgctctcggggcttgcgcagaggacgggaccgacgcctggaaccaccggatcggcggcatctctctcagtctcgtcgccgatttccctcggtttcaaccccacctccttcctcccgttcctgcagacagcgaggtggctcccgtgcagcgaccttgccacctcgtcgtcttcggcaccctcttcccctccccgctcgctggcgccttcggctccccccaagaaggcgttgattggtgcttctgctggttctaccggaattgcgacgagcagtggtgctggtgcagcgatgagcaggagcaactggctgtcgaggtgggtcagctcctgctccgatgacgccaagacggcgtt

SEQ ID NO: 33860 - DNA, 121 bp, Zea mays
  Clone ID: LIB3059-053-Q1-K1-H4
aattcccgggtcgacccacgcgttcgcaccaccaatgatgggttgttggtagaacactgttgagttttttggatgatgttggtggcgtcccagaaataagaaagtacatttctagattctt

SEQ ID NO: 33861 - DNA, 431 bp, Zea mays
  Clone ID: LIB3059-054-Q1-K1-A7
tacataataaacaatacagacttagctactagtgctgtgctactgtaacattgtttgatcaaatcctgtaaacgtcagcaagggatggatgttcttaaacatccgaattgtcagcctttataagtcataatatgtaagcagaactttttcgtactctatcgttttgaaataataaatttcattaatgactattaaataattataaaattattttaatattaattattataattaatttaatatattttaaattatataatatattttatattttatattttttcttattttttttatgggttttttatttttttttttttttttttttatttattattataattttttttttattttttatttttttattttttttattatttctttttttatatttttaatatattttatatctttttttttatatatat

SEQ ID NO: 33862 - DNA, 349 bp, Zea mays
  unsure at all n locations
  Clone ID: LIB3059-054-Q1-K1-A8
tcgtccggnattcccgggtcgacccacgcgtgcgatcgaatcgtctcgctcgtggctgctttactcgtgctgcttgccctcgccgcacgttcctccacgcgcagcgcacaaaaggagtccgtggctgacaacgccgggatgttggcaggcggcatcaaggacgtgccggcgaacgagaacgacctccagctccaggagctcgcgcgcttcgccgtcaatgagcacaaccaaaaggccaatgctcttctggggttcgagaagcttgtgaaggccaagacacaagttgttgctggcacgatgtactatctcactattgaagtgaaggatggcgtagtcaagaagctttatg

SEQ ID NO: 33863 - DNA, 277 bp, Zea mays
  Clone ID: LIB3059-054-Q1-K1-B1
cccacgcagtccgcgcactcgtccgaaaaaaaaaaaaaatataaaaaaaaaaaaaaaaaaaaaaaaaaaaagaaaagataaaaaaaaaaaaaagaaaaaaaaaaaaaaaaaaaaaaaaaaaaaaaaaaaaaaaaaaaaaaaaaaaaaaaaaaaaaaaaaaaaaaaaaaaaaaaaaaataaaaaaaaaaaaaaaaataaaaaaaaaaaaaaaattaaaaaaaaattaaaataaaatcaaaataaacatatttaaaaaaaaatatataaattataaaat

SEQ ID NO: 33864 - DNA, 221 bp, Zea mays
  Clone ID: LIB3059-054-Q1-K1-B12
cggacgcgtggggtgctgtagtatatccgctggctagctagctagttgagtcagttagcggcgatgattgagtaataatgtgtcacgcatcaccatgggtggcagtgtcagtgtgagcaatgacctgaatgaacaattgaaatgaaaagaaaatagtattgttccaaattaaatatttttttatatttaaaaagggcgtccgatctagagtgatccaagct

SEQ ID NO: 33865 - DNA, 396 bp, Zea mays
  Clone ID: LIB3059-054-Q1-K1-B6
tactcggtccggaattcccgcggcgacccacgcgtgcgcgattccacttctagatagagaaactaactaaaggagaatacttaataatagggcggaacatttatacaaaacacctatcccgagcacacgcaagggaaccgtagacaggcaagtgaaatccaatccacgaaataaattgatccatggacggcaccgttgtggtaaaggtcgtaatgccagaggaatcattaccgcaaggcatagagggggaggtcataagcgcctataccgtaaaatcgattttcgacggaatcaaaaagacatatctggtagaatcataaccatagaatacgaccctaatcgaaatgcatacatttgtctcatacactatggggatggtgagaagagatatatttt

SEQ ID NO: 33866 - DNA, 328 bp, Zea mays
  unsure at all n locations
  Clone ID: LIB3059-054-Q1-K1-C8
actcggtccggaattcccggcggcgacccacgcgtgcgagttagaccaactagcaacatataaatcacaatagtgtaccaacaatggcanccgaaatattttgcctccttatgctccttggtatttctgcaagtgctgctacggcgaccattttcccgcaatgctcacaagctcctatagcttcccttcttcccccgtacctctcaccagcggtgtcttcggtatgtgaaaacccaattcttcaaccctacaggatccaacaggcaatctcatctggcatcttacctttatcacccttgttccttcaacatatcatcaaccctattac

SEQ ID NO: 33867 - DNA, 260 bp, Zea mays
  Clone ID: LIB3059-054-Q1-K1-D10
ttcccgcgtcgacccactcatcctgggaaaaaaaaaaaaaaaaaaaaattaaaaaaaaaaaaaaaaaaaaaaaaaaaaagaaattttaaaattctaaagataacaaacacatacatacaaaaaaaaaacaaaaaatataaaataaccaaaataaaatatatataaacaactttaaacaacattttttacttttaaaacccttccaatactatatctaaattatctttattatcacatcctcttttctcatttttccttaa

SEQ ID NO: 33868 - DNA, 337 bp, Zea mays
  Clone ID: LIB3059-054-Q1-K1-D2
cggtattcccgctcgagccacgcgtccggctcggcgctctcctctcccgacgactgctacacctcacaaccgtgagctcgcgaaggagcgctgttcgcaattccggcgccggcaccatgagtaagctgcagagtgattctctgagggacgcgattgcctcaattaccaatgattcccgtgagaagcagcgcaaatttattgaaaccattgagctacaaattggactgaagaactatgaccctcaaaaggacaagcgcttcagcggttctgttaagctgcctcacatccctcgccctaagatgaacgtatgcatgcttgatgatgctcagcatgttga

SEQ ID NO: 33869 - DNA, 420 bp, Zea mays
  Clone ID: LIB3059-054-Q1-K1-E7
tgcagcattcaaaaacacaccaagcgtaagcgcactagcaacgacctaacaccgattgctaccaagatattagccctccttgcgcttcttgcccttttagtgagcgcaacaaatgcgttcattattccacagtgctcacttgctcctagtgccagtattccacagttcctcccaccagttacttcaatgggcttcgaacatccagccgtgcaagcctacaggctacaactagcgcttgcggcgagcgccttacaacaaccaattgcccaattgcaacaacaatccttggcacatctaaccctacaaaccattgcaacgcaacaacaacaacaacagtttctgccatcactgagccacctagccgtggtgaaccctgtcacctacttgcaacagcagctgcttgcatccaacccaatttgc

SEQ ID NO: 33870 - DNA, 383 bp, Zea mays
  Clone ID: LIB3059-054-Q1-K1-F10
taattcccgcgtcgacccactcgtccgcttataggcaacatcaacaactacttttcatccagctacctgttgcctaccagcgctttttcttccattcaaccaactaacatcattgaactctcctgcttatttacagcatcaacaactactaccattcatccagctatctgctgtgagccctgctaccttcttgacacaaccacatttgttgcctttctaccatcacgctgcgcctaacgctgtcaccctcttacaactgcaacaattgctgccattcaaccaacttgctttgacaaacctatcatttttctaccaacaacccatcattgtttttgccctcttttatatttcttattatttatatttcattattaaagtttttt

SEQ ID NO: 33871 - DNA, 539 bp, Zea mays
  unsure at all n locations
  Clone ID: LIB3059-054-Q1-K1-F5
gtactcggtccggaaattcccgggtgcgactccacgtcgtctcggtgccgagccatctgttnnnatttgtgtgagttgtgactagtggagcccttgctgagctgtggtggccgttgtatgcncntagattgacgttcgcgtgtattttctgtnngaattanntgaaatncatgtgcnnnttgcctgttgnnctgtttnngaaaacctgtgtcgagtggtcgagcccagcatttgtgccttaagtgtnncttttcaatttcaatctgtttgaaaccctgtgttgagtggcatagtcatgcagctctgtgccctaatgtccatgtgctatcatcatgaagccaggctaagccaacaaagccgtgcccttgcattcacagaagccaacaagcaaccagctcgtgccagatgaagaagcagcaagctcgaaccttaacttttaaagtgccttatagttttcaacttttcagtttttgtttggttttacttgctggaatgctttttaaccgtgtgcaactatggccacattgtgatgtggttta

SEQ ID NO: 33872 - DNA, 428 bp, Zea mays
  Clone ID: LIB3059-054-Q1-K1-G7
tacgcttaccgcgtacgtacgtgtcttcgggcgtggcactctccagtctccatgacccatccaccaagtgctactgctccttcgtagggagacgtgggaataaagagtggtagctgcatgcgcgtacggcggccatggctctccgatgagagagctagctgtgtacgtgtgttcgtgatgttgttccatgcatgacatgtatacgtattgcctaattacgcttgaactagttgagagactgtgcaagtttattgttctatttattatataattatatagtactctttttatgggggtgtgttattttttttatttttttatttttttttatttattttttattttatttatattttttattattttattttttttattttatctttttattttattattttattattttatttttttataatttttta

SEQ ID NO: 33873 - DNA, 389 bp, Zea mays
  Clone ID: LIB3059-055-Q1-K1-A11
ggtccgtaattcccgggtcgagccacgcgtccgcgcagctcttgtgatcatgcggctgctgagaaaactagagtaggtcgagaaggattgattatagattgtttagaaggtattgccgtctaaggaacgaagagtttggccagaagcaacatgctctgagacagctataaacatctggattgtaatgactactattcttccagacttcatagacattttcataggaattactctttccattccagaaaacaggacgtataaatttttcacgaatattagtgcaggtatcgatgctcagtgataaaataatgtataagtggtgtgcaaatttttctcgatcaaaatattattttattatttttatttttatttttttttttttttttttt

SEQ ID NO: 33874 - DNA, 65 bp, Zea mays
  Clone ID: LIB3059-055-Q1-K1-A12
gacccacgcgtcctgagaaacatctcaaccaacatcatataattcacaatactacaccaactact

SEQ ID NO: 33875 - DNA, 366 bp, Zea mays
  Clone ID: LIB3059-055-Q1-K1-B11
attcccgggcggcccacgcgtccgggtacttctccctccgccgccactctcctcccattctccgccaccgccaattccatgccgttctccgccacggctgctgagagcgagaagagatggcaggcaagggtgatgggccggcaatcggcatcgatctcggcacgacgtactcttgcgtcggcgtctggcagcacgaccgtgtcgagatcatcgccaacgaccagggtaaccgcaccacaccctcgtacgtcgccttcaccgactccgagcgcctcatcggagatgcggccaagaaccaggtcgccatgaacgggagggacaccgtctttgatgccaagcatctcattggcaggaggtttagtgatg

SEQ ID NO: 33876 - DNA, 354 bp, Zea mays
  Clone ID: LIB3059-055-Q1-K1-B7
tcccgcgtcgacccacacgtccggtttcactgtttagatactgtacgttttaacctgcacaataatgtcccaagcttgtctactataaatattttgcttccttatcctcctaactctttctccacatgtttctactgcaaccattttaccacaatgctcacaagctcctataacttcccttcttcccccatacctctcaccatcattgtcttcaatttctaaaatcccaattcttcaaccctacatgatccaacaatcaattccaacattcatctttaccattatcacccttaatccttcaacaaccttcatccctattacttcaattacttttttttcattttttttctcatt

SEQ ID NO: 33877 - DNA, 480 bp, Zea mays
  Clone ID: LIB3059-055-Q1-K1-C5
gtccgtccgattcccggtcgcccacgcgtccggccacgcgtcctgcgctacatgtgctgtccatgcatcgatccatggcaggggacgtcaagtgcgagcagccgaagcggacgccgagcccgagcgcttcgtctctgaggatcttcggctacgacgtggctggctcgggtatcgccgtccgcatcatcgagccttcgcctcatgacgattgccggccgtccgtggtggacagtatgcgcatgtttgagtttctgttttgttgtcttgtgttcttttatttttattttctttttttttattttttattttttttttttttttgggggggggtttttttttatttttttttatttttgttctttttattgtttttttttttttttttattttattttttttttattttttttttgttatttttttttttattttttttattttttttttttttttttatttttttttttttatttttttatt

SEQ ID NO: 33878 - DNA, 363 bp, Zea mays
  Clone ID: LIB3059-055-Q1-K1-C9
aattcccgcggcgagccacgcgtccgcatcgccatggcagccaagatgttttcattgtttgcgctcctagctcttgtgcagcaccactagtgctacccatatcccagggcacttgtcaccactactgatgccattggctaccatgaacccatggatgcagtactgcatgaagcaacagggggttgccaacttgctagcgtggccgaccctgatgctgcagcaactgttggcctcaccgcttcagccgtgccagatgccaatgatgatgccaggtatgatgccaccgatgacaatgatgccgatgccgaatatgatgccatctatgatggtgccgactatgatgtcaccaataacgatagctag

SEQ ID NO: 33879 - DNA, 195 bp, Zea mays
  Clone ID: LIB3059-055-Q1-K1-D3
cgacccacacgtccagccacacgtccgcccacgcatccgataaaaaaaaaaaaaaaaaaaaaaaaaaaaaagaaggataaaaaaaaaaagagagcaaaaaaaaaaaaaaaaaaaaaaaaaaaaaaaaaaaaaaaaaaaaaaaaaaaaaaaaaaaacaaaaaaaaaaaaaaaaaaaaaaaaaaaaaacaacccact

SEQ ID NO: 33880 - DNA, 418 bp, Zea mays
  Clone ID: LIB3059-055-Q1-K1-E2
gtcggctgctgagctccgccatgttatgaccaacctcggcgagaagctgacttagtaggatgtcgacgagatgatccgtgaggccgatgttgacggcgactgccagatcaactactaggagttcgtcaaggtcatgatggccaagtgaggagcgatccccgttatctatgaatgaattgaagtgaaatatcaggcacacaagctgtactttgccatgttccttttgagtacacattattatcatgcatgatgtcttgtctagtaatttatcaacttactactttttttatggggggatttttttcttactgaactcttctttttattttgtatcttttattactattttctattttttctacttttctttatttttttttttttttcttttttttctcatcttttttttttttttttt

SEQ ID NO: 33881 - DNA, 453 bp, Zea mays
  Clone ID: LIB3059-055-Q1-K1-E4
tcggtccggaattgccgggtcgagccacggggcacgcgtccgccttgttcctccttcaatcatcagccctattacaacagttacgtttggtgcatttattggcacaaaacatcagggcacaacaactacaacaacttgtgctagcaaaccttgctgcctactctcagcaacagcagtttcttccattcaaccaactaggttcattgaactctgcttcttatttgcaacaacaacaactaccattcagccagctacctgctgcctacccccagcaatttcttccattcaaccaactagcagcattgaactctcctgcttatttacagcagcaacaactactaccattcagccagctagctggtgtgagccctgctaccttcttgacacaaccacagttgttgccgttctaccagcacgttgcgcctaacgctggcaccctcttacaactgcaac

SEQ ID NO: 33882 - DNA, 458 bp, Zea mays
  Clone ID: LIB3059-055-Q1-K1-E6
tcccgggtcgagccacgcgtccggccacgctttcggctagttcaccttttaattttcttaaagagacagaagtgaagtgtaggctctaaagttcagatcgggggtgcagaaacatcgagcaaagtagataaacctactatcgataccagtgttgacaaatttgtaaatgacgtgttcgagatcatctccccattgttcttgtctgaggcattgaagaaattggacattaagaaggaagatctttctttgatcttagaaggcctcatgggacgggcagatccagatttgaagagtatagctatgactttgaagaatgggtggtatactctttagttttcactgctattataattctatgcttatatctttttttatattgttattttatttatttttcttttttttatattttattttttatatttttatattttttatttaattttttttattttttt

SEQ ID NO: 33883 - DNA, 305 bp, Zea mays
  Clone ID: LIB3059-055-Q1-K1-F12
ctcggtccggaattccggcggcgcacgcatccgagatacatttccactgcaaccaatatgtttgcatagatggcgctcctagctctttgtacatccgccactagtgcgacccatatcccagggcacttgtcaccactactgataccattggctaccatgaacccatcgatgcagtactgcatgcagcaacacgtggttgcccacttgctagcctagccgaccctgatgctgcatcaactgctggcctaaccgcttcagccatgccagatgccaatcatgatgccaggtatgatgccaccgatgac

SEQ ID NO: 33884 - DNA, 401 bp, Zea mays
  Clone ID: LIB3059-055-Q1-K1-F3
ggtccggaattcccgcgtcgacgccacgcgtccgagagcaacatagaaagtggaatccagtagcatcaacagagcaacaatggcgaccaggatgttttccctccttatgctccttgctctttctgcatgtgttgctaacgcgacaattttccctcaatgctcacaagctcctatagcttcccttcttcccccataccttccatcaatgatagcttcagtatgtgaaaacccagctcttcagccctataggctccaacaagcaatcgcagcaagcaacatacctttatcacccttgttgtttcaacaatcgccagccctatctttggtgcagtcattggtacaaaccatcatggcacagcagctgcagcaactcgtgctacctgtgatcaaccaagtagctc

SEQ ID NO: 33885 - DNA, 284 bp, Zea mays
  Clone ID: LIB3059-055-Q1-K1-F7
tcccgcgtctacccacacgtcctagtgttcatcgtgccctaagtttctctccttcaccgcggagctcaagtactgctcgttttattacaaattctgtcggcacaccatttctatcatcaccaactatttaatattcatcaactctcatcaaattctatcaacatttttcttaatctttttatcttatctttttttcattttttatttatttattttttatcttaatattttatttttttattatattttatatatcattcttaattatttattcttttttattt

SEQ ID NO: 33886 - DNA, 443 bp, Zea mays
  Clone ID: LIB3059-055-Q1-K1-F9
tcccgcgtcgagccacgcgtccggaataatctgtacttgttggggacttattattgccaatgaactttagcacgcaatgtttatgtgcagctggtgtagtaaattcaattgtgctctgttttccctgtttgtgttcattatagttttatttatatttatttgcggggtgtgcgctgatttttgttttacatttactctattatttttactgttttttattttcttttttttatgattatttctttctttttttttactttttttttttttaatttttttatcttttttttttttttttttttatttttttttttgggggggtttttttttttttttttttatttttttttattttttttatttatttttatattattttttatttctctttttattttttttttttttttttttatttttatttttttttttttattattttt

SEQ ID NO: 33887 - DNA, 408 bp, Zea mays
  unsure at all n locations
  Clone ID: LIB3059-055-Q1-K1-G4
tcggtccggaattcgcgggtcgaccctgacgaggagttccacagctgccgaaagcttctatttcaggcacanataatgcttgaaagggtgacaccacagatgatgcacatggcaaagagccaacagccctcgggctccttatcacaatcttcatctcacctcaatgagccatatccacagacagatgctatgattccgctagtctcaagaccttcaagtttgccaactaacataccaccgaacccaactgtcctacaggaacaaactgcaacactacatagtattcctcagcatcaacatgcatcccagcccctagtcaaaatgtttccacatggacatcagtctgggatcgccgcacaatctccaatgctacatcatggagctatagtgctggttctgttagcttac

SEQ ID NO: 33888 - DNA, 481 bp, Zea mays
  Clone ID: LIB3059-055-Q1-K1-G5
ttcccggtcgactccacgcgtccgcgccacgcgtccgcggacgcgttggattgcatcggcatgtgcactgttaatgtctgcaaaatttaaacattggtgggtaatacaaaattaattttaacaatatttttttattttatatttaataatttaatttatttcaatattatatattttattttttatattttttattattatatattttttattttattttttatttttatttttatatttttatttttattttaattttatttttttttatttattatttatttttattttattatttttatttttttttttttattttttatttttattttttgttaatattaattattttatttttaattattatttataatatattatttttttattttattatattaatttttttttttatttttattttattatttttattttttttttttatttttatttttatatttttattatattttttttt

SEQ ID NO: 33889 - DNA, 425 bp, Zea mays
  Clone ID: LIB3059-055-Q1-K1-G7
aagcaaagcaaatctgcaattgaattcaatccagtccaaaattgcaagtcgtccgtaagataaacgaacatattcgtttgtacggtaatgtaacataaaattctcatctaatgcctggacttcttcttcctagatttgttgctagtttttggctgttcagcatttaccgccggtgtctttgatgaattggtggtttggcttccttttgaggattctccgacattggtggccgatttttttttttactactctctttttgctcctttttctttatccttttattttggggtgtttttctttatctgtttcgtttttttatttttttgttatttttttttttatttttttttttattttttttttttttttattcttttttatttttaattttttttttatttatttttatttttttattttttttt

SEQ ID NO: 33890 - DNA, 342 bp, Zea mays
  Clone ID: LIB3059-055-Q1-K1-H12
acttgtccggaattcccgcgtcgacccactcgtcacgactgaactcggcacaatctaacccattattatacccatcggcaaccgcaaccaaccaaccaaatgaccgtgatccaacctaaccgtgggtgaaccctatcgcctacttgcaacaacagctgcttgcatccaacccacttgctttggcaaacgtagctgcataccaacaacaacaacagttgcaacagtttctaccagcgctcagtcaactagccatggtgaaccctatcgcctacctacaacagcaacaacttctttcatctagcccgctcgcttttggcattgcacctacatacctgcaacaac

SEQ ID NO: 33891 - DNA, 455 bp, Zea mays
  Clone ID: LIB3059-055-Q1-K1-H4
tcccgcgtcgacctacgctatgattgacttgtgaagggtcttcgcgtggctgccaaggccattgagaatgatgctgctcagctttgcgttgttgctgaggactgtgaccagccagattatgtcaagctggtgaaggcgctctgtgctgaacacaatgttcaccttgtcactgttcctgctgctaagactcttggcgagtgggctgggctttgcaagattgactcctaggtcaaggcaaggaaggttgtatgctgcttctgtgttcgtttcaatgtctactgttaattattttatggtcttaacattgtgcttgagtttttttattctttattttattttatattttttatttttatcttttatttttgtattaggtctaaatatttttttttattttttttatttttctttattttttttttcttattttttttttattatttcctttttttttt

SEQ ID NO: 33892 - DNA, 207 bp, Zea mays
  Clone ID: LIB3059-056-Q1-K1-A11
tcttccgcatctgctcatattgccctacatctagcaagctgtggcaagctgtagggcattctgtcctcagtcactgttgctcatctgctaccagcatttcgccattaacacggtgtgcgttcttacatcatcaaccatgcttgccctagagccagctcgttgtgccagaatcaccgcacatttcatgacatcccattatagctagtt

SEQ ID NO: 33893 - DNA, 254 bp, Zea mays
  Clone ID: LIB3059-056-Q1-K1-B1
actgaaatgaggatagtatcgcagctttcgtgattaaaacctgaatcacccacagcggtgttctaagtactcagccagtggtatttactggttgacctactgtagtttgcgtcggaatagatttgtttttttactcttcgtggggcagttttgtactggtggattcataaggactctgattatggtgcgttcggaacttataataataagcacatgaaattttgcttcaaaaaaatactaccattcaaacagat

SEQ ID NO: 33894 - DNA, 197 bp, Zea mays
  Clone ID: LIB3059-056-Q1-K1-C6
tgcactaagaacatgaaagatgcttctttaagaaaagaagaaatgaacatagattgtggagcatgcatctgtggcccacgagacaatacaaacagtgcccttcacttgttagaggaaacattttattcaaaaggacagattaaaattgcagacacaggaaggatgcatgtcatgaaagtttttgaaagtcattgaat

SEQ ID NO: 33895 - DNA, 383 bp, Zea mays
  Clone ID: LIB3059-056-Q1-K1-D3
tggagctcccaaactagccctaaaggtttccactcccagaagctccgttttttttgtgtcttgctacagaactgttattcatgtgggccacaggagcagggagagagatctgggtggagaagggcctgtgaggaccagatcgcaaagctgaagaagaggagcgtggcgaaggattcaaaagaagaacctgtcgtggggcgctcgcatgcggagaatggccgaggcgttagcaacggaatagctgcgacaagcgaccctgccaaatgcagctgtactcgtacgtagcatgtggagcgaaacgaaacggaatatattttctggtgggtacaatttggtctgcaaggtttttaaagcgtggatctaaagatgtccagatggaaacc

SEQ ID NO: 33896 - DNA, 384 bp, Zea mays
  Clone ID: LIB3059-056-Q1-K1-D4
tggagctcggaaactagccctaaaggtttccactcccagaagctccgttttttttgtgtcttcggcacacatctgttatccatgtgggccacaggagcatggagagagatctgggtggagaaggtcctgggaggaccagatcgcagagctgaagaggaggagcgtggcgaaggattcataagagaacctgtcgtggggcgctcgcatgccgagaatggccgaggcgttagcagcggagtagctgcgacaagcgaccctgtcaaatgcagctgtactcgtacgtagcatgtggagcgaatcgaaacggaatatattttctggcgggtacaatttggtctgcaaggttcttaaggcgtggatctaaagatgtccagatggaaacct

SEQ ID NO: 33897 - DNA, 449 bp, Zea mays
  Clone ID: LIB3059-056-Q1-K1-D7
taccggtctcggattcccgggtcgactcacgcgtccgcagacgcgtgcgatggaaaggtagccttcgatgattatcttgatgctacaggatcagggatgaaggcatcactcagcacaatagggatgcacagaccaagatcggatgtatctcgatcgaacttagtcatatggctacagtctaaacccaaccatgagatagatatggctacgtgctaagcactaatgatgaattatagctgctgaacacctatgtgcatgagattctataacatgttcttgcgaaagatgaaaatctgtagatcaatcaagctgaatgtaaaaagtcgaagcatgaccaatgctagtgctaatgacacagctattgcatcaacattcaggagagttgcacagattatatagactgtgcataggtccaatgcttattggacgactgagtgccagactatgat

SEQ ID NO: 33898 - DNA, 434 bp, Zea mays
  Clone ID: LIB3059-056-Q1-K1-F9
ttcccggtcgactccacgcgtccgctgacgacccacacgagcacttagccgttgggaggggcgatggctagaggtgtggtgtgagcgaagggcggcacggccgcgggcaagaagaaggggtcggtcgccttcacgatcgactgcaccaagcccgtggaggacaagatcatggagatcgcctcgctcgagaagttcctgcaggagcgcatcaaggtcgccggcggcaaggccggctacctctgcgaatccgtcatcatctcccgcgagaagaccaaggtcaccgtcacctgcgactggcccttctccaagaggtatctgaagtacttgaccaagaagtacttgaagaagcacaaggtgcgagattggctccgtgtgattgcagccaacaaggaccacagcgtctatgagctgcggtacttcaacattgctgagaa

SEQ ID NO: 33899 - DNA, 219 bp, Zea mays
  Clone ID: LIB3059-056-Q1-K1-H12
gctgcacaacctacaaggacagccagggctaccaagaagcctatctatattagcgatggcgaccctgaggatgaagtggagttgattgatgattcggactttgatgcggacggtgactctgacgagtgaagattgtagtcatccgtactttggctgcaacaatatccagtttgtgtcgttgcatgtgacaatttgataatgcatttcttgtgcgttgta

SEQ ID NO: 33900 - DNA, 148 bp, Zea mays
  Clone ID: LIB3059-056-Q1-K1-H7
cggttcggaatccccggctcgacccacgcgttcgatcacactttcttccatacattttaattatagtcatgtatctccattctaaagtatggttcaaatattcatctttgttacacaacatttgtccctgaatattcctaattataac

SEQ ID NO: 33901 - DNA, 367 bp, Zea mays
  Clone ID: LIB3059-057-Q1-K1-A11
tgagaccaactagcaacatagaaagcacaatagtgtaccaacaatggcagccaaaatattttgcctccttatgctccttggtctttctgcaagtgctgctacggcgaccattttcccgcaatgctcgcaagctcctatagcttcccttcttcccccgtacctctcaccagcggtgtcttcggtatgtgaaaacccaattcttcaaccctacaggatccaacaggcaatcacagctggcatcttacctttatcacccttgttcctgcaacaatcatcagccctattacatcagctacctttggtgcatttattggcacaaaacatcagggcacaacaactacaacaacttgtgctagcaaaccttgct

SEQ ID NO: 33902 - DNA, 370 bp, Zea mays
  Clone ID: LIB3059-057-Q1-K1-A2
tgttcctgttgttggaggccatgcgggtattactattctgccactcttctcgcaggccactcctgcaagcaattcgttgtcccaagaagacattgaggccctcaccaagaggacacaagatggtgggacagaggtggttgaagcaaaggcgggaaaaggctctgcaacgttgtccatggcatatgctggtgctgtttttgcagatgcatgtttgaagggtctgaatggagttccagacattgtagagtgctcttttgtgcaatcaactgtgacagagttgccattctttgcctccaaggttcggctcggcaagaatggagtggaggaagtgcttggtctgggtgagctcaacgagttcgagaagaagggc

SEQ ID NO: 33903 - DNA, 476 bp, Zea mays
  Clone ID: LIB3059-057-Q1-K1-A8
tactcggttctcggaattcccgggtacgacgccacgccgtaccggcaacaaaggcctaagaacgaagacacgaatagacggcatgactactgtcgtgaatgaggaactggcgtgaagtggatctgaatgcttggatggacttacgcagtcctgaaaagaggcatacatgatgacggaatacttcagaagtttctacgcaactcacgtagcacaaggcacttcaggagtatgacccatcgctagtgggttgagagcacacttcaactggatgaaaggagatgctttaatctcaaaggctttagctattcattccactcgaaagctacagcatgatctactatgaggagttactacaacagacaagcaagtcaaactctcaagctgtatgccagaagaatgttcatatgtgctgaatctgatgaccttgttccaaaatatctgagctatttgaggtgtattgttgactcagacgcact

SEQ ID NO: 33904 - DNA, 441 bp, Zea mays
  unsure at all n locations
  Clone ID: LIB3059-057-Q1-K1-B3
tcccaatcctctcttacgccgatttctaccagctcgcgggagttgtggccgtggaggtcaccggtgggcctgagattcccttccaccccggtagggaggacaagcctcagcccccacctgagggccgccttcctgatgccactaagggttctgaccacctgaggcaagtttttggcaagcagatgggcttgagcgatcaggacattgttgccctctctggtggccacaccttgggaaggtgccacaaagagcggtctggtttcgagggggcctggactacaaaccctttggtctttgacaactcttacttcaaggaacttctgagtggtgataaggagggccttcttcagctcccaagtgacaaagccctgctgagcgaccctgtttttccgcctcttgtcgagaaatatgctgcggatgagaaggctnntcttgatgact

SEQ ID NO: 33905 - DNA, 179 bp, Zea mays
  Clone ID: LIB3059-057-Q1-K1-B8
cttgctttgacagacccagcggcctcctaccaacaacacatcattggtggtgccctcttttagattgcttattagttgtaattcaataataaagttttttggatgatgtatgtggccaaccagaaataagaagttacatttccagattctaaaaaatacaaaaaatgagtataagaaac

SEQ ID NO: 33906 - DNA, 270 bp, Zea mays
  Clone ID: LIB3059-057-Q1-K1-C10
accggtccggcattcccgggttgacccacgcgtccgcttggctatagctgaattttcttgttagtccctgtagtgcttagccaggggtaacgtaaagagttctgtttaggttgccttcttgcggccacaatcatgtagcagaatgtgcgtgtgtttcaggttagcgtgggggtatgtgcatctgtccaaagagagtctgcaatttggcaaccggatatttggttatcaatttcagttacttcgaaaacaaaacatacgaatatgtgacat

SEQ ID NO: 33907 - DNA, 407 bp, Zea mays
  Clone ID: LIB3059-057-Q1-K1-C12
cggaattcccgggttgacccacgcgtccgaaccgctgcgtaaacgaatccatcgccatggcgtctcgtctcgttgcggcggcgggctcctcctcctccctctcctcagcgtcccccctcgctcgcctaatctctcgccgcggtcttgccggtgccgcagacggccatgggtctgcgaaggtgcccttgtggaaagatccgttgagcccgagcaagtggaaggaagagcactttgttctagcaagcctctcaatgtggggggttattttttatggcggttacaagctttctagtggaaagaatgaagccaagactgaagcggcatcaccacaggcataagtggcctagatggagttatacccgtatctgtggcctggcaacaatgttaaataaaaggaatgctttatg

SEQ ID NO: 33908 - DNA, 329 bp, Zea mays
  Clone ID: LIB3059-057-Q1-K1-D12
tccggaattcgggtcgactacgcgtccgggcacgcgtccgcggactcgtgagctgacgcgcgggcagaattgccgaggtccgtgggaccaaggagcctaagaacctgtacaacatgcacttattgaaacacttgacttaggcgaacatgaagactgcgacgagccagtcagctgcaaaggactctgctgtggtcctctctactaccaagaccaataagcagaacgcacctgcgaagctcatccacaaggctgtgatgcacaaggagttccgcaagatggccaacgctgtcaaaaaccagtttactgactactactacaggcctgatctg

SEQ ID NO: 33909 - DNA, 61 bp, Zea mays
  Clone ID: LIB3059-057-Q1-K1-D8
cccacgcgtccgaaaaaaaaaaaaaaaaaaaaaaaaaaaaaaaaaaaaaaacaaaaagggg

SEQ ID NO: 33910 - DNA, 294 bp, Zea mays
  Clone ID: LIB3059-057-Q1-K1-E5
ggaatcccgggtcgacccacgcgtacgaaaaatcatggttaattaaagttttattgtagaaaaaaaaaaaaaataaaatagaagggaaaacaaaaaaaaaataaaaaaaaaaaataaaaaaaataaaaaaaaagaaaaaaaaaaaaaaaaaaaaaaaataaaaataaaaaaaaaaagagaaaaaaagtaaaaaaaaaaaaagaagaaataaaaaagggggatcattcttaaagatgcaaagtttattaacattatatataatggataaattttataaaaagggccgcaaaaatt

SEQ ID NO: 33911 - DNA, 399 bp, Zea mays
  unsure at all n locations
  Clone ID: LIB3059-057-Q1-K1-F1
ggaattcccgggtcgacnacgcgtccggccaggtcgcagcagtagccatgtttttgctcctcctggccttgggtgctgaggccgacctctgcgtcacgcgtagcaggaccttcaaagggtggtgccaccagagcgagaactgcatcaccgtctgcaagagcgagggcaataccggcgggttctgcaagctcggggcttgcatgtgcaccaaagagtgtgtccgaagtactgacgctgctggtgctaataaagccccacagcagcatttgagttgatgagtagtaaagaagaacgcttttgttatgccagcgcaagctctagaattcgaggccgagatgaccaaaaataaatgattttgttactctattatatgagcgaatatcgggtgtggttgttctc

SEQ ID NO: 33912 - DNA, 349 bp, Zea mays
  unsure at all n locations
  Clone ID: LIB3059-057-Q1-K1-F3
cggattcccgggtcgacccacgcgtacgcaanaagcagcacaagagtgaggtacaagaacaccatgagaacaacgatggcagccgggatgggttccatgctaatgctgcttgctctgtgtaggtgaggagcgaacgcgaccatatgggcgaagtgactccgtgctcatataactagatctgctctatggatacttatccatcattgaccagattgagtgtagtgaaaactcgatagctatgaacactacaggctttgaacacggtatactgcctacgcaactgacctttataagccctgtactttcgacactcgtgagaccgatgtctgtagcactcattggttcatac

SEQ ID NO: 33913 - DNA, 332 bp, Zea mays
  Clone ID: LIB3059-057-Q1-K1-F9
accggttcggaatacccgggtctacccacgcgtccgcgcacgcgtccgatcgatctcgctttaaatccatgcatactcgcttccggcgaacggcagcatctcaaccccatggcctagatcaagatcggaatcaatgggttcggcaggatcggaaagctgtatggacatggtggccctgcaaagtgtcgatgtatagctcattgccatgaactacgactttatcatcaccgactatatgagctacatgttcaattactagactgtgcactgacagagcaagcaccatgaaaataaacgtaaggacttcaaaacccttctattttatgagaatg

SEQ ID NO: 33914 - DNA, 340 bp, Zea mays
  Clone ID: LIB3059-057-Q1-K1-G3
cctcgtccggattcccgggtcgactcacgcgtccgcccacgcgtccgcccacgcgtccggggtgagaacgatctgcctggtttaactgacactgagaagccaaggatgaggggtcccaaaagggcctccaagatcaggaagctgttcaatcttgcaaaggatgacgacgtgcgcaagtacgtgaacacgtaccgcaggacattcactaccaagaatggcaagaaggtgagcaaggcacctaagatccagcggcttgtgacccccttgacccttcagaggaagcgtgctagaattgctgacaagaagaagaggatcgctaagaagaagtctgaggctgctg

SEQ ID NO: 33915 - DNA, 392 bp, Zea mays
  Clone ID: LIB3059-057-Q1-K1-G9
tgaagaggaagactatcacccagggacaagggagcagtagcatctgccgtcgctatgttccaccccagggtacaccagctcgtcctggaggagggcaactgtcctaccaacgacctgctctgcatataccacaggcgactccgcatactcgccaggctgcccccactggcaccccaacgagacctactggccagggtactactacagtcaccacttgcttcaagtgtggtgaggttgggcactacgccaatgcttgtccgaagaggaatcccaacacacccgctcgaagcaatgtttaaagcaagcaacagactctggctaccggccaggggtccaataatgctagagtcaaccaaattagtgctgatgctactgttgacgatgatgatatt

SEQ ID NO: 33916 - DNA, 230 bp, Zea mays
  Clone ID: LIB3059-057-Q1-K1-H3
gttaagtcccaagtcccactaggtggttaagcagaaaaatcttgtgatggcattaagactttcagactttgtttttgggtctgatgcatgtaaaaaggattcccagtgtttctgttgctcttgcgatcctgtgaggacacatatgagagaaatatttagtttgttgatggcaaatcttgtcttatgttcatgcctgtacctatctgatcaagcgttatgatatgatccaa

SEQ ID NO: 33917 - DNA, 398 bp, Zea mays
  unsure at all n locations
  Clone ID: LIB3059-057-Q1-K1-H4
ccggattcccgggtcgacnacgcgtccgggaaaaggcagccttctcaccgtcggacccggcgatgcagcggcacgtcgcctccggccggccgtcgggcacggacggctccgacttttcttaccgcatggtcgtcgaatcccggtaccagagggtcgccgagggcagatcccgcctcgcgcgcctcatcctcgtgcaggcgctgcacctagtggccggaggcttgcttctattgctgtcgttgtccaagggggcggcggtgaacaagttcgccgtgctgtccatggccgcgggattcctggctatagtggtgggggaattagggcgaatgcggaccatggcagtgctgcttcggctttacacaagctagtcatcaattgcggttgcattctctgtgacg

SEQ ID NO: 33918 - DNA, 224 bp, Zea mays
  Clone ID: LIB3059-057-Q1-K1-H9
ttttaaagggttcaagcttaactacctcatttttccaacttattagcttttttaaattgtccctaaatttaaataaattgcccgtattttaaaaacgtataacttggaaaaacctggggatccccaatttaaatccctttgaagaaattccccttttaccaagttggttaaataccaaaaagccccaaacgattggcctttccaaaaatttgccaacctaaatt

SEQ ID NO: 33919 - DNA, 450 bp, Zea mays
  Clone ID: LIB3059-058-Q1-K1-A3
acccactcgtccgacgcatccggtgccacgctcttactccgtcctagcgctacttgccctctttgtgagcgcagcaaatgtgctcattattccacaatgctcacttgctcctagtgccattattccaaagttcctcccaccagttactttaatgggcttcgaacacccagctgtgcaagcctacaggctacaacaagcgcttgcggcgagcgtcttacaacaaccaattgcccaattacaacaacaatccttggcacatctaacaatacaaaccatcgcaacgcaacagcaacaacagttcctaccagcactgagccacctagccatggtgaaccctgccgactacttgcaacaacaactgcttgcatccaacgcacttgctctggcaaacgtagttgcaaaccagcaacaacaatagctgcaacagtttctgccagcgctcagtcaact

SEQ ID NO: 33920 - DNA, 404 bp, Zea mays
  Clone ID: LIB3059-058-Q1-K1-A6
ggattcccggctcgacgccacgcgtccggcgaaccgcactatcaacgttctaaccttaatggctaccacgatattatccgtctttgggcttcttgccctttttgtgagcgcaacaaatgctttcattattacacaatgctcacttgctcctattgccattattccacacttcctccctccagttacttcaatatgcttgcaacacccagctgtgcaagcctacaggctacaacaatctcttgcagcgagcgtcattacaacaaccaattgtccaattacaacatcaatccttggcacatctaaccatacaaaccatcgcaacgcaacagcgacaacaatttctaccatcactgatccatctacctgtgctgaaccctgtcgtctacttgcacagcaattgcttg

SEQ ID NO: 33921 - DNA, 375 bp, Zea mays
  Clone ID: LIB3059-058-Q1-K1-B3
tacattcaccaagcaatctacaacatggttcaatccataatccaggaggagcaacaacggcaaccatgtgagttatgtggatctcaacaagctactcaaagtgcggtggcaatcttgacagcagcacaatacctaccatcaatgtgcggcttgtaccactcatactaccaaaataatccatgcagcagcaatgacattagtggtgtttgcaattgaagaattgtgtctacctagccgttatactcctataacggtgttaagcaataaagtaccatacattatgatgttaaaaaaagccatagacagaaaaatggctcaaagctaagcaagagatgtaccaatcaacattaaaagagactccgatacatgagtacc

SEQ ID NO: 33922 - DNA, 124 bp, Zea mays
  Clone ID: LIB3059-058-Q1-K1-B8
accggtccggaattcccgggctgggcacttaatctgcatggactaatttggtttacttagggtgatcatcatcttctcactcattttttgtttggtttgtgcaatggaatgagttgatcaatca

SEQ ID NO: 33923 - DNA, 437 bp, Zea mays
  Clone ID: LIB3059-058-Q1-K1-C1
tcgacccacgcgtgcgcccacgcgtccggaagagggagatacatgttaatttttaggtaccagatcatctgattgctcagaagcgaaatgttgtttggagctcagtgacaccatcttgtaatgcctgtgattttacgggaaatggaggatcattctgtccatcccatgtctaagtctaaccatggctccttgtcaggaaatggttatgagatgaaacattcaggccataaagtttgcgatagggattcatcatcggagtctgatcggtctcaccaagaagcatcagcagcaagtgaaagcagtccaaatgaacacacatcaactcaatcagacaatgatgaagatcatgggaaagataatcaggacacaatgaagccagtattgtccttggggaaggaaggctctgccttttggccccaaaattacattacagccca

SEQ ID NO: 33924 - DNA, 248 bp, Zea mays
  Clone ID: LIB3059-058-Q1-K1-D1
attcccgggtctacccactcgtccgaatgaggtataaatcatcgttgtggtgtaaaaaaattaaaaaaaaataaaaaaaaaaaagaaaaacggaaaaattaaaaaaaaaaataaaaaattaaaaaaaaaaataaaataaaaaaatataaagtacaaccttttttaaatttccaaacttactttcacttactttcaacataataactttcctttaatgtcccaaaatttcaattcattaccctttattt

SEQ ID NO: 33925 - DNA, 462 bp, Zea mays
  Clone ID: LIB3059-058-Q1-K1-D11
cggaattcccgggtcgacccacgcggccgctcactaccatgtttgatctcagcgagcagcatgcccacagcattgttagcaagatggggatgcgtgaagagcttcatgctagctgggaccagccaacaaagtgcatcgtattccatagtgtggaccaaactaggcttcaggggctactcttccagatggcagataagctctcggtcctggtggagatcaatgagagggcatacgaggcaagaactggtggtgctctcgagggggtaccgcccaggcgcaggggtgagggtcaggataatatgggaaagtggcaggataactttgtctcgtcacaggggcggcagggtggtggcaaccggtttggatactccggcagaggtgcaatatctggtcaaagtggtggtggacaccagagggacaggggcaatcagggttaccgcgggggctatggtggcgtttcaa

SEQ ID NO: 33926 - DNA, 123 bp, Zea mays
  Clone ID: LIB3059-058-Q1-K1-E5
cctccatccgcactactgagagcgacaaagctagctctctccagggatcggattcggagcaccatgccgtccaccgtgaactccgcgtccctcgaccagaaccttgagctcgccaagcaatgc

SEQ ID NO: 33927 - DNA, 416 bp, Zea mays
  Clone ID: LIB3059-058-Q1-K1-F9
tacctcctcggaattcccgggtcgacccactcgtcctcggactcttgggaaaaaaaaaaaaaaattaaaaaaaaaaaaaaaaaaaaaaaaaaaaaagaaaaaagaaaccaaaaaaaaaaaaaaaaggccacccatttataagatcccaacttaactaccccttcattccaaataattactttttttttagtgcacctaaattcaattccattgccctttttttaaaaccttcttacttgaaaaacccttgccttacccaaattaattccctttaaaaaaattccccttttcccaacttgctttattaccaaaaagccccgacctattcgcctttccaaaattttcccaaccttaattgccaattggaacccccctttaaccgcccatttaaccccgccgtttttgttgtttccccc

SEQ ID NO: 33928 - DNA, 412 bp, Zea mays
  unsure at all n locations
  Clone ID: LIB3059-058-Q1-K1-G2
tcgaccaacgcgtccgaaaaagacgacgaccagcttacctttactaccggcaagtgcccctgccggtcctctgggcagccagttanattgtacgactaggtatcgtcgtacgtcgtgccgcatgcatgcatgcgcagaaggccaagatggctatgcagaaagcgtagcatatatcatacatgagcaacgccaaactgtgtagatatgtgcaagttttgcagtgtgctaaatgcatgtgcgcattgaagaggcaagcagcccaatttgctactcatggccagtaatcgaacaatgataatgttgccaaaactactagcgcatgttacatcgtgtgatgcatatcactatatgagcatgtggaatcaagcatgcatcctgagatagtagctgtgctggtatatattactgcatt

SEQ ID NO: 33929 - DNA, 350 bp, Zea mays
  Clone ID: LIB3059-058-Q1-K1-G7
ggaattcccggctcgacgccacgcgtccgtgaacaattgaaatgaaacgaaaaaagttttgttccaaaaaaaaaaaaaaaaaaaaaaagaaaataaaaaaaaaaaaaaaaataaaacaaacactctaaaggttccacgctttcgtacatccaaatttacattcccttcctttctatgtcatcactcttatatattgtaacctaacttcaattcacatacccatcgttatacaaaaccctgactttcaaaaccttatccttacccaacttattccccttttagccaattcccttttcaccaactagcctaataccgatcagccttgcacccatcgcccttcctaacatttc

SEQ ID NO: 33930 - DNA, 255 bp, Zea mays
  Clone ID: LIB3059-058-Q1-K1-H7
gtgaaaataaagcatccttttactataattgatgtcgcattagttattctgaacccagggagcctgggtcagtacctactaccctgtttatcataggacgtggagagaactcgtccagttttacattcccgtcactgctttgccggagtgctgtggcaatccataaaatctaataaagtaacaataagctgtctgcaactgcaaaaaaaaaaaataaaaaaaaaaaaaaaaacaaaaagaaaaaaaataaacaaa

SEQ ID NO: 33931 - DNA, 395 bp, Zea mays
  Clone ID: LIB3059-058-Q1-K1-H9
aaggaaaagggtctgcagaaatcctcttatgcaggtggaaagaagctaagaacatatcacaatctttgtacgataaaagcggagatcctctatgatgaggtcaaacaaaacatgtttctacggaatcaagaaagcttgacacagtcgattctgtaggcattccacccaaaccccgtgcacatgctatggaaaccacccaattcagggcacaggaaaattattggttcttcacggacatggaaatggcatcataagagttctctccaatctcttcaatatccccagttatcgttacggatttcatcgtcaaacttcttcctgagttcagggtacttctcaaagtaatcatctgctgtcattgtactgatctttttcctcatttcctccatttcagc

SEQ ID NO: 33932 - DNA, 411 bp, Zea mays
  Clone ID: LIB3059-059-Q1-K1-A1
tcctgcggcgtcggcagcgtcggcagcccgttcctgggccagtgcgtcgagttcctgaggcaccagtgcagcccggcggcgacgccctacggctcgccacagtgccaggcgctgcagcagcagtgctgccaccagatcaggcaggtggagccgctgcaccggtaccaggcgacatacggtgtggtcctgcagtccttcctgcagcagcagccgcagggcgagctcgcggcgctgatggcggcccaggtagcgcagcagctgacggcgatgtgcggcctgcagctgcagcagccaggtccctgcccttgcaacgcagctgccggcggtgtctactactgaggaaactatgtactggagtaataatgtaatggagccgctggctagctacctagctcgctagtttactcattt

SEQ ID NO: 33933 - DNA, 474 bp, Zea mays
  Clone ID: LIB3059-059-Q1-K1-B1
ggccggaattcccgggtcgacctacgcgtccgattggaattgaaagatctgcatgtccattgccttttgatgaagccaaactttgtcggggcgaaaatggtcctgagctaaagcaagagattcagaagcaatttagaaacattagtgcaattatggactgtgttggatgcgagaagtgccgactgtggggaaagctccaagttcatggtcttggaactgcactgaaaattcttttctctgttgatggggacagccatatgaatcagccattgcagctgcagcgaaatgaggtcattgcattgttcaatcttctgaacaggctctcagagtctgtcaaatttgtacatgaaaaaggatcatcaattgaagaagtcattgaggaacagatcccttcaacggttcaaaagagtgtttccatgccgaatcttaaactggacttactctgagatgtatgagagtaatttgtagttatac

SEQ ID NO: 33934 - DNA, 155 bp, Zea mays
  Clone ID: LIB3059-059-Q1-K1-B11
gacccactcgtccgccgacacgtacgcccacgcctccaccctctcgtccgcccacgcatcctctagtcacaagttccttgcaaacgattgcctatccccctcccaaccaaagacctatggcacccaatgccgagaagaagcccactcccaagaaa

SEQ ID NO: 33935 - DNA, 471 bp, Zea mays
  Clone ID: LIB3059-059-Q1-K1-B3
ggcccggaattcccgggtcgacccactcgtccggttaagaagtgggtctccaagactagttgaactgaacgattttgtgcgtcaacgacacagcaaaggatttcttgatgttcttagttttagtgagacccaggtcacaccgattgttgaaggatatggcggttgggcacttcgtatggagatagtgccaattgaatctgcatacccaggctttggggagcttgtcgttctaccgtccactgatcatataaattcatgtaagccagttaacatgaacgatccttcttatgcggaaaccttggcatttttggagaagaacttcaaattatgcctggaaagagcagagtcctaggtcttgtcaatggcgccgtggagttttcagcaatctgaaggcttcattttccatttaccgtcagagacttttctcccgttaacgacgaatggtggttgatctgaccatatgatctgggc

SEQ ID NO: 33936 - DNA, 193 bp, Zea mays
  Clone ID: LIB3059-059-Q1-K1-B4
acccactcgtccgactgttaattcgttctatctgcctacctttcgcattctcttgaacccattctctatacgagtatcgatatcactgagctaaaacttatcattcgactgcattccatcatctatatataaactatcgacttcgatctcttcgccacgatccatctctaaatcagcactcactaccttacct

SEQ ID NO: 33937 - DNA, 476 bp, Zea mays
  Clone ID: LIB3059-059-Q1-K1-C1
tcctgcattcccggatcgacccactcgtccgattgagaccaactagcaacatagaaagcacaatattgtaccaataatggcagccaaaagattttggctcattatgctccttggtctttctgcaagtgctgctacggcgagcattttcccgcaatgctcacaagctcctatagcttcccttcttcccccatacctctcaccagcgatgtcttcagtatgtgaaaatccaattcttctaccctacaggatccaacaggcaatcgcagcaggcatcttacctttatcacccttgttcctccaacaatcatcagccctattacagcagttacctttggtgcatttattggcacaaaacatcaaggcacaacaactacaacaactcgtgctagcaaaccttgctgcctactctcagcaacagcagttacctttggtgcatttgctggcacaaaacatcaaggcacaacaactacaacaac

SEQ ID NO: 33938 - DNA, 429 bp, Zea mays
  Clone ID: LIB3059-059-Q1-K1-C10
ttcagaaacacaccaagcgaagctacctagcaacgacttaacaacaatggctaccaagatattagccctccttgcgcttcttgccctttttgtgagcgcaacaaatgcgttcattattccacaatgctcacttgctcctagtgccattataccacagttcctccgaccagttacttcaatgggcttcgaacacctagctgtgcaagcctacaggctacaacaagcgcttgcggcgagcgtcttacaacaaccaattaaccaattgcaacaacaatccttggcacatctaaccatacaaaccatcgcaacacaacagcaacaacagttcctaccagcactgagccaactagatgtggtgaaccctgtcgcctacttgcaacagcaggtgcttgcatccaacccacttgctctggcaaacgtagctgcata

SEQ ID NO: 33939 - DNA, 427 bp, Zea mays
  Clone ID: LIB3059-059-Q1-K1-C11
taagaactgtttggtcattcagtggtctggagataatcctaatagccttgcaggtttagctctgaatacccctggtgatcttgccattagccttggtactagtgatacagtattcgggataacaacagaagctaaaccaagccttgaaggacatgttttccccaatcctgttgagcctaatggttatatggtcatgctatgctacaaaaatggctccttgaccagagaagatgtacgaaatctctgtgcagacaaatcatgggacgtttttaacagctatctggagaaaacgccccctctaaatggtgggaagttaggattctactactaagaccatgaaatcctccctacacttccagtgggtttccatcggtacactgttgaaaacctgaacgacgtctcatcagacgctctgttggagcgtgaa

SEQ ID NO: 33940 - DNA, 323 bp, Zea mays
  Clone ID: LIB3059-059-Q1-K1-C5
aattaccgactcgacccacgcatcctagcgcgattgcggaactgcttaaacttcatttgtgaagaggcatctcactgcagagggtgagatgaaatatgaaccaaccattggtgttgaagttcatccgttggatttcaccactaactgttgtaagatcacgttctactgctgggataccgcatggcaagagaagtttggtggcctcatggatggatactatatccatggccagtgtgcgatcatcatgtttgatgtaacctcaaggcttacttacaagaatgttcctacgtggcataaggacctgtgcaatgtctgtgaaaaca

SEQ ID NO: 33941 - DNA, 436 bp, Zea mays
  Clone ID: LIB3059-059-Q1-K1-C8
ttccttctcgccgataagcagcagctcatcacctgaaggagagcagcccggaggagggggagcaagcagcagccgtcggtggaagatgtcgtacctgctgccgcatctgcactcggggtgggcggtggaccaggccatcctcgccgaggaggagcgcctcgtcatcatccgcttcggccatgactgggacgagacctgcatgcagatggatgaagtgctagcagcagtagctgagaccataaagaactttgcggtcatctaccttgttgacatcacagaggtccctgatttcaacaccatgtatgagctgtacgacccttcgacagtgatgttcttcttccggaacaagcacatcatgattgatctcgggactggaaacaacaacaagatcaactgggccctgaaggtacagcaagagttcatcgacattgtggag

SEQ ID NO: 33942 - DNA, 136 bp, Zea mays
  Clone ID: LIB3059-059-Q1-K1-C9
tcggactcttgggaaaaaaaaaaaaaaattaaaaaaaaaaaaaaaaaaaaaagggcaaagggtctaaaagaatccaagcttacatacgcgtgcatgctacatcatatctcttctatagtgccacctaaattcaatt

SEQ ID NO: 33943 - DNA, 447 bp, Zea mays
  Clone ID: LIB3059-059-Q1-K1-D1
tcaagcgaagcgcactagcaacgacctaacaccaatggctaccaagatattagccctccttgcgcttcttgcccttttagtgagcgcaacaaatgcgttcattattccacagtgctcacttgctcctagtgccagtattccacagttcctcccaccagttacttcaatgggcttcgaacatccagccgtgcaagcctacaggctacaactagcgcttgcggcgagcgccttacaacaaccaattgcccaattgcaacaacaatccttggcacatctaaccctacaaaccattgcaacgcatcaacaacaacaacagtttctgccatcactgagccacctagccgtggtgaaccctgtcacctacttgcaacagcagctgcttgcatccaacccacttgctctggcgaacgtagctgcataccagcaacaacaacagctgcaacagtt

SEQ ID NO: 33944 - DNA, 358 bp, Zea mays
  Clone ID: LIB3059-059-Q1-K1-E5
cggaatgaccggatcgacccacgcagtacgtctaatggacgcgtacgctggattgagtgcaccgtccaaactaacgctcgagcaccctggcaagtactctcaattgctcgtaacatcctccatagaacgtatcggcggccatggtcatcagactcggccagaactctatgatgacgcgctagacgaacctcatgcagaacactgtcagtccttgcgagcagcttgaactgatcatgaaggccgtcaacgtgcaatacaagaagcgcatgcacacgtattatagaccgcctacaaaggcgaaatcagctgacattcctaggctaggccatgcactgtcagagtctacgagctgttgcca

SEQ ID NO: 33945 - DNA, 324 bp, Zea mays
  Clone ID: LIB3059-059-Q1-K1-E8
tcccggtcgacccactcgtccgttaattctcacccaaattaagcaatgggttgtactgtttcagtatcaaaaggtcatagcacaatgtaaagttcttagatcaagatacatactgatggcaataacctctctatagaatcatcaaagttacacctccagatccttagtatcacatgccatatgtataccatttatgatgctagaatgtaccgatataaactatcctaccattcgcagaaaacctaattatgaacctctgtatttacattaactgatttcaatcaaatatatatctaattctatataatactcaaattgttcata

SEQ ID NO: 33946 - DNA, 429 bp, Zea mays
  Clone ID: LIB3059-059-Q1-K1-F10
tgcctgtcgagccttttgaacctagtaaatcatgctacgtctgctctgagaccccacgtgttctggaggttaatactaagacaacaaagctccgggaagtcattgaaaaagttataaaaagcaaacttggaatgaacctccctttgataatggttggtgccacgctagtttttgaggatggtgaagatttggaagaggatgaaattgcaaattatgctttaaacctcgaaaaggtcttggctgaacttccagctccagttctaaatggtacaacacttacagtcgaggattttcatcaagaactaaaatgcagtatcaacatcaaacacagggacgagtttgatgaagaaaaggagcctgacggaatggttcttgctgggtggtctggcccagttgataagcaaattaccagtaatggtgagaatagat

SEQ ID NO: 33947 - DNA, 147 bp, Zea mays
  Clone ID: LIB3059-059-Q1-K1-G12
gtcgcccacgcgttcgcccacgcgtccgcccacgcgtccgtgtcgttgggcaaggtctagttcggtgttgtgtatggaacggtcgtcactgagtcatgcacgatttggtatccgtgttgtttatgttcaccggtttgaggaactctc

SEQ ID NO: 33948 - DNA, 347 bp, Zea mays
  Clone ID: LIB3059-059-Q1-K1-H1
aattcccgggtcgacccactcgtccggggaattaatggcgtcgtcgtctagcatcagccactgacgcctcatcctcgcagccgtggtcctagtgtccgtgctcgcggctgccagcgccagcgccgggacctccttcgtgccggagtgggccatcccgcacaacccgctcccgagctgccgctggtacgtgacctgccggacctgctgcatcgagccttgcctcccgtggccggagctgatgatgagatgctgccgggagctgacggacatcccggcgtactgtctgcgcacggagctgaacatcctcatggactgctcgattacgtccggcctggactcccatctat

SEQ ID NO: 33949 - DNA, 442 bp, Zea mays
  Clone ID: LIB3059-059-Q1-K1-H10
acccacgcgtccggcgttacctcccaggtcatcatcatgaaccaccctggccagattggcaatggctatgggccagttctggactgccacacctcacacattgctgtcaagtttgctgagctcgttaccaagattgataggcgatccggcaaggagctggagaaggagcccaaatttctcaagaacggtgatgctggtatggtgaagatggttcccactaagcccatggtggtggagaccttttctcagtatcctcctcttggtcgatttgctgtccgtgacatgaggcaaacggtggctgtcggagtcatcaagagtgtggagaagaaggacccaactggagccaaggtgacgaatgctgctgccaagaagaaatgatctatctgtctggtgctgtgcttgctttgtggttacctcgtggaagctaaaaatatctcgtctt

SEQ ID NO: 33950 - DNA, 373 bp, Zea mays
  Clone ID: LIB3059-060-Q1-K1-A2
ccggatcgtcccacgcgtccggtgcttggggactgagaggtctagggtctgatatgcatgcccgatgacatcgcgctgggcggggacactcgcactggtgaggcatcggctaagatgagtttcgcctgcctggatgcttgtgctacgatgagcttgcttgataagacgtagttgcttgagtgcgcaatcatgtgcatggaaggacctacggaaactgtctgcatggacatgcccaacccgttcatacactgctgactatcacatgacacgaacgcttggagtgtgtgcttaccgcgttctgatattccatgaccctgatcacatgtctgcatcagttacatgatacatgcgctatgctactaacaaaccctac

SEQ ID NO: 33951 - DNA, 111 bp, Zea mays
  Clone ID: LIB3059-060-Q1-K1-A4
attttcaccaatactgtttttcaagttatgtgtttatactggttaacaggtgtttacgagcattcgtatctatttaaaaaaaaataaaataaaatgaataaaaaaaaaata

SEQ ID NO: 33952 - DNA, 390 bp, Zea mays
  Clone ID: LIB3059-060-Q1-K1-A5
tgctaaccctgagccggaaggatgggttgctcgacccatcactcgcgacgctgctcgcgggtgtcacttccacgatgcgctcgacaccctgctacgtcgggcatttgaccgacatacttggtctgtcgagtatcgctgtgtggtctaccagcatagtcgcggggtctacctggaccgctgggaggcgacttgcttggtgcgctgcccggaggacagtctccagggtgcagaggcctgctcagagcactattctatttctgagcgggactcagctgaggcagccatgcaagatgctgcacggcgtgcgctttcgcactactgctcggttttcggtggggcagctgatggtcttgacctgaagtataacccccgccgtccatccggcagcac

SEQ ID NO: 33953 - DNA, 370 bp, Zea mays
  Clone ID: LIB3059-060-Q1-K1-A7
aaacacttgcgccgcggctggctcacaggtaaggccgccatggtctccggttcgggcgtgtgcgcgaagcgcatcgtggtggacgcgcgccaccacatgctgggccgtctctcctcgatcatagccaaggagctgctcaatgggcagaaggtggtcgtcgtccgctgcgaggagatctgcatgtcgggcggcctcgtccgtcagaagatgaagtacctccgcttcctccgcaagcggatgaacaccaagccgtcccacgggcccatccacttccgcgcccccgccaagatcctgtggcgcaccatccgcgggatgattccgcacaagaccaaaaggggggaggcggctctggcgaggctcaagacgtacg

SEQ ID NO: 33954 - DNA, 416 bp, Zea mays
  Clone ID: LIB3059-060-Q1-K1-A8
atgcagttgcagagaaacattcaagttattggcaacgaagagcccatttctgcttggaaagaagcaaagctacagttctatggtgggcctgatggtgctgtcatgcagagaacgccattaatccattttgtacagacaggcaacattgatctcagggccaagaaagaagctcaactcggcatgcttcctgtttgaagcaagggcaacaaacttaccccaccagatctctgtcgccaaagcagggctagtgaataagctgtgtttcctcccggattgtcactgcttttatatttgtgcatttattttgagggaaacattttgcccaaaaaaggcctgcagtgcacgttttaaacaagtcatttgaaccaactcttatgctgaaaactgtatgtgatactgcagaaggcaacacacta

SEQ ID NO: 33955 - DNA, 142 bp, Zea mays
  Clone ID: LIB3059-060-Q1-K1-B11
cggacgcgtgggcgagttcgctaaggctaagtaggtcccataaggaatgtcttgaggtatatatatatatatctcgagaaggagtttatgtttatcatgaaacaagtgaaatacagtttcagcgctttcgtgttgcgcctca

SEQ ID NO: 33956 - DNA, 427 bp, Zea mays
  unsure at all n locations
  Clone ID: LIB3059-060-Q1-K1-B12
cccactcgtccgcccacgcgttcgcccacgcgtccgcccacgcgtccgtagaaagcagaatagtgtaccaacaatggtagccaaaatattttgcctccttatgctccttggtctttctgcaagtgctgctacgacgaccattttcccgcaatgctcacaagctcctatagcttctcttcttcccccatacctctcaccagcgttgtcttcagtatgtgaaaacccaattcttcaaccctacaggatccaacaggcaatcacagcaggcatcttacctttatcacccttgttcctccaacaatcatcagccctattacatcaattacctttggtgcatttattggcacanaacatcagggcacaacaactacaacaactcgtgctagcaaaccttgctgcctacgctcagcaacagcagttacctttg

SEQ ID NO: 33957 - DNA, 410 bp, Zea mays
  Clone ID: LIB3059-060-Q1-K1-C5
tggacattcatccatcatcagtcaatgcattcgtaaaccaattcccgttacctttcggggtttacagtgagaaggtgaagactgctagcatttatgtaagggactcgacaaatatatcagactatgcccttctactctttggtggttcgcttagtccgagcaaaactggagaaggcattgagatgcttgggggttatcttcatttctcggctccaaagcgtaccatagagttgattcagaaattaagaggtgaattggacaaactccttcagaaaaagattgaggaacctggactcgacatcttttcgcaaggaaagggtgttgtggcggcagctgtagaactgctacacagtcaaaatttcgaccattagatgccaaatattacatgttatcaggacaagtttcacact

SEQ ID NO: 33958 - DNA, 377 bp, Zea mays
  Clone ID: LIB3059-060-Q1-K1-C7
ttattaggacccgggggattattaattatatattgataccgtatcaatacatataaataatacaccgaatcataacaagcacgtgtacatatatatgggacggttaaattaaataaatatattggcctgcgtccccaagcacaaaataatcaactacagtaacacgaccggatcgatacggtgctttttttagctctgattgaaatgaacgaacgtatgaacgacgaacttccgccgccaatttggtttattgccttccctttgccgtgaaacccctcgtacgtagcacacgacggccgcgcgctcacaagccggtggtgaaggggatggacgtgccggcgagccagaggtcgccgtcgatgaagttgccaacggtg

SEQ ID NO: 33959 - DNA, 416 bp, Zea mays
  Clone ID: LIB3059-060-Q1-K1-C8
tggccacttccacgcaagcaggtcggttaggagggcacgaagaccgaagaccgagcggtgcggtgactcagaacgggaaccggacaggaccccaaaatctcatatccttactgatcgcacgcacgtgcccgtagacacgtcgactcttgccagacgagcaccaactccggcctctgctcctacaacgagatcggatactccacagacatgcaccatggtgctgcggatcttatgctacggataactgatctggaaccccggctaacacattaactacaaaatcctcggcttcataaagggttacattcgcacctttaatcttgcttgcattgaccacagaggcacaccgtaacatgcagcgaggacctgtacgcttgaaaccgacgactaggacatatgctggggaattgcatatt

SEQ ID NO: 33960 - DNA, 387 bp, Zea mays
  Clone ID: LIB3059-060-Q1-K1-D9
accggttcggaattcccggctcgacccactcgtccgtcgacacatacacccacccattctcttttatgtcagactaccaacacttgatgccagtgcattatccgtgattaggctcattgtcttgcatgagaatgcacctcctccgtccattatctgagacatctgacttgatcctagtcgcatccattacacattcccctcacagctgttaaaacactgaacaaagaacacccaaatatgaacggctctttgctacaacacacatctgactccagtttctatctacttcatcttatcctgattcagcatcactcctatggacatttaaccatacaaactatcttatcatacagctaacataatatactacctgactagactcatata

SEQ ID NO: 33961 - DNA, 420 bp, Zea mays
  Clone ID: LIB3059-060-Q1-K1-E5
tctcaatctccctagcaatctctagcagcagatcctcgtgcgaagcaaagcgctagcccccttcgtactgtcccgatggcccgcacgaagcagacggcgaggaagtccactggcggcaaggcgccaaggaagcagctggccaccaaggcggcgcgcaagtctgccccggcgaccggcggagtgaagaagccccaccgtttccgccccggcaccgtcgcgctccgggagatccgcaagtaccagaagagcacggagctgctgatccgcaagctgccgttccagcgcctggtgcgtgagatcgcccaggacttcaagaccgacctccgcttccagagctccgccgtcgccgcgctgcaggaggcgtccgaggcctacctcgtcgggctcttcgaggacaccaacctctgcgccattcacgcc

SEQ ID NO: 33962 - DNA, 73 bp, Zea mays
  Clone ID: LIB3059-060-Q1-K1-F12
tctagaggaggcaagcttacgcacgcgagcatgcgacgaaatcgctgttgtatcccgtcacctacattcaatt

SEQ ID NO: 33963 - DNA, 420 bp, Zea mays
  Clone ID: LIB3059-060-Q1-K1-F7
tgcttcgagtatacataacacacgcttgataacccattaactgcaacctaacatcaggggtttaccagcatattataacctgccttccctttctgaacgctcaacggaccggaccaattgcttgattattgcacaaagcttaatttgttcaaggttcaagattacacaagttcttcgaacaagtacctcaattggcttagaacacccaagtatgcaatgctatatgctacaacaagcaattgcggcgagcgtgttacaacaaccaatttcccagttgcaacaacaatccttggcacatataacactacacaccatcgcaacgcaacagcaacaacaattcctaccagcactgagccacctagccatggtgaaccctgccgcctacttgcaacagcagttgcttgcatcaaacccacttgc

SEQ ID NO: 33964 - DNA, 371 bp, Zea mays
  Clone ID: LIB3059-060-Q1-K1-G11
tgctgaagctatatcaccggatgatgaagaatctctgttgcaaggagaacgcgaaggtgaaatgatgattgtggaggcctatgcagctcttgtgctcgcctttctttcaacggaaaggttcatagtgccttatttcataatcttttcttaattagttataattttaatgtgagccccaccccactgccgtcagcttatgaactgatgtttgctgccacagtatgaaggttcgaggagccatttctagttgccttccggacaacaacttgaaagttcttgtaccagtgctagagaaatctgtgtcatttcatctgcagctgaacatgatgacaagggaaacgcattcagctgtgactgaagtcatcgaaaga

SEQ ID NO: 33965 - DNA, 418 bp, Zea mays
  Clone ID: LIB3059-060-Q1-K1-G12
aattcccgggtcgacccactcgtccggacgttcgaatgggctaagatgcttgtgatgaaatacgggtcacttgtgtctgtggtctattttgttggactgtctatctaccttgtcgcgagcccgtccaagagcagctcaaaggcaagcaagaagagacgctgatctacttataggtcgcagttgacggtgtaactggtggttttgcctggaggaactcttggtagtttgagctgtgcgaaagcttttaagtatacatttactcaccactccatgaacggcaacgaagtattcatcagttagaaaagtgcacctataatttaggttgcttataactctctatttgtcagacatttaactcgaaggacctgttactaggaaagctaattttgcttggaagaacattctgataaataacagt

SEQ ID NO: 33966 - DNA, 441 bp, Zea mays
  unsure at all n locations
  Clone ID: LIB3059-060-Q1-K1-G3
cggattcccggtcgaccacgcgtncggtcggttaggtaattgggtccgacgacctaggacgacatggcggcggccaccaccaggaggggcagcaagaagtcgtcgtcggcgtcgtcctcgagctcggcgcagcgggcagcagctgccgccctgctcgtggcggtgttcgtcctggtggtgggcgcggcggcagtgtgcgacatgagcaacgagcagttcatgtcgtgccagcccgcggcggccaagacgacggacccgccggccgcgccgtcgcaggcgtgctgcgacgcgctggcagtggcggacctcaagtgcctgtgcggctacaagaactcgccgtggatgggcgtctacaacatcgaccacaagcgcgccatggagctgccggccaagtgcggcctcgccacgccgnccgactgctagccaagccaagcaggaagg

SEQ ID NO: 33967 - DNA, 282 bp, Zea mays
  Clone ID: LIB3059-060-Q1-K1-H11
accggtttcggattcccgggtcgacccactcgtccgtgcactcgtacgcagactcgtggactaaaattgaaccaagtcaaaaaaaaaaaaaagaaaaataaaaaaaaaaaaaaaaaaaaaaaaaaaaaaaaaaaaataaaaaaaaaaaaaaaaaaaaaaaataataacaaataaaaaaaaaaaaaaaataattaagaaaaatctgaatacaaaatacaaaaaaaatacacatcagattaagatctgatggatcatatagacactatgaatgacgaagaaacc

SEQ ID NO: 33968 - DNA, 421 bp, Zea mays
  Clone ID: LIB3059-060-Q1-K1-H3
cacgcgtccgcccacgcgtccgctctcttctatcactgtattttagataccatggccaagtcgaccgggagggttgtattctacctggccctgctggtggtgattgccaccactgagcacatgcggttgcaggccggtagcggcgtgcgatcccatgcccgtggtggtgtgcgatacggcgttcatgtacggagcgaaaccctccgtatgatgctgctccaccctgcgtgcgcaggaggcatgcttgtgcgtgtacgccaaagaccccaagtttgcaaaatacatcaacaaccccagcaccggcaaaacctttaccttgcgcggcatatccatacccaaatgctaagcaagcgctctgcgtcgtcgattcgattgctcttgctcttgtgggtaacatatccagcttatgaatatattatgt

SEQ ID NO: 33969 - DNA, 317 bp, Zea mays
  Clone ID: LIB3059-061-P1-K6-A1
attggaaggaaccaaggaatctaaacaagatggagatttatcactgccggacaggtctgtcaacagtacagctgtctcaagtagcaatgctgatggtggtgattcgaacatcaacatttccaaaaggttttcagaagttgaggagaacggacttgaagacaacatcgtcgcgctaaacccattcaatttggagccagttgatgctcctcctagtggtttgttgccatcttcatcattcctattcatttggatatcattaaatggttgctagccactcggtacatgatattgttttactaagtttccatcatgccttt

SEQ ID NO: 33970 - DNA, 158 bp, Zea mays
  unsure at all n locations
  Clone ID: LIB3059-061-P1-K6-A10
cgtccgattttgatttgtataggtctttagaagatatggggagtaaaccaatatttnnagtatatttatttatttgttaattaattggtaacagagctgcacatttgattactgaggtgctgaatggactattcctccataatttgttttttttgtgg

SEQ ID NO: 33971 - DNA, 324 bp, Zea mays
  Clone ID: LIB3059-061-P1-K6-A2
ccgggtcgaccttgcgtccggaagaattgttcagcttccacccttcaagcccttgaccaaagctcagcttgcaaggctcacaaaggagcagaagaatgcttattttgatgagtatgactacagggttaagcttcttcagaagaaacaatggaaggatgagatccccaagttaaaggagatgaaaaaaaagggggaaactggtctggatgattatgggtatgctaatatcactggtggggacgatcaggatcctccttcagaaaatgtgttagttcccttacctgacatggtactgcctccttcatttgattgtgacaattccac

SEQ ID NO: 33972 - DNA, 435 bp, Zea mays
  unsure at all n locations
  Clone ID: LIB3059-061-P1-K6-A3
gcatcattgatcgccgagcgtgcgtgctctagctctagcaatagcagcgaggagacggtcgaggatggatcagaacaacagcaacaggcagcagcagcaggcgccgccgccaccacccgcgggctacccgacggcaggcgcggagcagcagggaggcagcggcaggaagcagggacgccgggggaagacgacctcgcgcggggagaagggcttcatcgaaggatgcatcgcggcgctctgctgctgctggatctgcgagatgtgctgcgactaggcagcccccccttncctccgccgccaggctttgagcctttgacaggaacggagagatctgctccacccatagctgcagttgtggctgcacgtacttgttgagctgttgtgttgtgtccatctcggtactttttgatttgttattaagagaagctgtgatga

SEQ ID NO: 33973 - DNA, 286 bp, Zea mays
  unsure at all n locations
  Clone ID: LIB3059-061-P1-K6-A4
tattgctgtcaagaacctcgcgaacggcgactgctcttatgctgagtgctgtcatgttgttgcgccacatgcaattcaacgacaaagcagaccggatccacaacgccatcctccagaccatcgccgaggggaagtacaggactgctgatcttggtggaaaggcatcgacatcagagtttacggacgcagtctgtgatcacatctgagaaacggatgtgattcttccttctgattggtttggcatcctaatatttttttngcacatatgagaggagctttagcttta

SEQ ID NO: 33974 - DNA, 402 bp, Zea mays
  unsure at all n locations
  Clone ID: LIB3059-061-P1-K6-A6
caacaatttcttccattcaaccaactgtgtacactgaaccctgctgcttatttgcagcaacaactattaccattcagccagctagctactgcctactctcagcaacaacaacttcttccatttaaccaattggccgcactgaaccccgctgcttatttgcagcagcaaatactactaggatgtagccagctagctgcagcaaaccgtgcttccttcttgacacagcaacagttgctgcctttctaccagcagtttgcggctaaccccgcaaccctcttacaactacaacaattgttgccctttgtccaacttgctttgacagacccagcggnctcctaccaacaacacatcatttggtggtgccctcttttagattgcttattagttggaattcaaaaataa

SEQ ID NO: 33975 - DNA, 180 bp, Zea mays
  Clone ID: LIB3059-061-P1-K6-A7
ccagcgtccgggcaaaatggattcaacaaggctgaggagcgggtggttttacccgtgcatggatatactctacgaatgctatgaagatgtggcctctggaagtgaaatccggagcgtggtgttggctgggcggaggttttatgagaaagagggcctcccagcttttccgatgggcaacat

SEQ ID NO: 33976 - DNA, 548 bp, Zea mays
  Clone ID: LIB3059-061-P1-K6-B1
ccgggtcgacctacgcgtccgatttgcgcttagaagggatgagaagaagaagagggttgaaaagcaagaaaaaaacagactggataacttaaagaaagctgcaaaggttggcgctttgccaagtcatatacagcttgctgcgaaggcgttgcccatcacaggaacaaaagctgaccttccaaaaaaatctagaaaagaggatcttgagagtgttgtcggcatggcttcatcagcaacagcaagtggtgggaagtttgatgagaagttgcctggcgagaaacctccaaagcaccctggcaaacacagaaagttcctcccagttgccgaagggaagggaatgggcagcctggagaaacagcagaatgacaaaatcctgaactctctacttgccagaaactctgatgaaccacttgatgtcggcaaggcaattacaatgtacaaggtgaaaaaggagaagcagagaaggaaagaaaaaggcatgtcatcgaaatctgataagcttaagccccaaaagaaaccccacaagaagtaatcgaagaaaaaggctt

SEQ ID NO: 33977 - DNA, 263 bp, Zea mays
  unsure at all n locations
  Clone ID: LIB3059-061-P1-K6-B10
cccggttcgacctagcgtccgnatntgttttactaagacctactgtcgtttcgtgtgtgataaaaaggcatcntcctncactgcttaaacgactcggccgactacggctttcnattctgtcttcatggttttgttctgcgctctacattcttcgcacaccctcgcatgcttcattcantctgccttttgttaatctggttgttggtcttctcnaanatnctncncatcncaaaaccannaatnaccttccttctcataccatt

SEQ ID NO: 33978 - DNA, 392 bp, Zea mays
  unsure at all n locations
  Clone ID: LIB3059-061-P1-K6-B11
cccgggttcgacctangcctccgattgattttaacaagcaacatttaaagttaagtccagtaacaacaatanancaacaatggcgaccaagatattttccctccttatgctccttgctctttctacatgtgttgctaacgcgacaattttccctcaatgctcacaagctcctatagcttcccttcttccttcatacctgggtgtgtgatanctncaatatntnaaaacccaactcttcaaccatatanncttcaacaancaatcncancaaccaacatacctttatcncccttnttntttcaacaatccccanccctatctttnntccantcattnntacaaaccatcannncacaacanctncancaactcnncctacctntnatcaacca

SEQ ID NO: 33979 - DNA, 334 bp, Zea mays
  unsure at all n locations
  Clone ID: LIB3059-061-P1-K6-B12
ccgcccacttttccgnnaaaaaattaccaaaaaaaaaaaaaaaaaaaaaaaaaaaaaaaaaaaaaaaaaacgaacaaaaaaaaaaaaaaccaaacaaacaaacccaaaacanaccacggcacaccccaaacaaaccaaaccccccaaacccanccacccgcccgncaaannacttttttnnaaactaaatgttctcagnccantncccttcctaatccccaaaaaaaccccttccccttcccccagtttgcccaataaaaaanacgccccccccaatcccccttcccaaccgttggaacaacccaaaagccccatgccccccccctttaccaac

SEQ ID NO: 33980 - DNA, 554 bp, Zea mays
  Clone ID: LIB3059-061-P1-K6-B2
ccgggtcgacttcgcgtccggctcctttttctttctgcaagtgctgctacggcgaccattttcccgcaatgctcgcaagctcctatagcttcccttcttcccccgtacctctcaccagcggtgtcttcggtatgtgaaaacccaattcttcaaccctacaggatccaacaggcaatcgcagctggcatcttacctttatcacccttgttcctccaacaatcatcagccctattacaacagttacctttggtgcatttattggcacaaaacatcagggcacaacaactacaacaacttgtgctagcaaaccttgctgcctactctcagcaacagcagtttcttccattcaaccaactaggttcattgaactctgcttcttatttgcaacaacaacaactaccattcagccagctacctgctgcctacccccagcaatttcttccattcaaccaactagcagcattgaactctcctgcttatttacagcagcaacaactactaccattcagccagctagctgggggtgagccctgctaccttcttgacacaaccac

SEQ ID NO: 33981 - DNA, 434 bp, Zea mays
  Clone ID: LIB3059-061-P1-K6-B3
cccgggatcgacccgaaggcgatggacctgcagggtgcgggcggggacgtggaggtgccggcagggctggggctgacggcggcggagtacgagcagcgtgccgttcgacggttggacgcgcaccaccgatacgccgtgggggagggccaatgctgctcgctgctggcgcagcgcattcacgcgccgacggccgacgactgggcgagtcgccggcgatgagactggccgcatgtgtacaagcacttcatgcgcagctgcgcggtccggacggacccggacacatgggacgcccttcgccccagccgcctccgtgaggtgtgcgttatctagagcctgcccgacagaaccagcacctatcgcctgaaccaccttgactacccctccagggagatgaggtgctacataacggggggctagcacaacatcaggaacta

SEQ ID NO: 33982 - DNA, 459 bp, Zea mays
  Clone ID: LIB3059-061-P1-K6-B4
gtcctgattaccaccccattccacccagcttatgtcactgcagagaggataaagaaggcgaagaatcttgagcttcttctcacggcaggaatcggctccgatcatattgatcttccagcagctgctgctgcgggcttaactgtggctgaggtcactggaagcaacactgtctctgtggcagaagatgagctcttgcgcattctgattctgctcaggaacttcttgcctgggtaccaacaggtagttcaaggcgaatggaacgtagcaggcattgcccacagagcttatgatcttgaaggaaaaactgttgggactgttggggctggtcgtattggcaggctcttgcttcagcgtcttaagccctttaactgcaacctgctttaccatgacagacttcagattgacccagagcttgagaaagaattggggcccaatttgaggaggacctggatgctatgc

SEQ ID NO: 33983 - DNA, 568 bp, Zea mays
  Clone ID: LIB3059-061-P1-K6-B5
tcccgggtagaaagcacaatagtgtaccaacaatggcagccaaaatatggtgcctgcttatgctccttggtctttctgcaagtgctgctaccgcgaccattttcccgcaatgctcacaagctcctatagcttcccttcttcccccgtacctctcaccagcggtgtcttcggtatgtgaaaacccaattcttcaaccctataggatccaacaggcaatcgcagctggcatcttacctttatcacccttgttcctccaacaatcatcagccctattacagcagttacctttggtgcatttattggcacaaaacatcagggcacaacaactacaacaacttgtgctagcaaaccttgctgcctactctcagcaacagcagtttcttccattcaaccaactagctgcattgaactctgctgcttatttgcaacaacaactaccattcagccagctagctgctgcctaccccaaccatttcttccattcaaccaactggcatcattgaactcttctgcttatttacagcagcaacaactactaccattcagccagctagctggtgtgagccct

SEQ ID NO: 33984 - DNA, 285 bp, Zea mays
  unsure at all n locations
  Clone ID: LIB3059-061-P1-K6-B7
cccgaatgttttgagttgcttggtgggtatgggcttatggctgtacctggagagcatagataccccggttgctcatgtacatataataataacataatttggcaacgagtgtgagtcgtttggagattgtgtgcgcacttgtatctgagtatggatctgatggtggtacttgcatagtggggatgtgcatactgtttcgacgccatgtgtgtgtatggggcacctgataaaaaaattactgttgattcccaaaaaaaaaaaaaaaaanaaaaaaaaaaanaaaaa

SEQ ID NO: 33985 - DNA, 497 bp, Zea mays
  unsure at all n locations
  Clone ID: LIB3059-061-P1-K6-B8
cccgggtcgacctacgcgtccgcccacgcttccgcccacgcgtccgaggaggagcgcgccaacatccnncnttcgttcccaagggcgctagggtttaaccccccaactgttcggtctctctctctccccgaatccaattcagcgtcatctagtccgggagcctgcgacatggggtacctccaggatgcccgggagagggtgggaanaanaangtctangaagctttgcggagcaaaatgaaacaaaaggctcttcaggaatgtgatttctattgttcaaaatatgctgagtgtgcacggggaagaacattttctgtggtatggcaatgccgcaaacaagcaaaagaattgaatgagtgccttcatcaatacacaaatgatgcaatcctggaagaaatgaagaaggcttatatgattgagcaaaagaacaaggagataaatcaataagcaaaaatccaatgcgcaatgtgcatcacaatcaccctgctttgatgtata

SEQ ID NO: 33986 - DNA, 516 bp, Zea mays
  Clone ID: LIB3059-061-P1-K6-B9
ccaacattggcagccaaaatattttgggtcctgatgctccttggtctttctgcaagtgctgctacggcgaccattttcccgcaatgctcgcaagctcctatagcttcccttcttcccccgtacctctcaccagcggtgtcttcggtatgtgaaaacccaattcttcaaccctacagggggggcaggcaatcgcagctggcatcttacctttatcacccttgttcctccaacaatcatcagccctattacaacagttacctttggtgcatttattggcacaaaacatcagggcacaacaactacaacaacttgtgctagcaaaccttgctgcctactctcagcaacagcagtttcttccattcaaccaactaggttcattgaactctgcttcttatttgcaacaacaacaactaccattcagccagctacctgctgcctacccccagcaattttttccattcaaccaactagcagcattgaactctcctgcttatttaccgcagcaacaactactac

SEQ ID NO: 33987 - DNA, 218 bp, Zea mays
  Clone ID: LIB3059-061-P1-K6-C1
ctcgatcgatctcctctggatctggcagaggatggtaggacacactattgcctcctgctctagatcctcacgtcaccatcgccgtctcagctcaactgtacgactccgtatatattataaccatcggttgtcatcaaaaaaaaaaaaaagaaaacagagaagaacgaaacgagcggacgcgtgggaaagaccagaaaaaaaaagaaccaagaggggcg

SEQ ID NO: 33988 - DNA, 224 bp, Zea mays
  Clone ID: LIB3059-061-P1-K6-C10
aaagctataggaacgtcttacatcgggcaggggatcaggaaataatcctcttgtcagtctaaagttttgtcctggttttctgctcactggatttattggccctgcagcttatatggtcttagttcccttcggacgccttatgatccataaaacatgccaattatattatattgggggggggggctttttactgatcgcatgatcgtcgtatatatttgcttgtt

SEQ ID NO: 33989 - DNA, 191 bp, Zea mays
  Clone ID: LIB3059-061-P1-K6-C11
cggattcccgggtcgaccccgcgtccgcgcaatttcaccaagaaatccatctggatgccggcgacaggggaattaatggcgtcgtcgtctagcagcagccaccgccgcctcatcctcgcagccgccctcctgctctccgtgctcgcggctgccagcgccagccccgggacctcctgcgtgcccgggtgggc

SEQ ID NO: 33990 - DNA, 535 bp, Zea mays
  unsure at all n locations
  Clone ID: LIB3059-061-P1-K6-C12
gattttatccgccgccgctgctcaggggacagcgctcgagaagacgcctgctcctcgccgatcgatacgatggccgtcttctccgacctccacaccgccgacggcctcaagtccctcgaggctcacctcgccggcaaaacctatgtgtctggtgactccattactaaggatgacagggggggttcnccncggtgccntcnaancctggcgctgagtttcctaatgccgcccgctggtacgagaccgtctctgcggctgtagcctcaagattccctggtaaggctgttggtgtaaatctgcctgcgggatcagctcctgcggcagctgctcctgcggatgaggctgaggatgatgatgaccttgatctttttggtgatgaaactgaggaggacaagaaggcagctgatgagcgtgccgcccctgccaaggcctcttctaaaaagaaagaaagtggtaaatcctccttccttatggatgtcaaaccatgggacgatgagactgatatgaagaagctggaggaggctgtccgcagtgt

SEQ ID NO: 33991 - DNA, 94 bp, Zea mays
  unsure at all n locations
  Clone ID: LIB3059-061-P1-K6-C2
attttaataagtacaggctgatttctggacgtaaaaaaaaaaaaaaaaaaaaaaanaaaaaaaaaaaaaaaanaaaaanaaanaaaaanaaaaa

SEQ ID NO: 33992 - DNA, 563 bp, Zea mays
  Clone ID: LIB3059-061-P1-K6-C3
cggacgcgtgggtttcagcattcagaaacacaccaagcgaagcgcactagcaacgacctaacaacaatggctaccaagatattagccctccttgcgcttcttgcccttttagtgagcgcaacaaatgcgttcattattccacagtgctcacttgctcctagtgccattattccacagttcctcccaccagttacttcaatgggcttcgaacatccagccgtgcaagcctataggctacaactagtgcttgcggcgagcgccttacaacaaccaattgcccaattgcaacaacaatccttggcacatctaaccctacaaaccatcgcaacgcaacaacaacaacattttctgccatcactgagccacctagcagtggtgaaccctgtcgcctacttgcaacagcagctgcttgcatccaacccacttgctctggcgaacgtagctacataccagcaacaacaacagctgcaacagtttatgccagcgctcagtcaactagccatggtgaaccctgccgtctacctaccactgctttcatctagcccgctcgctgtgggcaatgc

SEQ ID NO: 33993 - DNA, 267 bp, Zea mays
  Clone ID: LIB3059-061-P1-K6-C4
cccacgcgtccggcggcgcagatagcgcagcaactgacggcgatgtgcggcctgcagcagccgactccatgcccctacgctgctgccggcggtgtcccccactgaagaaactatgtgctgtagtatagccgctggctagctagctagttgagtcatttagcggcgatgattgagtaataatgtgtcacgcatcaccatgggtggcagtgtcagtgtgagcaatgacctgaatgaacaattgaaatgaaaagaaaaaagtattgttcc

SEQ ID NO: 33994 - DNA, 580 bp, Zea mays
  Clone ID: LIB3059-061-P1-K6-C6
tttcaagacagaacacagagactcttgggctccggaatatgtttgcctgatgtcttcggtaggcaacccaaaactacttaaaatacaacagaacagacccaggaccagggcggacacaataacaaagtcggtttccagttgttctcaatattcgtgcccacaaagcagcaaataagatcctgcaaagtagaaccacaagttcatcctacacacaaaacagaatcctggtcgaaaagaattctagcgtagaacactagggctaagatagtaaacttcatgcttctgaacgcccccagaagagaacgcctttccacctgtgtaaatagattagtagaagagaacgccagagcctcattcctccttcgctgccgctgcatggtacttgtcgagttcggcgtcaaggtctgaagcagaaatgggtgtgcggttccggtcctgcactcggcctctcccctgtccgcggccaccgctggtttgactactgcgtccaccccgaccgttgacttgaggtgctcttcgctgaccatttctttgggattgaagcacactgctgtggatatcgttatagttctgcaaagga

SEQ ID NO: 33995 - DNA, 526 bp, Zea mays
  Clone ID: LIB3059-061-P1-K6-C7
cggacgcgtgggcggacgcgtgggaaagaaaactgtgatctcatcattgtggacacaagtggaaggcacaaacaagaagcagcactctttgaagaaatgcggcaagtttcggaagcaacaaaaccagacctggtgatttttgtgatggacagtagtattggtcaggctgcatttgatcaagcacaggcatttaaacaaagtgtttctgttggtgctgtgattattacaaaaatggatggtcacgcaaaaggcggtggtgcccttagcgcggtcgcagcaacaaaaagtcctgttatattcattggaactggcgagcacattgacgagtttgaagtttttgatgtgaagccatttgttagtcgcctgttaggaatgggagattgggcaggctttatggacaagattcatgaagtcgtacctacggatcaacaacctgagcttctgcagaaactgtctgaaggaagctttactctcaggcttatgtatgagcagttccaaaacattctgaaaatgggtcctattggac

SEQ ID NO: 33996 - DNA, 414 bp, Zea mays
  Clone ID: LIB3059-061-P1-K6-C8
gtcgggtattcacagtagagtctcttaggggtggatcatgagtatgcaaaccttatatatgctgatggatggagtgacatgggattggaatgggctataggcatggcgtaccgattattacagaagaacactctaccatgcctgaaaatgattggcctgtcgagatgtggcttgttacattggtgcaaaagcaccagaggggtgcagttggagtttacttgggattactgaaaaaggaatcatcacctgctgtgctatgttcataggccttggtactcactatgtaccttctgcaaatttgggttcactcaaagagtccctgctgagtgctaacttcaccaatgatcctcatagagacgttgagtcagttctgacaggatacaagaaagaacccgagtctgaaccacaactaaa

SEQ ID NO: 33997 - DNA, 601 bp, Zea mays
  unsure at all n locations
  Clone ID: LIB3059-061-P1-K6-C9
cccacgcgtccggagaccaacaagcaggatagagagtggaatccagtagcaacaatagagcaacaatggagaccaagatattttccctccttatgctccttgctctttctacatgtgttgctaacgcgacaattttccctcaatgctcacaagctcctatagcttccctttttccccgagaccttccatcaattatagcttcagtatgtgaaaacccagctcttcaaccatataggcttcaacaagcaatcgcagcaagcaacatacctttatcgcccttgttgtgtcaacaatcgccagccctatctttggtgcagtcattggtacaaaccatcagggcacaacagctgcagcaactcgtgctacctgtgatcaaccaagtagctctggcaaacctttctccctactctccgcaacaacaatttcttccattcaaccaactgtctacactgaaccctgctgcttatttgcagcaacaactattaccatttagccagctagctactgcctactctcaacaacaacaacttcttncatttaaccaattggccgcactgaaccccgctgcttatttgcagcagcaaatactactaccatttag

SEQ ID NO: 33998 - DNA, 487 bp, Zea mays
  Clone ID: LIB3059-061-P1-K6-D1
cccacgctttcgggggatgcgatacggaacgccctgcgcctgcgcgtccaccggtggactcgtcgacaccatcatcgaaggcaagaccgggttccacatgggccgcctcagcgtcgactgcaacgtcgtggagccggcggacgtcaagaaggtggccaccaccttgcagcgcgccatcaaggtggtcggcacgccggcgtacgaggagatggtgaggaactgcatgatccaggatctctcctggaagggccctgccaagaactgggagaacgtgctgctcagcctcggggtcgccggcggcgagccaggggttgaaggcgaggagatcgcgccgctcgccaaggagaacgtggccgcgccctgaagagttcggcctgcagggcccctgatctcgcgcgtggtgcaaagatgttgggacatcttcttatatatgctggttcgtttatgtgatatggacaagtatgtgtagatgcttgcttgggctagt

SEQ ID NO: 33999 - DNA, 449 bp, Zea mays
  unsure at all n locations
  Clone ID: LIB3059-061-P1-K6-D10
ccggttcgacctacgcgtccgcgattattttgttcgctctcncggaagcgtgggggtggtcaacacccncaaaggcccagacgcccaaaaccggaaggggcgccatggccgcgtcggatctggagagcaaggccaaggaggccttcgtcgacgacgacttcgagctggccaccgagctctacagcctttccatcggggggtggggggccaccncctacctctattccaaccacacccanncncacatcaagctcnncaactacactgaggctgtggcggatgctaacaaagcaattgagcttgatcctatgatgcataaagcttactaccggaaaggggctgcatgcattaagcttgaagaataccaaactgcaaaggctgctcttgagttgggttcttcttatgcatcaggcgattcaaggtttgctcgtctattgaaagaatgtgat

SEQ ID NO: 34000 - DNA, 384 bp, Zea mays
  unsure at all n locations
  Clone ID: LIB3059-061-P1-K6-D12
ccccttcgactcacgcgtccggcggattgggctttccccttcggaaacgagagtgcaaaaagcaacancacancnccacccctcctntcccnccnagttcnnnaccccacncaaggcggngggaggagcaagaagccgccggcctccctcctccggctcaccaccaggcttactccncacctttcttccacgggtatgatcggcntcaaattctttattcccaaacaaattcancccnnannttcanccaaanctattttctaanaaaaatnncnncaatnattttnncnatnacttcnannancaanaacancatattacccctnnanaanaancannncttttctattcanctaccananctcccnttcccttnnnattcac

SEQ ID NO: 34001 - DNA, 565 bp, Zea mays
  Clone ID: LIB3059-061-P1-K6-D3
cccggtgtcgacctcacgcgtccgatcgagtggccgtcgacaggggaattaatggcgtcgtcgtctagcagcagccaccgccgcctcatcctcgcagccgccgtcctgctctccgtgctcgcggctgccagcgccagcgccgggacctcctgcgtgccggggtgggccatcccgcacaacccgctcccgagctgccgctggtacgtgaccagccggacctgcggcatcgggccgcgcctcccgtggccggagctgaagaggagatgctgccgggagctggcggacatcccggcgtactgccggtgcacggcgctgagcatcctcatggacggcgcgatcccgccgggcccggacgcgcagctggagggccgcctagaggacctgccgggctgcccgcgggaggtgcagaggggattcgccgccaccctcgtcacggaggccgagtgcaacctggccaccatcagcggcgtcgccgaatgcccctggattttcggcggcggaacgatgccctccaagtaactgggaagagcatagtgcatgaggaatgagcttgtagctagctcat

SEQ ID NO: 34002 - DNA, 455 bp, Zea mays
  Clone ID: LIB3059-061-P1-K6-D4
cccgggtcgacctacgcgtccgccctggattacgttggtcttgctccgcagggcagtgagagggtctctaatttcctggagaaggctgcagaagggctggtagagggcggaaagaaggagatcttcacgccaatgtacttctttcttgttcggaagcctcttctggaatgagctcttggatcaccttttcagagagagaaggcgagtggtcatttcgaagaagccgaggagagggaacctggaatcaagaaaaccttcagctctcctgtgtaggaggaaagttaacgaacagtgtagtaactgttcagctttgtgtttattcagttgttttgctgcttgaggttattcgtttctaggtgggggttggaatccttttcgccataaacctctcagtggcataaataagatgggtttgcataagagtacttcatggatacccgaagggctactactga

SEQ ID NO: 34003 - DNA, 577 bp, Zea mays
  unsure at all n locations
  Clone ID: LIB3059-061-P1-K6-D6
ccggttcgactcagcgtccgcccacgtttccgccgcgagaggctgccgtgtagggaccgtagactcagcgactgcgaaggagggataaggggatggccgggatcggaccgatcaggcaggactgggagccggtcgttgtgcggaagaaggcacccaccgccgccgccaagaaggatgagaaggccgtcaacgccgcgcgccgcgccggtgcggagatcgataccatgaagaagtacaacgctggtacgaacaaggcggcatccagcggtacatccctcaacaccaagcgcctcgacgacgacaccgaaaacctcgcccatgagcgagttccaagtgatctgaagaagaatctcatgcaagcaaggctcgataagaagctgacacaggcacaacttgctcagatgataaatgagaagccacaggtgattcaggagtatgaatcangcaaggcaatccccaaccagcagatcattagcaagctcgagagggccctgggaaccaagttgcgtggcaagaaatagctttcctacgagtttgtgttccggagcatcataatagggggaagacaaggcaagct

SEQ ID NO: 34004 - DNA, 313 bp, Zea mays
  unsure at all n locations
  Clone ID: LIB3059-061-P1-K6-D7
cgtccgccccgctttcgcccacncntccgcagacgcgtgggacacaatacacacttnatgagtttcatggtgtttgcaggaaagggatttgtcagggaggacttggaatgcagtcattacatgaagaactttgatgtcggacatgtgcctttaaggttagcaaaggccatttctctgctgggggtgtgtggaccacaactttcttaactctctcctttataccancnntacttnnaccnccttnntnaaaccaantacctcatttctcttaanaatctntntnacaatnncatcnttcaaccntaccctcccc

SEQ ID NO: 34005 - DNA, 479 bp, Zea mays
  unsure at all n locations
  Clone ID: LIB3059-061-P1-K6-D9
cccggttcgactcagcgtccgcccacgcttccgcggacgcgtgggttgccagcggtgagcactacanttgatcnagacactacttgcaattgatccagcagatcgcttaacagcgtcttctgcattaagaagtgatttctttacaaccgaaccttttgcatgcgaaccatcaagtcttccaaaatatcctccaagcaaggagagtagatgtgaaacgaagagacgaagaagccagacgtttaagagctgttggtggtagagctaatggtgatggagccaagaagacgagaacacgtgatcgacctaaggcagttccagctccagaggcaaatgctgaacttcaagtaaatattaataaaagaaggtttattactcatgcaaatgctaagagcaagagcgaaaagttccctcccccacatcaagatggtgcggttggtgtccccttggatgccttaaatcatatggatccactttaccaa

SEQ ID NO: 34006 - DNA, 326 bp, Zea mays
  Clone ID: LIB3059-061-P1-K6-E1
cccgggtcgaccctcgcgtccggggcgacttcttcgtcttccccaaggccatgatccacttccagatgaacctcgaccacgacaagcccgccgcggcgctctcgtcgctcagcagccagaaccctggcgtcatcaccatcgccagcgccgtcttcggctccaagccgcccatctcggacgacgtcttggccaaggcgttccaggtggagaagaaactcatcgactggctccagtctcagttctgggataccaactactagctgcctagctagctaggaatatacttgcttgcttattttgtgcatgcatgcaccacccacacaagc

SEQ ID NO: 34007 - DNA, 432 bp, Zea mays
  unsure at all n locations
  Clone ID: LIB3059-061-P1-K6-E2
ccgggtcgacctagcgtccggnatctttcctgcacaatgacccttaccacagcgacaaggccccggatatcctggtcaacttctttgacaaatgccagggggaacccagctactgggacaagatcttacagggcggcccgcagagaatctatgagaaggacacctggaagctctactcccagaggctgatgaccctggccggggtgtacgggttctggaagatcctgagcaacccggagaggcgcgagacccgccgctacatctagatgttctacgccctgaagtaccgtaacctggcaagccaggttcccctgtccttcgattagtaccgggaaagaaggggaagaagaagaagaagcccacgccggagaaacatcccctgcatttcgatctgnttcaccgcaattcncattgttaggccgggattggagt

SEQ ID NO: 34008 - DNA, 392 bp, Zea mays
  Clone ID: LIB3059-061-P1-K6-E3
cccgggtcgacttagcgtccgcgcctcccaaaatgatcacgagggacaagaacgtgagcttggaagggcacggttgcttccggaaggtggtgtcggcgatagccaccaggagaggagtcagggatctgaacacgatgaaagtgtcgacgtttgcatgcttgaggaggtgggtgttggtgaagattgcaaggtagaagacaaccgcggccggcgcaaacttcttggcggtctggaagttgaaagcgttgtggcaaaagaagcccagctttccgagcacccacacttcaaccaccgaggtcaagtacttcagggcggtcagcaatccggggtagctgaacttggtgatggcatacttgttgatgatagccagcaagctggagcacagcgcgtac

SEQ ID NO: 34009 - DNA, 418 bp, Zea mays
  unsure at all n locations
  Clone ID: LIB3059-061-P1-K6-E5
gggtcgcccagcgtccgatccaattcagatcagcaaagcggcagtgcgtagaaaggatcctccaacaaaacaacctgaagaagggcatcggtctcgtcgtgtgcccggctctgtcagcttccaacgcctcttcaatgcaaatgccctgcccctgcgcggggcttcagggcttgtacagcgcttgcgcccgcctggggacgataataggcgcccgcgggctgtacccctacgcggagtacctgaggcagccgcagtgcagcccgctggcggcggggccctactaccccncgtgtggggcagccaacgccatgtttcaacccgtccggcaacaatgctgccagcagcanatgaggatgatggacgtgcagtccgtcgcgcagcagctggagatgatgatgcagcttggagcgtggccgct

SEQ ID NO: 34010 - DNA, 379 bp, Zea mays
  unsure at all n locations
  Clone ID: LIB3059-061-P1-K6-E6
cccgggtcgactacgcgtccggaccattagcaacatagaaagcacagtggtgtgccaacaatggcagccaaaatattttgcttgcttatgctccttggtctttctgcaagtgttgctaccgcaaccattttcccacaatgctcacaagctcctatagcttcccttttttccccatacctctcaccatcngtgtcttgagtgtgtgaaaacccaattgttcaaccctacaggatccaacaggcaatcgcaacaggcatcttaccattatcacccttgtttctccaacaaccgtcagccctattacagcagttacctttggtccatttggtggcacaaaacattagggcacaacaactacaacaacttgtgctagcaaacc

SEQ ID NO: 34011 - DNA, 69 bp, Zea mays
  unsure at all n locations
  Clone ID: LIB3059-061-P1-K6-E9
tcccgggtcgacctacgcgtccgcccagcttncgcccaacttncgcagacacgtnggtttaattttttt

SEQ ID NO: 34012 - DNA, 51 bp, Zea mays
  Clone ID: LIB3059-061-P1-K6-F1
cccacgcgtccgcccacgcgtccgtaaataataagaatgacacctccagcg

SEQ ID NO: 34013 - DNA, 221 bp, Zea mays
  unsure at all n locations
  Clone ID: LIB3059-061-P1-K6-F10
gctattcctctcgtgtcttcgtgttcgtatatcagncagcaatggccccgtgtgacctggatacctttctttttntgccaggttgtttgggggctctatnaatttcttttaatcccttaaaaaccttntntnttcnatcnnataatcnanttattttctttncantnaaaaaaaaaaaanaaaanaaaaaannnnccccnaaaaaaaaaaaaaaaanaaaa

SEQ ID NO: 34014 - DNA, 581 bp, Zea mays
  unsure at all n locations
  Clone ID: LIB3059-061-P1-K6-F12
cccgggtcgacttagcgtccggtccttatcagcagtagcgaaggacgaggtgagggaggagagagttcttggacggaatacttggtggatttcatgttatccgaggaggagaggaagagacaggcagatgctagctcatactcatactgcgctaccgaagacgaaggcggcagcaaatacggtgtctatggaagcaggggtgatgagnannangaggaggaagaagaggagtccatggtctccgatgccgcctctcatgcccctacgactgcaggcgccaccgcactgataccagctggcaggtacaaggagctgaagaagctcaagaaaaagcctttcggcaaagccctggatcatgacggttccctggaggataccgcaagctctccggtgaatagcccaaaggtcagtgttgtgtcacagctggaattgagtgctaaaaggaggtgcaacatcagggacctcaccaagggagtccttggaattggcgatgatcaccgcggggaggggatggacgtctttacagatgcaaccaccacggaaggagcgaggcttggtgatcagtaccacacaagcatagc

SEQ ID NO: 34015 - DNA, 288 bp, Zea mays
  Clone ID: LIB3059-061-P1-K6-F2
cccgggtcgacctaccgcgtccgagctggtttgagccctgctaccttcttgacacagaccacagttgttgccgttctaccagcacgttgcgcctaacgctggcacccttttacaactgcaacaattgctgccattcaaccaacttgctttgacaaacccagcagtgttttaccaacaacccatcatttggtggtgccctctggggggtttcttatgaattatagttcaataataaagatttttatctgatggttgtggcttcccagaaataagaaaggacatttctaa

SEQ ID NO: 34016 - DNA, 212 bp, Zea mays
  Clone ID: LIB3059-061-P1-K6-F3
ctcgatcgatctcctctggatctggaagaggttggtatgaccctctattgcctcctgctctgctcctcacgtcaccatcgccgtctcagctcaactgtacgactccgtatatattataaccatcggttgtcatcaaaaaaaaaaaaaagaaaacagagaagatttttcaaaacggaggggtgggacaacaaagaaaataaaagaccagaagg

SEQ ID NO: 34017 - DNA, 519 bp, Zea mays
  unsure at all n locations
  Clone ID: LIB3059-061-P1-K6-F4
gtccggnattcccgggtcgacccagcgtccgggagcctacccgtttgaagatcaggaggatcctgaaaatattagaaagaccattcagcgaattgcagcaattcaatataatatcccagacaacattcgcatatctgatgattgcagacaactcatttcacgtatctttgtcagcaatccattaaggagaatcaccatgagggaaatagagggccatccatggttcctaaagaacttgccgagggagctcacagaggcggtgcagttatcctacttcaggagggacaacagtgtctctgcattttcagaccaaacaaccgaagaaatcatgaagattgtcaaggaggcaagaaccttgccaaaatcgtcgagatcaggctatggttacagngaagaatgctcagatgaggaggaaaaggaagtggagagcgaacccaaagaggaggaagaagaagctgagtgtgataagacaattagggaggttcccgagagcggggagctggatatgacctcactgca

SEQ ID NO: 34018 - DNA, 143 bp, Zea mays
  Clone ID: LIB3059-061-P1-K6-F5
cctgaactttgcggccttgcgggtgcgtatgcagcgatgcttgtgtctacaccttactccagccacagttcatacctgacggttgctaagtgttgatgcatcttactagcctcgttaggatggattggcccttaagtttattt

SEQ ID NO: 34019 - DNA, 503 bp, Zea mays
  unsure at all n locations
  Clone ID: LIB3059-061-P1-K6-F6
cccgggtcgacccagcgtccgagagagtgagagaccctaccgggcgggagagagccaggaagaggagggcgacgatggcgtccggctggggcatcaacgggaacaagggccgctgctacgacttctggctggagttcagcgagtgcatgagccgctgccgccagccctccgactgcggcctcctccgcgaggactagggggagtgcctccaccactccaaggagttccagcgcaggaacaggatctacaaggaggagcaacgtcagatcagagctgctgctcgtaaggccaaggaggaagctgagggtgcccctgctgttgcagcacaccattagtctccctgtctattttttgtgttgttgttttctgttaactcatctttggttcagttatgatgctaagggcaaggcaataatctccagctgttggactacacagattttttcccccatgacttaaatatcaagactcattttgtgctttaaaaaaaaaaaaaanaaaaa

SEQ ID NO: 34020 - DNA, 485 bp, Zea mays
  unsure at all n locations
  Clone ID: LIB3059-061-P1-K6-F7
cccgggtcgacctacgcgtccgcggacgcttgggctaatgggttaggggggggggctgatagttcacacataaggaggcttgatgattgccgtgctgaactccacaatctcttgaaagaagagagactagttggagcttcattgttgatttttgcaaataagcaagacatgcaaggagctctaaaaccaactggaatggcggggagtcactctccnacagctcatcnccncttggttctcccnccnntacacaaggtttaagaagcgctccgcggacttccacggccgcgctgccgatctcgtccacagcctccggggcacggcgatgcccaggagacaggccctcgaggaagagcaatgtagagaagagaaaggtatctcgactgttccaaagcacaagtatgcatccaaagcctgttccccaaaagttttgaagacttaaacaaattgctgcatgaaaatctttactttattcacaacacacc

SEQ ID NO: 34021 - DNA, 582 bp, Zea mays
  Clone ID: LIB3059-061-P1-K6-F9
cccggtgtcgactcacgcgtccgtgcattttcacctgcttctttcatgaggtggggattagcagaatcaggcaagcattttgtgacaacggttgtcaatggagctgatctggttcccactgtatcaactgcatctattgatgatctccgttctgaggtaacagcttcatcatggttaaatgatctgagggatcaaatagaggggacacgcttcctaaatgtcgtttaccggtcagccactgctttaggaactcgcctgcagtctttttctggtgcgagagagagggttgcaggtgctggagcatttctacgtcctgtttcaaacaaaacccaggttgtgatgaaacaagcacagaatgtcgcacaggctgttgctagaagtcggtctgcattttcctcatggtcatgcatgggtgcacgtcgtcgaggtgtaggtgtagttactgcatgttctaaagatgatatgagagtggaaacccatgtaacatcaacagttgagtcaaagtctgtccttttaaaacattgtggcgccaagaccatagaaaaactgcagtatactgcaactagtgtttctgttcatgat

SEQ ID NO: 34022 - DNA, 510 bp, Zea mays
  Clone ID: LIB3059-061-P1-K6-G1
gacctagcgtccggcgccccttacgccgggtgagggcagccgagcgccatgttccagccgctccggcaacagtgctgccagcagcagatgaggatgatggacgtgcagtccgtcgcgcagcagctgcagatgatgatgcagcttgagcgtgccgctgccgccagcagcagcctgtacgagccagctctgatgcagcagcagcagcagctgctggcagcccagggtctcaaccccatggccatgatgatggcgcagaacatgccggccatgggtggactctaccagtaccagctgcccagctaccgcaccaacccctgtggcgtctccgctgccattccgccctactactgattcatgatatttgggaaatctcctctatccatctctctctatctatatatgtaataatgcagtaagacgacacacattatcatgtgtggtatgaccaataatatatgcatggtcataataaagttttggtttaatgaatttatcgggcgcttgatgtcc

SEQ ID NO: 34023 - DNA, 197 bp, Zea mays
  unsure at all n locations
  Clone ID: LIB3059-061-P1-K6-G10
cccgggntcgacctacgcgtccgcagcatgttccgatccctgctatggaggggggggtggccatataaaagcntccancccattgttctctgacgatgataagtccgatcacggtggtggcggaggtcggaaacaacaacctcccaagcaggacgttccgccggttgttgatcccaccaatagagctgtgtactata

SEQ ID NO: 34024 - DNA, 365 bp, Zea mays
  unsure at all n locations
  Clone ID: LIB3059-061-P1-K6-G12
cgtccgcgaggttttccgtcggattcgggattgtgtgatgtgactagaaaanataatacantacctatggcttctcttgaccccntgcgaggagacctcgccctgctgattctgtacctgaacaaggccgaggcgcgggacaagatctgcccagcgatccagtacgggtcctatttcatcagggaggggagccannncctnctcataacntcaacaaatccaccancctnnccctnaaagtnttccnnctctttaanttcntcaacnaccttcatnctttnatcanccctcctnccaannnnactccnctcccncttatcctactcnnnaantccaanaacccnatnctntcnactttcctcttc

SEQ ID NO: 34025 - DNA, 464 bp, Zea mays
  unsure at all n locations
  Clone ID: LIB3059-061-P1-K6-G2
ccgggtcgacctacgcgtccgagaactgttagttgcattggcaaattctaatgtgaaagagatgcttgagatgtggttcactaacataaaacgagctgggatttcaaattatttagtagttgcattggatgacagcatagagaacttctgcaagtccaatgatgtcccagtttaccgacgcgatccagatgatggcatcgacaatattggcaagacaggcggaaaccacgctgtttctggactcaagttccgcatattgagggagtttttgcagctcggatacagagntctgctctctgatattgatatcattttcttccaaaatccatttgattatctttacagagattctgacgtagaatcaatgagtggtggccacaacaacatgacagcttatggattcaaccatgtgttcgatgagccttcaatgggctgggcaagatatgcacataccatgcgcatat

SEQ ID NO: 34026 - DNA, 371 bp, Zea mays
  Clone ID: LIB3059-061-P1-K6-G3
cccggttcgactcacgcgtccgcccattcttccgatttgatcgatgcaaaaagttttggcggtggaaacaagatgggcgggcccactacaatgggtagctcaaatggtggccagcctatgattggtggaaagaaatagggttatttgtctatatatatacagctgatggtgatcggtagctgccttgttatttattatgattactttgtctggtgtacatttgtacttgtatatcgccattcccccttttgacagatttggctgcattggttgattcgtgggtgcaactgttaagtttaacagagatatggacaattgctcatgtacataaatgattagcatttgctccactgaggtggatggttgtgatg

SEQ ID NO: 34027 - DNA, 460 bp, Zea mays
  unsure at all n locations
  Clone ID: LIB3059-061-P1-K6-G4
cccgggtcgacctacgcgtccgcccacgcttccgcctagtgccattagggcacagggcctcccaccagttacttcaatgggcttcgaacacctagctgtgcaagccaacatgcaacaacaagcgcttgcggcgagcgtcttacaacaaccaattgcccaattgcaacaacaatccttgccacatctaacaatacaagccggggggggcgcaacagcaacaacagttcctaccagcactgagccacctagccatggtgaaccctgccgcctacttgcaagagcagctgcttgcatccaacccacttgctctggcgaacgtagntgcaaaccagcaacaacaacagctacaacagtttctgccaacgctcagtcaactagccatggtgaaccctgccgcctacgtacaacaacaacaacttgtttcatctaacccgcttgctgtgggcaatgcacctacata

SEQ ID NO: 34028 - DNA, 406 bp, Zea mays
  Clone ID: LIB3059-061-P1-K6-G5
cggacgcgtgggtgagcattcaggaagcacaccgagcgaagcgcactagcaacgacctaacaacaatggctaccaagatattagccctccttgcgcttcttgccctttttgtgagcgcaacaaatgcgttcattattccacaatgctcacttgctcctagtgccattattccacaggtgggggggccagttacttcaatgggcttcgaacacctagctgtgcaagccaacatgcaacaacaagcgcttgcggcgagcgtcttacaacaaccaattgcccaattgcaacaacaatccttgccacatttaacaatacaagccatcacaacgcaacagcaacaacagttcctaccagcactgagccacctagccatggtgaaacctgccgcctacttgcaagagcagct

SEQ ID NO: 34029 - DNA, 449 bp, Zea mays
  unsure at all n locations
  Clone ID: LIB3059-061-P1-K6-G7
ggccaaactcccgggtcgacctaagcgtccgatatggcttaacgaatagtgatggagggcaaagctgattacccancancctgcaatgctatggagacattgcttgttcataaagaccttataaaggctccaggtcttgatgatatactcctatcactcaaaacagaaggagttgctatttatggagggcctgttgcacatgaagtagtgggtgttccnaaagcanattcattccatcatgaatatanctctatggcctgcacaattgagttcgttgatgatgtacagtcagcaattaaccatatacatcgttatggaagtgcacatacagattgtattatcaccacagatgataaagtagcaaaaacttttctgcgtcaagttgatagtgctgctttatttcataatgcgagtacacgattctctgatggggctcgttttggattggg

SEQ ID NO: 34030 - DNA, 545 bp, Zea mays
  unsure at all n locations
  Clone ID: LIB3059-061-P1-K6-G9
tcccgtgtcgacctcagcgtccggcacattgaaagcacaatagtgtgcgggcggggcagccaaaatattttncctccttatgctccttggtatttctgcaagtgctgctacggcgaccattttcccgcaatgctcacaagctcctatagcttcccttcttcccccgtacctctcaccagcggtgtcttcngtatgtgggggggcaattcttcaaccctacaggatccaacaggcaatcgcagctggcatcttacctttatcacccttgttcctccaacaatcatcagccctattacagcagttacctttggtgcatttattggcacaaaacatcagggcacaacaactacaacaacttgtgctagcaaaccttgctgcctactctcagcaacagcagtttcttccattcaaccaactagctgcattgaactctgcttcttatttgcaacaacaacaactaccattcagccagctacctgttgcctacccccaacaatttcttccattcaaccaactggcagcattgaactctccttgttatttac

SEQ ID NO: 34031 - DNA, 186 bp, Zea mays
  unsure at all n locations
  Clone ID: LIB3059-061-P1-K6-H12
ttgcatccaacccacttnctctnncaaacntanctncataccaacaacaacaacaattncaacantttcttccancnctcantcaactanccatnntnaacccttttttctacctacagcagtgagaactnctttcatctatccctctaaaaaaaaataatncacctacatacctncaacaacaat

SEQ ID NO: 34032 - DNA, 495 bp, Zea mays
  Clone ID: LIB3059-061-P1-K6-H3
gcaggtttccgccgccaccttctcccagaaataacagcaggtcaccaccggcagcccgagacgtgagcaggtcaccaccggcagcccgagacgtgagcaggtcgccaccaccacctcctgatgccagaagaagctatagtggatccccaggacagcagccacaacgcgacgagtccccatatgccaatgacgcctgagattctcttagctgccccaagatgctggaaaatgctaggggcccccagcatgttttgcctgtccggtcggcacaactgtaattctgtaggatcgagtctgagattttgttccagtgttttgggtttcccttgacacatcgctgctgatacaattgtggaggcaggagcacaacgtttctgttttaagtattgactggatgactctgggcgcttgtagttgtcaaggcaggacctgatttggtgtaggcttgtattactagactgcattcgaatttggagaaagtgttcatcgtgctgt

SEQ ID NO: 34033 - DNA, 374 bp, Zea mays
  unsure at all n locations
  Clone ID: LIB3059-061-P1-K6-H6
tcccggtgtcgacctcacgcgtccgcccacgtttccgcgcaaattgcaccgggaaggcgtcgagaggccctcnacaggggaattaatggcgtcgtcgtctagcagcagccaccgccgcctcatcctcgcagccgccgtcctgctctccgtgctcgcggctgccagcgccagcgccgggacctcctgcttgccggggtgggcggtgccgcacaacccgctccctagctgccgctggtacgtgaccagccggacctgcggcatcgggccgcgcctcccgtggccggagctgaagaggagatgctgccgggagctggcggacatcccggcgtactgccggtgcacggcgctgagcatcctcatggacggcgcgatcc

SEQ ID NO: 34034 - DNA, 227 bp, Zea mays
  unsure at all n locations
  Clone ID: LIB3059-061-P1-K6-H9
tcgacttagcgtccgcccatttttccggctgcncctaaaattagaaggcgcttacaactacaacaattgctgccattcaaccaacttgctttgacaaacccagcagcgttctaccaacaacccatcattggtggtgccctcttttagatttcttatgagttatagttcaataataaatttttttgtctgatgggggtggcttcccanaaattataaantccatttat

SEQ ID NO: 34035 - DNA, 161 bp, Zea mays
  Clone ID: LIB3059-062-P1-K6-A11
ccgccaacctgcttctctgctttgtggggcgtgggttgcaaaattagcaacatgccacagtgagttgcttccgagggcacgcgtgtcattgggtaaggtcgctcgttcccgaacctcagacaggagggtctggcaacgggcctgtgactatttagggctca

SEQ ID NO: 34036 - DNA, 579 bp, Zea mays
  unsure at all n locations
  Clone ID: LIB3059-062-P1-K6-A12
cagaacatttacagtctacttgtgaggagggggggttgaagttgatcttnttgaagtttgccacccgaataactgcaacgttggactgcttgcatactccccgttggctggtggggttctcactgggaagtatcttgacgctaacgctgacatctcaaagagcattctaaatctctgggggggatacatgncacgctacaatgactctttagctaaagaagcgacattagagtacgttaagcttgccaagaagcacgggctaactccagtccagcttgcccttggcttcgtgcgtgatcgtccattcaccgctagctccatcattggagcgaccaccatggagcaggtgaaggagaacatcgacgcgtttaccagcactccacggcctctaccacaggaagttcttgacggcattgaggatcttttcaagagatacaaagatccagcaatcctctagtttttcattcaccttttttggcgaaaagtaacaattcctcgacaatacaaagcccanaaaacattttacaacctatgatcgtatggtcataccattttgttcatgctgatacaantattgct

SEQ ID NO: 34037 - DNA, 95 bp, Zea mays
  Clone ID: LIB3059-062-P1-K6-A2
ccgggtcgacccagcgtccgcccacgcttccgcccacgcgtcgcgcaaaaaaaaaaaaaaaaaaaaacaaccaaaaaataatagaaaacatatgg

SEQ ID NO: 34038 - DNA, 579 bp, Zea mays
  Clone ID: LIB3059-062-P1-K6-A3
gttggcttctcctcccccccggttcgtgttcaggttctggttcgtgggcgagagggaagagatggcggcgtcggacgttgagtaccgttgcttcgttggcggcctcgcctgggccaccgacgaccactccctcaacaacgccttcagcacctacggcgaggtcctcgagtcgaagatcatcctggatcgggagacgcagaggtcccgcggcttcggcttcgtcaccttctccacggaggacgcgatgcgcagcgccatcgagggcatgaacggcaaggagctcgacggccgcaacatcaccgttaacgaggcccagtcccgcggcggccgtggaggcggcggtggcggatacggtggcgggcgccgtgatggaggcggctacggcggtggcggtggaggctacggcggtggtcgtggaggctacggcggcggtgggggatacggtggtgcaaaccgcggcggcggctacggcaacaacgacgggaactggaggaactgagcggtggggtccgctgaggcctaattatcttgttcgcttctggtaccgtgttcaccctagtctagagggggtttatcttc

SEQ ID NO: 34039 - DNA, 306 bp, Zea mays
  Clone ID: LIB3059-062-P1-K6-A5
ccagcgtccggagaccaacaagcaacatagaaagtggaatccagtagcaacaatagagcaacaatggcgaccaagatattttccctccttatgctccttgctctttctgcatgtgttgctaacgcgacaattttccctcaatgctcacaagctcctatagcttcccttcttcccccataccttccatgagggatagcttcagtatgtgaaaacccagctcttcaaccctataggctccaacaagcaatcgcagcaagcaacatacctttatcacccttggttcaacaatcgccagccctatctttg

SEQ ID NO: 34040 - DNA, 619 bp, Zea mays
  Clone ID: LIB3059-062-P1-K6-A6
ggtccggacttcccgggtcgacccagcgtccggccagaggcgcagaaggcagtcgcgggcaggaggaagaggaagaagaagcggcagcgagcgaggatgccgtgcctgaacgtgtcgaccaacgtgaacctggagggggtggacacctccgccatcctcgccgaagcctccaagtccgtcgccaacatcatcggcaagcccgaggcctacgtgatggttgttctcaagggttcggtgcctatggcatttggaggtacccaggagccagcagcttacggtgagctggtttccatcggaggcctgaaccctgatgtgaacaagaagcttagtgctggcatcgcttctatcctggagtcaaagctgtctgttcccaagtcacgcttctacctcaagttctatgactcgaagcgctcggacttcggttggaacggctccaccttctagacttgaggtctgcagctgaaataaaagaaattcgtggaatcatggtacctaatgcccatggctattgcctattaaggacaatgtcataagatgtgtcttaatcggtgctgaactgagaaacagtaactggtgtcgtggaactggaagtggggtgctggcgtgttagaatgcttgc

SEQ ID NO: 34041 - DNA, 167 bp, Zea mays
  unsure at all n locations
  Clone ID: LIB3059-062-P1-K6-A8
tcccggttcgacctaagcgtccgcccactcttccagtatttattccctggggagtgagactgctttcnacccatcctactgccttttggggtggagtttggcaaatttgcctccctttataagttctacagcggtcgtaatttgcttgttgtcaactttgctttcct

SEQ ID NO: 34042 - DNA, 120 bp, Zea mays
  Clone ID: LIB3059-062-P1-K6-A9
cccactcgtccggacaaaccttacgtgtatggtgctggcaagtcccagtggcgtgccatgaaaatttacgttccgtcttttaactgggtatccgagtgtcgtgctcagcatattatggat

SEQ ID NO: 34043 - DNA, 571 bp, Zea mays
  Clone ID: LIB3059-062-P1-K6-B1
cccgggtcgacctacgcgtccgcccacgcgtccgcccacgcgtccgtgacgacaggctttctccaaggcctgttttggccaggacaccagacgaagtaattgcagccaaaggtgtgaagccaacattatcaccaaatctcaatacacttgccttagtcgagctggtgtaaagcggcttcttttctgcggtgtgggctgtcaagtgcaagctttgagatctgtagaaaagtaccttggtttggaaaagctttatgtgcttggaacaaactgtgttgacaatggtacgcgtgaagggcttgataaattcttgaaagcggcaagcagtgagccagaaactgttatgcattatgaatttatgcaagactacaaggtgcatctaaagcatttagatgggcacattgaagaggttccttatttttgcctgccagcaaacgacctggtagatgttattgcaccgtcatgctatagctgctttgactacacaaatggcttggcggtaaggtttccatcattttgaatttgaatagggtcccttgttttgaattggaactttctttctagtgctcatctg

SEQ ID NO: 34044 - DNA, 408 bp, Zea mays
  unsure at all n locations
  Clone ID: LIB3059-062-P1-K6-B10
cccagcttccggatcaaccaagtgggggtggggagacctttctccctactctcancaacaacaatttcttccattcaaccaactgtctacactgaaccctgctgcttatttgcagcaacaactattaccatttagccagctagctactgcctactctcagcaacaacaacttcttgggatgtagccaattggccncactgaaccccnctncttatttncancancaaatactactaccatttanccanctanctncancaaaccntccttccttcttnacacancaacanttnctncctttctaccancantttncnnctaaccccncaaccctcttacaactacaacaattnttnccctttntccaacttnctttnacaaacccaccnncctcctaccaacaacaca

SEQ ID NO: 34045 - DNA, 335 bp, Zea mays
  unsure at all n locations
  Clone ID: LIB3059-062-P1-K6-B12
cttcccgtttcgactcacgcgtccggtgaatctcttccagaggaaatttgtggggggggtgtagctacaaanaatttccgtgctggcaccttgagcctgcgtcagatacgatttgccagtgtagatatggagcttcatacaagttatgaccccaatggctcagtgtccatatatgatgtggaccaaatattttcanaacgggtgcaggttcttnctcctctttcnnangacaaaaacctatncanctttanccatatttttncanntnnctattctnctnnatactacanttacaantnnnctnaantactttcanctnatncattctcancttt

SEQ ID NO: 34046 - DNA, 407 bp, Zea mays
  Clone ID: LIB3059-062-P1-K6-B2
cccgggtcgacctacgcgtccgagaccatttagcaacatagaaagcacagtagtgtaccaacaatggcagccaaaatattttgcttccttatgctccttggtctttctgcaagtgttgctaccgcaaccattttcccacaatgctcacaagctcctatagcttcccttcttcccccatacctctcaccagcggtgtcttcagtgtgtgaaaacccaattgttcaaccctacaggatccaacaggcaatcgcaacaggcatcttaccattatcacccttgttcctccaacaaccgtcagccctattacaagagttacctttggtccatttggtggcacaaaacatcagggcacaacaactacaacaacttgtgctagcaaaccttgctggatactctcagcaacatca

SEQ ID NO: 34047 - DNA, 638 bp, Zea mays
  unsure at all n locations
  Clone ID: LIB3059-062-P1-K6-B3
cccggtgtcgactcagcgtccgcacaacttaagttttcagtagaagaacatcaaatacatanctggctcacntcgtgattccttcacccagcagttcgtaaccacctgctaaatcatcaaaaagatggccccctgcaaagtagcagcagccttactcctgttgatcacaacaatttccgtcaacaccgtaaccgggtcgcgatgtaacgctcaggagaagaaccagattgtgagcttgtgccaaatgtacatccagagaggaaccctcgttcagctcccatcccaaactgggccatgctgtgcggcagtgagagagctggagagggtacacaggggtatgcagatgaagtgcatcgccgatctactaaacgctggagacctgcagaaatacgatccaactaagatcaagcatcttgacatttcctgctacacttaacacatcgntagtttcattcctctcctccccatcgttgtaaggtcatgctgtgaagggcgcgatggcgtggaatggatggtggtggtagcaaagatgctcagaagatgacatttcgttagttatttaattaagtcttccaaggcgtcaatcttcctgacatgtatttttattcgaaaaaataaactggattatttctgggttt

SEQ ID NO: 34048 - DNA, 494 bp, Zea mays
  Clone ID: LIB3059-062-P1-K6-B4
cggacgcgtggggtgaagttttcgataccacccatgaagataactctattttctcatttgaaattggacaaggcgctgtcatcaaagcatgggatatagccttaagaactatgaaggttggcgaggttgcaaaaattacatgcaagtcagaatatgcatatggagctgcaggctcgccaccagagatacctcctaatgcaacccttatttttgaggtggagctagtagcttgcaggccgaggaaaggttcaagcttaggcagtgtatctgatgagaaagcccgggtgcaagcaaagcttgatgccaagaaggggaaggggaagggaaagggaaaatagatcgtgacgttgctgctgactattgttgtaaccaagaaaataattgtgggagcgtcctcaaactgctccgtcacttgctggctactgtgcttgatgttgtagcgtggactaatgtatcgaaaagagctaagtataaataatatctggtatctatgt

SEQ ID NO: 34049 - DNA, 468 bp, Zea mays
  Clone ID: LIB3059-062-P1-K6-B5
cccgggtcgacccagcgtccgagaccaacaagcaacatagaaagtggaatccagtagcaacaatagagcaacaatggcgaccaagatattttccctccttatgctccttgctctttctgcatgtgttgctaacgcgacaattttccctcaatgctcacaagctcctatagcttcccttcttcccccataccttccatcaatgatagcttcagtatgtgaaaacccagctcttcaaccctataggctccaacaagcaatcgcagcaagcaacatacctttatcacccttgtttcaacaatcgccagccctatctttggtgcagtcattggtacaaaccatcagggcacagcagctgcagcaactcgtgctacctgtgatcaaccaagtagctctggcaaacctttctccctactctcagcaacaacaatttctttcattcaacccaactgtctacattgaacccgtgct

SEQ ID NO: 34050 - DNA, 572 bp, Zea mays
  unsure at all n locations
  Clone ID: LIB3059-062-P1-K6-B6
tcccgggtcgacccagcgtccggggttgtcttctcctccccctccggggcgggggcgggttcgtgaggttctccggggttcgggttcgtgggtgagcggatcgagatggcggcgtcggatgttgagtaccgctgcttcgtcggcggcctcgcctgggccacggacgaccactccctccacaacgccttcagcacctacggggaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggtgggtacggtggtggccgtggaggcggcggctacggcggtggcgggcgccgtgatggcggtggcggctacggcggtggcggcggctacggtggcggcggcggctaccggggtggtggcggcggctacngcggnggcaaccggggcggcggcttcgggaactccgacgggaactggaggaactg

SEQ ID NO: 34051 - DNA, 538 bp, Zea mays
  Clone ID: LIB3059-062-P1-K6-B7
attgatactaactagcaacatacataggggaggggcactagcaacatcttagcaccaatggcagccaagatttttgccatccttgccctccttgctctttcagcaagcgttgctaccgcgactattattccacaatgctcacaacaatacctctctccggtgacagccgcgagatttgggggggcaactatacaatcctacaggctacaagaggccatcgcagcaagcatcttacggtcgttagcattgaccgtccaacaaccatatgccctattgcaacaaccatccttaatgaatctatatctccaaagaatcgcagcacaacaactacaacaacagttgcttccaataatcaatcaagtagttgcagcgaaccttgctgcttacctccagcaacaacaatttcttccattcaatcaactagctggggtgaaccctgctgcttacttgcaggcacaacagctactaccattcaaccaacttgtcaagagccctgctgccttcttactgcagcaacagttgcttccattccatctac

SEQ ID NO: 34052 - DNA, 112 bp, Zea mays
  unsure at all n locations
  Clone ID: LIB3059-062-P1-K6-B8
accaaacagctgaaagagttcagttgagttaaaaaaaaaaaaaaaaaaaaaaaaaaaaaaaaaaaaaaaaaaaaaaaaaaaaaaaaaaaaaaaaaaaaaaaaaaaaanaaaa

SEQ ID NO: 34053 - DNA, 569 bp, Zea mays
  Clone ID: LIB3059-062-P1-K6-B9
cccgggtcgacccagcgtccgagaagtttaagatttcaacactagcgctggggggtgaaccttaaagctatcaagagactcgtagaggctgaggcacttaagatggaaattattccaaaccccaaggaagttgatggtgtgaaagtccttcaactcgaaaccgcagctggtgcagctattcggttcttcgacaaaggggggggaattaatgttccccgctcaaggtttctcccagtgaaggctacatctgatctgttgcttgtgcagtctgatctttacaccttggttgatggctttgtcatccgcaacccatccagagcgaatccagctaacccttcaattgagcttggacctgagttcaagaaggttgccaatttccttgctcggttcaagtccatccccagcatagttgagcttgacagcttgaaggtttctggtgatgtctggtttggctctggaattacactcaagggcaaggtgacaattatcgccaagcctggagtgaagttggagattccagatggagacgtacttgagaacaaggatgtcaatggccctgaggatcttta

SEQ ID NO: 34054 - DNA, 339 bp, Zea mays
  Clone ID: LIB3059-062-P1-K6-C1
gtcggctaggtaatctggtggtacgacgacatggcggccaccagcagcaagtcgtcgtcgtcctcgagctcggcgcagcgggcagctgccgcactgctcgtggccgccgccgtggcggtgtccgtcctggtggtgggcgcggcggcggtgtgcgacatgagcaacgagcagttcatgtggtgccagcccgcggcggccaagacgacggacccgccggccgcgccgtcgcaggcgtgctgcgacgcgctggcgggggcggacctcaagtgcctgtgcggctacaagaactcgccgtggatgggcgtctacaacatcgaccccaagcgcgccatggagctt

SEQ ID NO: 34055 - DNA, 331 bp, Zea mays
  unsure at all n locations
  Clone ID: LIB3059-062-P1-K6-C10
cccggttcgacctagcgtccgaatccagatcagcaaagcgncagtgcgtggtgggggatcgtacaaacanaacancatnaanatggtcatcgttctcntcntgtgcctggctctgtcagctgccagcgcctctgcaatgcagatgccctgcccctgcgcggggctgcagggcttgtacggcgctggctccttcctgacgggtgtggtggncnccnncngtctttacccctacacanatacctnangcanccncantncancccncttgcngcggcgccctactacgccgggtgtgggcagccgaacgccatgttccagcccctccggcaac

SEQ ID NO: 34056 - DNA, 468 bp, Zea mays
  unsure at all n locations
  Clone ID: LIB3059-062-P1-K6-C11
tcccggtgtcgacctangcgntccgagaccatttagcaacatagaaagtgggatgcagtggcaacaacaaancaacaatggcgaccaagatattttccctccttatgctccttgctctttctgcatgtgttgctaacgcgacaattttccctcaatgctcacaagctcctatagcttcccttcttcccccataccttccatgagtggtagcttcantatntnaaaacccanctctacaaccctatannctccaacaancaatcncancaaccaacatacctttatcacccttnttntttcaacaatccccanccctatctttnntncantcattnntacaaaccatcannncacancancttcancaactnctcctacctttnatcaaccaaatanctctnnccaacctttctccctactctcancaacaacaatttcttccattcaaccaactttctacactnaacc

SEQ ID NO: 34057 - DNA, 582 bp, Zea mays
  unsure at all n locations
  Clone ID: LIB3059-062-P1-K6-C2
caattattctttcacatcatatgctccctggttttaaagaaggccaggagaaaatgtcaaagagtgacccatcctcggctatctttatggaagatgacgaagcccaagttaacgtgaagataaagcaagcattttgccctcccaaaattgttgaggggaatccttgtttggagtacattaaatacatcgttttcccttggtttggaaggtttgaggtggcccggaaggaaagcaatggcggtaacaagacatttacaagcatggatgaactaatttctgattatgagactggtgctttgcatcctgctgatgtcaaacctgcactggcaaaagcaataaatgaaattttgcagcctgttcgtgatcacttcaacaacaacaacgaagccaaagttctactaaacactgtcaagaagtacagagtaaccagntgaggagcggaaggtgttcatctttagggtgaatgtcgctgattgaaattcttatatgcctattcctgttactaaatgcaccactcattttagatcaagctttgagccattggttatcaatgtataatctctatgaaggcatttttgtggc

SEQ ID NO: 34058 - DNA, 433 bp, Zea mays
  Clone ID: LIB3059-062-P1-K6-C4
gtgtaccaacaatggcagccaaaatattttgcttccttatgctccttggtctttctgcaagtgctgctaccgcaaccattttcccacaatgctcacaagctcctatagcttcctttcttcccccatacctctcaccagcggtgtcttcagtatgtgaaaacccaattcttcaaccctacaggatccaacaggcaatcgcagcaggcatcttacctttatcacccttgttcctccaacaaccgtcagccctattacagcagttacctttggtgcatttgttggcacaaaacatcaaggcacaacaactacaacaacttgtgctaggaaaccttgctgcctactttcagcaacagcagtttcttccattcaaccaactggctgcattgaactctgctgcttatttgcaacaacaactaccattcagtcagctagc

SEQ ID NO: 34059 - DNA, 542 bp, Zea mays
  Clone ID: LIB3059-062-P1-K6-C5
gcgatggcgaagtctctgcgatccaaacgcgagaagcggcttcggacgttgcgccgggagatagcggagccgttctacgacaagaaggaggccgccaagctcgccgcgcaggccgccgccctagctgctgccccgctcccggtccgcgggcccccgccatcccaggatgccggcagctggcgcgcagctagctcggcctcggctatggatgtggagatgtctgatgcagggaacaacaggtctaagaccttcttgaggccacttggcagcattagcaagaagaaggtgcagcttcatttgaagatcaagaaagacaagagaaaagctaggaagaagggaaagttttcttttaagaagtagaggagtgtatgataaatcatgcagttttgttcccagtttgtaaaacaaacgcactgcagtcatgtcatgtggtgcacctacctaagtccattcgtgggtgacctactattaaatatgttgaaatgggtacgaaaaaaggatagtgctgacctatcagctgtttctgttctgcgggtataaat

SEQ ID NO: 34060 - DNA, 417 bp, Zea mays
  Clone ID: LIB3059-062-P1-K6-C6
atttggtgctacaacaagcatggtgcatcctgcaaccagtacagacgaatcatcaagtttttacacaccagtttccacctagcatatattgacaacttttcacaaaatacatagggtacttagtggtcagatctttgtctggtgctccaagatggcaagatatgcttctgtgatatctgacatcgtaagaaattgagttcctgaagaatatttgcttggaaattcacaaaattacattccatcaatgttcggtaagcattattatggtatttattcaacttggttggttctactgtctaaaggttcagacaagttagcaaaactttatgtgacccactattatatgatgttacaacatggagaatattgtcgcctcaagaaaggaaacaccaacaatcattcttccttttttgatta

SEQ ID NO: 34061 - DNA, 415 bp, Zea mays
  Clone ID: LIB3059-062-P1-K6-C7
cccgcaatcagatgcaggtgggcgctgtgggcgggaggcaagtgtaccagaacgtcctccacgctatctactgcatcctcaagaaggagggcgccggcggcctgtaccgaggtctcggccctagctgcatcaagctcatgcccgccgccggcatcgccttcatgtgctacgaggcgtggggggaagatcctcgtcgacaaggaggatgaggaggaggaggacgaagccggcggcggagaggatgacaagaaaaaggttgaatgatcaaagttcttggccaagaaggtagcaatgtcgtgaagcgtacgtgaactggaaacggatggacaagtatatttggagtttgatgtggtgtttccggatcgtgtgtttgtctcagattaaaaaaaacaatattttgaagtccaattaattc

SEQ ID NO: 34062 - DNA, 272 bp, Zea mays
  unsure at all n locations
  Clone ID: LIB3059-062-P1-K6-C8
ggccaacttcccgggtcgacttagcgtccggacaaatttaacagtgttctaccaggggcgagggttggtaatgccctcttttagattgcttatgagttatagttcaataatgaagttttttggatgaaaaaaaaaaaaaaaaaaaaaaaaaaaaaaaaaaaaaaaaaaaaaaaaaaaaaaaaaaaaaaaaaaaaaatttaaaaaaaagggagttgggagnggcnncctttcncaatcaaaaacaaatnttctaaatcncaacccncccccct

SEQ ID NO: 34063 - DNA, 458 bp, Zea mays
  unsure at all n locations
  Clone ID: LIB3059-062-P1-K6-C9
cccactcttccgaatgcgtttattatgccacagtgctcacttgctccnagtgccattattccacagttcctccctccagttacttcaatgggcttcgaacacccagctgtgcaagcctataggctacaacaagcgcttgcggcgagcgtcttagaacaaccaattgcccaattacaaggggatccttggcacatctaaccatataaaccatcncaacgcancagcaacaagcactgagccacctagccgtggtgaaccctatcgcctacttgcaacaacagctgcttgcatccaacccacttgctttggcaaacgtagctgcataccaacaacaacaacagttgcaacagtttctgccagcgctcagtcaactaaccattgtgaaccctatcgcctacctacaacagcaacaacttctttcatctaacccgctccctattggcaatgcacctacatac

SEQ ID NO: 34064 - DNA, 112 bp, Zea mays
  Clone ID: LIB3059-062-P1-K6-D1
ccgggtcgacctacgcgtccgcggacgctttggcgagtggtggtctgcactcgtcgtaatgtcgtttgcctaaactgattttgatggaacaggaaatcttgctggtcttgcc

SEQ ID NO: 34065 - DNA, 294 bp, Zea mays
  unsure at all n locations
  Clone ID: LIB3059-062-P1-K6-D10
gtccggccatcatttagccacctagnccggaagaggaggctgtcgaaaacttacaacaacanctgcttgcatccaacccacttgctttggcaaacgtagctgcataccaacaacaacaacagttgcaacagtttctgccagcgctcaatcaactagccatggngaaccctatcttttacctacaaagttgcaactnctntcatctatcccnctcaatataaacaatncacctacatacctncaacaacanntnttncaacaacanttnctncaacaaattttaccanctcttac

SEQ ID NO: 34066 - DNA, 292 bp, Zea mays
  unsure at all n locations
  Clone ID: LIB3059-062-P1-K6-D12
cggactttgggtctcnattttcaatagatacantcctagatttcttctattatatgtttgcggagatactcccttctgcgctggttctcttcgtccttcggaagcttcctcccaagcgggtatcggcgcaataccaccctattaactagggagttctttttttttatgatgggggagtcgaagaactccttataatctnnaactaaaaaaaacctacatccnnttntattnctntaatattttatnnaaacatcccacnnttnncaanatccatcatcaccatcatnctcta

SEQ ID NO: 34067 - DNA, 603 bp, Zea mays
  unsure at all n locations
  Clone ID: LIB3059-062-P1-K6-D2
ccgggtcgacctagcgtccgtgagatctacaagcaacatagaaagtggaatccagtagcaacaacagagcaacaatggcgaccaagatattttccctccttatgctccttgctctttctgcatgtgttgctaacgcgacaattttccctcaatgctcacaagctcctatagcttcccttcttcccccataccttccatcgatgatagcttcagtatgtgaaaacccagctcttcagccctataggctccaacaagcaatcgcagcaagcaacatacctttatcacccttgttgtttcaacaatcgccagccctatctttggtgcagtcattggtacaaaccatcagggcacagcagctgcagcaactcgtgctacctgtgatcaaccaagtagctctggcaaacctttctccctactctcaacaacaacaatttcttccattcaaccaactgtctacactgaaccctgcttgttatttgcaagaacaactattaccattcaaccagctagctactggctactttaagcaacaacaacttnttcatttaaccaattggccgnactgaaccccgttgttattttgcagcanaaatactacttaca

SEQ ID NO: 34068 - DNA, 483 bp, Zea mays
  unsure at all n locations
  Clone ID: LIB3059-062-P1-K6-D3
cccggtgtcgactcacgcgtccgtacaaatgtacatggtgatccaagctgaacctgngagttgtcatcccgaggaaagaagggcnactgggggcattactatcaagaaaaccggcatgtccttgattattggtgtctacgacgagccaatgactccagggcaatgcaacatggtggtggagaggctcggttattacctgatcgagcagggcttctaaaagttcgtcatgttctgttttggtcatttgggcaccaaagtttgcgcctcatttggttctgtaatccgngagctcgtgcatgtacttggcgtattgcatgcagtgaataatttagcttgggtttgtttgttgggggcagtgttggggacggatttggattggggtttatgcttggcattccgtcgtatcgaaactcagctgctgtttcgctgagtaatgtacatttccctggtaatggtacttgtggactctgatgcttttatggg

SEQ ID NO: 34069 - DNA, 385 bp, Zea mays
  Clone ID: LIB3059-062-P1-K6-D4
cccgggtcgacctacgcgtccgtctcgactttcagcttccatctgccggggatgcgtttgctgaggcaaatgctgaggactctggtgctggtcctggaacgaaggattatgtgcatgtgcgcatccagcagcgcaacggcagaaagagtctgactacagtccagggtctgaagaaagagttcagctataacaagatcctgaaggatctgaagaaggaattctgctgcaatggtactgtagttcaggacccagagctaggccaggtcattcagctccaaggtgatcagcgcaagaatgttgctactttcctagttcaggctgggattgcgaagaaagagaacatcaagattcacgggttctaagggacctgtaatgcttgtgccct

SEQ ID NO: 34070 - DNA, 536 bp, Zea mays
  unsure at all n locations
  Clone ID: LIB3059-062-P1-K6-D5
ccggttcgactcagcgtccgggcagttttatgacagtgagtacgggtcgagaggtcgataacacanggcgccgccgacaggaagctgctgagtagcggcacaatcctcctccggtgcacgttcgtcgggggcgacgacgagcgcggcggcttcaccggcgagcagctcaggtacccctgcaagctgaggcggcaggggggggccnantgcnggatgcaccgcggcgagcacggcggcaggcccggcgcgggcgtcagggtcagggacgaggacctgcccccgcgcaagcgggccgtgttcagggcgcggggagagttgcagccgatggtgatgggcctcggcggcggcgaggacgagggcgacggcgagagggaggggcaggcctgggctaccgcccacgccgtcgccaaggggaagcggggggccaggagacggcccgcggcgtggcgcgagctttgaaaccttgaatatataatgctgggaagccaaaagtcgaattggcgctgccactgtgttttgcacatgggctgtccact

SEQ ID NO: 34071 - DNA, 327 bp, Zea mays
  Clone ID: LIB3059-062-P1-K6-D6
atcaagatggcaaacgtttcttgcttgtgctccaaggtcaccaaagaaactgagaaggttgtgtgcatggagaaggttgtgtatgttgctgagcagtgtaagaggccatttgagcatggcttccagtgcggaagctacaaggttccagcaaactgatgatatcgcaagagggaagcgcttgacgtagtctttagatttcaattgttgcagccgatcaaccttcttagggttgtataatatgaagtcaatgttgagactaatgtgaggtgggagaggcctattgatgcatcaaaagtattatgagctaataataaagccttctccaca

SEQ ID NO: 34072 - DNA, 115 bp, Zea mays
  Clone ID: LIB3059-062-P1-K6-D7
tccagccaggccgataagccactgcgtcgtatagcggtgtcgttcgaggagctcgccgccgtcgctaagcagcagcccgcggtgcccatggacgctggggccttctctctctcct

SEQ ID NO: 34073 - DNA, 381 bp, Zea mays
  unsure at all n locations
  Clone ID: LIB3059-062-P1-K6-D8
ggaaaaaacagatgtatggtggggggtaaaaatcatntantgtttgttgtttattcatttgttgcacacctgttaattcaccatggaagtcttcaactctatatagttagccttagcccatgctgacaggacatcacatatctggaagcctggctaccaccattcagggggggtggctnatntnanccctntttccttcttnacacaacaacanttntttccnntctacctncacnctncncctaaccctttcaccctcttacaactncaacaattncttccattcaaccaacttnctttnacaaacccaacaacnttctaccaacaacccatcattnncnntcccctcttttaaattncttatnanttatanttcaataa

SEQ ID NO: 34074 - DNA, 408 bp, Zea mays
  Clone ID: LIB3059-062-P1-K6-E1
ccgggtcgacctacgcgtccgcccacgctttcgctgacatggtgattctaggcaaagcactcggtgctggagttgttccagtcagtgcagttcttgcagacaagggtgtcatgctgtgtatcagaccaggggaacatggaagtacattcggtgggaatccgttagctagcgctgtggcagttgcatcactgaaagtgggcagagacgaaggtcttgttgaaagggctgcaaagttaggacaggagtttagggaccagttacagaaggtccagcagaaattccctcaaatcctaagagaagtgcgcgggaggggtttgctgaacgcagtggatctaaacaacgacgcgctttcttctgcttctgcatatgacatctgcatcaagttgaaggagagaggcattttagcga

SEQ ID NO: 34075 - DNA, 87 bp, Zea mays
  Clone ID: LIB3059-062-P1-K6-E10
aaccccatacacctgtttcccctggatttgcctttgtcagcatggacactgttgaagaagcggagcgttgcataaagtatcttaatg

SEQ ID NO: 34076 - DNA, 437 bp, Zea mays
  unsure at all n locations
  Clone ID: LIB3059-062-P1-K6-E11
cgtccgtgccctttgccttcgtcgtcaacgtgtggggcgcggctcaaaataatnaccaacngattgctgaagagcgttgagcaccgcgtggtgaccagctcgactctggcgctgacggcggtggccacattcatcatgcccaccccagactgcctcatcggcccntcaattttttcctcggggtgtggggccaccntnctacctcaccatcaaaataaatnacttcatncncatttacaacactttcaancttttntcatccatcaaccanactacanatcttaanaatttccanaaaaaaatatnancatattatatttacccnaaatcctccccccancannnntcctccaanattttattcctttaataaaacctaccaccaatttatntcaancaataaaacctacnaacnacaacttntaataatattatta

SEQ ID NO: 34077 - DNA, 492 bp, Zea mays
  unsure at all n locations
  Clone ID: LIB3059-062-P1-K6-E12
cccgttcgactagcctcccccattttccgcccagcntccgggggggggatgaacttccanatctcttntancggaagcaaanaaagcagcatctaaagccaccgatgatagtgctggtcaagaggctttgaaaaatgtatttcgtgcagctgaggcatgtgaagaatttagtggaactttttttaccctagggggggctcttnatgatctttgtggcctaactaacaaaaatgtgggtcccttacctggttatattgaagatgctgttaaagctgcatataatcgctacatgacatatctggagtcctttggtcctgaggaaaactatctaagaaagaaggtggagactgatttggggacaaaaatgatacaccttaaaatgcgatgcagtggcataggttctgagtggggaaagatctccctgattggcacctcanggatcttaagttcctatgttgagctaaaggcatgatgggacctctgcaagtaacc

SEQ ID NO: 34078 - DNA, 599 bp, Zea mays
  Clone ID: LIB3059-062-P1-K6-E2
cggacgcgtgggcggacgcgtgggcggacgcgtgggatcatttgggacaaggagattgaagtagctgaggggcatgctaagaagcctcttgaggaggtgattcaggctgcaacgaaagcccctccttcaagagacttctatggcgctttagaagctgcctacaagcgtaatggggtgcctgcattgattgctgaggtcaagaaagcatccccgagtaggggtgtgctcagggagaactttaatcctgttgaaattgctcaagcttatgaaaagaatggagctgcatgtttgagcattttgacagatgagaagtactttcagggaagctttgataatcttgaaaaggtgcgcagctcaggagtgaagtgccctcttctctgcaaggagtttgtcattgacaagtggcaaatctataatgctcgctctaagggtgctgatgcaattctactaattgctgctgtgctaccagatcttgacataaggaaatttcttcagatttgcgaagagttgggaatgacagctcttattgagggtcatgatgaaagagagatggaacgtgtgcttgagataaatggagttaagcttattggtatcaataa

SEQ ID NO: 34079 - DNA, 138 bp, Zea mays
  Clone ID: LIB3059-062-P1-K6-E3
tagttgtaagagggttgcggggttagccgcaaactgctggtagaaaggcagcaactgttgctgtgtcaagaaggaagcacggtttgctgcagctagctggctaaatggtagtaattcaataataaagttttttggatg

SEQ ID NO: 34080 - DNA, 360 bp, Zea mays
  Clone ID: LIB3059-062-P1-K6-E4
ggagcagttgagccctgctttgacagtggctagaggttttgctttctatctgctccctgcttactgatcccaacccagacgaccctcttgtccctgagattgctcacatgtacaagacggatcggcctaagtacgaggcgacagcccgcagctggacccagaagtacgccatgggatggggtgttcggcgttactggctaaatgcagacgattgtggtgttgcccatgaaactgttatcggggacgtatgttcttctggtccttgtgcattctccgatccatcttctaggatccgagttctagtccaacattaacctaccattgccttgggtaatgagatgacttgtgcttgctgtggtt

SEQ ID NO: 34081 - DNA, 558 bp, Zea mays
  Clone ID: LIB3059-062-P1-K6-E5
cccgggtcgatccagcgtccgcccacttttccgcggacgcgtgggctagcggcgtagaaagcacaatagtgtaccaacaatggcagccaaaatattttgcttccttatgctccttggtctttctgcaagtgctgctaccgcaaccattttcccacaatgctcacaagctcctatagcttcctttcttcccccatacctgtgaggagcggtgtcttcagtatgtgaaaacccaattcttcaaccctacaggatccaacaggcaatcgcagcaggcatcttacctttatcacccttgttcctccaacaaccgtcagccctattacagcagttacctttggtgcatttgttggcacaaaacatcaaggcacaacaactacaacaacttgtgctaggaaaccttgctgcctactctcagcaacagcagtttcttccattcaaccaactggctgcattgaactctgctgcttatttgcaacaacaactaccattcagtcagctagctgctggctacccccagcaatttcttccattcaaccaactggcagcattgaactctgc

SEQ ID NO: 34082 - DNA, 566 bp, Zea mays
  unsure at all n locations
  Clone ID: LIB3059-062-P1-K6-E6
gcttattgtacttaccttttttccaaaaattattattttctctctgctagcttccaactttgcacttttcttgagaaatatgttttccatctgaggatattatagtttcctaaacaaataattctcctctgttgtttagaaacttcccagtataagtatttttcagtttatataaaaacacattaggtattaagaatgttattttaattgagaaaaaagttcttattatttaaagttaagagggtcgggcatgagcatgatgtcattaagccttcaagttgattatctctataacaaatcagataaattttgatattttccaattgctactgctttaaaagcctccatgctatattaaactgccatgctgatcttgtttatgttggagtttcaagagacctactgaaccttactactttgtacaaactattttaatatcctgctctaactatgattttaccttttccatattttacagtgactcaagtgactcanatgatgaatatttggatacatgcatatgctcaatcatgtaaatacatcttgcacaggtggattctatcatg

SEQ ID NO: 34083 - DNA, 383 bp, Zea mays
  unsure at all n locations
  Clone ID: LIB3059-062-P1-K6-E7
ccgggtcgaccctcgcgtccgcgaagagtttctgaggcctatcgcctgacccggcggcgcatcagccatcagccatggcgatggccgctcgcctcgtctcgcgctcccgtcagctacattcggttcaagcagcttttgcgaatggaggtgccactcaagttcgctcctttgccaaggatgcagctccatctgaccggggtgggtggggntggnnatnatctcctnaaaggcatattctttnaggtaaagaagaagtttgagacagctctcggcgtccttaaaaaggaaaagatcactattgatccagatgacccagcggcaggttctcaatatgctcaagtcatgaagactgtaagggaaaaggcggatcttctttctgattc

SEQ ID NO: 34084 - DNA, 511 bp, Zea mays
  unsure at all n locations
  Clone ID: LIB3059-062-P1-K6-E8
tgaaaccactggcggagtgttgatgttcgtttccactccagatccaattggcaacaagtactatcttggccctgctcctctgcaggatatggcaaggcaaattgctacagccaatggccctactggctataacaggtaatccctattatattctcagtagggcggggggggtgtaatangnattacctnttctcaatgaaaaangcattanccaacattanccacnaanatnattcnatcatanancttncaaacnacgtnangaangtgctcaacagaacaaaggagaccaagatcactgctgccaatgcttccatgaaatcacatgcccntcttgtgcacctgtccgcgcttccagaagcaccgttgtggactcnagatagccacctctactcggaattaactttcagctcttgcatgtttgtgggtttggccatcatgtactgattttcccttttcaacanttgtccngaggctttaatcnctggattaaaaaaaaaaaaaactaaaa

SEQ ID NO: 34085 - DNA, 227 bp, Zea mays
  unsure at all n locations
  Clone ID: LIB3059-062-P1-K6-E9
cccggttcgactcagcgtccgcccacttttccgctcatcttttgcgggctggggtcccctaactctcacccatggcttcngcggcggcggcaactcaggtggggacttacttcctgcggaactactacaacctgctgcaacaaacccccgatgtcgtccaccagttctacagcgaagccagcaccatggtccgcgtggaggggctcaccnncaacaatactncaaca

SEQ ID NO: 34086 - DNA, 325 bp, Zea mays
  unsure at all n locations
  Clone ID: LIB3059-062-P1-K6-F1
ccgggtcgacctangcgtccgcccacccattcgcactctcgcaagcgctgcgctcgctacctcgcttcgcattccattcgaggagagcggtgagaggggaggaaaggcaagatgttcatcgagagcttccgcgtcgagagcccccacgtgcggtacggcccgacggagatcgagtcggagtaccggtacgacacgacggggggggtacacnagggcaaggacggcgcctcacgctgggtcgtccgccccaagtccgtcaagtacaacttccggaccagaaccgccgtccccaagctcggggtgatgcttgtgggggggggaggca

SEQ ID NO: 34087 - DNA, 246 bp, Zea mays
  unsure at all n locations
  Clone ID: LIB3059-062-P1-K6-F11
cgacctacgcgtccgttcaaccttctggctgcatttaagaaactgatatggctaaaaataacancaangtttcctagcacaagttgttgtanttgttgtgccaaaatttttgcttccttatgctccttggtctttctgcaagtgctgctaccacaaccattttcccacaatgctctctttttcctagagaatgtttggggcccccatacttctcaccaaaaaaaaaaaacannannnnaaaaccca

SEQ ID NO: 34088 - DNA, 148 bp, Zea mays
  unsure at all n locations
  Clone ID: LIB3059-062-P1-K6-F12
ctacctagccgttatactcctataacggtgttaagcaataaagtaccatacattatgatgtttgtactaaaaaaaaaaataacaaaaaaaaaaaaaaaaaaaaaaatttttttaaaaaaaaagaagttttggnnnnnnnatatttntt

SEQ ID NO: 34089 - DNA, 364 bp, Zea mays
  unsure at all n locations
  Clone ID: LIB3059-062-P1-K6-F2
cccgggntcgacctcacgcgtccgaaaaaaaataaaaaaaaaaaaaaaaaaggaaaaaaaaaaaaaaaaaaaaaaaaaagaaaaaaaaaaaaaaaaaaaaaaaggccacatgttcaagacccagtagagggagatatttctgcctccctatcgggggtcgcccccaatggcctttggtcgcagaccatctttgctgctggggtggggggggaataaatgtgaacggggcccctggacgctggatccatgctggttttggacacgtggtctttttgtgttaaacttatctgctaccgtcctgtaacgaattcactaagttctagttcttttgggctttgttaaaaatataaacaatgaggtttca

SEQ ID NO: 34090 - DNA, 539 bp, Zea mays
  Clone ID: LIB3059-062-P1-K6-F3
ggaacataagaagcacaaacatcggcataaggatcggagtaaggacaaagataaagacaaagacaaggataagaaaaaagataaaagtggccatcatgaaaagaagaggaagcatgagggaacagaagattcagtagatgtgcataagcacaagaagagtaagcacaagagctccaaaaccgatgagatggggaatggagttagttaacacttcctagctctacctccaatccttttaatttgctgttaaaacttaaaaggagacagacggtctctgctatcaaaaccctgtgcagaatagtgtatgcttcgtcgccgaaggtcctgtgagaagaaacaccttcggaaggccaaaaacacaatgctgaagctatcaatcagggagcttcgtagcgtatctccagatgcaccgacttaaagatgaaatgaccaatcggtccatgacaacctgtgttttgattgtaaccatttgtaaagggcatgaatgtaattttctacaggctgcgttccgtgtctataaatagatgaacagtaccccc

SEQ ID NO: 34091 - DNA, 411 bp, Zea mays
  Clone ID: LIB3059-062-P1-K6-F4
cccacgcgtccggactattgtagctggtgatgcagtgctgtcacccatggcgaagtgcagcagcttccaaggattattctggttgctttccatgattcttctagcatcctttgttgctcatgcacgcacaacaagtgggcacaccaaagaggacagcaatgctaggaacatgaccatgaccaaggcgagggcatcgggcaacatacttgttagccgtaatgaccaccggccatgctatctagattccggtcttaatgagtacctctgcagaaagactaataagtgctataagagcttggtgctctgcgtggcgagttgtcaaccatcatcatgaattcatgatactgcggagacatcatgatactgcggagacacacagcgagagatgaggctagctagatgctgtttcac

SEQ ID NO: 34092 - DNA, 519 bp, Zea mays
  Clone ID: LIB3059-062-P1-K6-F5
cccacgcttccggcaacatagaaagccaatagtgtaccaacaatggcagccaaaatattttgcttccttatgctccttggtctttctgcaagtgctgctaccgcaaccattttcccacaatgctcacaagctcctatagcttcctttcttcccccatacctctcaccagcggtgtgtggggtatgtgaaaacccaattcttcaaccctacaggatccaacaggcaatcgcagcaggcatcttacctttatcacccttgttcctccaacaaccgtcagccctattacagcagttacctttggtgcatttgttggcacaaaacatcaaggcacaacaactacaacaacttgtgctaggaaaccttgctgcctactctcagcaacagcagtttcttccattcaaccaactggcttcattgaactctgctgcttatttgcaacaacaactaccattcagtcagctagctgctgcctacccccagcaatttcttccattcaaccaactggcagcattgaactct

SEQ ID NO: 34093 - DNA, 588 bp, Zea mays
  unsure at all n locations
  Clone ID: LIB3059-062-P1-K6-F6
caacaatggcggccaagatattttccatccttatgctccttgctctttctgcatgtgttgctaacgcgaccatttttcctcaatactcacaagctcctatagctgcccttcttcccccataccttccatcaatgaccgcttcagtatgtgaaaacccagcccttcaaccctacaggctgcaacaagcaatcgcaacaagcaacttacctttatcacccctgttctttcaacaatcgccagccctatctttggtgcagtcattggtacaaaccatcagggcacaacagctgcagcaactcgtgctaccagtgatcagccaagtagctctggcaaacctttctccctactctcagcaacaacaatttcttccattcaaccaactgtctacactgaaccctgctgcttatttgcagcaacaacaactactaccattcagccagctagctactgcctactctcagcagcaacaatttcttccatttaaccaattcgccgcactgaacccctctgcttatttccagcancaaatactactaccatttggccagctagctacaacaagccccgtttccttcttgacacaacaac

SEQ ID NO: 34094 - DNA, 317 bp, Zea mays
  unsure at all n locations
  Clone ID: LIB3059-062-P1-K6-F9
cttcctncacacagccgcaggcnagctcgcggcgctgatggcggcccaagtagcgcagcagctgacggcgatgtgcggcctgcagctgcagcagccaggtccctgccctttcaactcttctnccgggggggggtactactnannaaactatntactnnaaaaataatntaatnnaacccctnnctanctacctanctcnctantttactcatttaacnncnatnantaacctantntcacccatcaccatnnntnncannnnnaccaatnacctnaataaaccatnnaaatnnaaannaataatatataannaaaaa

SEQ ID NO: 34095 - DNA, 252 bp, Zea mays
  unsure at all n locations
  Clone ID: LIB3059-062-P1-K6-G10
cccgggtcgacctagcgtccgggagagtttcaatgcaagctctcagtggggcggggcatataccaanncacttnccaccagtcatgccattgggtaccatgaacccatgcatgcagtactgcatgatgcaacaggggcttgccagcttgatggcgtgtccgtccctgatgctgcagcaactgttttccttaccgctgggtgtggggccannnatnatnccacanatnataacacctaacatnatntcaccat

SEQ ID NO: 34096 - DNA, 223 bp, Zea mays
  unsure at all n locations
  Clone ID: LIB3059-062-P1-K6-G11
agactcataagaccaatgcgtatttcaaacgtttccaagtgaaattcaagagaaggcgggctggcaagacagactacagggccaggataaggctgattaaccaagacaaaaactttacaacacagtggagtcanatttnntnttcnatttaccaacaaaaacatcactncccaaatcatatctnctantatancnnntnatatnnttcttncttctncctact

SEQ ID NO: 34097 - DNA, 576 bp, Zea mays
  unsure at all n locations
  Clone ID: LIB3059-062-P1-K6-G12
caacaatcaacatagaaagtggagtgcgggggcgcaatagagcaacaatggagaccaagatattttccctccttatgctccttgctctttctacatgtgttgctaacgcgacaattttccctcaatgctcacaagctcctatagcttccctttttcccccataccttccatcaatgagatggtcantatgtgaaaacccanctcttcaaccatatangcttcaacaagcaatcgcagcaagcaacatacctttatcgcccttgttgtgtcaacaatcgccagccctatctttggtgcagtcattggtacaaaccatcagggcacaacagctgcagcaactcgtgctacctgtgatcaaccaagtagctctggcaaacctttctccctactctccgcaacaacaatttcttccattcaaccaaatggctacactgaaccctgctgcttatttgcagcaacaactattaccatttagccagctagctactgcctactctaaacaacaacaacttnttccatttaaccaattggcccnactgaaccccnnttnttatttncancaacaaatactactac

SEQ ID NO: 34098 - DNA, 520 bp, Zea mays
  Clone ID: LIB3059-062-P1-K6-G2
cccgggtcgactcacgcgtccgcgctcttccaactccaacttctgtcttgggccttccaatcggtcaacatatcagctgcagaggacaagacgctacaggtgaagaagtaatcaagccttatacccctactacattggattctgatcttggatattttgagcttgtcataaagatgtatccccaagggagaatgtcccatcatttccgcgagatgaaagttggtgattatttgtctgtgaagggacctaagggccgattcaagtaccacgttggccaagtgagggcatttggaatgctggctggtggatcaggcattactccaatgtttcaagttgccagagcaattcttgagaaccctaatgacaacaccaaggttcacttaatttatgctaatgtcacatatgaagacattcttctgaaggatgagctggacgacatggccaaaacctatcctggccggtttaagatctactatgtgttgaatcagccttctgagaactggaacggtggtgttgggtt

SEQ ID NO: 34099 - DNA, 229 bp, Zea mays
  Clone ID: LIB3059-062-P1-K6-G3
cccgggtcgacccagcgtccgcggactcgtgggcggacgcgtgggatcgccagcaccccaggggaaggtggtggctgggcaatgcaccagcctaatttttccatagctatatgtctgctttgtgtggccagtgatattgccgtgagtatttttggatcctattcgagtcgaatgtaccagtaccagagttaatttgctttaattcgaaacaccgttccggttggaattc

SEQ ID NO: 34100 - DNA, 201 bp, Zea mays
  Clone ID: LIB3059-062-P1-K6-G4
ttcatgttccatttttggccttctagggtttggttttcttgttttcttcctttctggcatatactacaaatatatgtgctgctggtgctgttagtaaatggatctcactcttgggaggatgatacctcagctcgagacgagtgatctgtctgaaagctatttccttgtctgaaacaggaggggtttgcattcttttgtact

SEQ ID NO: 34101 - DNA, 404 bp, Zea mays
  unsure at all n locations
  Clone ID: LIB3059-062-P1-K6-G5
tcccggttcgacttagcgtccgcccattttccggtgtgccgctgacagtcggggggggcgttacctcaccgcctctgccatgttccgcgggaagatgagcaccaaggaggtcgacgagcaaatgatcaacgtccagaacaagaactcgtcctacttcgtggagtggatccccaacaacgtcaattccatcgtgtgcgagagggcgcccannggcctgtccatggcgtccaccttcatcggcaactcgacctccatccaggagatgttccggagggtgagcgagcagttcactgccatgttcaggaggaaggctttcttgcactggtacacgggcgagggcatggacgagatggagttcaccgaggccgagagcaacatgaacgacctcctgtcggagtaccagc

SEQ ID NO: 34102 - DNA, 591 bp, Zea mays
  Clone ID: LIB3059-062-P1-K6-G6
tgtaagtgaattatgtgctgagacgggagccgagccaggaggatgccctcgcgcgaattgaaaagctttcagaagtaaacccgatgcttggcttccgtgggtgcaggcttggtatatcgtaccctgaattgacagagatgcaagcccgggccatttttgaagctgctatagcaatgaggggccagggtgttcaagtgttcccagagataatggttcctcttgttggaacaccacaggaactggggcatcaagtgactcttatccgccaagttgctgagaaagtgttcgccaatgtgggcaagactatcgggtacaaagttggaacaatgattgagatccccagggcagctctggtggctgatgagatagcggagcaggctgaattcttctccttcggaacgaacgacctgacgcagatgacctttgggtacagcagggatgatgtgggaaagttcattcccgtctatcttgctcagggcattctccaacatgaccccttcgaggtcctggaccagaagggagtgggcgagctggtgaagcttgctacagagaggggccgcaaagctaggcctaacttgaaagggggcattt

SEQ ID NO: 34103 - DNA, 159 bp, Zea mays
  Clone ID: LIB3059-062-P1-K6-G7
cccgaggttagcatgcatttattgacagagagggggaagacacaactcaacaagaaacatcggcaaagcaatcgaccctgtcattgacctcgacgaggaaacctacgctagtgttagtaccgtctcagagcttgctggccactgctgcgctagggaagc

SEQ ID NO: 34104 - DNA, 476 bp, Zea mays
  unsure at all n locations
  Clone ID: LIB3059-062-P1-K6-G8
ccgtttcgactcagcgtccggngatttttcccaaaatgagccttaagttctgctgacgtataatagncatttcnttgcttgaaaaggttggattttgaagagatgaaattcagtttgtattttctaggttacgaggatgtgaccttagcccctgatgatcatatcaagcggactgaatggactttttttcaaaaaggtgggtggagctcacccacaactgnngcacggaaaatgaccctnaattcaaaggttaccataatgggaactcaaaccctcgtggttttggtcatataggagtaactgtggatgatgtccacaaggcatgtgaacgctttgaacgtcttggggtttaatttgtgaagaaacctgatgatggaaaaatcaaaggcatcgttttcatcaaagatcctgaatggttctggatcgaaatatttgaccagacgattgggaccggaacttcttcaacatcatgatga

SEQ ID NO: 34105 - DNA, 405 bp, Zea mays
  Clone ID: LIB3059-062-P1-K6-G9
cccacgtcttccgcaaatatacactacgacgtggctaatgtcacatatccacaaccaggtgatctcaagtaattaacagaaaatatattccatcattgaaaatgagttccgttgttttgggtgctactggtagggagaataagacatcatggcctgaggtggtgggcatgtccatcgggggggcaagagagatcattcttaaagacatgcccaacgctaacattcaagttctaccggttggctcgcttgtgacccaagactttcgccctgatcgtgttcgcatcttcgttgatattgttgcctagactccaacagttggctgacaaggatatgccttatctataggccaaataaacaaagcctacttttatgtatcatggctaataaatcctacatttcttggtt

SEQ ID NO: 34106 - DNA, 506 bp, Zea mays
  unsure at all n locations
  Clone ID: LIB3059-062-P1-K6-H1
cccgggtcgacctacgcgtccggcaatttttgcaagcgtgttttcactgacattgatcttccagcgattgattccgacaaaactgtgatggtcacgtttaagcatgatgacaagttaccagaaaatgtggaatgtggcttccagtgtgcacttctctatactactgtatatggacaaaggaggatccgagtcataaacctgtcactttcatgtacaaatttgcttgccaatcttttccggtatgctgatttggagacacagtttgcatgcttcctgaagcaagctgctaatggcatcctgacctcttcattacctcgtattcgggatgaagcaacaaacacatgcataaatattcttcaatcttaccgcaaacactgtgcatntgtaacctcattggggcagttgattctcccagaggctctaaaactgctgcctttatatactctggcactgggaaaaagtgtaggcttgagaaccgatgggcgattagatgaccggtcctattg

SEQ ID NO: 34107 - DNA, 353 bp, Zea mays
  unsure at all n locations
  Clone ID: LIB3059-062-P1-K6-H10
cgacctacgcgtccggtcggacttggtgcaggtggacgaggtggagaggcgacaacaacaacaaggccaacgcgctgagcagctacagcaagggacacacctacgccttccagctcaaggacgccaaggactactacttcatctgcagctacggctactgctacaacggcatgaagctccacttcacagcagagtgatgtgctcatcctcctcctcctcctcataaaaaccntccnnatctnactcctcctcctcctcttacaacnactcttcctccccctcnccncccnccaaaaantccaannccaaaaccancnccncnccnnccacctcactcctcncttccacnccca

SEQ ID NO: 34108 - DNA, 616 bp, Zea mays
  unsure at all n locations
  Clone ID: LIB3059-062-P1-K6-H11
cccgttgtcgacctacgccgtccgatattatttgagaccaacaagcaagagagggagggggatccaataacaacaacanancaacaatggcgaccaanatattttccctccttatgctccttgctctttctgcatgtgttgctaacgcgacaattttccctcaatgctcacaagctcctatagcttccctttttcccccggggtgtggtcaatgatagcttcattatgtaaaaacaaagctcttcagccctataggctccaacaagcaatcgcagcaagcaacatacctttatcacccttgttgtttcaacaatcgccagccctatctttggtgcagtcattggtacaaaccatcagggcacagcagctgcagcaactcgtgctacctgtgatcaaccaagtagctctggcaaacctttctccctactctcagcaacaacaatttcttccattcaaccaactttctacactgaacccttctgcttatttgcagcaacaactattaccattcaaccagctagctactgcctactcttaacaacaacaacttcttccatttaacccaattgccccactaaaccccccttcttatttgcaacaacaaatacttctacca

SEQ ID NO: 34109 - DNA, 426 bp, Zea mays
  unsure at all n locations
  Clone ID: LIB3059-062-P1-K6-H12
cctttcgacctangcgtccgattgattccaactagcaacatagagagggagaggtgtaccaacaatnnncanccaaaatattttgcctccttatnctccttnntctttctncaantccttctaccncnaccattttcccncaatnctcacaacctcctatancttcccttcttcccccnttcttttttccancgggatgttgggatntnaaaactcattcttaaaaaaatanatccaacanncaatcncanctnncatcttacctttatcacccttnttcctccaacaatcatcanccctattacancanntacctttnntccatttattnncacaaaacatcannncacaacaactacaacaactnnncctancaaaccttncttcctactctcancaacancannntcttccattcaaccaact

SEQ ID NO: 34110 - DNA, 564 bp, Zea mays
  Clone ID: LIB3059-062-P1-K6-H2
cccacgcttccgcccacgcgtccgcccacgcgtccggtcgcattgagccacccgggtcagttgtaggataggtaaaaaaacaaaacaaagttttgcccatattccattaatctagttgacatcaacgaaatcatcatgagtaactttgcgtgtatgtgatacttgctaggcactctttggtacaactaggttacattccagcttccactcttcgacatgcagaatctcacctgcaatggaactctttcagcacttctcgcggaaggggagatgtattaaccgtcctagttccagaagggcagtaggatcttttggcagtaccagccgacagacaacacctagctttcctcagctcttcagctcttctgaggcagccgaaggtatacaatgtgttgtcagaatatcttgagttgcagcctttgcagttttcgtctccaggacaaccacctgatcgaagtccagatcaaaccttaagaatgcttcattgcactcttccaccatggtcgctaggtgctttaaatttttaaccggggtgccattgaaggcaagaacctgaatgttgac

SEQ ID NO: 34111 - DNA, 660 bp, Zea mays
  unsure at all n locations
  Clone ID: LIB3059-062-P1-K6-H3
cccgggtcgactcacgcgtccgcccattcttccgcggacgcgtgggccgccgccctacctcgacccgcatcccgccgactcctacacctacacggtcttccttgtccccgttcgcctccgccgcggcctctgtcgcggcggccgttgcatcgtcccctgcctcaccgttctcttcctcctcgcgctcgcgggcttcctcctgtggcccgcggacccggacatctccctggcccgcctccacctagcgcacgtctccgtcgtggcacgccctgccgtcgccgtcactatatccgccacgctcaaggttcgcgttcgcaatcctgacctcttcgcgctcgactacacccgcctcgacgtcgctatcggctaccgcggtgcggggcttggccgggtaacatccggcggcggacgggtccgggcgcgcgctgtctcgtacgtcgacgccaacctgcagctcgacggcatacgcgtcgtcgaggacgcgatgtacctgctcgaggacctcgcgcaaggatccgtgcccttcgacaccatcgccgaggtcgagggccacctccacttccttttcctcagcatcccgggcaaggggaggaattcttggggtatgcatatnaatccaaacaccaaacccatagacatnagggatggtatcctgagtga

SEQ ID NO: 34112 - DNA, 434 bp, Zea mays
  unsure at all n locations
  Clone ID: LIB3059-062-P1-K6-H4
cccggttcgacctacgcgtccgcccacgcttccgcccacncntccgggggcagggggcgcaccaacactnaccgggcgtgccgcgagggccggcgccccgggaaaccctggagcgaggaagagcacaggctcttccttcaggggctggagaagtacgggcgcggggactggcgtaacatctcgcgcttcacggtgcggaggggggcgccnncncatgtggccagccactcccaagaatacttcaaccggcagctcaaccccgccagccggaactccaagcggaagagcatccacgacatcaccaccccttgaccctggccgccgacggcgacgcgcgctccctgcttccaacaaaatccgacagccactcatttcatctcgagatcagaatagaagaaacaagtaggcattactcgtagtccatgacaatagct

SEQ ID NO: 34113 - DNA, 385 bp, Zea mays
  unsure at all n locations
  Clone ID: LIB3059-062-P1-K6-H5
cccggttcgacttagcgtccggcggctttttgtcctcccctggcctgctggggcgcttctggcgagcagtgtgttgtgttgtgtgggtgccgcacgctagcaggctagccatgtgccctgctgtgttgtgtcaccatccatctataatcttatccataccccaccttttgtgtgatgcgtgtaccctttcctgatgggggtggccgggagtataaggggggtgtttggttcctctcctaatttttaatcgcgtcagatgtttgaaggctatttttaagtacattatacatgtatactaaaaatcttaggagagcttttagtgaggctctatgcgcanaaaaaaaaaaaaaaaaaaaaaaaaaaaaaaaaaaaaaaaaangnnnnn

SEQ ID NO: 34114 - DNA, 675 bp, Zea mays
  unsure at all n locations
  Clone ID: LIB3059-062-P1-K6-H6
cggcttcccgggtcgactacgcgtccgaagaagtcaaggaagagatccatctganaagcaggagcaaggacgagcggtccggcgaggaagacggcaaggaggaggtcgaggtagagattgaggccaagtttgttgagaaggaagaggtcaaagactcgggtgacggtgcgggaggaaagggtaccaagaagaaggatacaaaggggggggacaagaaaaagaaggaaggtggtgaggattcagggaaggcagaggaagacaagaaggataaagcgaaggattcggagggcaagggccaagtgaagaaggaaaagaaggatggtgctggagacgacggaggcgaggagaagggcaaagaaaagaaagataagaaggacaagggtgagaagaatgacaaggagaagaaagagaagaagaaagacaagggtggagagaagaagaaagacaagggcgccaaggagaagacgaccgatcccgtgaagctcagagcaaagctggagaaggtggacaccaagctgcaagacctacatgccaagagagaagatatcctgaggcagctgaaagagctggaactggaagatggcggcaagggaaaggccaacgaagaggagcctgcacatgtacagactctggaacaaggtggagagagcgtggtcaaagaacagagtcatgtcg

SEQ ID NO: 34115 - DNA, 166 bp, Zea mays
  unsure at all n locations
  Clone ID: LIB3059-062-P1-K6-H7
gtccgcccacgctttcgcaccaaccaaactaatatggggtgcaactaaacatcncntctnctacncctctcctncaagacnaccaatggcttccangaagttcttcntgggtggcaactggaaatgcaacggtactggcgaggacgtgaagaagatcgtcaccgtg

SEQ ID NO: 34116 - DNA, 496 bp, Zea mays
  unsure at all n locations
  Clone ID: LIB3059-062-P1-K6-H8
ggccaaacttcccgggtcgacctcacgccgtccgaacgcattttgcaccaagaaatccgtgggggaggggncgacaggggaattaatggcgtcgtcgtctagcagcagccaccgccgcctcatcctcgcagccgccgtcctgctctccgtgctcgcggctgccagcgccagcgccgggacctcctgcgtgccggggtgggccatcccgcggggggggctcccnagctgccgctggtacgtgaccagccggacctgcggcatcgggccgcgcctcccgtggccggagctgaagaggagatgctgccgggagctggcggacatcccggcgtactgccggtgcacggcgctgagcatcctcatggacggcgcgatcccgccgggcccggacgcgcagctggagggccgcctagaggacctgccgggctgcccgcgggaggtgcagaggggattcgcccccacccttgtcacggaggccgagtgcaacctggccaccatc

SEQ ID NO: 34117 - DNA, 533 bp, Zea mays
  unsure at all n locations
  Clone ID: LIB3059-062-P1-K6-H9
ccctttcgactcacgcgtccgcccacttttccgcttgcaacaacagaggggaggatccaacccacttnctttnncaaacntagctgcataccaacaacaacaacagttgcaacagtttctaccagcgctcagtcaactagccatggtgaaccctatcgcctacctacaacagcaacaacttcttttatctagcccggggggtatgggcaatgcacctacatacctacaacaacagttgttgcaacaacagttgctgcaacaaattgtaccagctcttactcagctagctgtggcaaaccctgctgcctacttgcaacaactacttccattcaaccaactgactgtgtcgaactctgctgcgtacctacaacagcgacaacagttacttaatccactagcggnggctaacccattggtcgctgccttcctacagcagcaacaattgctgccatacaaccagttctctttgatgaaccctgccttttcgtggcancaacccatcnttggtggngccatcttttaaaanacatatg

SEQ ID NO: 34118 - DNA, 159 bp, Zea mays
  unsure at all n locations
  Clone ID: LIB3059-063-P1-K6-A10
cgtccggcccgattctttngccanccttgtagtttgagtggtctacaaaaanaattcnnnccatatttctgccanccagtcattgctggacttggagatgacaacgtaccattcatttgtaccatggactgcctcggtgcaaaggagctggccaaggat

SEQ ID NO: 34119 - DNA, 457 bp, Zea mays
  Clone ID: LIB3059-063-P1-K6-A2
gatatggtgagctccagctacagcttcaccgttatgcaacgggccgcgaatcaagagttgtaactgctcttacactactgaagtcacacctcttcaagtatcaaggccatgtcagtgctgcccttgttcttggtggagtggattgtactgggccacatttacacactgtttatccacacgggtccactgatactcttccttttgccaccatgggctctggttctcttgctgcaatgtcagtgtttgaatcgaagtacaaagaaggccttactagggaggagggaatacagattgtgtgcgaagcaatctgtgctggtattttcaatgacttgggtagtgggagcaacgtggacgtctgggtgataaccaaggggaagacagaatacttgagaaaccaccagtttgccgaatcccaggacttatgcctgtttaaaggggatacagtttcaccaagggg

SEQ ID NO: 34120 - DNA, 408 bp, Zea mays
  Clone ID: LIB3059-063-P1-K6-A4
gtccggactcccgggcccacatctcttgcggtcgtccttcagccgcgtcgcacctcgtggcggtgtacgattcgaagctctctgctcgcaggggaccatggcgaagaactacccaaccgtgagcgccgagtacagcgaggccgtcgagaaggccaggcgcaagctccgcgccctcatcgccgagaagagctgcgcacccctcatgctgggggtggcgtggcactccgcggggacgttcgacgtgtcgtcgaggaccggcggtcccttcggtactatgaagtgcccggcggaactggctcacggcgccaacgcggggcttgacatcgcggtgcggctgctcgagcccatcaaggaggagttccccaccctctcctatgccgacttctaccagcttgcccgagttgtggc

SEQ ID NO: 34121 - DNA, 364 bp, Zea mays
  unsure at all n locations
  Clone ID: LIB3059-063-P1-K6-A5
ccaaattttaagtcacagcgttgaaagggtgagcgatgtctggccgcggcaagggcgggaagggtctgggcaagggcggcgccaagcgccaccgcaaggtgctgcgtgacaacatccagggcatcaccaagccggcgatccgcaggttggcgaggaggggcggcgtcaagcgcatctggggggctcatctacnaggagacccgcggcgtgctcaagatcttcctcgagaacgtcatccgcgacgccgtcacctacaccgagcacgcccgccgcaagaatgtgaccgccatggacgtngtctacgctctcaagcgccagggccgcaccctctacggtttcggcggttaggtcgcccctctcccgg

SEQ ID NO: 34122 - DNA, 408 bp, Zea mays
  unsure at all n locations
  Clone ID: LIB3059-063-P1-K6-A8
cccggttcgacctagcgtccgggcaattttgccctcgattcgaccccgagtggggcgcccaaaaccannattccctccnccaagcgcggatctgaacgctgcgctccgtgtcgccgctcgaatccgccatgaagggggccaaatccaagggcgccgccaaggccgatgccaagctggcggngaatatcaatnggggcggggggagcgccnccaanngcattaaagggaaggccaacaaggaccccaacaagcctaagagggctcccagcgctttcttcgtgttcatggaggaatttcgcaaggagttcaaggagaagaaccctaagaacaagtctttcgctgcggtggggaaagctgctggccacaggtggaaatccctgagcgagtcggacaaggctccctatgtag

SEQ ID NO: 34123 - DNA, 367 bp, Zea mays
  Clone ID: LIB3059-063-P1-K6-B1
ccgggtcgacccttgcgtccgtgagcattacacaaacaggagcctcggatctttcattctggtcgtcttttactagatctttatggtggatatgttcccgattctttcgtaccagagcttcatgatgaatttgctcttgatattgagaagtgccctctttgtccaaactacaaacttgtttatgattgcccatcaaaggagtgcaagaacagcagacatagtacttgcagagggtgtattgtttgcatctggagatgtttgctatgtgggagatgtatagacattgccaatgtgttccaagagtcgttttgtttggggaaactttgccgtgactgtgtcaaatatgaagacttgctccccacagaaa

SEQ ID NO: 34124 - DNA, 510 bp, Zea mays
  unsure at all n locations
  Clone ID: LIB3059-063-P1-K6-B2
cccgggtcgacctaagcgtccgtagctttatctactccagagcgcagaagaacccgatcgacaccatgagggtgttgctcgttgccctcgctctcctggctctcgctgcgagcgccaccttcacgcatacaagcggcagctgcggctgccagccaccgccgccggttcatctaccgccgccggtgcatttgccacctgcgggtcacctgccaccttctgtgcatctcccaccgccggtccacctgccgccgccggtccacctgccaccgccggtccatgtgccgccgccggttcatctgccgccggcaccatgccactaccctactcaaccgccccggcctcagcctcatccccagccacacccatgcccgtgccaacagccgnatccaagcccgtgccagctgcagggaacctgcggcgttggcagcaccccgatcctgggccagtgcgtcgagttcctgaggcattaatgcagcccgacggcgaagccctacttgtcgcctcagtgcc

SEQ ID NO: 34125 - DNA, 467 bp, Zea mays
  unsure at all n locations
  Clone ID: LIB3059-063-P1-K6-B3
cccggttcgactcangcgtccgggcagctaaaatattttgcctccctatgctccttggtctttctgcaagtgctgctacggcgaccattttcccacaatgctcacaagctcctatagcttcccttcttcccccgtacctctcaccaacggtgtcttcggtatgtgaaaacccaattcttcaaccctacaggatccaacaggcaatcgcagctggcatcttacctttatcacccttgttcctccaacaatcatcagccctattacagcagttacctttggtgcatttattggcacaaaacatcagggcacaacaactacaacaacttgtgctagcaaaccttgctgcctactctcagcaacagcagtttcttccattcaaccaactagctgcattgaactctgctttttatttgcaacaacaacaactaccattcagccagctatctgctgcctacccccagcaattt

SEQ ID NO: 34126 - DNA, 460 bp, Zea mays
  Clone ID: LIB3059-063-P1-K6-B6
gtcgactcacgcgtccggcagtttcttccattcaaccaactaggtgcatggaactctgcttcttatttgcaacaacaacaactaccattcagccagctacctgctgcctacccccagcaatttcttccattcaaccaactggcagcattgaactctcctgcttatttacagcagcaacaactactaccattcaggcggctagctggtgtgagccctgctaccttcttgatacaaccacagttgttgccgttctaccagcacgcttcgcctaacgctggcacccttttacaactgcaacaattgcttccattcaaccaacttgctttgacaaacccaacagcgttctaccaacaacccatcattggtggtgccctcttttagattcttatgagttatagttcaataataaagttttttgtctgatgtttggggcttcccaaaaataaaaaagtacatttct

SEQ ID NO: 34127 - DNA, 158 bp, Zea mays
  unsure at all n locations
  Clone ID: LIB3059-063-P1-K6-B7
caacaatggcaccaaaatttttgcctccttatgctccttggtctttctgcaagtgctgctaccgcgaccattttcccccaatgctcacaagctcctatagcttcccttctttccccctaccttttaccancggggggggggggttttaaaacccaatt

SEQ ID NO: 34128 - DNA, 263 bp, Zea mays
  unsure at all n locations
  Clone ID: LIB3059-063-P1-K6-B8
gggcaaaactgcccgggtcgacttagcgnccggncagtttttcaattagctcatcggtgcaagtgggagaactcaacacctnaangttctgatcgttgcccttgctctcctggcgctcgcttcgagcgccgccttcaatacaagcggcggctttggcttccaaacaccaccgtttcatctaccgcctcccttctatattccgcctggttgttgtctnccnccncaacancanccccaaccatancaataccccactcaaccac

SEQ ID NO: 34129 - DNA, 445 bp, Zea mays
  unsure at all n locations
  Clone ID: LIB3059-063-P1-K6-B9
gtccgaattcccgggtcgacccagcgtccgggatacttacacgtgcgcatccagcggcgtggtggtcgcaagagcctgactaccgtccagggattgaagaaggagttcagctacagcaagatcctcaaagatctcaagaaagagttctgctgcaatggtacagtggtccaggacccagaacttggacaggtcattcanctccagggtggggagaggaagaacgtctcnaatttcctcntccaagccggcattgtgaagaaggagcacatcaagattcatggtttctgagcaaccgccgggtccatagcaaaccaaccctgcatgcaaggccagcttattatatataatatctgaggtggagcatatctatctggctgtgtactacaagcaggcctaatacgccggctgcgccttccttctattacacataacacatatagccccc

SEQ ID NO: 34130 - DNA, 398 bp, Zea mays
  Clone ID: LIB3059-063-P1-K6-C1
ccgggtcgacctcgcgtccgcattcagtcagctatctgctgcctacccccagcaatttcttccattcaaccaactgacagctttgaactctcctgcttatttacagcagcaacaactactaccattcagccagctagctggtgtgagccctgctaccttcttgacacaaccacaattgttgccgttctaccagcacgctgcgcctaacgctggcaccctcttacaactgcaacaattgctgccattcaaccaacttgctttgacaaacccaacagcattctaccaacaacccatcattggtggtgccctcttttagatttcttatgagttatagttcaataataaagttttttgtctgatgtttgtggcttcccagaaataagaaagtacatttctag

SEQ ID NO: 34131 - DNA, 251 bp, Zea mays
  unsure at all n locations
  Clone ID: LIB3059-063-P1-K6-C10
cggccaaactttttacaacnnccnagtgcggtgaggcccccaaaaaaaatnacantacnccaacagcatggcatgctcccaattcagcaatcttcaaagcagtcatcaagaacacagacacacatgtttggcccccagcatccaccacaaatgatgaataggnnttatatttttnagaggttgtttggcannnatccaatatcaanatcatcaaaacaccatnncanccaanttcaacattttcctctcca

SEQ ID NO: 34132 - DNA, 169 bp, Zea mays
  unsure at all n locations
  Clone ID: LIB3059-063-P1-K6-C11
agtccctggtgcggaacaagccggggatggccagcatcaaggagatgccggtggtgcaggacgggccgccgccgggcggtttcgcgcccgtgcgcttcgccctctttatccccaggggtgtgggcancnccaccnccatcttcctcaccaaaaacnntnctttcncata

SEQ ID NO: 34133 - DNA, 566 bp, Zea mays
  unsure at all n locations
  Clone ID: LIB3059-063-P1-K6-C12
cccggttcgacctagcgtccggncgtgtatggaccccaacatcagggggggcggggtggtgatcaactcctncnnccacnacnggcccttcngcgccaccggcgtcaagaggctccaggacatcggcatgatcagcgccgtgcccgggatgaaggcgctcgacatgaacgccgccgaggactatatcttgcgcctggcgggcgaggtcntnccctgcatgatcgtcaccaaaatggaggtcgcagagatcgacggcgccccgaggatgggcccgacgttcggcgccatgatgatctccggccagaaggcggcgcacctggcgctgaaggcactgggcaggcccaacgccgtggacgggaccatcccagaggtgtcgccggccctgcgcgaggagttcgtgattgcgtccaaggacgaccaggtcgtggacgcctgagccagcatccacgcgccaacatgcaagcaacgtcttattctggcccgcgccatcacggggtttctttttttaatctgggactttgttgcttgtggacaaatgaattcccttcnatccggtaactttaatc

SEQ ID NO: 34134 - DNA, 200 bp, Zea mays
  Clone ID: LIB3059-063-P1-K6-C3
cccggttcgacctagcgtccggtcgtatccaccttgcctcacaactaacttgtcaccagaagtatacctgcttaatttgagcatattatcttagcatgccttcaagataatcataaattgccctgatctacattgctgcagtgcagaatgtacatttgttttaatcatttgtgaagtataattgccctgatcatcataag

SEQ ID NO: 34135 - DNA, 343 bp, Zea mays
  unsure at all n locations
  Clone ID: LIB3059-063-P1-K6-C5
ccgggncgacctacgcgtccgngaacttttctgcttatgtacaacagcggctactaccattcagccagctagctgctgtgagccctgctgccttcttgacacagcaacagttgttgccgttctacctgcacgctgcgcctaacgttggcaccctcttacaactgcaacaattgctgccattcaaccaacatgcttggggggggccaacagcgttctaccaacaacccatcattggtggtgccctcttttagattgcttatgagttatagttcaataataaagtttttttgctgatgtttgtggcttcccaaaaataagaaagtgcatttctagtttcttaana

SEQ ID NO: 34136 - DNA, 193 bp, Zea mays
  unsure at all n locations
  Clone ID: LIB3059-063-P1-K6-D10
cccgtttcgaccttgcgtccggnggacttttccgatagccttggcgtgtggggtggttataaaaccttcttcctcnncggcgcaggggacccggcgtcggtcattgccggttttgggccgaagacgcttacccgtgccttcaacgccacctacgacgagttggcgcgtatcctgttgccactaacctttttcc

SEQ ID NO: 34137 - DNA, 224 bp, Zea mays
  unsure at all n locations
  Clone ID: LIB3059-063-P1-K6-D11
cttcagtatgtgaaaacccaattcttcaaccctacaggatccaacaggcaatcgcagcaggcatcttacctttatcacccttgttcctccaacaaccgncagccctttttcagcagggaagttttgggncatnnnttttctcaaaacataaaaaaacanccnctncaacaacttntnctannaaaccttnctncctactctcancaacancantttcttccatt

SEQ ID NO: 34138 - DNA, 498 bp, Zea mays
  unsure at all n locations
  Clone ID: LIB3059-063-P1-K6-D12
tcgactcagcgtccgatttttttggctcantgagatagggagggggggcgcttaaaataatacatnaatactacaaaagtaatgctaccggtcttggtgttttctttactctttactatgctttcgacacatcaagctttggggaataaggaaaattgtgacaaggataaagatttcatttttcgtcaatggtggaggtgcattnnantttttcntaaattccctacaacacaactatnttncaatnctataaaaananctnatatnncttncntctntcntancataacactanaanancanctcacaataantntcntnaannttntnnattttncaaannaatntnncaacccnntnccccctttaaataaatntnnaacttnnacttttccaccacaactnctnnnatnnntncatccntaannnttcaacaaancnancaacaaannncccatnnatanaaattcaacaatnaaancaatcatannaaaatct

SEQ ID NO: 34139 - DNA, 482 bp, Zea mays
  unsure at all n locations
  Clone ID: LIB3059-063-P1-K6-D6
gcaaagcacatccnactccgagagtggncgcggtgatgttcgggctggagactcccctgatggcggctgcacacctgctggacgtgcccgacggcgacgccggcgcgggcggcgctctttacngcagggggggagcncccnctcacctacttcccaaacacncncatnncngnaccccnnccacntnnaagacttcccnnncctacccnttcntnntgnacatgccnnngctgggcacgggcgacatccgggtgcaggtggaggacgagcgggtgctggtggtcagcggcgagcggcgccgggaggagcgcgaggacgacgccaagtacctgcgcatggagcggnggatgggcaagttcatgcgcaagttcgtgctgncggacaacgccgacgnnnaccaggtcgncgncgngtgcagggaccgngtgcttacggngaccgnnnagaagnctgncccnncggagcccaanaagncaaaacca

SEQ ID NO: 34140 - DNA, 210 bp, Zea mays
  unsure at all n locations
  Clone ID: LIB3059-063-P1-K6-E10
nnaccccccctntancnncncattaancncnncnnntntnntnnttacccccancntnaccnctacacttnccancnccctancnncccctcctttcnctttcttcccttcctttctcnccacnttccccccctttcccnctcaacctctaaatcnnnncctccctttannnttccnatttaatcctttaccncacctccaccccaaaaa

SEQ ID NO: 34141 - DNA, 168 bp, Zea mays
  Clone ID: LIB3059-063-P1-K6-E2
cccgggtcgacctacgcgtccggtcagttgttagtgctgtgttcatcctcggctccagcagacccatgcatcaaacagcatggactgcggatcgatggatgctgttacccccgtcaggctttattctaagttaatcttaaggaaaaaatggtgcttcttggtgctgca

SEQ ID NO: 34142 - DNA, 656 bp, Zea mays
  unsure at all n locations
  Clone ID: LIB3059-063-P1-K6-E3
cccggttcgactcacgcgtccggttatatcggcatttaatttcccttgtgctgtgcttggttggaatgcttgcattgctttggtctgtggaaattgtgtcgtctggaaaggtgctccaacaactccactgatcactattgcaatgacaaaaatagtggctagtgtattggagaagaacaacttaccaggcgcaatttttacatctttttgtgggggcactgaaattggtcaagcaattgcccttgacattaggatacctttggtttcattcactggaagtacaagggctggtctaatggttcagcaacaagttagtgcaagatttggtaaatgccttcttgaacttagcggaaacaatgccatcattgttatggatgatgcagatatccagctagctgtgcgatctgtcttgttcgctgctgttggtacagcaggacaacgctgcactacatgtcgtaggctgattcttcatgagaacatatatcaaaccttccttgatcagcttgttgaggtatacaaacaagtccgaattggggatccgttggagaaaggcaccttactgggaccactgcacactcctgcttcaaaagagaactttttgaaaggcattcagactatcaaatctcagggagggaaaatccttnttggaggatctg

SEQ ID NO: 34143 - DNA, 296 bp, Zea mays
  Clone ID: LIB3059-063-P1-K6-E5
ggggcaaacgcccgggtcgacttagcgtccggaagaagttattgaggaacagatcggggcagcggttcaaaagagtgtttccatgccgaatcttaaactggacttcctctgagatgtatgagagtaatttgtagttatacaagattgcaatgacatgctggaagattaacatagacatgtacggatataacgaaagattaacatgtgcgggggggcagtttcatacatacttgtgttgcagctgtatttaagagaatgagagatacagatacttttgagctaaatgcgatgacaca

SEQ ID NO: 34144 - DNA, 565 bp, Zea mays
  unsure at all n locations
  Clone ID: LIB3059-063-P1-K6-E6
cggaaactttgcaaancngctgctcgagttgggggggaatgcggtgtcgccggcattatcgtgtccaaccacgggggccgccagctagactatcttcctgcaaccatcagctgcctggaagaggtatgcaaatcaatcacagcacagctgcctaggacacctctggtccatggccggatgctaacttaccttggaaagggaaacttcaggttgtgagagaagcgaagggccgccgtgtgcctgtgttcctcgacggcggcatccgccgtggcactgacgtgttcaaggccttggcgctgggagcctcaggagtgtttgtaagtctgcaggaacatttgtttgttgtacatgtactgcgtcatgcatattcatgcttgtcctctgtcagattggaaggcccgtactgttcgccctcgccgtggacggcagggcaggggtgaggaatgcgctgccgatgctgagggatgagctcgagatcaccatggcgctgagcggctgcgcgtcgctgaaagatatcacccgcgaacgcgttatcaccgagagcgacatgatccggcgctctcgg

SEQ ID NO: 34145 - DNA, 625 bp, Zea mays
  unsure at all n locations
  Clone ID: LIB3059-063-P1-K6-E9
gcccggttcgactcagcgtccggggcgttagagatcggagttcggggtgtggggggagcagatcctcnccntgncggtggaagccgccaagagcgccggcgagattattcgcaagggattctaccagaccaagaacgtcgagcacaagggccaggtggatttggtgacggagacggacaaggcctgcgaggacctgagggggaccacctccggaagcacttcccggaccacaagttcatcggggaggaggagtccgcggcgctcggggccaccgctgacctcaccgacgaccccacctggatcgtcgatcccctcgacgggaccactaatttcgtccatggtttcccatttgtatgtgtctccgttggcctcaccattgggaaaattcccactgtcggagtcgtcttcaaccccatcatgaacgaacttttcacggcggttcgtggaaaaggggctttcctgaatggctctccaattaaagcatcatctcaagatgagttagtgaaggctcttctggtaacagaagctggaaccaatagagacaagaccactgtggatgatacaaccaacagaatcaacaggctactatacaagattcgatccatacggatttgtggatcattgg

SEQ ID NO: 34146 - DNA, 452 bp, Zea mays
  unsure at all n locations
  Clone ID: LIB3059-063-P1-K6-F1
cgacgcatgaattttgcatgccagcccgcagaggaggggcagagcaccgcgtactacgtgctgcaagaaggcatccttgacgacgcgtcagccatatccggtttgcacgtcgacccagccctccccgtcagcgtcgtttcgtccaggccagggcccttcgcggcgacctccgttcgggtccgggggagggtcaccgataaaggcgggcacgccgcgatgccccacgaatccatcgaccctggtgtagctgcagccactactgacgacagcctccaaaagatcatctcccgagaaatcgatcccctgcagggcgcggntgtgtacgtcacttttctgaaaggaggagaaagcgnacaatgtcatcccaaaaaatgtgtcctttggccggaccctgaagagcatgacgaatgaagggctatcgatctcaaaaaaggacaaagagatcgtcgaag

SEQ ID NO: 34147 - DNA, 282 bp, Zea mays
  unsure at all n locations
  Clone ID: LIB3059-063-P1-K6-F11
cgtccgactaccattccatggaggccaccaagggcgatgagggcccataactaaacnactactaccacttcgacccgacccctgttgccaaggcgacctggcgcgaggccagggagtgcatctacgtcgagcccgaggaccgcaagggcgtcttctggtacaacaagaagttctattccnccgcgcgggttgtggagctnanannactctaccatannaataaaacannaaccannannannanacnntactcnccccaaantctccntctacctatctaat

SEQ ID NO: 34148 - DNA, 305 bp, Zea mays
  Clone ID: LIB3059-063-P1-K6-F2
ccgggtcgaccttagcgtccgggaaaatgtggagagattggctcagggcccacgggaacctgcggcagcaccagtatcagctactgctccggctgcagctgcaccaaagaaggcgaagaagtgaaaagggtgatcttctagttctaggacctaattttggagcgccccaactcttttgctgttacatatccaagctggcagatgtctgtaataacatcttagacttgtttgtcccaagtttatttggaacgaattttcacagaatctgcttaatgcttcggtggaacccagttctggttttgctt

SEQ ID NO: 34149 - DNA, 436 bp, Zea mays
  Clone ID: LIB3059-063-P1-K6-F4
ggggtgttctggcaagtatacactacgtgagagatgaagaaaacccacggtggacaatctttgagaggcggcttccttgctgtggttgtggtataggatggtcttcgtaagtatgctttactactccagtcttcatataaacttcggttcacaattgtccaataagcatactgtggttgcggggttcttttagggttcttgtgtcctttgatttggtactttgcagccactctttactgctgcaagtactacaacaaggatcctcgagagcgccctgggctagctgcatcagctgttgcggcactcatcttcacagtcctggcactcatcgctctctctgtggcactgatattctatatataaagcgaggaatgaacttgcgcttgcttgaaatgcgtactcaggcactcatcttcacagccctggcaaccataca

SEQ ID NO: 34150 - DNA, 566 bp, Zea mays
  unsure at all n locations
  Clone ID: LIB3059-063-P1-K6-F6
cccgggntcgactcacgcgtccgatatttttcctccttatgctccttgcggtttgtgcatgtgttgctaacgcgacaattttccctcaatgctcacaagctcctatagcttcccttcttcccccataccttccatcaatgatagcttcagtatgtgaaaacccagctcttcagccctataggctccaacaagcaatcgcggggggcaacatacctttatcacccttgttgtttcaacaatcgccagccctatctttggtgcagtcattggtacaaaccatcagggcacagcagctgcagcaactcgtgctacctgtgatcaaccaagtagctctggcaaacctttctccctactctcagcaacaacaatttcttccattcaaccaactgtctacactgaaccctgctgcttatttgcagcaacaactattaccattcagccagctagctactgcctactttcagcaacaacaacttcttccatttaaccaattggccgcactgaaccccgctgcttatttgcagcaacaaatactactaccatntagccagctagctgcagcaaac

SEQ ID NO: 34151 - DNA, 355 bp, Zea mays
  unsure at all n locations
  Clone ID: LIB3059-063-P1-K6-F9
ccttacctccaccttacacgggcctttatcggtccctttgccgctacacccaccgcaccacccacctgaccactattcttattgctcttcattacactataaatcccagcaccccaccaatctccccaacaatagcagtagtaacctcnannatacccacatncaccaccacctccactaccactaccaacacctctcttaccacatnaactttcaaancacctntctaancaccctactaanaaccataacatccatnatnacactcatcaacttnctaatcaaaatcaaaccctcaaccaaaccaacccacacctccaaaaatacctccaaacctcaacccaacctcttccaa

SEQ ID NO: 34152 - DNA, 352 bp, Zea mays
  Clone ID: LIB3059-063-P1-K6-G1
cgtgaagcttgtattccagccggcagaggagggccagggcggcgcgtactacgtgctgcaagaaggcgtccttgacgacgcgtcagccatattcggcttgcacgttgacccggccctccccgtcggcgtcgtttcgtccaggccagggcccttcgcggcgacgtccggtcggttcctggcgacggtcaccggtaaaggcgggcacgccgcgatgccccacgaatccatcgaccctgttgtagctgcagccactactgtcgtcagcctccagaagatcatctcccgagaaatcgatcccctgcagggcgcggttgtgtccgtcacttttctgaagggaggagaagcgtacaat

SEQ ID NO: 34153 - DNA, 378 bp, Zea mays
  unsure at all n locations
  Clone ID: LIB3059-063-P1-K6-G4
ccgggtcgacctcgcgnccggnnnngctttggatgaccaaagaaggatgaaggtggtagagatagggggagctcaggaactgcttaatgtattggaaggtgctaaagatgataaaacacgaaaagaaactctaaaagctcttgctgcgctttcaaaatctgaagaagctgcaggatttttggacaaggtcggcgcctaggctgttgtcagttccactcccgactctcaagaatatgctgagatccaaacttacaagaccagtcttctgacggcatttgatcaactgaagtcatgatgtccaaaagccaatgggtatattaagcaacattttaactctgcactttgccgtggcgggtaatgttctaatttcttgaatcg

SEQ ID NO: 34154 - DNA, 358 bp, Zea mays
  unsure at all n locations
  Clone ID: LIB3059-063-P1-K6-G5
aggcatttaggtcggcgaggagggcagtaagaccgaagaccgagccgtgcgggggctcgggacgggaacgggacaggaccccaaaatctcagatccttcctgcccgcccgcccgtgcccgtcgacgcgtcgttcttgccggccgcgccccacctccgccctcttcttctccagggggaggggggacnccacangctgcgcgatggtgctgtgggtcttcggctacggctccctcatctggaaccccggcttcgacttcgacgacaaaatcctcggcttcatcaaaggctacaagcgcacctttaatctcgcttgcattgaccacagaggcacaccggagcatccggcgaggacctgca

SEQ ID NO: 34155 - DNA, 284 bp, Zea mays
  unsure at all n locations
  Clone ID: LIB3059-063-P1-K6-G7
cggcaacatcttcaacaacagnnnctgaagacaggggagccacataaccatnnntnaaccctntcacctacttncaacagcanctgcttgcatccaacccacttgctctggccaacgtagctgcataccagcaacaacaacagctgcaacagtttatgccagtgctcatttaactanccagggggggggcctnccntctacctacaactactttcatctaacccccttcccngtgggcaatgcacctacttacctacaacaacagnttctgcaacaaattgtac

SEQ ID NO: 34156 - DNA, 351 bp, Zea mays
  unsure at all n locations
  Clone ID: LIB3059-063-P1-K6-G8
cccggttcgacttacgcgtccgctacattttcgtcgagaactccgagccaggggggtgctgaaggacaagaagaagccgatcatcttctcgatggcgcgtctcgaccgcgtgaagaacatgacaggcctggtcgagatgtacggcaagaacgcgcgcctgagggagctggcgaacctcgtgatcttttccngtgacggggggggggattccaangacaggnaggagcangcggagttcaagaagatgtacagcctcatcgacgagtacaagttgaagggccatatccggtggatctcggcgcagataaaccgcgttcccaacggggagctgtaccgcttcatttgcgatac

SEQ ID NO: 34157 - DNA, 495 bp, Zea mays
  Clone ID: LIB3059-063-P1-K6-H1
cccgggtcgacctcgcgtccgcgtgaatctcgtattccagccagcagaggagggccagggcagcgcgtactacgtgctgcaagaaggcgtccttgacgacgcgtcagccatattcggcttgcacgttgacccggccctccccgtcggcgtcgtttcgtccaggccagggcccttcgcggcgacgtccggtcggttcctggcgacggtcaccggtaaaggcgggcacgccgcgatgccccacgaatccatcgaccctgttgtagctgcagccactactgtcgtcagcctccagaagatcatctcccgagaaatcgatcccctgcagggcgcggttgtgtccgtcacttttctgaagggaggagaagcgtacaatgtcatcccagagaatgtggcctttggcggcaccatgaggagcatgacgaatgaaggtctatcgtatctaaagaagaggatcaaagagatcgtcgaaggacaggcagcggtgcaccactgcag

SEQ ID NO: 34158 - DNA, 538 bp, Zea mays
  Clone ID: LIB3059-063-P1-K6-H2
cagctcttcaaccctataggctccaacaagcaatcgcagcaagcaacatacctttatcacccttgtttcaacaatcgccagccctatctttggtgcagtcattggtacaaaccatcagggcacagcagctgcagcaactcgtgctacctgtgatcaaccaagtagctctggcaaacctttctccctactctcagcaacaacaatttcttccattcaaccaactgtctacattgaaccgtgcttcttatttgcaacaacaacaactaccattcagccagctatctgctgcctacccccagcaatttcttccattcaaccaactgacagctttgaactctcctgcttatttacagcagcaacaactactaccattcagccagctagctggtgtgagccctgctaccttcttgacacaaccacaattgttgccgttctaccagcacgctgcgcctaacgctggcaccctcttacaactgcaacaattggtgccattcaaccaacttgctttgacaaacccaacagcattctaccaacaacc

SEQ ID NO: 34159 - DNA, 409 bp, Zea mays
  unsure at all n locations
  Clone ID: LIB3059-063-P1-K6-H4
ccaatccatatcagcaaagcggcagggcgtagggaggatcgtcgaacagaacagcatgaagatggtcatcgttctcgtcgtgtgcctggctctgtcagctgccagcgcctctgcaatgcagatgccctgcccctgcgcggggctgcagggcttgtacggcgctggcgccngcctgaggggggggatgggcnccngcgggctgtacccctacgcggagtacctgaggcagccgcagtgcagcccgctggcggcggcgccctactacgccgggtgtgggcagacgagcgccatgtaccanccgctccggcaacagtgctgcccgcagcagatgaggatgatggacgtgcagtcccncccgcaacaactgcaaatgaagatgcagnttgagcgtgccgctgccgccagcagc

SEQ ID NO: 34160 - DNA, 532 bp, Zea mays
  Clone ID: LIB3059-063-P1-K6-H5
gcaatcccttcaccagattagtggggtgggagcggaaatattcattatgttgttaatcagaacgctatgggagttagctctaagccaccaggtgttctaaagaccgagagcactgactcactgagttgtagttatggctatattggtggtagcaccagtgtggactctggctgggggtgttctcagtccaaaaatccacagtatggtctactgcagaatcaaaatgatgttaacggcagctggtcgccttcacaagattttgatagttttggaaattctcttgggcaaggccaccctggtaccacttcatctaacttccagagttccgcccttgggaagttgcctgaccaaggacgagggagaaatcatgggtttgtcgggaaaggcacttgcattccaagccgctttgcagtggatgaggttgaatctccaactaacaacttgagccacaacattggaaacagtggagacatagtgaaccccgacatattttgatttagtggacatatgtgaaactttcttgaatttcgtt

SEQ ID NO: 34161 - DNA, 322 bp, Zea mays
  unsure at all n locations
  Clone ID: LIB3059-063-P1-K6-H7
cccgggttgaatttaaanngngcagactcttttgatnataactttgtagtaaagaagcatcataaaaaatncnnatatccatgttagaacttcangggagtgtcgagtcaggcttatcagtgcctaaacttgttgatacgagctaaaagtttgctgaagcatctttcctgtgaggacctgacaactttctttcacaaaaggagttgggtaaaatnctnatccactctnnntaaaaacaaannttctctatattnttttccaatntccaaacatctnanatnnnaaaaaataactnnccattnataataatnaaataatccac

SEQ ID NO: 34162 - DNA, 250 bp, Zea mays
  unsure at all n locations
  Clone ID: LIB3059-064-P1-K6-A10
ccggttcgacctangcgtccgcccagctttcggccggctcaagggaggggttggcctcataacaccnccnncaccnaagtcgggcctcttcgtgggcatcaacaagggccatgtcgtcaccaagcgcgagctgcctctgcgcccgtcccaccgcaaggggaaagcaacgaagagggtgtccattttcatngngcgggggtgggagannttnctnnctttnctccttataaaaancntatcaccnancttc

SEQ ID NO: 34163 - DNA, 461 bp, Zea mays
  unsure at all n locations
  Clone ID: LIB3059-064-P1-K6-A12
tcccggttcgacctangcgtccgcaacagtttcatanaaagttgagacgagggaggcaataaancaacaatnncnaccaanatattttccctccttatgctccttgctctttctacatgtgttgctaacgcgacaattttccctcaatgctcacaagctcctatagcttcccttcttcccccattccttccatcaattgggggtggaatatntgaaaacccanctcttcaaacatatangcttcaacaagcaatcncancaagcaacatacctttatcgcccttgttgtttcaacaatcgccagccctatctttggtgcagtcattggtacaaaccatcagggcacaacagctgcagcaactcgtgctacctctgatcaaccaagtagctcttgcaaacctttctccctactctcaccaacaacaatttcttccattcaaccaactgtctacactgaaccc

SEQ ID NO: 34164 - DNA, 569 bp, Zea mays
  Clone ID: LIB3059-064-P1-K6-B2
ccgggtgtgaattgttgctagccatcaagtatccaacggtctgtatcagaacgtgcagctctatcaagttcatcctcggtttcttgcgtatcttcgtctcccccatgtgagcagacagggcatgaaccgcagactagagtgctcgtggagaaagatcctgagcctgtagatgaagtctttctgaacttctctctcacacccgaggggatttcaatggacgatttgttaggacggatagatgagattcctgtttgtgacgaccctgtcagcccaactgatgagcttccacttgacaatttcacgagcctggaagatgcattcccgatcagcgatttcatcggttcaagagatgagcatctgtatgagcactatattggcctggctgacattagccacctgcctcttccaatggatgatccagctttcaatctggatgcagagcttgattggagtgggtttgacttcgctgcgattgaaggtgaacttgatgtcccttgaggctgcaatcagtggtgtgttatactgaaacctgcacttgcttatgttgtattcagctgaaagctcctctc

SEQ ID NO: 34165 - DNA, 430 bp, Zea mays
  unsure at all n locations
  Clone ID: LIB3059-064-P1-K6-B5
cccgggtcgacctacgcgtccggggtattttgagagcaactgtgaacacatttggttatatcgcaaaggctatagggccacaggatgtgttggccaccctgttgaataacttgaaggtgcaagaacgacagaaccgggtctgtacaactgtagctattgctatagttgctgaaacttgctcacctttcacagttttacgggggggtatgaatgagtaccgggtcccaaagctcaatgtccaaaatggggttctgaaatcactctctttcctctttgagtatattggggagatgggcaaagattacatatatgcccgcacccccttacttgaagatgctttaatggatagagatctgggtcaccggcagactggtgcatctgctgntaaacacatagctctagggggtgctggcttgggttgggaggatgc

SEQ ID NO: 34166 - DNA, 307 bp, Zea mays
  unsure at all n locations
  Clone ID: LIB3059-064-P1-K6-B6
cccgggtcgacccagcgtccgggaaaatgtggagagattggctcagggcccaggggaacctgcggcagcaccagtatcagctactgctccggctgcagctgcaccaaagaaggcgaagaagtgaaaagggtgatcttctagttctaggacctaattttggagcgccccaactcttttgctgttacatatccaagctggggggggtctgtaataacatcttanacttgtttgtcccaagtttatttggaacgaattttcacagaatctgcttaatgcttcggtggaacccagttctggttttgctttt

SEQ ID NO: 34167 - DNA, 581 bp, Zea mays
  unsure at all n locations
  Clone ID: LIB3059-064-P1-K6-B9
caacaagtcaacatanaaagtggaatcgantggcgacaacagagcaacaatggcgaccaagatattttccctccttatgctccttgctctttctgcatgtgttgctaacgcgacaattttccctcaatgctcacaagctcctatagcttcccttcttcccccataccttccatcaatggggggttcagtatgtgaaaacccagctcttcagccctataggctccaacaagcaatcgcagcaagcaacatacctttatcacccttgttgtttcaacaatcgccagccctatctttggtgcagtcattggtacaaaccatcagggcacagcagctgcagcaactcgtgctacctgtgatcaaccaagtagctctggcaaacctttctccctactctcagcaacaacaatttcttccattcaaccaactgtctacactgaaccctgctgcttatttgcagcaacaactattaccattcagccagctagctactgcctactctcaacaacaccaacttcttccatttaaccaattggccccactgaaccccgttgcttatttgcagcagcaaatactactaccat

SEQ ID NO: 34168 - DNA, 437 bp, Zea mays
  unsure at all n locations
  Clone ID: LIB3059-064-P1-K6-C10
cccgggtcgacccttgcgtccgcccagcctctgaaggaaccttccagaggcgcgggctctaaaggccntcnccttcccattcttcctcgccgcgggggtcgcctgagatcacataaacaatggtgaaggctgttgctgtgcttggtagcagcgatggtgtcaagggcaccatctttttcacccaatatttagatggccgggggctgtcaccnnaagtgtctctggcctcaagcctggcctccatgggttccatgtacatgcacttggtgacaccaccaatggatgcatgtcaactggaccacactacaatcctgcgagcaaggagcatggggcaccagaagatgagaaccgccatgctggtgatcttggaaacgtgacagctggagcagatggtgttgctaatatcaatgtcaccgacagccagatcccactgactg

SEQ ID NO: 34169 - DNA, 191 bp, Zea mays
  unsure at all n locations
  Clone ID: LIB3059-064-P1-K6-C11
cccgtttcgantttgcgtccgcagtgtttttatcgaatataaaggagggcgggtaggaaaaaaaaaatcaactnntntcagaagcaatatgtgcaggtatcttcaatgacttgggtagtggaagcaatgtggatgtctgcgtgataaccaaggggaagacagaatacttgagaaatcaccatttttctaat

SEQ ID NO: 34170 - DNA, 254 bp, Zea mays
  unsure at all n locations
  Clone ID: LIB3059-064-P1-K6-C6
cccgggtcgaccagcgtccggagcttcgccggaagtgccgaaggcgcctttacggccccgtcctccgtccgccgcgttggatgtccgccgggctgtcgacggagctccgccacaagtacaacgtgcgctccatcccgatccgcaaggacgacgaggtgcaggtcgtgcgcggcacctacaagggccgcgaggggggggtggtgcangtctaccgccgccgctgggtcatccacgtcgagcggatcacccgcgag

SEQ ID NO: 34171 - DNA, 474 bp, Zea mays
  Clone ID: LIB3059-064-P1-K6-D1
ataggctccaacaagcaatcgcagcgagcaacatacctttatcacccttgttgtttcaacaatcgccagccctatctttggtgcagtcattggtacaaaccatcagggcacagcagctgcagcaactcgtgctacctgtgatcaaccaagtagctctggcaaacctttctccctactctgagcaacaacaatttcttccattcaaccaactgtctacactgaaccctgctgcttatttgcagcaacaactattaccattcagccagctagctactgcctactctcagcaacaacaacttcttccatttaaccaattggccgcactgaaccccgctgcttatttgcagcagcaaatactactaccatttagccagctagctgcagcaaaccgtgctttctttttgacacagcaacagttgctggctttctaccagcagtttgcggcttaccccgcaaccctcttacaactacaac

SEQ ID NO: 34172 - DNA, 180 bp, Zea mays
  Clone ID: LIB3059-064-P1-K6-D10
cgtccgatttcctttccgggctttcctttaccgatcagcggaaacaactaaatcccattccatcttcgtttccgctccgccgccgtcgatggagttctggggtctcgaggtcaaacctggatccactgtcaagtgtgagcctggacatggctttatcctgcacgtttcccattcttccct

SEQ ID NO: 34173 - DNA, 539 bp, Zea mays
  unsure at all n locations
  Clone ID: LIB3059-064-P1-K6-D2
cccgggtcgacccagcgtccgctgggtcttcagaccattagctttatgtactccagagcgcagaagaacccgatcgacaccatgagggtgttgctcgttgccctcgctctcctggctctcgctgcgagcgccacctccacgcatacaagcggcagctgcggctgccagccaccgccgccggttcatctaccgccgccggtgcatctgccacctccggttcacctgccacctcctgtgcatctcccaccgccggtccacctgccgccgccggtccacctgccaccgccggtccatgtgccgccgccggttcatctgccgccgccaccatgccactaccctactcaaccgccccggcctcagcctcatccccagccacacccatgcccgtgccaacagccgcatccaagcccgtgccagctgcagggaacctgcggcgttggcagcaccccgatcctgggccagtgcgtcgagttcctgaagcatcagtgcagcccgacggcgacgccctactgctcgcctaagtgccagncgttgcggca

SEQ ID NO: 34174 - DNA, 412 bp, Zea mays
  Clone ID: LIB3059-064-P1-K6-D4
tcccgggtcgacccagcgtccggcggcgttggcagcaccccgatcctgggccagtgcgtcgagttcctgaggcatcagtgcagcccgacggcgacgccctactgctcgcctcagtgccagtcgttgcggcagcagtgttgccagcagctcaggcaggtggagccgcagcaccggtaccaggcgatcttcggcttggtgctggggtccatcctgcagcagcagccgcaaagcggccaggtcgcggggctgttggcggcgcagatagcgcagcaactgacggcgatgtgcggcctgcagcagccgacttcatgcccctacgctgctgccggcggtgtcccccactgaagaaactatgtgctggagtatagccgctggctagctagctacctagctcgctagtttactcatttag

SEQ ID NO: 34175 - DNA, 149 bp, Zea mays
  unsure at all n locations
  Clone ID: LIB3059-064-P1-K6-E12
cgcagggttcaaggcagcagctgtcgcgaccgtctcctctgcagggggggggtnnttancntcangatnctnccataaaccaannccaacatcaaccccnctttccannccctcatcntctccacaattnctnncatnncntacttcat

SEQ ID NO: 34176 - DNA, 526 bp, Zea mays
  unsure at all n locations
  Clone ID: LIB3059-064-P1-K6-E2
cccgggtcgacctangcgtccgcccacgcgttcggtcacgtctcccagatctaactccccccgactcacgaatcccagagagcctgcatggcgacgcaccgncactgcctcccactcctcctcgtggccgccgccctcgccctcgccgncgtccctgctcgcgcggcgctgggcggcgggcgcggcccgctgctgggcgggggggacccgatccctgacgtgagcgactcgcacatccaggagctaggcgggtgggcgctggggcaggcgaagcaccagaagctggccgccgacgggctgcggttccgccgcgtggtgcgcggcgagcagcaggtcgtgtccgggatgaactaccgcctctacgtcgacgccgccgaccccgccggccgnaccgtgccctacgtcgccggcgtgtacgagcaggtctggacccgcacccgccagctcgcctccttcaaccccggggccccgcgccccctgaaccttacggacacgggtgggccgaagccaccccgaccatgttctc

SEQ ID NO: 34177 - DNA, 411 bp, Zea mays
  Clone ID: LIB3059-064-P1-K6-E3
cccggttcgacccagcgtccggcaggtatggctatttgacaaacacaaaggtcaaatttatcatggtcacgactgatcttgatgtcaaagatgcagatgcccgaaattttttcaggaagttccatgctgcatatgtagatgccgtctcgaacccgttccatgtcccagggaagaagattgcttcaagaagctttggcgcaagagtaagcaccatcgttaaatccttcggttcagggtccagttgatcgaatgccacttttgtcagactttctgtaatcaaacatatgtgttctctctctgtttgacaaaattactccctaccgtgtactgcttgtctggtgaacgagatgctattggtactgattgctgaacaaagaaaaatagtggtttattcattcaaaatccttctca

SEQ ID NO: 34178 - DNA, 382 bp, Zea mays
  Clone ID: LIB3059-064-P1-K6-E6
cttaaacagatgcgataatattgtaggataagataatggtccacaacacatcctaaccgattacaaagttcaccttgagaaaattgcaaaccaaacaataattccaactcaaacgataacaactaatggtggctcactgctcctcttcgatcacacccttgtcgctcacatagataccatccaaaaacttcctgatatccttcttcttgacatggcatttctggttgatgagggcggcggagcgagagactaactcgacgtcgttgccatcgagaataagctcgtccttgaccttcttggagcggaggatggtcacgccgtcaagcatgtccacctttctgaccttctttttcccgaggaagttccttatctcgatggcggt

SEQ ID NO: 34179 - DNA, 444 bp, Zea mays
  unsure at all n locations
  Clone ID: LIB3059-064-P1-K6-E8
cccgggtcgacttagcgtccgcaacaattttcagccctatctttgntgcgtcgttggtacaaaccatcanggcacatcagctgcagcaactcgtgctacctgtgatcaaccaagtagctctggcaaacctttctccctactctcagcaacaacaatttcttccattcaaccaactgtctacactgaaccctgctggtggtggggagcaacaactattaccattcaaccaactanctacttcctactctcaacaacaacaacttcttccatttaaccaattttccccactgaaccccncttcttatttncancancaaatactactaccatttanccancttncttcancaaaccntncttccttctttacacancaacaattncttcctttctaccaacaatttncnnctaaccccncaacccttttacaactacaacaatttt

SEQ ID NO: 34180 - DNA, 421 bp, Zea mays
  unsure at all n locations
  Clone ID: LIB3059-064-P1-K6-E9
cccgggtcgacttagcgtccgagccgttttccccgctacnttctttagacggaggcatccgacaaaatacacgaagggcaacgaggcgaggcctagtatagaggaaaacgagtgagaggggggaaatgctgcgccacgccgcccgccgtctcgtctcccgcaccgccgcggcgcccaccgcccgccgtgcgctcgtgaggtgggaggtgcctgcngaggccgccgaggactccacgtttgtggaggcgtggaagaaggtcgcccccaacatcgagcccccaacgacgcccctcttcctcatgcagccgcgcccgcccacgccggctaccatccccactaagctcaccgtcaacttcgtcctcccctacaagtccgagatcgccaacaaggaggtggacatggtaattgtaccagctacaac

SEQ ID NO: 34181 - DNA, 147 bp, Zea mays
  unsure at all n locations
  Clone ID: LIB3059-064-P1-K6-F10
ccccttcaattcccaaagcacggcctgtcaacacactncannattctcancactgtaatgccgatgggatgcctatcacgtcgcctccgataaatgactatccctggagtcctagatgggaccaggcagagatggttgaacggatct

SEQ ID NO: 34182 - DNA, 164 bp, Zea mays
  unsure at all n locations
  Clone ID: LIB3059-064-P1-K6-F12
gtccgcccactcttccggtcacntctccgagagagcgggcgcccccaactcacnaatcccananagcctccatggcgacccaccgccactgcctcccactcctcctcgtggccgccgccctcgccctcgccgccgtccctgctcgcgcggcgctgggcggcggg

SEQ ID NO: 34183 - DNA, 320 bp, Zea mays
  unsure at all n locations
  Clone ID: LIB3059-064-P1-K6-F2
cccgggtcgacttangcgtccgctggaacttcaagcacgtcatcttcatggtggacgacatgcccatcagggacttccgcaacctggagagcaagggggtggcgttccccaagagccagccgatgcggctctactccagcctgtggaacgcggacgactgggcgacgcagggcgggcgcgtcaagactgactggtccggggggggcttctccgcctcctaccncggnttcaaggccgacgcttgcgtggccgtcgcgggcggccggacccgctgcggcgccaccgtcggcaccgagggcaccggcgcccccgcctccgcc

SEQ ID NO: 34184 - DNA, 100 bp, Zea mays
  unsure at all n locations
  Clone ID: LIB3059-064-P1-K6-G10
ccgggtcgacctagcgtccgggtccggtcttctatggattgttcgatggtggagaactgaactaactatnttttgtgctattttggttgtttaatgcccc

SEQ ID NO: 34185 - DNA, 614 bp, Zea mays
  unsure at all n locations
  Clone ID: LIB3059-064-P1-K6-G12
ccaacttcccggttcgacctcagcgtccggggtcttcagaccattagctttatgtgcgtgcggagcgcaaaanaacccgatcgacaccatgagggtgttgctcgttgccctcgctctcctggctctcgctgcgagcgccacctccacgcatacaagcggcagctgcggctgccagccaccgccgccggttcatctaccgccgccggtggatctgccacctccngttcacctnccacctcctatgcatctcccaccgccggtccacctgccgccgccggtccacctgccaccgccggtccatgtgccgccgccggttcatctgccgccgccaccatgccactaccctactcaaccgccccggcctcagcctcatccccagccacacccatgcccgtgccaacagccgcatccaagcccgtgccagctgcagggaacctgcggcgttggcagcaccccgatcctgggccagtgcgtcgagttcctgaggcatcagtgcagcccgacggcgacgccctactgctcgcctcagtgccagtcgttgcggcagcagtgtttccagcagctcaagcaggtggagccgcacacccgtaccaagcgatcttcggctttgtcct

SEQ ID NO: 34186 - DNA, 276 bp, Zea mays
  Clone ID: LIB3059-064-P1-K6-G2
cccgggtcgacctacgcgtccgggacacattaagcagttccacaacagtgagatcaagttcccgctcgtgcaccgcaaggtcaggccgccgaccaggaagctgaggaccacgttcaaggcttcgaggcccaacctgttcatgtgatttagctgtggtcagtgtatgcgatcataagagtcacaagtgtttctgtttttttttaagttttgacttcctaatagtaatacttaatcggtttgatgattcaactcgttttgaagcgagcttggtggacc

SEQ ID NO: 34187 - DNA, 516 bp, Zea mays
  Clone ID: LIB3059-064-P1-K6-G4
cttgcaacacaattctttacgacttgtgctaaccatcttcttgctagtcgcaatgaatgtaacctattttgcacccagtgtgagaccaaaccagctgctttctgtaactattgtcgttcaagtgatcattccacccaccgtgtaatccagataaggcgttcatcgtaccatgacgttgggagggtgtccgagattgaggatatccttgatgtcagcgatgtgcaaacttatgtaatcaatagtgcaaggattgtattcctgaatgagcggccacaactgcgtgcttctagtgtccccatttgtaaggcacccacatcatcaacacatagctgtgagacatgtagccgtgtgctacttgatgcatttcgcttctgctctcttggatgcaatcttagaggcttaaatatggaagctggtatgcaagctatggttggcaacaaccctcggtccaatggtattgatcatgtggctaggattgacaatgttggttcaagtactacaaatgaccaaaacagc

SEQ ID NO: 34188 - DNA, 565 bp, Zea mays
  Clone ID: LIB3059-064-P1-K6-H1
cccgggtcgaccacgcgtccggaccattatctttatctactccagagcgcagaagaacccgatcgacaccatgagggtgttgctcgttgccctcgctctcctggctctcgctgcgagcgccacctccacgcatacaagcggcagctgcggctgccagccaccgccgccggttcatctaccgccgccggtgcatctgccacctccggttcacctgccacctcctgtgcatctcccaccgccggtccacctgccgccgccggtccacctgccaccgccggtccatgtgccgccgccggttcatctgccgccgccaccatgccactaccctactcaaccgccccggcctcagcctcatccccagccacacccatgcccgtgccaacagccgcatccaagcccgtgccagctgcagggaacctgcggcgttggcagcaccccgatcctgggccagtgcgtcgagttcctgaggcatcagtgcagcccgacggcgacgccctactgctcgcctcagtgccagtcgttgcggcagcagtgttggcagcagctcaggcaggtggagccgcag

SEQ ID NO: 34189 - DNA, 286 bp, Zea mays
  unsure at all n locations
  Clone ID: LIB3059-064-P1-K6-H10
ccgatcaggttttaacaactacaacaagttattgtatcgaaccataatacctactctcancaacagcagtttcttccattcaaccaactagctgcattgaactctgcttcttatttgcaacaacaacaactaccattcagccatctatctgctgcctacccccancttttttttccatgggaagttgtgacancatnnaactctcctactaataaacaacancaacaactactaccattcanccanctanctnntntnanccctnctaccttcttnacacaaccac

SEQ ID NO: 34190 - DNA, 530 bp, Zea mays
  unsure at all n locations
  Clone ID: LIB3059-064-P1-K6-H12
cttcccgtttcgactcagcgtccgaatacatttcactcacatgttgctgcggggtgggccaagtaaccaacncaaattncaccaagaaatccatcnagaggccgtcnacaggggaattaatggcgtcgtcgtctagcagcagccaccgccgcctcatcctcgcagccgccgtcctgctctccgtgctcttttcttccagggtggtgggcgnnacctcctgcttgccgggataaaccatcccgcacaacccgctcccgagctgccgctggtacgtgaccagccggacctgcggcatcgggccccgcctcccgtggccggagctgaagaggagatgctgcccggagctggccgacatcccggcgtactgccggtgcacggcgctgagcatcctcatggaccggcgcgatcccccccggcccggacgcgcagctggagggccgcctagaagacctgcccggcttccccncgggaggtgcaaaggggattcgcccccacccttgtcacggaggccgagtgcaacctggccacca

SEQ ID NO: 34191 - DNA, 578 bp, Zea mays
  unsure at all n locations
  Clone ID: LIB3059-064-P1-K6-H3
ggagccatggcgagcgacggcgacggtaagggccgcgtcgctacggcgccgggggcagggtacgggtacgcggcgtacggcggctaccagggggcggaggagcggaagtggtggccgtggctcgtgcccaccgtcatcgtcgcctgcatcgccgtgttcgtcgtcgagatgtacgagaacaactgccccaagcacgggagccagctcggcgactgcgtcgccggcttcctccgccgcttctccttccagccgctccgcgagaacccgctgctcggcccgtcctcctccactttggagaaaatgggagctcttgactggaataaaattgtccatcaaaaccaagggtggcgccttattagctgcatctggctccatgctggcctaatccatttggttgtgaacatgctaagtttgctgtttattggaatccgccttgagcagcaatttggatttgttcgcattggtgccatatacctactgtctggttttggtggcagcgtgttgtctgcactcttcctacggaacagctacatttncggtggtgcttctggagctctatttggcctggtgggatccat

SEQ ID NO: 34192 - DNA, 347 bp, Zea mays
  unsure at all n locations
  Clone ID: LIB3059-064-P1-K6-H4
cgtccccagactttttcatgngatctggaggagatgtgatagtattttgttccggattagagcgcaggcgcaaccgcgcaacgacgaacgaaatgtacaggtcgcttcttgtcaaggttacatggacgaaacaggctctcgtggccgtgctcctttttctccccccaattgagtgcttgagtgtggacnaatntnnncccaaaaaaaaaaaaaaaaaaaaaaaaaaaaaaaaaaaaaaaaaaaaaaaanaaaaaaaaaaaanaaaaaaaaaanaaaaaaaaaanaaaaaaaaaaaaaaaaaggccnccccttttaaaaaatccaaccttacttacccttccttccaa

SEQ ID NO: 34193 - DNA, 98 bp, Zea mays
  unsure at all n locations
  Clone ID: LIB3059-064-P1-K6-H7
ctanctaggaagaaatggagctctctcgcaagctcttcacggccgtcctcctcgtcatgctgctgctgctgtccgcagaagtcgggccggtggcggtg

SEQ ID NO: 34194 - DNA, 270 bp, Zea mays
  unsure at all n locations
  Clone ID: LIB3059-064-P1-K6-H8
actaattattccncaccgaggggggttcccaacaatttctcatccttaataacaaattttaccccccctttatcnncncattaaacnncccnnntttnntnnttacccccancntnaccnctacactttccancnccctaacncccnctcctttcnctttcttcccttnctttctcnccacnttcnccnnctttccccctcaacctctaaatccnnnnctccctttaaaattcccatttaatnctttacntcacctcnaccccaaaaact

SEQ ID NO: 34195 - DNA, 183 bp, Zea mays
  unsure at all n locations
  Clone ID: LIB3059-064-P1-K6-H9
ttcgacctacgcgtccgcccacgtttccgggccctctcagaaggggaggngcgtaatcaactaccancanccaccgccgcctcatcctcgcagccgccgtcctgctctccgtgctcgcggctgccagcgccagcgccgggacctcctgcgtgccggggtgggccatcccgcacaaccctctcc

SEQ ID NO: 34196 - DNA, 209 bp, Zea mays
  unsure at all n locations
  Clone ID: LIB3059-061-P1-N6-A10
gttaattaattggtaacagagcttcacatttgattactgaggtgcttaatggactattcttccataaggggtgttgggtnntnncncttcananacttcatttaatatttacaattccattatcttnctttcttnnattantnccatcatttntacccaaatctctcattattnacctctactattttattcnncannattcaaccacc

SEQ ID NO: 34197 - DNA, 310 bp, Zea mays
  unsure at all n locations
  Clone ID: LIB3059-061-P1-N6-A11
ctatcacgtcccatgcacgcctacctaagctttgatcctcttacacggccggccgttttgtggttttaaacaaccctcctattattgaaattatgaacacccatttagccaaccctggtttttgttacatatcgcatccacctctatcatgctaaacttcacactcttgacagttaaaacgttggaaacaaatcatatctactggggggctctataccactcannacatctctctactaaaattacaangcttcaatcaactcatcacctatttcttaaccctcatcttcacccttntcttctncatact

SEQ ID NO: 34198 - DNA, 387 bp, Zea mays
  Clone ID: LIB3059-061-P1-N6-A12
aaaaagcacggagatcttatcaatctgcaagtacagcgttcaactgctttgtggcaacagaactaaaacatcaactactcaatcgcatgaaagaagtacaacttttgcattgttcacctacatgaagctccactgcggggggagattattcatggtggatgagtaagagtagcttctcaatatattgcctacgtaaagcaaaatctcctgttgccacaatttatcaacttgaaagcacaacataaagcattccttttatttaacattgttgccaggccacagatactggtataactccatctccggcacctatgcctgtggtgatgcctcctcagtcttggcttccttctttccactaaaaagcttttaaccaccataaaaaataac

SEQ ID NO: 34199 - DNA, 436 bp, Zea mays
  unsure at all n locations
  Clone ID: LIB3059-061-P1-N6-B11
tacctaagcttggatctctctacacggccgcccgttttttgtttttaaaaccatttttttttttttttttttttttttttttcaaccttaaaatctcacttcttatttctattttgccccttacatatatccaaaaaacttttttatttaattacctctcataaccattttaaataaatgccccggcgtgtgatatatctttcctactgaccccttccttctatcaaatctagtttnacaaanggcaacactttttctatttccaaaaaggtttcaacattaaccccaaactgcttgtataaaggcatcaacttttgctttttcaaaaaagaaacaccgttttctgcagctagctggctaaatggaacatatattttctcctccaaataaacacccgggttcatttccccccattggttaaatggaaaaagttttt

SEQ ID NO: 34200 - DNA, 70 bp, Zea mays
  unsure at all n locations
  Clone ID: LIB3059-061-P1-N6-B12
aaaaattttttttttttttttttggttttttttttttttttttttntttgtttttttttttttttttttt

SEQ ID NO: 34201 - DNA, 311 bp, Zea mays
  unsure at all n locations
  Clone ID: LIB3059-061-P1-N6-C10
cctctaccacccccgccctttgttttcttttcataaatttcttttttctttctttcttttttttcttttttttttcctcctgtcactctaaaattttttcctcgttctctcctccctgaataaattaaccctcccccttatataatcttactttttcttctggcgggtttgttgtccctaaaacatcccaatccttttatattaatacctcttctttttactnatcccataatcctcctctatattttccttttacatnnnnaaatttaccaaaaccccatannttttttaaaaaaccccctttatttttt

SEQ ID NO: 34202 - DNA, 493 bp, Zea mays
  unsure at all n locations
  Clone ID: LIB3059-061-P1-N6-C11
acctgtttttgtttttaaatttttttttttttttatttttttttcttttttttttttatttttttttttttttttttatcattattcatctttttcttattctcgcaaacacccccctacttcttttttcttacatctatcagccccatctcggggggggtttaatttctcattttccaccatccattacaactttaattccaaaactacccctcntaacataaccancctaacctttttcatcccccctnacatacaaaatccttatcttaatannanatnctacacaccatctttcttacatacttaaaaactaccnttacatttttctaaaaaacaaaatctatttctctataattttttgccccgacaaacaactcgaaaaaccccttaatttttttcctggcttttttttaaaaaaaaataagctttttaaccgctttttttttattcaatatttttttaaaatatactttataagcatttttccccc

SEQ ID NO: 34203 - DNA, 113 bp, Zea mays
  Clone ID: LIB3059-061-P1-N6-C12
cttctatactcataacccttccctactcattacctctactcctaaaaacatcaattccctctccttttaatataaatctatataccaaaaaaactcctcaccactcctacaat

SEQ ID NO: 34204 - DNA, 329 bp, Zea mays
  unsure at all n locations
  Clone ID: LIB3059-061-P1-N6-D10
acaaaaaaaacatcttacaccaaaaagaataggcattccatacattatactttgctctctttaataccacagatgcttccccctcgataccacataataacatacctatgtccatcaaaatctaccnacaattgcgggggggacacaccctatnactatcatacacaaancttacaaaacccnacacttaaccaatcaatctcatcccactatannctcactnaattatctcatattttccaanacctnnatttacaaaanataaaccantccaaactttantattcccacttcttaacctccataccatcannnncnctcccttctac

SEQ ID NO: 34205 - DNA, 457 bp, Zea mays
  Clone ID: LIB3059-061-P1-N6-D11
acataagcttggattctataaagcggtcgaccgttttttgtttttaaattattttttttttttttttattataatttttttattttttttttttaaattattaataaaaaaaagttactaaaaatatttactaactaaaacaaatttaatgaatttgtttctaaaaatttaaaacctataagagggggggtttttaaaaaaaaataaattttaaaataatataaagaccaaaaaaaaaatcaattttttttcatataacttactttttttacatttattttaaaatgaaaaatccacaaattttatttgaatctacaacaaaaaaactttatgatataaataaaaagaatttattaataagggtaatgaattttttaaaaacttataaaaggaaaagggtaatggagaaaattgaagacaataatttaaattgggcataaaaaaaaaatttttgccc

SEQ ID NO: 34206 - DNA, 139 bp, Zea mays
  Clone ID: LIB3059-061-P1-N6-D12
tttttgtgtttaaaattttttaaacttaaccaatttatcatctaaaaaacgttcaaatatcttcgatctacattttcatcacttgataatactacggtatactccccaacccaacccaaacctattctaccctctcact

SEQ ID NO: 34207 - DNA, 321 bp, Zea mays
  unsure at all n locations
  Clone ID: LIB3059-061-P1-N6-E11
ctacctaagctttgatcctctaccacggccgcccgttttttgttttaaaataattttttttttttttttttttgcaaacatatatcttaaatcccaaaattaattcttcatatcacattaactactccaagaacatagtgtctccccatacctaaatccaataaaccttaaaatcctctaaactgggggatcctaacccaaaanatcaaatananctcantcttctcaaccatcaaacattacaccatttaaaccaaanattacacttctcacccttaaacancnacccttccanccacttnntccaaatcaccccttccc

SEQ ID NO: 34208 - DNA, 320 bp, Zea mays
  unsure at all n locations
  Clone ID: LIB3059-061-P1-N6-F10
tttcttattaatgtgcccattataactatatcttttcttttcattcttcaataattcaacattgtcccattttggtcttgtcagggcccttctatcctctcttntctcntctcttatataaaagggggttgttgggtnccactacatacttncatctaaaaaaacacccnnnttctttataacccctcntcctccctcaaaancttcttttttcaataccataatctanttatttttttttcacccaaaaaaaaaaaaaaaaaaaaancctctttcaaaaaaaaaaaaaccacggggggaaaaaaanacccccttttttt

SEQ ID NO: 34209 - DNA, 259 bp, Zea mays
  unsure at all n locations
  Clone ID: LIB3059-061-P1-N6-F11
ctatacatttttcccttttttccttccttttttttttctttctcttttttttcttttctttttttttttttttttcttcacctcccaatcaatactgcttactaccttattatcaaaagatactctattttatcctaaggtttgtttgatttccctcaattanactttctaatacaccctacccccttaccccttnaacttaccaaaaatccttttcttttcatatnnancatataacccccccttcccttatttactc

SEQ ID NO: 34210 - DNA, 270 bp, Zea mays
  unsure at all n locations
  Clone ID: LIB3059-061-P1-N6-F12
ttttgtttttaaaaatatttttttttatttttttttttattttttttataaggaaaaacatatatttcttccacagatttaattttttctgatattcatacatacaacacatacatgctcccatatactcatacttccctaacaataagtatgtttgttaattcatacattncttatttaatcaacttcccccatnataatnaanaanaacaaaaaaantccacaaactaatatccttnttcttaaactcctaacattnaactatcctcc

SEQ ID NO: 34211 - DNA, 382 bp, Zea mays
  unsure at all n locations
  Clone ID: LIB3059-061-P1-N6-G10
acctaagcttggattctcttacacggccgccatttgttttttttttaaaaacacaatactgaaccgatgtgtatatatttaactcacataaagtttctacaagcaatctaataacacacttatctacacctcaacctgaatgacatccataaaatcaaatatacacagggctacacaaatggttagttatgataataatttcttcntttccaccaaatacttatctacactatattttattcaaaataacatnacangaaaaaaaaaaaaataccaatttccaacaaaaatccaacacttcactccctcaaactaatactncacccttctntctcaccaacacaanaaccatgcaataaaaaccttatgttgaacctatcct

SEQ ID NO: 34212 - DNA, 350 bp, Zea mays
  unsure at all n locations
  Clone ID: LIB3059-061-P1-N6-G11
gtgtttaaaaaaaatcgactttattatttcttggaacccacaaacatcatacaaaaaactttattattgaactataactcataataaatctaaaagagggcaccaccaatgatgggttcttgttataactctgctanctttgggggtggaagttcnttcaatagcatcaattgttacacttctaacaggttgccatcgttaagctcatcgtacagatacaactgcaataactcttattatgtcaagaatgcaacaaggctcacaccagctagctcgctgaatgatattagttatttgctactgtaaataagcaaaagagttcaatgatacctttttttttaatcgaaaaa

SEQ ID NO: 34213 - DNA, 71 bp, Zea mays
  Clone ID: LIB3059-061-P1-N6-G12
aaaaaattctttttttttttttttttattttttacttaaaatataatacattacctaaaaaaaaaaaacaa

SEQ ID NO: 34214 - DNA, 249 bp, Zea mays
  unsure at all n locations
  Clone ID: LIB3059-061-P1-N6-H10
atacatccanaaccagaattattcttcccccacnttaaaacaaaccgcccttntctcangtctcntaaagcatcactaaacatntantancatatatacacacatcncctttctcataaacacgggtgtaggcctttacctctttacnnnttactaaacaaaccatatccctatcccactcttcnaatccaaccctcancttnccatantcnaanaccntntnntanactcccatnaaaacatcaccca

SEQ ID NO: 34215 - DNA, 116 bp, Zea mays
  Clone ID: LIB3059-061-P1-N6-H12
caatcaatatctttattatttctatgaaacacatgccgctatcatgccaccattttccattacatctcatatctaatctaaaacatcacccctccaaccatcagttttttccacca

SEQ ID NO: 34216 - DNA, 188 bp, Zea mays
  unsure at all n locations
  Clone ID: LIB3059-062-P1-N6-A10
gggttttaaatatttttttaaaatctggaaatgtaacttcttatttctggttccccacatacatcatccaaaaaactttattattcaattacaactaataaccaatctaaaaaagggcaccaccaattatcttttttttataggggggcggtnnctctatcaaancaatttnnacaaaaggcaacaat

SEQ ID NO: 34217 - DNA, 240 bp, Zea mays
  unsure at all n locations
  Clone ID: LIB3059-062-P1-N6-A11
aaatatttttttcttctaaattttgtttaattccatcaatccatctattatacgaataacctaacaagacctaaaactacaggactctttataagtattatcctacagaaataaacctaaatgttcataccancccgtgtgtggaaaannnaactttatcttcaaaacaaaatanttatatttccttctnctananaaatcatncctncaccaatncactcatncanatattttcttcat

SEQ ID NO: 34218 - DNA, 378 bp, Zea mays
  Clone ID: LIB3059-062-P1-N6-A12
tgttcgggggtttaacatttcatgtctccagggaagacgcccattctacttacacagggaaggaaaaaaaacatcaattcttactctgaggtatggcctgtagagcccttccaagaacaaaggagtagctgtctctgcgtaaacaaaagggggggggggtgccatcataggtggcaatcatgttctctgggctttgtgttggccacggttcgctacttttcggcataaaaggggaatgtaaaactacaggattgctggatctttgcatctgttaaaaagatcctcaatgccgccaagaacttcctcgggtacaggccggggagtgctggtaaacgcgtcgatgttctccttcacctgctccatgggggacgatccaat

SEQ ID NO: 34219 - DNA, 260 bp, Zea mays
  unsure at all n locations
  Clone ID: LIB3059-062-P1-N6-B10
tacacggccgcccgtttttgggttttaaattttttttttttacaatctggaaatgtaacttcttatttctacttgaccacatacatcatccaaaaaactttattattgaattacaactaataagcaatctaaaagagggcaccaccaatgatttnttgttgggggggggcccctnnntctntcaaancaanttnnacaaannncaacaattnttntanttttaaaaannttncnnnnttanccccaaacttcttntaaaa

SEQ ID NO: 34220 - DNA, 281 bp, Zea mays
  unsure at all n locations
  Clone ID: LIB3059-062-P1-N6-B12
ctgtttttgttgttaaacaacaaactagtattcatttcatttttatgtctatattcaaattaatctagacacatatacaaaaacacatacattaataatatgtcttgtttatttgtcttctaactcatttaataatctaaatgactctaaggggggggggnctaaatatctatcttcatcaaataatacaccnnatcaaaatcctccctctttaaacataaataacanaaaaatctttcctacactanccancaacaataatcaancctacttctctaaca

SEQ ID NO: 34221 - DNA, 165 bp, Zea mays
  unsure at all n locations
  Clone ID: LIB3059-062-P1-N6-C10
gattcattaaaaccaaaactttattataaccatacatatattattattcataccacacattataatgtttttccacttactacattattacatatatagatacactgacattgatagagggggtgtcccaaatatcatnaatcantcactactgccaaatatcat

SEQ ID NO: 34222 - DNA, 315 bp, Zea mays
  Clone ID: LIB3059-062-P1-N6-C11
ggtgttttaaatttctgcaaatgtaacttcttatttctgcttcaccacatacatcatccaaaaaactttattattgaattacaactaataagcaatctaaaagagggcaccaccaatcatctatttttcctaaaacgcccctggggggtgcaaatcaagtttgacaaagggcaacaattgttttatttgtaaaagggttgcaaagttaacctcaaactgcttgtagaaacgcaccaactattgctgtatcaaaaatgaatcactgattcctgcagctagctcactaaatagtcctattatttgctcctgcaaata

SEQ ID NO: 34223 - DNA, 291 bp, Zea mays
  unsure at all n locations
  Clone ID: LIB3059-062-P1-N6-D10
tacctaagcttggatcctctacacccgccgccctgtttttggttcaaaaatttttcttcttaaatctcaatcactatattcattatttttacaaaacacattcccctataaccccaccattatcgaatacatctcatatttaatctaaaaaatgccaccaccaaccattctttcctcctggaggggggcanccaccaataacttaaccacctctattcaattaaataacttttttcccttttntacntacccaacaaanttcnacacaatcaatttnttaaatcaaantat

SEQ ID NO: 34224 - DNA, 505 bp, Zea mays
  Clone ID: LIB3059-062-P1-N6-D12
tcgctactggaggttgtttgtcttgctgagacgtttccctattgaatctaaggggcggcaaaagaagctgtatgaggttgggaccgtgacagcaatttgtgttacctgctttctgataagatgtgttgtggtcgcgctatctgcatttggtggtgggtatctctcgaggttttggatcatccagtcctagatttcttctattatatgtgtgcggagatactcccttctgcgctggttctcttcgtccttcggaagcttcctcccaagcgggtatcggcgcaataccaccctattaactagggagttctttggttgtatgatgttacatgctaagaactccggataagctggaactgctgaaaacctacatccggttgtattgctgtaatattttatggaagcatcccagggttggcaagatgcatcatcaccatcatgctctatgagaaaagatgttgagtggggcttatgagtttgtgctactgctagccggagcatcacatga

SEQ ID NO: 34225 - DNA, 192 bp, Zea mays
  Clone ID: LIB3059-062-P1-N6-E10
ctttgttttcgttaaaattatttttttttttttttttctattctttttatttttttttttttccatttttttctttaaccccatacacttggacccccatgcctctaccttttttaacataaacacttttccaacttccaatcaaaacgtggggggtgttaattttctcctaattcaaatacccaaacatca

SEQ ID NO: 34226 - DNA, 478 bp, Zea mays
  unsure at all n locations
  Clone ID: LIB3059-062-P1-N6-E11
cctctacaccggccgacctttgttttctttccaaattcctttttttttaacttttttcatcatctttatttttttaccaacttatttcttaatatcttttatcaccttttttttaccatctctactctttctctttcttcttttttccacattcatcatncccacccgagagtggctaatcnncccctcaaannanttcctaaacaaccacaaaccaccttnctaccttaccataaaattaaaaaacttnatacccctctacaacactaacaatcttnnnaaataaataaaccanactacatatcttaaaaattttcaaaaaaatatatnancatgggatataaaccccaaatcttttttttttcaaannnncccncaaaannnaatncctttaaataaaactaccacgaatttattttcagcaataaaaaaaactattgacaacttttaataatattattattaatgggaggcaaaa

SEQ ID NO: 34227 - DNA, 432 bp, Zea mays
  unsure at all n locations
  Clone ID: LIB3059-062-P1-N6-E12
cgttttggggggttatacttttcttttattcttttttttttgttttatttaactttcatattctgcgggcgagggcgcataaacattgaacagggcttcatgaacaaaacgtacaactcacaccgctttaacaaaaatacatccccctcccaagggggggcaaaacttaaatggttcacccatatcccccttcttattacaaacaaatacccanacccctgggccgggagtatctaaagctcctaaaaccgcccccctagttgataatctcattggtattaccatgctaactaaaaaggggaaaggaaaatgcactactggcatattctgatctacaaacttcctcaactaatngatgatttccatgggtacctggaaacctcccatcatgcccttagctcaaaataggaacctgagatcccttaggggcca

SEQ ID NO: 34228 - DNA, 204 bp, Zea mays
  unsure at all n locations
  Clone ID: LIB3059-062-P1-N6-F10
aaactatcacgtcccatgcactcctacctaagctttgatcctctanaccggccgcccgttttttgtgtttaaaacctccaccaactgctanctactattctttaatgacttgaaaattttccttcttgaactccatcggagagttatttctcttttcttttttttccatgtacaatccactcttcttatgcttctacanctaca

SEQ ID NO: 34229 - DNA, 259 bp, Zea mays
  unsure at all n locations
  Clone ID: LIB3059-062-P1-N6-F11
ctttgtttttttttaaacaatttttttttttttttttcttttttttttttttttttttttttttttttttctttttcttttttttttttttttttttccaaaatatttttctttcttatactccttcaactttctaccttttctccctaccgttgtttgttacccacaatactcacaaactaaaaaaaacccctttcttnccccatacctctcaacccttttttnttttttaaaaaaaaacccaattattcaaccctat

SEQ ID NO: 34230 - DNA, 224 bp, Zea mays
  unsure at all n locations
  Clone ID: LIB3059-062-P1-N6-F12
ataagcttggatcctataaagcggcccacatagtttttttttaaaaattttttttatttttttttttttttttttttttttattttaaaaattttttttatttaataaaaaaataaaaaaaaaaaaaaaattaataaaaaaaaataaataaaaaaattaaaattaaaaaaaaaaataggggtgaagaaaaaaaaaaaaatttccncaaaaaaaaaaaacaccct

SEQ ID NO: 34231 - DNA, 445 bp, Zea mays
  unsure at all n locations
  Clone ID: LIB3059-062-P1-N6-G10
tacacggccccttgtttttgtgttttaaaatgataaaaggaaacttgttttattgttaataataatgagtcacaccccatggcatgtcaactcattatttggtacaacacaaatatttctatctagaatgcaccaccaacaaagggttnctttaagaacatgggggggatcntcatnnccattgggttcaacattaatggtaactgctgttgcagcataatctgcgagacggcgtctcagtgacattgtggcatcatcatttgcgacatcatgctcggcaagaccattggtgacatcatgctcggcatcatcaatggtgacatcatgttaggcgtcatcatctgtggcattatcactcgcatcgtctgaagcggtaaggccaacagttgctgcagcatcagggactgacaccccatcaagcttgcaagcccctgttgcatcatgc

SEQ ID NO: 34232 - DNA, 84 bp, Zea mays
  Clone ID: LIB3059-062-P1-N6-G11
aaatatcttcttttcttctttcttgtcctttttattttttttttctttattactcatattaccaattcttatttcaaacttttc

SEQ ID NO: 34233 - DNA, 398 bp, Zea mays
  unsure at all n locations
  Clone ID: LIB3059-062-P1-N6-G12
cgtttgtgggtttatattttttttttttgtagaatctggaaatgtaactttttatttctgggtggccacatacatcatccaaaaaactttattattgaattacatctaataagcaatctaaaacagggcaccaccaatgatctcttcttgggagggggctncttnntttctcaaaccaaggtcgacaaaaggcaacaattgttataattctaatagggttccggggttagccccaaactgctggtaaaacggcaacaactgttgttgggtcaagaaggaagcacggcttgctgtanctagctggctaaatggtagggggatttgctgctgcaaataaccagcggggttcagtggggccaattggttaaatggaagaagttgttgttgttgagagtagg

SEQ ID NO: 34234 - DNA, 220 bp, Zea mays
  unsure at all n locations
  Clone ID: LIB3059-062-P1-N6-H10
ataaatatagctcttcattcacacttcaccttatactaatctctacctctttgaaaaaaaaactgcatcaacaacaatctgcattcaagataaaaagaaacaaaaaactactccaaataatttaaccacgaacgatgtctataacantcacacaattcaanaaacaacaaacaancattctanaaccanaanatncctccccaatctcaannnctnatct

SEQ ID NO: 34235 - DNA, 385 bp, Zea mays
  unsure at all n locations
  Clone ID: LIB3059-062-P1-N6-H12
acctgtttgtgttttttataacaatttacaaatggacttgattatttctgggaagccacaaacatcaaacaaaaaactttattatagaactataactcataagaaatctaatagagggcaccacctatgatgggtttgctgacaaacgctgctggggggggggcaaancaaggtngttcaatggcaacaattgtttcanttttaaaaaggtgccagctttaggctcatcgtacaagtagaacagcaataactgttattgtatcaagaaggcaccagggctcacaccaactatctggcttaatggaagtagttcttgctggtggaaataagcaagagagttcaatgatgccagttggttgaatggaagaaattgttgggggtaggc

SEQ ID NO: 34236 - DNA, 269 bp, Zea mays
  unsure at all n locations
  Clone ID: LIB3059-063-P1-N6-A10
ttaccaacttagtattgcacctaacataatattataaaacagaccttaataaatcaaaccttccttctcataccaactgagatgatacaatattactccttaatacaaacacatcatttttcttaaacgttgttgaccanctaataattctatttnccattatataatccatccttctcttaatcacatactccctcacttcantcnntatcacaatcaacacatanccaccccatcctctaaaacattcacaatctactnatnaattc

SEQ ID NO: 34237 - DNA, 355 bp, Zea mays
  unsure at all n locations
  Clone ID: LIB3059-063-P1-N6-C11
tattttctttttttttttggagccgccaccacactacgcacttattatatttcatactttcttcaataacaaagattcatatgtccaaattacttacagataacaaacaccacaggcttggaagcaatancacacagtgaggcgttacatctatgtaaacctcatctttacatatccaattattaaccacccatatttcaantacaacaaatacacttctttaaacancttatccttaatcaaaaatnaaactttatccctccccccnttacatnatnacattcanttccttcaacanncccttaccaaacctcagggcggatctttcctttagcccggggcatccatttcccaa

SEQ ID NO: 34238 - DNA, 556 bp, Zea mays
  Clone ID: LIB3059-063-P1-N6-C12
cgttttggggggtttttaattaacaccatccatttgtatggcgtcatcacaattccatcttctcttattcactctgacatcagcacgacaccccacaagaggcccccacacaacagagcacacagctcctggcccgcattgaacgccccgggcgggacccactaccaggacaagatcaagctcaccacgcgcgaggacttgccccggcacgacacgcaacacgggatggaggtcgcagagaacgacggcgccccgaggctgggcccgtcggacggtgccttgatgctctccggccagataggcggctcacgcggcgctgaacgcactgggctggcacaccgccacggactgctcgctcaccgccgggtacaccgctctgatggaggcgtccacggcggcgggcctggccagcgcgttcagcgccaggtgcgccggcttctggccggagatcagcatggcgccgaacgtcgggcccatcctcggggcgccgtcgatctctgcgacctgcatcccggtggcgatcatgccgggcacgagctcgcgcgtggggcgcacg

SEQ ID NO: 34239 - DNA, 359 bp, Zea mays
  unsure at all n locations
  Clone ID: LIB3059-063-P1-N6-D10
tggggtttaactccttctatatccttttctttgaacctaaaaatcacaaatacttttatttataaacagcgcacccaaaaaaaaaaccaacaacactttactcccaagacgcttaccacaagcactaaaaacactttacgacgactcgggcccttttcantaacccaaaactccaaaactaaaaaatcaatccacttactcccccnaccccttattcacaaccatccnaaaataactcctctttatccctaccctttactaccatnctcctcatactccttcccaacacaagaccncttaatcatgncctcccggtgcccacccacacncttactaaacttcttttcgcaaacaccaaa

SEQ ID NO: 34240 - DNA, 262 bp, Zea mays
  unsure at all n locations
  Clone ID: LIB3059-063-P1-N6-D11
ttctttccccatacctttcaccatctttttctttcatatttttaaaacccaattcttcaaccctactatatccaacatgcaatctcatcatgcatcttacctttatcaccctgttgtgtccaacaaccntcanccctattacaacaaatacctttnntncatttnttnccacaaaacatcaanncacaacaactacaacaacttntnctannaaaccttncttcctactctcancaacancantttcttccattcaaccaac

SEQ ID NO: 34241 - DNA, 319 bp, Zea mays
  Clone ID: LIB3059-063-P1-N6-D12
ctatgacatctcatgcacacctacctaaacttgtatcctctaccacggccgacctgattttgtgattaaattttctcactcatatatacaaaattcactcttttcattatacatcaatactacaaaaacaatagctacaattctccctaatttctatactctctactatgctaccgacacataaacattagggtaatacagaaaagtgggacaagcatactgatttaattaaaactcaatcccaaaatccattgaagtacccagtaaattccctacaacacaactatcttgaaatcctataaaaagagcttatatatct

SEQ ID NO: 34242 - DNA, 346 bp, Zea mays
  unsure at all n locations
  Clone ID: LIB3059-063-P1-N6-F11
ctataccatctcatgcactcttacctaaacttgtattctctaccacgtccgacctgtttttgtgtttaaaaacccaaaaaaaggttctcggtcagacaatctattattcctccaaatacaccataaaacatcttcttcttttacaacaagtcaacaacacaccgccagcacgaagatacaactccaacacgactacagacncacacggggatggcgctacatncacactcaagcattnacacntattccaaccacacaaaccacctccttctnaaagcctacancancnactactaanaaaaacaacatnnnacacactaatttnacnaatttncctacttatact

SEQ ID NO: 34243 - DNA, 342 bp, Zea mays
  unsure at all n locations
  Clone ID: LIB3059-064-P1-N6-A12
aaaaaatctgaaaatgtaacttcttatttctagttgaccacatacatcatccaaaaaactttattattcaattacaactaataatcaatctaaaagagggcaccaccaatgatttcttttatttatcaacacctctggggggggcaaatcaanttcgacaaatggcaacaattattgtanttataagagggttcccaggttagccacaaactgctcttaaaaaggcaacaactgttgctatctcaacaaggaagcactgtttgctgcaactatctggctaaatggtagtagtatttgctgctgcaaataaccatcggggttcagtgcttccaattggttaaa

SEQ ID NO: 34244 - DNA, 215 bp, Zea mays
  Clone ID: LIB3059-064-P1-N6-C11
ctttgtttttttataaaattaatttaattttttttatttttttatattttaatatttaattattttttttttttaatcatatttttatttattttttattactttttttattaaaaacaataaaaatatcttctttataaccaacgggaaggagtggtacttaataaatcacctattttccaaataccacaacttatattatttcaaagggatat

SEQ ID NO: 34245 - DNA, 275 bp, Zea mays
  unsure at all n locations
  Clone ID: LIB3059-064-P1-N6-D10
tttttgctgttaaaaaatctttcttttcttttccctgtttttaacaccctcaacccaattatttctacgcaaactttacacatcacatccttttttctctacaaattacatatccacccttctttaaacaaaataagtacaccctactagcgttggcaatcttaccaaactcactttaatctcccatacttaaccttaattnactcnaattnacctacnactcacttnaccaccatacttttcctttatnaactcactttaacctccaactcatt

SEQ ID NO: 34246 - DNA, 381 bp, Zea mays
  unsure at all n locations
  Clone ID: LIB3059-064-P1-N6-D12
tttcttttttatcaccaaccatcactttataattaccatcaaatttttacaattatcaatattattaacataattcaaaaatatattccatataaatctcaatcaatatattagattatttcctacaaaacacatgcggtggggttagggcacccattatcgactacatctaatatntaatctaaaaaataacccctccaactatgggttacttcctcgacaacacagcgtttattcaagagaactagttttttgccaccaattgttactactctatgaaggcacctaccaattagttacccactgctagtcaattaagtaactgttttctctgttttaggtacccaccaaagttccacatactcagttggttgaatcaaa

SEQ ID NO: 34247 - DNA, 170 bp, Zea mays
  unsure at all n locations
  Clone ID: LIB3059-064-P1-N6-E10
cagttcttttttctttcccctcagcctaacgaatnngtcaaaacctcacccaccgagcgtaggcgcaccatcatttcatctttcctcatggactccttcacataaaaacaatgaccccgaatgcccataattaccccaattatacccacacgaactcatcattttcatcc

SEQ ID NO: 34248 - DNA, 370 bp, Zea mays
  unsure at all n locations
  Clone ID: LIB3059-064-P1-N6-E12
tcaggaactgcggcatcacagctaactacggcgctagtttgatgctctctccctcaaggccatcaacaaccctggctgcggacagcccgtgcccttgaaggaggtctccttgatgtgctcccactccttctcatacgagtgcttcctcaccaggggggggatcttcttntcccccccnatnaantacaccatcccancaactgtggatactattagggccttnccagcagggttaatgttagcctttgcccatggcatcatcctgacgctaaccaggttggaaactgcataggcgactgtcgcaacaactactgccttgaaccctacgaaggcctcctatcactagcatcgcttggacagctcaaacatc

SEQ ID NO: 34249 - DNA, 283 bp, Zea mays
  unsure at all n locations
  Clone ID: LIB3059-064-P1-N6-F10
actatcacatcccatgcacgcctacctaaccttgtatcctctaccaccgccgccctgtctttgcttttaaacatcccccttcattcccaaagcatctacctttcttcacactgcatatttctcatcactttaattcctattttttttcctatcacttctcctcctataaatgactatccctnnagtcctatattttaccaggcgggggtggttaaacnnatctacnacttcctnacccacaantnccaaaatttcaaaaaattcttcancnatcctatcactc

SEQ ID NO: 34250 - DNA, 278 bp, Zea mays
  unsure at all n locations
  Clone ID: LIB3059-064-P1-N6-F12
tttttgtttttaaaaaagtcaaatactatcacaatccattacatcacagaactataattcccccatatatataatgtactactactgatacaataacagtacctagcctctattcggctcattttcattggcatggcttattctagtgggggggtagcnaaacacactntctactctctccctcacaacatactantatactactatangtccatannaacannnanaancattattataataatanaaacaataataanattanctcnacacntaat

SEQ ID NO: 34251 - DNA, 68 bp, Zea mays
  unsure at all n locations
  Clone ID: LIB3059-064-P1-N6-G11
ctatcacgtcctgcattctactaacttggtccttanatcacccctgattgcgaccaaaacctcagcta

SEQ ID NO: 34252 - DNA, 395 bp, Zea mays
  unsure at all n locations
  Clone ID: LIB3059-064-P1-N6-G12
aaaaacaatacttttttcttttaatttcaattgttcattcacctcattgctcacactaacactgccacccatggtcatgctttacacattattactcaatcatcgcccttaaatcactcaactagctagctagccagggggtatactacancacataatttattcactgcgggacacctcccacatcancttacggtcatagattcggctacttcacacctcacatccacctcagttgctgcgctatcttcgcccccaacagccccgcgacctggccgctttacggctgctgctgcaggatggactggaggaccaagcccaatatctcctggtaccggtgctgcggctccacctgcctgagctgctggcaacactgctgccgcaaccactggcac

SEQ ID NO: 34253 - DNA, 225 bp, Zea mays
  unsure at all n locations
  Clone ID: LIB3059-064-P1-N6-H10
tcatactaaaaacttcattatttaactatatctcatcaaatatctaaattaaaccaccaccaataattgcttcttcatcaaattctatctagtcggttgtgggcaantttattcaattccancaattataacaattctaataacntcccancattatcctcatcattctcataaaacaccaacaactctatttatntcaataaactancatnactcacaccacct

SEQ ID NO: 34254 - DNA, 200 bp, Zea mays
  unsure at all n locations
  Clone ID: LIB3059-064-P1-N6-H12
tacataaacaatgccccctacaggccattataacgccacttctactaacaccaactaatcacttttaatcatcagaatgggtggccttctctcaattatcnnnaattcaaacaccanctccnnaacctcctaccancctttntantccatcccacacaacctaatacctanctcctcttcttacctatccatacaaacct

SEQ ID NO: 34255 - DNA, 609 bp, Zea mays
  unsure at all n locations
  Clone ID: LIB3059-061-P1-N7-A1
ggccgcccttggtgtttttttttgagaaggctacattgatgtatatcctgaggtcacaacagttctcatctangctatcttgttcaacatcccanatcccctctacagtaaaatggtccccatntgggtcatcacctatngattganaggtttttttttcttgactcctgtttttgtttntaccttttttctgttccttttnttctttcccttatttttttcctttttttttttttcttcccttcnnntttttttttttttttcttttnctttttttttttttttctcctttttttnnnntnttttttttttcttctttnttttnttttttttttttcttttttctttttttccttttttttttttttttttttntttctttttttttttttccttctttttctttttaattttttattttttttttttttntttttttttcctcttttttttttctcttttttttttttcttttcttcttttcccctttttttttttntttttcccttcttttttttttttttttcttttttcctgtctttttttattttttttcttctctttcttttttttttttttttttttttnccgtccttctttttttttttt

SEQ ID NO: 34256 - DNA, 167 bp, Zea mays
  unsure at all n locations
  Clone ID: LIB3059-061-P1-N7-A10
cttggcatcctctacacggccnccctgtttttgtttttttttttttttttttttttttttttttttttttttttttttttttttttttttttttttttttttttttttttttttttttttttttttttttttttttttttattttttttttttggnggtcttccctc

SEQ ID NO: 34257 - DNA, 573 bp, Zea mays
  Clone ID: LIB3059-061-P1-N7-A11
gccgttggggttttttttgcaaccctgctgttattggaattatgaacagccagttggccaagcctggttttggttacagatcgcatccagctctagcatgctaaactgcagacgctggacagttaagacgttggaaacaaatcatagctacttgctgccgctataccactcaggacatctctctactgagattgcgaggctgcaatcagggcagcacctatttctgaaccgtcatctgcacgcttgtcttctgcatacttgactcctgaaccgtcatctgcatgcttgacggccactaagtcgtttttgtactgagactgtgaagctgcaatcagggcagcacctattcctgagccgtcatcggcatgcttgatggccaccgccttggacgcctcgtctcctagcagctcacccagtgtggtctccaagcaccggcggaatttggtgtagtgctcgaacagtcctccgtcgatggcgatgactgaccgttggtcctcgacgctgtgatctctcccgatcttcatgaggatccctgcaagccccgcagcagccagccggggctgctcttgtcgc

SEQ ID NO: 34258 - DNA, 581 bp, Zea mays
  unsure at all n locations
  Clone ID: LIB3059-061-P1-N7-A12
gcgtgcgtnagcttgggtacctctanacggccgccctgttgggttttttttagaaagcacgnagacttatcaatctgcaagtacagcggttcaacttgttggtgggcgaacagaaagtaaaacatcaactactcaatcgcattgaaaaaagtacaacgtttgcattgttcgccgacatgaagctccactgcagggggggtgattcatggtggatgagtaagagtagcttctcaatatattgcctacgtaaagcaaaatctcctgttgccacacatttatcaacttgaaagcacaacataaagcattccttttatttaacattgttgccaggccacagatacgggtataactccatctccgccacctatgcctgtggtgatgccgcctcagtcttggcttccttctttccactaaaaagcttgtaaccaccataaaaaataaccccccacattgagaggcttgctagaacaaagtgctcttccttccacttgctcgggctcaacggatctttccacaagggcaccttctcagacccatggccgtctgcggcacccgcaaggccgcggcgagcggactctttg

SEQ ID NO: 34259 - DNA, 545 bp, Zea mays
  Clone ID: LIB3059-061-P1-N7-A2
aacatccctcccatttttattcagctatagttccagttaaactcgcaccctcttccccaaaattatgataggaaacgatctgccaattacaaggagtgaactgaaacagcaggaaacatggttgatatgaaagcaaattgctaagagaaacgatgtgatcatgaaataattaaactgagactcctgacaagctaataagcaaaggatggttcactgggccggaaactccggtaaatggaggctgcaaccggtacgagacccagaagtgcaatctggacctgctctgaggtgcttgtcctgacggtgatctgcccactcagcttgttgttcagaccaagtcgaactgtcatcttcgacccccttccgatggaaaactgggactgcaagtttgcgcccagagcaaggtcccgacgccacttcatcagagagagacccaaggttgagagggactgggctatcggatagtctttgtccttcaagcgtgcctccaggttagctccatatgcagggtccccttgggctcgcattgcgccagtgcttgcaac

SEQ ID NO: 34260 - DNA, 398 bp, Zea mays
  unsure at all n locations
  Clone ID: LIB3059-061-P1-N7-A3
ggttgggtcatatcagggggttgtggaaagtagaggggggcgccgacgtccagccccgccttcaaggcggcctcaggggggggggggggagagggaaacgggggggggggggggaaggggggggggggggagaaagaggcgcccgggcctcggggtgagagttaaaaaaaatgggcaaagcaaaaggccccggggggggggcagcacaggggggcacaagggacggggcggccgagggggggttttgggggggggggggcgggccggagccgggaaggggccaaagggggggggggggggggngggggggctgccccacccccgcacntgtcggaggggggggcccgccccccgccgggagggtcccgctctgaaagcgcgtgtgcgggggtgggggg

SEQ ID NO: 34261 - DNA, 493 bp, Zea mays
  Clone ID: LIB3059-061-P1-N7-A4
taacatggcacagctggcattctgaccagttggcccaatatttcaagaacgtgaatgagataaaccctacatactgttataatgctgatgttgattattacagacaattcttggctccattccaatgttgaaagaatttctgaaccgcaagaaatgtgacaaaattatttgacggtctcaaaccgtgttaaacaccccaaagaagttcgaggtgctgccagttaacctcttaaagctaaagctcctctcatatgtgacaaaaaatattaggatgacaaaacaatcagaaggaagaatcacatccgtttctcagatgtgatcacagactgcgtttgtaaactctgatgtcgatgcctttccaccaagatcagcagtcctgtacttcccctcggcgatggtctggaggatggcgttgtggatccggtctgctttgtcgttgaattgcttgtggcgcaacaacttgtcagcacttagcttaagaagcgtcgggttt

SEQ ID NO: 34262 - DNA, 453 bp, Zea mays
  Clone ID: LIB3059-061-P1-N7-A5
gaattgtttgcaaatcgtttaattgaatgtgatatgttgctgggacattacatgaacatactttttaaaaaattatggggcagacaattgctgattactattactaattggaatgtaacacgcttgagacagcaatacattacagagctacctaaatgggaataccacaataccgaccgaaaccaccatgaataactgaattaagcttacacgacatacccaacacgggaaaccattttgatgaaattcttgcggctgcctggatgctgtgtgcatcacagtattgaacctcacgggacgcagcagcagacaagaatggcaagtttcaatgataacgcatcaaagacagcatgttgaattcttgcagattgaaaccatttcgctcccccaatgcccgcctcagatcttgtcgagcttttttttcctcaccacaggattggccttgacaatcaa

SEQ ID NO: 34263 - DNA, 211 bp, Zea mays
  unsure at all n locations
  Clone ID: LIB3059-061-P1-N7-A6
ggggggggggggggggnnnnnttttttttttttttggggggggggctttttttttctaaaaaattttttttttttttttccctttttaaagcttttaaagggggggcccccccatttttttttttttgggggggggcctttgttttttttcaagaggggtggtgggggggtatctttttttttgtttgggggggggggggggggccgcccc

SEQ ID NO: 34264 - DNA, 349 bp, Zea mays
  Clone ID: LIB3059-061-P1-N7-A7
ggggtgggttttttttttttttttttttttttttttttttttttttttttttcccaggggaagacccattttattccggaaacagatgcccaggctttctccgggtcctctgatagaagctcacataggttcacagttcaaacttgacttacaggggggggggcaaaacatacagcactttgttctaactggggacacgaaatcctttttttttttttccctttccgttcactgcctcaatctaggaagactgccggggctccgggcccacaaagtcggcgttggcaggcccagagatttaaacggggggccttagtttggcgctgaccttgttggccccggggcctgg

SEQ ID NO: 34265 - DNA, 170 bp, Zea mays
  Clone ID: LIB3059-061-P1-N7-A8
ctgggttttttttttttttttttttttaggataacaaaatgtattaatcccaggaagttcagcttcaagctgtggagacaaaagtttcacggtatcttatttaatgagataacatcaccgaaagaaaatccatgaataatcccagacggacgcgtgggcgggcgcgtggg

SEQ ID NO: 34266 - DNA, 452 bp, Zea mays
  Clone ID: LIB3059-061-P1-N7-A9
cggggggttgtttttattttttttttttttgttttgtttttttttttttttttttttttttttttttttttttttttttttttctgggtctggttttttgggggaaaaccccagccttgccaaagaaggggcctcgggccttaatccactggggggggggggcgcggatgaaaacctcttccctatggggcctttttggggtacccgaaccagaaccaagtcttgggggattggcttcaaatggaagggggctgtattgggcccgcgcttttggccctccccgggggtcaatatctgaagatgttcctttcagcggattgggggtaaatccaatggccccacctgggaatgcttggggggaccacctggttattttttgctggttgataaaactccggagggggctgcccccctttaattgggttgcgctcaaagggcgaacaacggacccc

SEQ ID NO: 34267 - DNA, 393 bp, Zea mays
  Clone ID: LIB3059-061-P1-N7-B10
cgggggtttttttttttttttttttttttttttgttttttttttttttttttttttttttttttttttttttttttttttttttgggttttttttttttttttttttttttggccgccaatgatcaaccagaggggtaccattttaaaccaaaggggggggggaattagtctatccaaaaagaaacaagctaataaaaatttaaacaccttggccattggggggggttgggcttaaaagcaggctttttggccaaaaattgggggggccggggggaacccggggaagggagaatttcaatcagggtgctcccgagaagggaggggggggggaaaaaaatttctcgaggggaaaccatgggggccagggggggtccctgtgccaagcccaaggg

SEQ ID NO: 34268 - DNA, 471 bp, Zea mays
  unsure at all n locations
  Clone ID: LIB3059-061-P1-N7-B11
gtgggttttttttttttttttttttttttttttttttttttttttttttgaatctggaaatgtaacttcttatttctggggggccacatacatcatccaaaaaactttattattgaattacaactaataagcaatctaaaaaagggccccaccggggggggggtgttggtaggaggcccctgggtctgtcaaagcaagttggacaaagggcaacaattgttgtagttgtaagagggttgcggggttagccccaaactgctggtagaaaggcagcaactgttgctgtgtcaagaaggaagcacggtttgctgcagctagctggctaaatgggagtagtatttgctgctgcaaataagcagcggggttcagtgcggccaattggttaaatggaaaaagttgttgttgctgncagtcggccttttctagctggctaaatgggaataggtgttgctgccaataagcagcagggtt

SEQ ID NO: 34269 - DNA, 438 bp, Zea mays
  unsure at all n locations
  Clone ID: LIB3059-061-P1-N7-B12
gcncggttggggggtttttttttttttttttttgggggggttttttttttttttttttgtcgcttgggcgggcccggggggtgacccggggaacccggcccgggcccccccggcggccccccgggccccaccgggggcccccccacacccgggggggggggggggggcccccccccccctcttccacctttcacccccccccaatccccccctcctccctccccctatcctaatccttaaaccccccctcccccccctactccccaaccccacatcaatcccctcccccccccctcccccctcccaccccccaacccccccccccccccctcctccccccccccccccccccccctttctcccccttctccccctcttccccccccctccccccccctccccccccctcccccccccncccccntccccccccccccc

SEQ ID NO: 34270 - DNA, 414 bp, Zea mays
  Clone ID: LIB3059-061-P1-N7-B2
gcgtcgtaagctggtccttagacggccgccttttttttttttttatagtaaaaacttattattgaacatactcatagaaattaaagagggcaccaccaatgtgggtgtggtagaacactgctgggtttgtcaaacagttggttgaatggcacaattgtgcagttgtagaggggccagcgttaggcgcacgtgctggtagaacgcaacaactgggttggtaagaagtagcaggctcacaccactgctggctgaatggagagttgtgctgtgaaataagcaggagagttcaatgctgctagttggtgatggaagaaatgctgggggtaggcagcaggtagctggctgaatggagtgttgtgtgctattttagcggttcatgaacctattgttgaatggaagaactgtgtgctgaga

SEQ ID NO: 34271 - DNA, 478 bp, Zea mays
  unsure at all n locations
  Clone ID: LIB3059-061-P1-N7-B3
ctacggaatcattccactcgcataaagctgaaactaaccaaattctggaagaagcagagatgacaggaacgaacctaggagnatgaaaggaaggaatctaggagatgacagagagggtattacaggtcgccaccctggcaacgggacacctgattcaagctgacccaacccctcctctcctcctttcggccagaccaaatccatccacgaccagtatctaattcagggaggaccatcccttagagatgtgaaataacagaaaaacgcccaaaactagctggtgcgttaatccccttgccggttgcggccgcccgctgctaccacggcggctggggtgcggaactggaggtgctggcctagctgacggtcttgtgcttctggaggttgagccctgtcacggtggcngcgaggaggcggctgttgtgcttggtggtgccgtcggggccctcccccgcttgggttttgagtgcgacggtgc

SEQ ID NO: 34272 - DNA, 330 bp, Zea mays
  unsure at all n locations
  Clone ID: LIB3059-061-P1-N7-B4
gggggggaagaaagtggaagtaacattgtctgtgggggagaagatgaggtgttgtttattttgaggggggtcaggaactttttgtctgggttccaacaggtagaaaaaggggaatggaaaagagttttttttgcccacattgcttatgaaaatagaaggaaaaactgaagaaattgtggggggtggtcgtattgggaggggaaaggttcattttttgagagggtgtaattgcccggggggaaccctggcggtgtaaaaacagtcgggggggggcaaaaaccccgggggttcggggtgggggggtttttgggggtccccgngttggggggg

SEQ ID NO: 34273 - DNA, 520 bp, Zea mays
  Clone ID: LIB3059-061-P1-N7-B5
agaaatggactttattatttctgggaagccacaaacatcagacaaaaaactttattattgaactataactcataagaaatctaaaagagggcaccaccaatgatgggttgttggtagaacgctgctgggtttgtcaaagcaagttggttgaatggcagcaattgttgcagttgtaagagggtgccagcgttaggcgcagcgtgcaggtagaacggcaataactgttgttgtgtcaagaaggcagcagggctcacaccagctagctggctgaatggtagtagttgttgctgctgtaaataagcaggagagttcaatgatgccagttggttgaatggaagaaattgttgggggtaggcagcagctagctggctgaatggtagttgttgttgcaaataagcagcagagttcaatgcagctagttggttgaatgttttaactgctgttgctgagagtaggcagcaaggtttgctagcacaagttgttgtagttgttgtgccctgatgttttgtgccaataaatg

SEQ ID NO: 34274 - DNA, 287 bp, Zea mays
  unsure at all n locations
  Clone ID: LIB3059-061-P1-N7-B7
gggaatcaacagtaaattttgtacccggggccccaaacacacacagggaggggtaaacagcttgcacatctaaacgatccaaggcccaggcggggggggggacccagaaacaacgccccccacaaacggcaaacgcctcacacccggggcccaatttgggtattgttgttgggccatgggcgaccgggggttctatgggccccagggccagccctgagcccataactaccaagaaaccctngccctgccggggggcgcgtgggtcggcccgggggttcgggcccggg

SEQ ID NO: 34275 - DNA, 448 bp, Zea mays
  Clone ID: LIB3059-061-P1-N7-B8
ctgtgtttttttttttttttttttttttttgcagcagaagaaaacaacttatatcgcatgttcgacagaaacagcaagattgccagtttgccacccaatactagtatcaggttatgcatgtggggagaacaatgtttgcaacactacccatgaatggggggtgatgaaaggcaacagtatacatacaagcagggtgattgtgatgcacattgcgcattggatttttgcttattgatttatctccttgctcttttgctcaatcatataagccttcttcatttcttccaggattgcatcatttgtgtattgatgaaggcactcattcaactcttttgcttgtttgcggcattgccataccacagaaaatgttcttccccgtgcgcactcagcatattttggacaatagaaatcacattcctgaagagccttttgtttcattttgctccgc

SEQ ID NO: 34276 - DNA, 600 bp, Zea mays
  Clone ID: LIB3059-061-P1-N7-B9
agaaatgtactttcttatttctgggaagccacaaacatcagataaaaaactttattattgaactataactcataagaaatctaaaagagggcaccaccaatgatgggttgttggtagaacactgctgggtttgtcaaagcaagttggttgaatggcagcaattgttgcagttgtaagagggtgccagcgttaggcgcaacgtgctggtagaacggcaacaactgtggttgtgtcaagaaggtagcagggctcacaccagctagctggctgaatggtagtagttgttgctgctgtaaataagcaggagagttcaatgctgctagttggttgaatggaagaaattgctgggggtaggcagcaggtagctggctgaatggtagttgttgttgttgcaaataagaagcagagttcaatgaacctagttggttgaatggaagaaactgctgttgctgagagtaggcagcaaggtttgctagcacaagttgttgtagttgttgtgccctgatgttttgtgccaataaatgcaccaaaggtaactgttgtaatagggctgatgattgttggaggaacagggtgattaaggttagatgccagctgcga

SEQ ID NO: 34277 - DNA, 394 bp, Zea mays
  unsure at all n locations
  Clone ID: LIB3059-061-P1-N7-C1
ggccgcccgggggtttgtttttttgtttttttttggggggggggggggngtgngnnnnnnnnnnngtnnggnnggggttggggggggggggggggggggggggggggngggggtgggggggggggggtgtgtttttggngnggnnggnnnntngtgggggggggggggggggggnnnnttttttgtnttggtgtgggggggggtggggggggggggggggttggggngggtggggggggggggggggttgggggggggggggggtggggggggggggggggggggtggtggggtggggggtggggtgtggggtggggtggggggggtgtntgggtggggtggggggggggggggggggggtgggggngggttgggggggtgggggtgggggggg

SEQ ID NO: 34278 - DNA, 151 bp, Zea mays
  unsure at all n locations
  Clone ID: LIB3059-061-P1-N7-C10
gcgcggctgtttttcccgggaccgggcgggccgggtggagggtccccccccggtttatttntgcggcttgctttttggttggggggggggggggggggntcctacccccttccctcgggggggccccccntcccggggggcgggggtccgg

SEQ ID NO: 34279 - DNA, 489 bp, Zea mays
  Clone ID: LIB3059-061-P1-N7-C11
gccttgtgtttttttttttttttttttttttttttttttttttttttttttttttttttttttttttttttttttttttttttttttttttttttttttttttttgaaaaaacacacaaatgttttttataaaaaaaaaatggaacctttgggggtgggggggggtttttatttcccacttaaaatttccatttaaatagaggaagggccgggaaaaaaaaaccccaaaattttttaaagcccgtggggaaaaaaaatttttgtttgctttggggggggaccagccttttttcttccaagtttaaaaggaattgttatttttttcaaaaaaaaaaaaccggatcccctttaattttttgtccgggtgaaccaccccaaaaagcctttatttttttggggggtttttttttccgccctttgggcggggcacaagctcctttcttaagcccttttctttttggggtttcttggggggcgttgttccccccc

SEQ ID NO: 34280 - DNA, 598 bp, Zea mays
  unsure at all n locations
  Clone ID: LIB3059-061-P1-N7-C12
gcgggggggtgtttttttttttttttttttagactcagaaccattgcaaactcattaactttagacaaaaaaacatcagtaccgctgtttttaagataaatgtatattggaaaaaaactggcaccactcaacaataaactcagaccaagatgttgggagggggcgggggtccnaacaacatttctgtaatagactagaagggataaactggcatcccagcacaaacttgacgagctgagccgctgccgttgcccaatctcagaaactgaactctagatcttgttgaaagccacaatgtcgcaactctggacgtactcattgatgggctcttgcgtaagggggtcctcaattagagtgtcgatggacacaagatcgtcgacaattgtcaacatgatagtcatcttcttgatgccgtatccaacaggcacaagctttgatgctccccaagtcagaccctccatctggacactgcggacagcctcctccagcttcttcatatcagtctcatcgtcccatggtttgacatccataagggcggaggatttaccactttttttctttttagaagaggccttggcggcggcggcacgctcctcag

SEQ ID NO: 34281 - DNA, 250 bp, Zea mays
  unsure at all n locations
  Clone ID: LIB3059-061-P1-N7-C2
gggcgggtggggggggggggggggggggggggggggggggggggggggggggggggggggggggggggggggtttttttttttgggggtttttggggggtggggggggggggggggggtggggtgtggtgggggggntggggttngggggtggggtntntgggtttggggggtgggggggggggggggtggggggggggggnggggggggggggggtggggggtgggtgggngggggtgtgggggggggg

SEQ ID NO: 34282 - DNA, 551 bp, Zea mays
  Clone ID: LIB3059-061-P1-N7-C3
aaatctcaatcaatatattgattatttctaggaaacacatgccggtatgagggcaccattgccgagtacatctcatatgtaatctaaaaaaggcacctccaacgatgggttgctgcaaggcagggttcatcaaagagaactggttgtatggcagcaattgttgctgctgcaggaaggtagcgaccaatgggttagccactgccaatggattaagtaattgttggcgctgttgtaggtacccagcagagttcgacacagccaattggttgaatggaagcaattgttgtaagtaggtagcagggtttgccatagctagctgatgagttagagctggtacaatctgttgcagcaactgttgttgtaggtacgttggtgcattgcccacagtgagcggtctttttgtaagcagtttttggttgacggttggtttctccatggttagttttctgagcgctggtttttactgttgtagtttgttgttgttgttgttttgtttcttcttttccttgtctttggttttctgttttttctttcttttttttttttgtttt

SEQ ID NO: 34283 - DNA, 246 bp, Zea mays
  Clone ID: LIB3059-061-P1-N7-C4
ctgggttgttgtttttttttttttttttttttttttttttttttttttttttttttttttttttgttgggaacaaaacttttttttttcaatttaaaacggccaatcagggcaatgcgcaaaccggcactgccccacatggggtggctaggcaggggggggggtaatcaaccgggggaaatggctcaactaggtggctcgccagggggtgtcccccagggcaagggtgtgcgagggggggaccccg

SEQ ID NO: 34284 - DNA, 549 bp, Zea mays
  unsure at all n locations
  Clone ID: LIB3059-061-P1-N7-C5
aattctttaaaaccaaaactttattatgatgcatatattattggtcataccacacatgataatgtgtgtcgtcttactgcattattacatatatagatagagagggatggatagaggagatttcccaaatatcatgaatcagtagtagggcggaatggcagcggagacgccacaggggttggtgcggtagctgggcagctggtactggtactggtagagtccacccatggccggcatgttctgcgccatcatcatggccatggggttgagaccctgggctgccagcagctgctgctgctgctgcatcagagctggctcgtacaggctgctgctggcggcagcggcacgctcaagctgcatcatcatctgcagctgctgcgcgacggactgcacgtccatcattctcatctgctgctggcagcactgttgccggagcggctggtacatggcgctcgtctgcccacacccggcgtagtagggcgccgccgncagcgggctgcactgcggctgcctcaggtactccccgttagggtacagcccgccggcgcc

SEQ ID NO: 34285 - DNA, 628 bp, Zea mays
  unsure at all n locations
  Clone ID: LIB3059-061-P1-N7-C6
gccgctgccggccaagcaggtcgctcgagacgggaatgaagctgcacatctccaatcttgactccggcgtcacggtcgaagatgtccaggaactcttctcagaagttggggagctcaagcgttattcaatgaactatgacaaggatgggagatccaaggggactgcggaagttgtttttgcaaggaaagtggatgctttggatgctatcaagagatacaatggtgttctacttgatgggaagccaatgaatttagagctcattggaaacaatgtcgaaccacctcccttgccaccattaatacacaatcgtcctttgcagaactataacgatatccacagcagtgtgcttcaatcccaaagaaatggtcagcgaagagcacctcaagtcaacggtcggggtggacgcagtagtcaaaccagcggtggccgcggacaggggagaggccgagtgcaggaccggaaccgcacacccatttctgcttcagaccttgacgccgaactcgacaagtaccatgcagcggcagcgaaggaggaatgaggctctggcgttctcttctactaatctatttacacaggtggaaaggcgttctcttctgggggcgttcangaagcatgaagttactatca

SEQ ID NO: 34286 - DNA, 491 bp, Zea mays
  unsure at all n locations
  Clone ID: LIB3059-061-P1-N7-C7
ctgtgtgttttttttttttttttttttttttttttttttttttttttacataagcatattccatttggcaaatattatatcttatacattttttcgagggcaaatggactggtcataatcatataaattaaatttcaggcatggggagctacaggggggggggtccataacatggggcaggctgatcttcatggaaacctttgacgatgatcagaccggagcactaaaccctttcaatttagcatcacagggtcacagggacgatccaccaaaaacagggcgtaaaattgccggtcgccacccntgcctncaaacattccggtcatctccttccgtcccctctgtttctttgggggctgcgggccgcccttgccacccttctgtttaggcctttggggggggggggccttgcttatgggctggccattcctggtggggggcagggcgctgctcgcccctgtgtttggggttttgggggcctggttgtggcc

SEQ ID NO: 34287 - DNA, 463 bp, Zea mays
  Clone ID: LIB3059-061-P1-N7-C8
cgggccggccggggtgtgttttttttttttttttttttttttttttttttttttttttttttttttttttttttttactttttccggggccgggcctgggtcaaagcccctggggaaaggggcttagggccctattccatataataaataccccacacaggggggggggtggggggcccacttgtggtaaacacccctttgaaatttggtgggcagacaacggtttccggccccgggtgttcttacccttctcacattaggctacctgcaggggcccggggcaaacccttttagaggttttggccctccacccgggcccatgggtggaattttgcaggctggggccggaatgccagcatcaaaccttagattcccacgcgcccctttcgggaaagtgggcccccctccggttgttcatgaagacacagcatttatggggtcggggggcctcgcatttctggtt

SEQ ID NO: 34288 - DNA, 621 bp, Zea mays
  unsure at all n locations
  Clone ID: LIB3059-061-P1-N7-C9
atcgaacacccttggagaccaatatcacatgntagaatctggaaatgtaactttttatttctggttggccacatacatcatccaaaaaactttattattgaattacatctaataagcaatctaaaagagggcaccaccaatgatgtgttgttggtaggaggctgctgggtttgtcaaagcaagttggacaaagggcaacaattgttgtagttgtaagagggttgcggggttagccgcaaactgctggtagaacggcagcaactgttgttgtgtcaagaaggaagcacggcttgctgtagctagctggctaaatggtagtagtatttgctgctgcaaataagcagcggggttcagtgcggccaattggttaaatggaagaagttgttgttgttgagagtaggcagtagctagctggctaaatggtaatagttgttgctgcaaataagcagcagggttcagtgtagacagttggttgaatggaagaaattgttgttgcggagagtagggagaaaggtttgccagagctacttggttgatcacaggtagcacgagttgctgcagctgttgtgccctgatggtttgtaccaatgactgcaccaaagatagggctggcgattgttg

SEQ ID NO: 34289 - DNA, 176 bp, Zea mays
  unsure at all n locations
  Clone ID: LIB3059-061-P1-N7-D1
gggggaaaaaggcctctatntaatatctatccgaggggcgatacgaccaccgaacagcaggggttatttactccaccactacaggtccatttatttactcgcantgtannattcccgntcggttctgggggggggggcgggcntttngttcatgcgcttttttgggtgggccgcgg

SEQ ID NO: 34290 - DNA, 505 bp, Zea mays
  unsure at all n locations
  Clone ID: LIB3059-061-P1-N7-D10
gacaagaaaaacatcttagaccaaaaagaataggcattccatacattatagtttgctgtctttgataccacagatggttcccggtcgataccacataatagcatacctatgtccatcaaaagctacggcaagtagcactcaggcacacgctagactgtcatacagaaagcttacaaaagcagagacttaaccaagcaagctcatggcactatgggtggacggaattaggtcatagtttccaagacctggatttacaaaagatgggcagtccaaactttagtattcccacttcttgagctccataccatcaggggggctcccttctaccttctttgctccaacatctttccaattggttgagagaacagtgccatttgattccacgaatgacttcatcatggccctccgcatatcttcatcagcatccttgttgatgtcacggaagattttgttcantgcggcatcaccatcaagttgttcttgcttttcctcctttttggcttcc

SEQ ID NO: 34291 - DNA, 603 bp, Zea mays
  Clone ID: LIB3059-061-P1-N7-D11
cggggggggtttttttttttttttttttttttttttttttttttttttttttttttttttttttttttttttaaaaaaaagagggggccaacaacgggggcacccgccccgaattcacggggtagggttcgccaaccccgagaccaaatagaagggggggggggggaggtcccaacagattctaacagggtccccgggcgcccaaaaaaataaattaactggcccaaacccttcctttttcccccttcatataagggggaaacagcccaaatccccaaggggggcgggcccctacaagctttggggggcagggccagaacctccctcatcgggggcgtggggggcgttaaaccttctaaaccggggggggtcaggggggaaattcgggggcttggctataatgggggcggacccccccattatgggcccgagcattcctgggcggcctgggggggcccctttgggtccaaccgggggggggggccctggctttctcagcatttgcttgggtttttggggggggggcgggaccaatggcccccgggggcaccgccccggggcctggcttttttttggggggggggggggttttcccccccaggg

SEQ ID NO: 34292 - DNA, 576 bp, Zea mays
  Clone ID: LIB3059-061-P1-N7-D12
tgggtgtttttttttttttttttaaactgaaccaaattatgatctaaagggcgttcaaatatcttggatctacattttcatcagttgataatactagggtatactccccaacccaacccaaacctcttctagcctggcacatcagtcataccggggggggggggcatacatgcttcagcttcactcactatcctcattgtcttcgaccaggatcttcttacaggcctcgtagcacatgaacgagatgcctgctgcaggcatcaacttgatgcagctcggtccgagccccttgtacaggccgccaaccccttccttctccattatgcagtagagcgcatggaacacattcttgtagacctgcctccctcctactgctcctacctgcatttgcttgcgggccacctcaagagggaatgttgcagtgctagagatggcgccagcagctgaaccaattaggagagttgcgatgttgctgatctcctcctgcttgaacgtcttcctatagagcttctttagggtgtcataggcgtagtaattagtcgcggcatatggcaccactcctatcagacttggtgt

SEQ ID NO: 34293 - DNA, 232 bp, Zea mays
  Clone ID: LIB3059-061-P1-N7-D3
gtgcttgtgggggggggtggcgcgttccgggggggggggggggggttgtggtggtttttttttttcgctggtgggggtgggggggggggtgttttttgggggcttggttttggggggttttgggggggggggggggcggccggggggtttgggggggtcttgggggggcgcggggggggggggggggggggtctttgtgttcggtgtggggggggggggttttgtctttttt

SEQ ID NO: 34294 - DNA, 329 bp, Zea mays
  Clone ID: LIB3059-061-P1-N7-D4
gggcacaaaacccccggtttgtatgaaaaaaaggggggaataattaccactaggggcccacaacccaggcggggaaaacatttctttttcaggagaaccccttacgggttccaggaaggccccttatgcaaaccattttatttatccccctgagggggttttggggaaaggggttccaccccccacctaaaaacgaataaccccaagcggcaaaacaacggaataaacacaaagctgaacaggtaccaccctggtcgtaaactttccccccacacaggggagctgaagggttttttgattcccggttccctctcccgggttttttggaa

SEQ ID NO: 34295 - DNA, 523 bp, Zea mays
  unsure at all n locations
  Clone ID: LIB3059-061-P1-N7-D5
tttatttttttttttttttttttttttttttttttctttttgttttgtggagtccttaaaccaagaaaccaggggaataaaaataaagttcggaacatgcgggggggcaaacaaaacacgaataggagccacatccacaagggggaaggggcccgcccacggaaacaaaccgactccgcccaccaccaaagaaggggggtaaaaaacctactccagcaaaaggaggcaagccttcccctatctttaagggggccaaccatccaaaaaagccccaccccggaaggatccccaaatatttggaacggcctggggccatggcccaccaggcaagggaggggaaaacccggcgtactgaactgaaaccgggttctgggaaatggaaatctgccgggctctcactgggagaaaggcctggaaccttgaggaccgcccctactcttttggggcactgcttttcccaaactcccttgaacttgcctgggactcggtgnctgggggggagatgtggcctttccggctccgg

SEQ ID NO: 34296 - DNA, 450 bp, Zea mays
  Clone ID: LIB3059-061-P1-N7-D6
gtgggctaagggtttgggggaaaattttcccttggccggttcatcacaaatgtttggggcgcgggcaaatgacaaggggcacggcgtacagggccgggaacacatttattcccttttgggccaaccgaaacaggccgcaggacttgggataccaaacattgacaaataagcagaccggttgccttggcttccccctattatgaggctccgggacacaaactcgtaggaaagctattttttgccacgcaacttggttcccagggccctctcgagcttgctaaagatctggtggggggggattgccttgcctgattcatactccggaaacaccgggggcttttcatttatcatctgagcaaggtgggcctgggtcagctttttattgagccttgcttggatgagaattttctttagatcacttggaacccgctcatgggcgaggttttcggg

SEQ ID NO: 34297 - DNA, 390 bp, Zea mays
  unsure at all n locations
  Clone ID: LIB3059-061-P1-N7-D7
attaaattattgccatattatcatattttcttatggggcaacacatttaatcgagattgaaactcggacgaaatccccgctggaaatagcctaacaatgggccatgggggcccgggaaaacatattactgctacttgtacatccacaatctttagcgagttattataaaactcatacaacatcctgaactctggaggaccaaaccatttatccgagtgtgatccataaacggatggcgctccacacacacaacctggtacaaggggcctcctccagccgcattcagtagtcatcgcctctggaaatgacctctttgcaagttggccggggttngattgtgtgctccacctgtgagacgttgctccctctctcctctgcccggggagggtt

SEQ ID NO: 34298 - DNA, 596 bp, Zea mays
  Clone ID: LIB3059-061-P1-N7-D8
tatcagggcaaaggtttaatttaaatgctcaaaacttaacattgttcacgtccactgccacttcaccgtaccaaattcctaggcaactttagcatcaaaactatgttttttgaagtacatagggagacccaacataacatggaggaatcaacgaaatagagtggagatatccagagggcatcatatttatgcattttcggtcatagggtactcaaagaccacatctttcccacacagcctgcggtagaccgcagtgcaggtctccagcttgtattcagtgttgttcctctcctttgggtccaagaaaatcttgataatcttggaaccatccagacggtatctgacacgcttccccacaatctcagctgggtagacaacatcctccaagatgccatcgtgaacagcagtcagagtcctggtgcgagggcgcagaacagctgaacccttcttgggtggcctcacaatcctccgtgtagcaacaattaccacatccttgccgctgaatttcttctccagctccctgacgagtctgacatggatctttcctgaagccttgcgcagtgcggttgggacgtgaatgatcacagcctttctac

SEQ ID NO: 34299 - DNA, 564 bp, Zea mays
  unsure at all n locations
  Clone ID: LIB3059-061-P1-N7-D9
caccaaaacttacgatttcaattgaattgataagaactgattatgcagggaacacactgttacaatggaagggggtgtagtggcgggaacactagagatctaagcttccattcaaatgaatctaacatcacggggtgcttaaagagcaggaaagaaaacctaatgtacagaagtaactacttcaactccctccccagcctatacacgaagtctagaaaaaaaaatcactcacatgacaacaggtaaccaacaaactactttatcattgcatgcctcgtttgcaaaacagcgtgcaggtgccgccatggagtattttcccaccatgttgaagtctccttattttttacctgtaaatatcgatccttaggatcttaccgagcacgggcagtggccggctgtttcgatgagcgcccggacttgtgcttgcccttttggttcaccactgcagcnggatcaaccattggtccagaccaagttggcacagcgcctttttcgtgtgtgaacacattgctgtaggatgatggctccggaggttcgctttggggttcctttggtttgcggctt

SEQ ID NO: 34300 - DNA, 276 bp, Zea mays
  Clone ID: LIB3059-061-P1-N7-E10
ccgggctcaccgtcgaggagcgcaacctgctctccgtcgcctacaagaacgtcatcggcgcgcgccgcgcctcctggcgcatcgtctcctccatcgagcacaaggaggagacgcggggcgcggcggggcacgccgccgccgccagggggtacggcgcgcgcgtggaggcccagctctccgggatctgcgcggggatcctgcgcctcctcgacgagcgcctcgtgccggcggcggcggccgtggtcgccagggtcttcttcctcgagatgggtgggg

SEQ ID NO: 34301 - DNA, 471 bp, Zea mays
  Clone ID: LIB3059-061-P1-N7-E11
ctgggtttttttttttttttttttttttttttttttttttgcaaacatatatcttagattcgagaattgagtcttgatatcacattaggtactcggggaacataggggggcgccatagctagatgcaataaaccttaaagtcctctgaactgggggggggggacccaaaagagcaaatagagcgcagtcttctcaaccatcaaacatgacaccattggaaaccaaagatgacactgctcacgcttcaacagcgacccttccagccacttggtccagatcacgccttccctggttggtgatgaggcgtccacccttgggatcgacatcgatgatgcccataatctgcagctgctgcaggatgttgcgtgcaacagcaccactgctcttgcagaagtgtggggggcgggagccattcctctggcggccaccgttgatcttttgaaagccacccacaccgatgccttgccttag

SEQ ID NO: 34302 - DNA, 448 bp, Zea mays
  unsure at all n locations
  Clone ID: LIB3059-061-P1-N7-E2
acaggtgaacgagcaggcatttttattcgaagcaaaggtgcagccaattctcaccatactaggaaccaggccagcgctgcccaaaaacgctcaaacaagaaagaaaaaaaaaacaggaaccaaagttcttggaaaccaagtacacataactccaatacacgactaacaatgcgaattgcggtgaaacagatcgaaatgcaggcgatggttctccggcctgggcttcttcttcttcttctccttctttccccgtactaatcgaaggacagcggaacctggcttgccaggctacggtacttcagggcgtagaacatctcgatgtatcggtttttttcgcgcctctccaggttgctcacgtacttccagaacccgtacacgccggtcagggtcatcagcctctcggagtagagcttccaggtgtccttttcatanattctctgcaggccgc

SEQ ID NO: 34303 - DNA, 472 bp, Zea mays
  Clone ID: LIB3059-061-P1-N7-E3
tttatactattcgtaatcggatctgaatctaattacaggtgtatatgcatgtattatgatttatgcctactaacttctattgctttgcaaaaaaaatactgggtgtacatgtgtacactatacatccatgctctttactgagtccgcccctggtctgatcgattcttgcttgacgccgcctggtccatggatgaaccgtgtcacctacaattgattctgggatccggcttctgatttttccgtgtgagttttcaggccaacgggacctgattcatggcgaagcaggcgttcgccacgagcagtctcgtggtcgggttcgcgctgtgctccagcttgctggctatcatcaacaagtttgccatcaccaagttcagctaccccggtactgctgtccgccctgcagttcctgtccttgttggttggtgtgtgggtgctcgggtaagctcggttttctttgttccgtctccttttt

SEQ ID NO: 34304 - DNA, 530 bp, Zea mays
  unsure at all n locations
  Clone ID: LIB3059-061-P1-N7-E5
aaaaccaaaactttattatgaccatgcatatattattggtcataccacacatgataatgtgtgtcgtcttactgcattattacatatatagatagagagagatggatagaggagatttcccaaatatcatgaatcagtagtagggcggaatggcagcggagacgccacaggggttggtgcggtagctgggcagctggtactggtagagtccacccatggccggcatgttctgcgccatcatcatggccatggggttgagaccctgggctgccagcagctgctgctgctgctgcatcagagctggctcgtacaggctgctgctggcggcagcggcacgctcaagctgcatcatcatctgcagctgctgcgcgacggactgcacgtccatcatcctcatcttttgctggcagcactgttgccggagcggctggaacatggcgctcggctgcccacacccggcgtagtagggcgccgccgccagcgggctgcactgcggctgccttcagtncttcgcgttgggggtcagcccg

SEQ ID NO: 34305 - DNA, 453 bp, Zea mays
  Clone ID: LIB3059-061-P1-N7-E6
gggggacctgaagcgcataaaaactaaaaagctctctattatttttgggcacgccgcaaacatgatccaaaaaacttgagtggggggctataactcataagcaatctaaaaggagggccccaccaatgatgggtggttggtagaacactgtcgagttggacaaagcaagtgggttgaatggcaacaattgttgcagttgtaagagggggccagcgttaggcatagcgtgcaggtagaacggcaacaactgttgttgggtcaagaaggcagcagggctcacatcagctagctggctgaatggtagtagttgttgctgctgtaaataagcagcagagttcaatgctgctagttggttgaatggaaaaaattgctgggggtgggcagcaactagctggctgaatggtaattgttgttgcaaataagccgccgggttcaatgccgccagttggttga

SEQ ID NO: 34306 - DNA, 366 bp, Zea mays
  unsure at all n locations
  Clone ID: LIB3059-061-P1-N7-E7
aaaacgggaatcccggggcccaaagcattatcaggaatcccagcacccaaacgggggaaaccccaatcaagcgggggggccggggggtccacagacccccccctaacccgctaaataaaaccgggggcggtccctggtaaactaagcccccccctcagaccccccccctttttttcagacccaaaggacccgcccccgggggggccccccatgccggggggggggcggcccacccgcccctaccagagggatctaggggggctgtccccagtcagggcccttgccccccttggggggggggccctgggggggcccccccttttggggggccttggcgacgttcatccccttnacgacctggccgaa

SEQ ID NO: 34307 - DNA, 525 bp, Zea mays
  Clone ID: LIB3059-061-P1-N7-E8
agccataacaaacatgttttgcttacaacaatctgctcatttttttcctggcaaatcactcggtgtctcaaaaactttagagctatgtagttgaaagactaatcaacacgcgggggagccatgagcaagctttggttaattattacaggctacgagtacttattcaggcagatcactctgaggttgtgcctactgttgggcgctgccagcttgaccttgttggtagctgccactgccagcaggagtaagcacagccagctcatgcttcctaccgttcttgagctctgcagcttcctccatggagatggcatacgagctggcgatgacggcggccggcaagtcgctcaggacggagttcttcccggcgacgtggctgaccatggtgtcagggttcgtctcgaaggcgatgtactggaagccttctccctgcgccttggtggcgacgaggtagccctggggttcgatgagcagctgcccctcccggggctcgttgtctaacaccgtggtcccgttgtgcctggcgac

SEQ ID NO: 34308 - DNA, 66 bp, Zea mays
  Clone ID: LIB3059-061-P1-N7-E9
aaaaaaaaaaaaacccacccccccggggcacccggggggggacccggggggggggggggggggggc

SEQ ID NO: 34309 - DNA, 78 bp, Zea mays
  Clone ID: LIB3059-061-P1-N7-F1
gtcttagcagcgtactgatacttggacctctagacggccgcccttggtttttttttttttttttttttttttttgggg

SEQ ID NO: 34310 - DNA, 371 bp, Zea mays
  unsure at all n locations
  Clone ID: LIB3059-061-P1-N7-F10
tgggttttttttttttttttttttttttttttttttttttttttttttttttttttttttttttttttttttttttttttttttttttttttttttttttttggtttttttttttttttttttttttttttttgccggcggaaaaattctgtgggggggggggggggccccaaaggtcccanggggttcacctggttttttgaagcccctggggttgccccattggggcctttttttgttcccggggcctttgtttttgttttccacctctgccccgcgggtttgtgtgggccttttcgtgccctattggggccttggtgtctttttgtttcgtgtccgtattattttttttttttttggggccctttttt

SEQ ID NO: 34311 - DNA, 457 bp, Zea mays
  unsure at all n locations
  Clone ID: LIB3059-061-P1-N7-F11
aacttggaatcctctaaacggccgccctgtgggtgttttttttttattattttttttttgttttttttttttttttttttttttttttttttttttttttttttttttttttttttttgcccccaaatcatcccgctttaaaacctggtcccccagggtaacaaaaaaaaatttaaggttttgttttggggcacaaatagnacttttcccttccccccacccccttaccccttgggcttaccaaaaaacccttctttttcactgggggcctggaaccccccctccccaaatttggaccatttgtctgttaactttgtcttttttccccccccccccccccgggggggttcctctgcgggggcccggcggggggtccccccccctttttttggccccccccgcctccctttgctcctctgtggncgcccttttccctcccccggtggggggccccccc

SEQ ID NO: 34312 - DNA, 536 bp, Zea mays
  Clone ID: LIB3059-061-P1-N7-F12
ctgggggggttttttttttttttttttttttttttttttttttttttttttttaaggaaaaccatatatatatccacagtatcacattcttctgggattcgttcataccacacatgcatgcccccatagagtgtaagttgccaaacactagggggggggggggttcccacattgcttttttcctcactttggcccatgggagggcagccgcacggaaaaggggaacaaacaaatccccttgtccttcagctccgcacatggagctatgctcgggtgggactgatcaccaagcctcgctccttccgggggcgttgcatttgtacagacgtccatcccctccccgccgggatcatcgccaattccaaccactcccttggggggggccctgctgttgcacctccttttagcccccaattccagctgtgccacaacactgacctttgggctgttcaccggggggcttgcggggtccctccaggaaccctctttatccagggctttgcccaagggctttttcttgggctttttcagctcct

SEQ ID NO: 34313 - DNA, 221 bp, Zea mays
  unsure at all n locations
  Clone ID: LIB3059-061-P1-N7-F2
catggggggggggggggtgttttttttttggttgttcccttttggggtttttttgtggggtgtggttttttgggggggttgtttttttggtgtggggggtttcgcggtggtgggttcgttctttttgggggggggccctcttgggggggttgtcgttgtttttcctgttcttctgtgtggtggtttgtttgtggggggggnnntcggggtttttttttttt

SEQ ID NO: 34314 - DNA, 208 bp, Zea mays
  Clone ID: LIB3059-061-P1-N7-F3
gggggacaaccggggggtataaaatatacggggtcgtacagttgagctgagacggggatggggaccgggggggcagaggggggggcaaaagtttgctccagcgacatgggccagatccaggggggatcgatcggggaagagggtgggttccccccgggtttcccgccgggtcccggcggggggcccggctttccctttgggggggggt

SEQ ID NO: 34315 - DNA, 493 bp, Zea mays
  Clone ID: LIB3059-061-P1-N7-F4
gtcgttcgtttgccttcctgtttgttgttcaggttgttccttttttttttgtttgtcctttcagtgttttgctgtttttttttttaaaaaaccagtcaacttcacatttgggaggaagccgacccctttggccaggaatcggcggcggcaatcccttttggaggggcaccccgcgggcatagggctgccaaccccggaaaggaaggggctggggggggaagcgcacagaaaccgtgcattcaaaaccacacaaagggggggcgccagccaaagcgctgccccgtcaaaccaaccccagtcggggggccccccgtcccgggggcaacaaaccaagtctttaccgggggggaaagggcttttttcgcgcccttttttggcccccggagtggcataggtccccccaattcccgcccacattgaggccattttctccgggcccgtcacagcctccggggcgggttttgggggggcggggggggtatttccggccccc

SEQ ID NO: 34316 - DNA, 443 bp, Zea mays
  Clone ID: LIB3059-061-P1-N7-F5
ggggcgaataaattgaacacacctatgacaaagtttagccaaaaaaagactatgaacggggcgcagggatacaaagcttgacgtacaacttatgtggcctgaactaaacatatattatgactaagaaactgtgacgcgcttagtttgtgagcatgctttgaagaactctttcactagtagcaggtgaacaggtaatggatcataatgtaaatttaaaaggaaatctcaactcaggaaattctctggtactacaggtacaaatgagcaattggctaaaactcctaaggaatacatgccgaggctacactccattccactttaaataaacctaagggccaatccatcctaaccgagctagctagatgcatcaacacttagcaaccgccaggtatgaactgtggctggagtaaggtgtagacacaagcattgttggatgatgcccc

SEQ ID NO: 34317 - DNA, 332 bp, Zea mays
  Clone ID: LIB3059-061-P1-N7-F6
agcacaaaaggaggctggatatttaagaccagggggcaaaaaatctgcgttgtccaacagctggagattattgccttgcccttagcatcatggctggaccaaagatgagttaacagaaaacaaccccccaaaaaatagaccgggagactaatggtgtgctccaacaccgggggcaccctcaggttcctccttggccttacgagcaggatctttggtctgacgttgctcctccttggagatcctgttcctgggctggaactccttggagtggggggggccctcggggtagtcctcgcggaggaggccccagtcggggggctgggggcaggggc

SEQ ID NO: 34318 - DNA, 519 bp, Zea mays
  Clone ID: LIB3059-061-P1-N7-F7
acatcaaaaataaacagggctcaggcctacctaagtacatcaattttgaattccgttgaagttatttacactctcgaaaggtatttgaaaaacaaaaaatgttgaaacgaatcgctgctacaaaagcattgttggggactctcaaaacttcggtggagtcatcaggcttatggtcagacatcattgtatgctcatctctccggatgacacagctctctcaccaaatggtcgaaaaacgtcggcgagctcatcgagcctctcctccagaagctttgcgtagagcttgaggagtgactcaagtgcgtcggccctttgctgaactatgttcaaatgatcccactttgcaggtgcgttatctgtatgcgccaattttagtgtgctaatgggtgatgattcctttgttataattgtgtcacacaactttggctttgttgcttgataatagtgtggcttcacatccttcctttgtgaaggacacaaccgtgagggaatcacttataaagtcattttccatcttct

SEQ ID NO: 34319 - DNA, 597 bp, Zea mays
  Clone ID: LIB3059-061-P1-N7-F9
tttgactggaaaggtattaaattgctgattctggtttcttttacatttacacatcacacactcacatgaccctaactaaaatccttttttcacgggtcaggaggacatcacctcttgtatattgcaatgtcagataggctaataacagctaacacggagtattgtacagttatcgatgtacataggtcattcatgcttccatgttattctgcagtagaacctgtacaatagcagtcctcatccctcgcgaacttctcaatcaatgtttccatcattttcttatacattggcatgtagtggtcattgatcatggtatttgagagtcgaatcttgctgtaaagatctctaggggtctcatatattccaacacagcactcgtcagcagcaaccggatcatctgggtcagcgtctgtgggaggcattgcaaccatgtgcatgattctaccaggggggtagaattgctgcctctccaagctatctggtgtgaaggactgcctgtcatctacaccttttagcacagcactttcctcttccattatttctttggctgcagctgcctttttctcccttgttcgtgcctccatttaaccttgtaaa

SEQ ID NO: 34320 - DNA, 132 bp, Zea mays
  Clone ID: LIB3059-061-P1-N7-G1
gacatcaagcggccgatagattcattaaaaccaaaactttattatgaccatgcatatattattggtcataccacacatgataatgtggggcggcttactgcattattacatatatagatagagagagatgga

SEQ ID NO: 34321 - DNA, 609 bp, Zea mays
  Clone ID: LIB3059-061-P1-N7-G10
aaagtacaatacggaaccgatgtatatatatttaactcgcataaggtttctacaagcaagctaataacacacttatctgcacctcaacctgaatgacatccatgagatcaaatatacagagggctacacaaatgatgatgatgatgatgagttcttcgtttccaccaggttcttttggacactatattttattcaaaataagaagagaggaaagaaaaaaaaagaccaatttggaacagggatccaacacttcactcccccaaactaatccggcacccttctgtctcaccaacacaagaaccatccaataaaaaccttatgttgaacctatccttggatggtgcatgcttgttttgatcccaatgcaaatgcacagttgcctaatagcaacatcttcactctttgccgcggattcatgtaacatgcggtagcaacgataatgataagtaacagacggataacgaggcctctagaatttgaggcatacctgaattcaccaatcctcgggctgcttaatgtttttcagcctggccagcatccggagagacaatgggcggattctggggcaatgttggaggggcagctgcctgtggtagtagacttggggcg

SEQ ID NO: 34322 - DNA, 378 bp, Zea mays
  Clone ID: LIB3059-061-P1-N7-G11
gccgtgggtttttttttttagaaatggactttattatttctgggaagccacaaacatcagacaaaaactttattattgaactataactcataagaaactaaaaggggcaccaccaatgatgggttgttggtagaacgctgctgggtttgtcaagaggggggtggttgaatggcagcaattgttgcagttgtaagagggtgccagcgttaggcgcagcgtgcaggtagaacggcaataactgttgttgtgtcaagaaggcagcagggctcacaccagctagctggctgaatggtagtagttgttgctgctgtaaataagcaggagagttcaatgatgccagttggttgaatggaagaaattgttgggggtaggcagcag

SEQ ID NO: 34323 - DNA, 536 bp, Zea mays
  unsure at all n locations
  Clone ID: LIB3059-061-P1-N7-G12
gcacgcgtgcgtaagcttggnatcctctacacggccgcccgtgggtgtttttttttttttttttttttttttttttttttttttttttttttttttttttttttttttaaaaaaaaaaaaacggcttggggggaccaaacctatccataggggggtggtttatcaatttttttgatgataattacatatttggggggggggggccctacaagggggtttggcaaccaaatcaaacctatccggggggattattttcctggtaaacaatgcttggagtcggagtcctcacttgcttttttttgctggggggcttggaacccgcttgtaccaaccgatgagggggctggcgaaaccaaacccccccttgacgcggggggtcacctttttcggggcccgttgcaggagccccacggccaccacgatgtccaggctcgacttgacgagccccaccacccgctcgttcgatttgtgcagctttatgcgggacttgtcgtttttgtacagcttttggggcttcaactccttttccagctttt

SEQ ID NO: 34324 - DNA, 467 bp, Zea mays
  Clone ID: LIB3059-061-P1-N7-G2
gcatctcaagcacacaggatttataatgacaatgcatgtataagtcaatataatcgcgcacagtttcaagacgactagatactaggttatcatttttctgttctacaaaagctggggcctatcattctgatccatcagggaagcgttcaagggcattctgtttcccgttaacataaaattcaatcactgctttcatgcgatccgacttatctggatggtagttcaaatgcacaaccaccggcttcaaattccgcagataagcatctttcctcaccgtcttgaagagaactttactgttcatgaagaggtagatatccatggttcttttggatgcatgtattctttcataaccaggatgtgagggaaaaaacagctcctcattgaaaactgcttggtcccatgatttgggctcgtgagaaaggcgataagcaaccctgccaagaagctcaatcgaaggaatcgtcggc

SEQ ID NO: 34325 - DNA, 539 bp, Zea mays
  unsure at all n locations
  Clone ID: LIB3059-061-P1-N7-G4
atcgagataaatctcaatcaatatattgattatttctaggaaacacacgtcggtatgagggcaccattatcgagtacatctcatatgtaatctaaaagaggcacctccaacgatgggttgctgcctcgacaagacaggattcatcaaagagaactggttgtatggcagcaattgttgctgctgtaggaaggcggcgaccaatgggttagccactaccaatggattaagtaactgttgtcgctgttgtaggtacgcagcagagttcgacagagtcagttggttgaatggaagcagctgttgcaagtaggcaacagggtttgccacagctagttgagtcagagctggtacaatctgttgcaacaattgttgttgcaggtatgtaggtgcattgcccacagcgagcgggctagatgaaagcagttgttgttgttgtacgtaggcggcagggttcaccatggctagttgactgagcgttggcagaaactgttgtagctgttgttgttgctggtttgcaactacgttcgncagagcaagtgggt

SEQ ID NO: 34326 - DNA, 633 bp, Zea mays
  unsure at all n locations
  Clone ID: LIB3059-061-P1-N7-G5
ttgagataaatctcaatcaatatattgattatttctaggaaacacacgtcggtatgagggcaccattatcgagtacatctcatatgtaatctaaaagatggcacctccaacgatgggttgctgcctcgacaagacaggattcatcaaagagaactggttgtatggcagcaattgttgctgctgtaggaaggcggcgaccaatgggttagccactaccaatggattaagtaactgttgtcgctgttgtaggtacgcagcagagttcgacagagtcagttggttgaatggaagcagctgttgcaagtaggcaacagggtttgccacagctagttgagtcagagctggtacaatctgttgcaacaattgttgttgcaggtatgtaggtgcattgcccacagcgagcgggctagatgaaagcagttgttgttgttgtacgtaggcggcagggttcaccatggctagttgactgagcgttggcagaaactgttgtagctgttgttgttgctggtttgcaactacgttcgccagagcaagtgggttggatgcaagcagctgctcttgcaagtaggcggcagggttcaccatggctaggntggctcagtgctggtaggaactgttgttgctgttgcgttg

SEQ ID NO: 34327 - DNA, 499 bp, Zea mays
  Clone ID: LIB3059-061-P1-N7-G7
aggacagcacataaaccttggaatatggagattcataagaaacaaggcaccaacaaaaattggttgggttccaccgcaaaacaaatataaccgggtccttttgtttaacccaaacaccctcgggacataagggctttattacccccaacactgttttattggggaggggggggggcccccaagctcaccacaatggctacacaaacaatgactgaacatccatggattcacaggcctcaaacgaaaaaaacaccattctttggtcctgcctggtgaaactatcaaacatcactgggtagacacgaatcctgatcaagcacaaaaacagcctcattggaagggaagggtcttatgggggtatgcaacatttttggcaccattcaccacttgcccacttccttgcatgatccagcggggtgttaaaaaacctttaacacccacaggcccccgagcatgtataccccctgtgcttatgccaaccttgggccccaaaccaaaa

SEQ ID NO: 34328 - DNA, 566 bp, Zea mays
  Clone ID: LIB3059-061-P1-N7-G8
gtatgaacggcatcggtgtgcttattactgttgttcggttcctcagaagacagtcaaacaagacaaccaagtaggaggggggaggggacgggaaagccgcgaggaatcctacggtattgctaagcctgctcctgcacctgcaccgggtgggtcctccagcccaagcccagttcaggagagaacggccatcagatccgacgccctcagcacgatgtagttcgtgccgtcggcgcccttgaactcgctgccggcgtacttggagtacaggacagtgctccccgcggagacggacagcgcgagcctctcgccatcctcgtccagggggcctgggccaaccgctacgaccgttccgatagatggcttctccttggcagtttccgtaagcagtacgcctcctggagttttgtcttcagcttcagcaaccttgattagaacacggtcgttcagaggcttcatgtctttcacgtcatcagtttctaagatacctatcacgtcatcctctttgagaaccagatggctgtgatcggtcaacgcgacctcggttccagcgtactttagaattcaca

SEQ ID NO: 34329 - DNA, 500 bp, Zea mays
  Clone ID: LIB3059-061-P1-N7-G9
agaaatgtactttcttatttctgggaagccacaaacatcagacaaaaactttattattgaactataactcataagaaactaaagggggcaccaccaatgatgggttgttggtagaacactgctaggtttgtcaaagcaagttggttgaatggcagcaattgttgcagttgtaagagggtgccagcgttaggcgcagcgtgctggtagaacggcaacaactgtggttgtgtcaagaaggtagcagggctcacaccagctagctggctgaatggtagtagttgttgctgctgtaaataagcaggagagttcaatgctgccagttggttgaatggaagaaattgctgggggtaggcaacaggtagctggctgaatggtagttgttgttgttgcaaataagaagcagagttcaatgcagctagttggttgaatggaagaaactgctgttgctgagagtaggcagcaaggtttgctagcacaagttgttgtagttgttgtgccct

SEQ ID NO: 34330 - DNA, 262 bp, Zea mays
  unsure at all n locations
  Clone ID: LIB3059-061-P1-N7-H1
aaaaaaccggccgcatgcaggcggagctgggagaacttttacacatggtcttttttttctcttctctgttttagcttgctgtaaaaaaaagggtctatggagagttaaatgaaatgaaacaagaacagcatgagcgtggggggtgcgagacctacacaagccaccaccaccgcaaccaggaagggctcgctccgctancctaggcgcgtgggctaccacgatcgtcgaaaacgcgcatccaaactgggtttgctgtgccgct

SEQ ID NO: 34331 - DNA, 404 bp, Zea mays
  Clone ID: LIB3059-061-P1-N7-H10
gcctgtttgggttttttttttacggaggatacatccagaaccagaattattcttgcgccacgttaaaacagacgggcgttgtctcaggtctcggaaagcatcactaaacatgtagtagcatatatacacacatcgccggtcgcataaacacacagaggggggggggggctctggacgggttgctgccaaaccatatccctaggccgactctgcgaagccaaccctcagcttgccatagtcgaagacggtgtggtagactcccatgaaaacatcacccaagatccagagagggccacggggtggtgggatatccatagctgtgaatccgctgatgcactgggcagcctgtccttcaccccacgcgtccgcggacgcgtgggcggacgcgtgggcggacgcgtggg

SEQ ID NO: 34332 - DNA, 461 bp, Zea mays
  unsure at all n locations
  Clone ID: LIB3059-061-P1-N7-H11
aaacaaacaaatgtgcttttattaagttggcaataacccatacaagccatacacgtactatggccgtgcataataataatgataccgaaaacacaacttgcatcaatcaaggcacacttgacaatancaaatactacttgtgggggtgatataantaancaatnactantaactgtcnatgcttcaagctccccaatatgtggaggcacacaatatagggcacaagcatttacaggtcccttagaacccgtgaatcttgatgttctctttcttcgcaatcccagcctgaactaggaaagtagcaacattcttgcgctggtcaccttggagctgaatgacctggcctagctctgggtcctgaactacagtaccattgcagcagaattccttcttcagatccttgaggatcttgttatagctgaactctttcttcagaccctggactgtagtcagactctttc

SEQ ID NO: 34333 - DNA, 499 bp, Zea mays
  unsure at all n locations
  Clone ID: LIB3059-061-P1-N7-H12
ctctanacggccggcgtgtgggtttttttttttcgagaaaagtcaatcaatatacttgattattttctagggaaacacatgccggtatgagggcaccattatcgattacatctcatatgtaatctaaaagaggcacctccaacgatgggttgttgccaccacaaggcagggtgcagcgaaganaactggctgtatggtaccaattgttgctgctgtaggaaggcagtgaccaatgggttaggcactgctagtggattaagtaactgttgtcgctgttgtaggtacgcagcagagttcgacacagtcagttggttgaatggaagcagctgttgcaagtaggcagcagggtttgccacagctagctgagtcagagctggtacaatctgttgcagcaattgttgttgcaggtatgtaggtgcattacccacaactagagggctagatcaaaccagttgttgctgttgtgggtaggcggcagggttcaccatggctagttgac

SEQ ID NO: 34334 - DNA, 421 bp, Zea mays
  unsure at all n locations
  Clone ID: LIB3059-061-P1-N7-H2
aagaatctagaatgtctttcttatttctgggaagccacaaacatcancaaaaactttattattgaactataactcataagaaactaaagngggcaccaccaatgatgggttgttggtagaacgctgctgggtttgtcaaagcaagttggttgaatggcagcaattgttgcagttgtaagagggtgccagcgttaggcgcagcgtgctggtagaacggcaacaactgtggttgtatcaagaaggtagcagggctcacaccagctagctggctgaatggtagtagttgttgctgctgtaaataagcaggagagttcaatgctgccagttggttgaatggaagaaattgctgggggtatgcagcaggtagctggctgaatggtagttgttgttgttgcaaataagaagcagagttcaatgcagc

SEQ ID NO: 34335 - DNA, 410 bp, Zea mays
  Clone ID: LIB3059-061-P1-N7-H3
tacagcacgagaacactttctccaattcgaagcagtctagtaatacaagcctaacacaaatcaggtcctgccttgacactacaagcgcccaagtcatccagtcaatacttaaaacagaaacgttgtgctcctgcctccacaattgtatcagcagcgatgtgtcaagggaaacccaaaacactggaacaaaatctcagactcgatcctacagaattacagttgtgccgaccggacaggcaaaacatgctgggggcccctagcattttccagcatcttggggcagctaagagaatctcaggcgtcattggcatatggggactcgtcgcgttgtggctgctgtcctggggatccactatagcttcttctggcttcaggcggtggtggtggcgtcctgcttccgtctcgggctg

SEQ ID NO: 34336 - DNA, 392 bp, Zea mays
  unsure at all n locations
  Clone ID: LIB3059-061-P1-N7-H4
cgtgcgttaacttggnatcctctacacggccgcgcttgttggtttttttttttttttttttatattttttttttttttattttttaaacttatttttttttttttttttatttttttttttatttttctttatatgctataccctcgcctgagagacgtagcaacaccaacaagcccatcctcaaaggggggggggggggagaaaaccctggtaaagtgaataccgatcggttctacatattctgcccctttttcacccccttcttttattcttggggggcccccccctgccccccttttctgaaagaaaaaaaaggtttctttaccgggtcctgggtcccccgccccccggtggccgtttggttttccttcttggggggggttggccccac

SEQ ID NO: 34337 - DNA, 363 bp, Zea mays
  Clone ID: LIB3059-061-P1-N7-H6
gtcgcttgcacgcgtgcgtatgcttggctcctctagcacggccggccggtgttttttttttttccaagtataacaggaatcgttaattatatcacaggaacaaatccggatcccctttaattattgttccggatgaacgatccgaggaaagcattcatcttcttgctgtgcttattattcagacatatgagctagctacagggggggggctcatgcactatgctcttcgcagttacttggggggcatcgttccgccgccgagaatccaggggctttcggcgacgccgttgctggtggccgggttgcactcggcctccgtgtcgggggtggcggcgtttcctttctgcgcctcctgcgggccgc

SEQ ID NO: 34338 - DNA, 479 bp, Zea mays
  unsure at all n locations
  Clone ID: LIB3059-061-P1-N7-H7
ttggcatcctctacacggccggccttgttttgggtttttttaatatatcgagnaaaatctcaatcaatatattgcattatttctaggaaacacacgtcggtatgagggcaccattatcgagtacatctcatatgtaatctaaaagaggcacctccaacgatgggttgctgcctcggcgggggggggggcatcaaanagaactggttgtttggcagcaattgttgctgctgttggaaggcggcgaccaatgggttagccactaccaatggattaagtaactgttgtcgctgttgtaggtccgcagcagagttcgacagagtcagttggttgaatggaagcagctgttgccagtaggcaacatggtttgccacagctagttgagtcagagctggtacaatctgttgcaccacttgttgttgccggtctgtatgtgccttgcccttcgcgggcgggcttgttgaaagctgctgttgtttgtc

SEQ ID NO: 34339 - DNA, 289 bp, Zea mays
  unsure at all n locations
  Clone ID: LIB3059-061-P1-N7-H8
agccggcacaagtcttctctcacaatcaatatatgaactggcatgtctcacatgtggcgctgcccgtgcccgcgacttcatacattttcttttcctcccccccactggggggggggggggggttcccttttnnctcacacctcacctttttgcattctaatccccnggccttttttaacctttcccttgtggacactcaacaggtcatgatgcgggcttcgctgaaatgcggccgtcttgctcggcgccttgtcttctgaatctggttcttcgtgcgggccttctttcc

SEQ ID NO: 34340 - DNA, 278 bp, Zea mays
  Clone ID: LIB3059-061-P1-N7-H9
cttggttttttttttttaccatataccgtctattcaaacatgttgctgctttaaatagtctgccatcgtggttcgtcggagccttgctgttcacgattcgacacgacggcacacaagcatacaggcagggagggggctctatgcggtatgtgtaatgggaggggggggcaaggggattactaggtgtggttgttggacgctgccagatagatttgctgcacgttgtattttatatataatgaagctggcccttcatgcagggttcgtttgttatggac

SEQ ID NO: 34341 - DNA, 454 bp, Zea mays
  unsure at all n locations
  Clone ID: LIB3059-062-P1-N7-A1
atcgaagggaatacaaactagccctttcatgtgttccacagtacaaacaggctttaggaatttggtccaaaactatttgtattccggagtctgaaactaacagcgcaaacacacattactctgatcatatgtatgttcagagacagcattggtccacagcactacactacgcttcaaattctaaactatttacacggcagattcgctggcgtcgagtcccaccgaaccatcattcgccatgaactaagagcaggcagatatattccctgaaccgcgcatcagaaccttcagccagcacctagcacaacaccggtcaccaaagctcagttcttcacacgtntgagtcaagatagtcgaatccgcggatcatcctgtactgcaacaggctggcatagacgcggccgcacactccggtgaacagggactcgtcgtccgggctgggcgtgttcccggg

SEQ ID NO: 34342 - DNA, 489 bp, Zea mays
  unsure at all n locations
  Clone ID: LIB3059-062-P1-N7-A10
cgttttgtggtttttttttttttttttagaatctggaaatgtaacttcttatttctggttggccacatacatcatccaaaaaactttattattgaattacaactaataagcaatctaaaagaggcaccaccaatgatgtgttgttggtaggagggggggggggctgtcaaagcaagttggacaaagggcaacaattgttgtagttgtaagagggttgcggggttagccgcaaactgctggtagaaaggcagcaactgttgctgtgtcaagaaggaagcacggtttgctgcagctagctggctaaatggtagtagtatttgctgctgcaaataagcagcggggttcagtgcggccaattggttaaatggaagaagttgttgttgctgngagtgggcagttgctagctggctaaatggtaatagttggtgctgcncctccgccgctgggttctgtgttttcagttggttgaatgtgacaaatttttgtttc

SEQ ID NO: 34343 - DNA, 504 bp, Zea mays
  Clone ID: LIB3059-062-P1-N7-A11
cgttgtggttttttttttttttttttcttctaaattttttttaattccatcaatccatgtattataggaataaccgaacaagacctaaaatacaggactctttatgagtattatgctagagaaataagcctgaatgttcaaaccagcccctgggggggggggaacttggatcttcaaaacaaaatcgttatatggccttctgctagagaaatcatgcctgcaccaatgcactcatgcagatattttcttcattctgttgggaggaggtcggcaaatgaaaaattatgagacggtggacctttttgctgggctaaaaggtaaaaaggaacatgagctaccatctttgttcctccttcactccaattcacaataccaggaccatttccttgggcggtggacggtcccagtccagataaacagatggctggttcattcatgagccctaaatagtcacaggcccgttgccagaccctcctgtctgaggttcgggaacgagcggccttt

SEQ ID NO: 34344 - DNA, 542 bp, Zea mays
  Clone ID: LIB3059-062-P1-N7-A12
gcctgttgggtttttttttttttttttttttcagggaaaacctgcattctacttacacagggaaggaaaaaaaacataattctgctctgtggtattgcctgtagagccaatacaagaacaaagcaataactgtatcagcatgaacaaaatggtgtggcggggggggcataggttgtaatatgttttctgggctttgtattgtccgaggattgctacttttcgccaaaaaggggaatgaaaaactagaggattgctggatctttgtatctcttgaaaagatcctcaatgccgtcaagaacttcctgtggtagaggccgtggagtgctggtaaacgcgtcgatgttctccttcacctgctccatggggggcgctccaatgatggagctagcggtgaatggacgatcacccaccaagccaagggcaagctggactggagttagcccgtgcttcttggcaagcttaacgtactctaatgtcgcttctttagccaaagagtcattgtcgcgggccatgtatccagggaagagatttaccctgctttt

SEQ ID NO: 34345 - DNA, 273 bp, Zea mays
  Clone ID: LIB3059-062-P1-N7-A3
cggggggggggttgggggccaaaactggggggggaaaaccaacaacctaaacaaaaaggggggagggggcccccaggcccccccagacgaaaataaaccccctttgggacgagggggaacaccgggggctaaagggaacaaaataatttgggcttagggggccccccccgttggtttcttgggtttccagggttggtggcgggacccccccccgggtttggccccccggttccccccccggggggggggttttcggggccgcggcggttgcct

SEQ ID NO: 34346 - DNA, 553 bp, Zea mays
  Clone ID: LIB3059-062-P1-N7-A5
cacattaaaactggaaatgtaacttcttatttctggttggccacatacatcatccaaaaaactttattattgaattacaactaataagcaatctaaaaggggcaccaccaatgatgtgttgttggtaggaggctgctgggtttgtcaaagcaagttggacaaagggcaacaattgttgtagttgtaagagggttgcggggttagccgcaaactgctggtagaaaggcagcaactgttgctgtgtcaagaaggaagcacggcttgctgcagctagctggctaaatggtagtagtatttgctgctgcaaataagcagcggggttcagtgcggccaattggttaaatggaagaagttgttgttgctgagagtaggcagtagctagctggctgaatggtaatagttgttgctgcaaataagcagcacggttcaatgtagacagttggttgaatggaagaaattgttgttgctgagagtagggagaaaggtttgccagagcgacttggttgatcacaggtagcacgagttgctgcagctgctgtgccctgatggtttg

SEQ ID NO: 34347 - DNA, 460 bp, Zea mays
  Clone ID: LIB3059-062-P1-N7-A6
tttttttttttttttttttttttttttttttttttttttttttttttttttttttttttttttttttttttttttttttttttttttttttttttttttttttttttttttttaaccaaaccccaggccccccgggggggggggaaaaaaaaccggttttaaccccaaccccaaaaaaaaaaaaaaaaaggcttttttttttgggggggaaaaaagcctttttccccccccccccccttttttttgtttaaaaaaaaaaaaaattgttttttttttaaaccccgttaaaaaaaaattttaaaaaatttccctaaaagggaaaaacccggggggtttgggcccccattttccaaaaattttttttttttcgcggggcccccctgggttaaaaggggggggccctccccccccaagtccgggggtttaaagtgtaaaaccttggggggggaccttgttttgg

SEQ ID NO: 34348 - DNA, 416 bp, Zea mays
  Clone ID: LIB3059-062-P1-N7-A7
gcctgttttggggttttttttttttttttttttttttttttttttttttttttttttttttttttttttttttttttttacacaccaatcctggtttatgggtaaaaacccccctaaaaattaaacagcaggccccccccccataaaaccctagggggggggggggggagaggtccccatggttgggcccccccagattggggtcttgcgaacccatcatttggggggggtggtcccccaaccccggcccactaattcagttgcccaggccaccccatccaatcctgggggggccccctctgaagcccccgccgggaggggtccaggtggggggccccaaccccaacccctggggggccgttttccccttttttcccttgggttgtcaggcccccaccgggggcccccccccccgc

SEQ ID NO: 34349 - DNA, 603 bp, Zea mays
  Clone ID: LIB3059-062-P1-N7-A8
tttttcacgcaacgaagttcactttattactttaggaaagcagcaccgaggcacgatacatcgcgatcaacgtgcgtcacgcacgatgtaatgagctgagaccctaatcacaaacatgactggccacctcgttgtgaccttccagcgggtcttctcgcccttcatccaaaagcaaatctccctcatcagcagcgccaccacagctcccatgtgaacgccgaaatcgatgatatcctagatgcggcacgaagcaacttgatctcgacctcggtggcctcttgcgctgcgcgggaaacgtcgcactccccgaagacgcctgaaggaaagggagaggagacaaagagctcggccgaagcagcctaacatgtggcaatgtgatcgcctcatcggcgacgactaccctacaacaaaaggagaaagggggaaaatatcaaagcttgagaaggggttggataaactcataggaggaaacttaccttgaccatggcccgtggaacgcgacagcccaagcaacctgagatctgtcaaacaacccggtcagaggtacgctcaagaagggccaaagtacaaggaagcaaagtcgccaacagcaaactacgaccg

SEQ ID NO: 34350 - DNA, 513 bp, Zea mays
  Clone ID: LIB3059-062-P1-N7-A9
cttgttttgggttcttttttttttttttttttttcctttatattgctttgcacgtctctctgtttccccttttaaatactgaacccaaattttcatggcacgccactgggactcgccggcaccataagggacaggaaatgtccaaaccccgggggggggggggggggggcccctaaaataccggaccggcccctcccggggggccacccttgcctctacccgggcatttcggaccttggcctgctggtggtccaagttttcctctgggggggattgttataccctcgcctttccctcgacataccagcctcctgcgtaaaatgtaaatcctgggctgcctcctgagtgagccgactccccttcattgcgtggcactccctggccgccttctaggggggcaacctgtcatgcctggtgtgttcctgactgccccctttcccggggggaggcccctcgcgccctcgggcccctggggggggtccccctcccccggtggggcgggctccctttttt

SEQ ID NO: 34351 - DNA, 465 bp, Zea mays
  unsure at all n locations
  Clone ID: LIB3059-062-P1-N7-B1
acagcacagcctggttatctactcgtgttcagttaacgttacaaatctcatgccatccctcctctgcagacgaccaagaactgaccaagttcagcaggaaggccagaatgtcgccgacgaatctaggagctggtttcgactggcctttccctgtagatccattcgtttgtttatttacatgaatgtaagccaaacggatcgtcattgttactactaattctattccaatgctaagtactagtattccatacaaatggggattaggcgaggtacccagttttgcggcatcgtcagctttcactgtctccataacaaacggttgcctggagccactgctaattgtaggggtgctttccagaggccagctaccaggttcagcatctcccttccacgatcgttcctgggggcttngggtccccatgntgctcaccagggtactgtaggcaatataattgcccaatccta

SEQ ID NO: 34352 - DNA, 490 bp, Zea mays
  unsure at all n locations
  Clone ID: LIB3059-062-P1-N7-B10
aggaatctgggaatgtaacttcttatttctggttggccacatacatcatccaaaaactttattattgcaattacaactaataagcactctaaaagaggcaccaccaatgatgtgttgttgggggggggggggggggtctgtcaaagcaagttggacaaagggcaacaattgttgtacttgtaagagggttgcggggttagccgcaaactgctggtagaaaggcagcaactgttgctgtgtcaaacaggaagcacggtttgctgcagctagctggctaaatggtagtagtatttgctgctgcaaataagcagcggggttcagtgcggccaattgcttnaatggaagaagttgttgttgttgtgagtnggntgttgttcgctggcttaatggtaatagntggtgctgcnnataagcagcagggttcagcgttgaccgctggttgtttggaagatattgttgctgctcggcgttggggggcatggtttgccct

SEQ ID NO: 34353 - DNA, 299 bp, Zea mays
  unsure at all n locations
  Clone ID: LIB3059-062-P1-N7-B11
agcaacttcaagaagctcaacgtggcagaacattcagatcgcgcatttcaagaagagcctcgtcctcgcctaactactgctactgctaggatccatgccattgccatgtcgtcttcacatccatatccatgcttacacgcgggggggggggcgttatttcttctaccncnaacctagccgcgncctggcttgctctggnttctgtgtcggcctggctctggcntggctccttgctgttgctgtcgttnggcgtggccgcggctctccttggngcgcgcgttctgtctgttccccccgtg

SEQ ID NO: 34354 - DNA, 430 bp, Zea mays
  unsure at all n locations
  Clone ID: LIB3059-062-P1-N7-B12
aacggcgggcctgtttgtggtttttttaaaaaactagtatgcagttgatttttatgtctatattcaaatgaatctagaccatatacaaaaacacatacattaataatatgtgttgtttgtttgtcttctaacttatttaataatctaaaggacgctaagggggcagtngggggtgtctatcttcatcaaataattgaccggatgaaaatgggccctgtttaagcataaataacagagaaatctttggggcactaggcagcaacaggaagcaagccgttttgtctaagaagtgggtcaggcgaaggctcccgtcctcggaatgaaacgaacacctcaggcggggactttccacctccnngcgcttgatcagtgtctctgtatcgtctgcncgtttcctcgattgccttctcgtcctcccnccccgcggctt

SEQ ID NO: 34355 - DNA, 571 bp, Zea mays
  Clone ID: LIB3059-062-P1-N7-B2
tctagaaatgtctttcttatttctgggaagccacaaacatcatccaaaaacttcattattgaactataactcataagcaatctaaagggggcaccaccaatgatgggttgttggtagaacactgctgggtttgtcaaagcaagttggttgaatggcagcaattgttgcagttgtaagagggtgccagcgttaggcatagcgtgtaggtagaacggcaacaactgttgttgtgtcaagaaggcagcagggctcacatcagctagctggctgaatggtagtagttgttgctgctgtaaataagcagcagagttcaatgctgctagttggttgaatggaagaaattgctgggggtaggcagcagctagctggctgaatggtagttgttgttgcaaataagcagcagagttcaatgcagccagttggttgtatggtagaaactgttgttgctgtgagtttgcagtatggtctgcttgcacaagtttgttgttgttgtttgtgccctgtcgtttttgtgcttccttctttttcctttgtttctcttttttttcttttttttttttttttttctttt

SEQ ID NO: 34356 - DNA, 397 bp, Zea mays
  Clone ID: LIB3059-062-P1-N7-B3
ggggcccagaaaaacccagtttattttttcgaataggaaacatgtcaggaagagggcccccttggaggacttaattaaataactaacgaagggggggggggggagcatttttgctaccaccaccatccattccacgccatggggcccttcacagcatgaccttacaacgggggggggggggggaatgaaactaacgatgggttaaggggggcaggaaaggtcaagaggcttggtcttagggggatcggttttcggcagggctccagcgtttaggagatgggggatgcacttaatttgcatacccggggggcccctttccaggtcttttacgggcggacagcagggcccagctggggaggggggccgaacgggggttcctttgtggtgggccctttgg

SEQ ID NO: 34357 - DNA, 489 bp, Zea mays
  Clone ID: LIB3059-062-P1-N7-B4
acatagataccagatattatttatacttagctcttttcgatacattagtccacgctacaacatcaagcacagtagccagcaagtgacggagcagtttgaggacgctcccacaattattttcttgggtacaacaatagtcagcagcaacgtcacgatctattttccctttcccttccccttccccttcttggcatcaagctttgcttgcacccgggctttctcatcagatacactgcctaaagatgaacctttcctcggcctgcaagctactagctccacctcaaaaataagggttgcattaggaggtatcactggtggcgagcctgcagctccatatgcatattctgactagcatgaaatttttgcaacctcgccaaccttcatagttcttaaggctatatcccatgctttgatgacagcgccttgtccaatttcaaatgagaaaatagagttatcttcatgggtggtatcgaaaacataccccacgcg

SEQ ID NO: 34358 - DNA, 591 bp, Zea mays
  Clone ID: LIB3059-062-P1-N7-B5
tagaatctggaaatgtaacttcttatttctggttggccacatacatcatccaaaaactttattattgaattacaactaataagcaatctaaaagaggcaccaccaatgatgtgttgttggtaggaggctgctgggtttgtcaaagcaagttggacaaagggcaacaattgttgtagttgtaagagggttgcggggttagccgcaaactgctggtagaaaggcagcaactgttgctgtgtcaagaaggaagcacggcttgctgcagctagctggctaaatggtagtagtatttgctgctgcaaataagcagcggggttcagtgcggccaattggttaaatggaagaagttgttgttgctgagagtaggcagtagctagctggctgaatggtaatagttgttgctgcaaataagcagcacggttcaatgtagacagttggttgaatggaagaaattgttgttgctgagagtagggagaaaggtttgccagagctacttggttgatcacaggtagcacgagttgctgcagctgctgtgccctgatggtttgtaccaatgactgcaccaaagatagggctggcgattgttgaaac

SEQ ID NO: 34359 - DNA, 355 bp, Zea mays
  unsure at all n locations
  Clone ID: LIB3059-062-P1-N7-B6
ccttaagattaacttagaataaagcctgacgggggtaacagcatccatcgatccgcagtccatgctgtttgatgcatgggtctgctgaaaccgaggatgaacacagcactaacaactgacacagagcgaccttgcaatcaaaaacacagatgggcaacaacaaacacgacacgaacgaagataaaccctctggactagggtaaacatcacggtagcgaacaggataacttggccgcgcgggccccaccgctcagttcctccagttcccgtcggagttgccgtagccgccgccacggttgccaccgccgtagccgccgccaccaccaccgtagccgccgccgcncccgttgccgcc

SEQ ID NO: 34360 - DNA, 301 bp, Zea mays
  unsure at all n locations
  Clone ID: LIB3059-062-P1-N7-B7
cccggggaggggccatcttttcgggggggggggggggtttttcccttttaaccacaaaaaatttttaatagggggcccccacaggggggggttttttaattgggggggggggtttcccaaagggggtggggtataggggggaaaattttttttttttggggggggcttttttttttccccctttttgggggggggggatgggnnnnagttggactggngaagggggntttttttttcccccccctttggggtttttgggtccttttttttgtttggttcgcccacttccccttttttttcc

SEQ ID NO: 34361 - DNA, 412 bp, Zea mays
  Clone ID: LIB3059-062-P1-N7-B8
aaaaaaaaagaaactttttaaattttttggttaaaaaggggggggggggccaaattaaaaaaaaaaattaaacgggaaaaaagggggggggggggggccccggaaattccgggccgggcccggggggggtacaaatttttcttttgggggggcgtataaaaggtggggggaaaaaggggaaaaggggttttcggggggaaattggtttccccaaaaatttccccaaaaaaaaaaggcgggaggtttaaagggaaaaaccgggggggcccaaggggggggcccacccacaaaaatggggggggcccccctgccccttttcccggggggaaatttgttggggcggctttttttttgaattccccaacccccggggggggggggtttttttttttgggcgcccgggggttttttt

SEQ ID NO: 34362 - DNA, 604 bp, Zea mays
  unsure at all n locations
  Clone ID: LIB3059-062-P1-N7-B9
gctcttcggggtatcatttcagtaaaaattacgtcctggcgcacaaaaacagagtacagacgcagcaaagaagatacaattattctctagcgggctcacatgaccctcacagcggaatcggaatgcacatgaaaattacaaaatatagagctcagtaggagtgactaggcttggcagttcctgtgacatgtccttgggaaaaactggtgatgacaaacattgcttaaagatcctcagggccattgacatccttgttctcaagtacgtctccatctggaatctccaacttcactccaggcttggcgataattgtcaccttgcccttgagtgtaattccagagccaaaccagacatcaccagaaaccttcaagctgtcaagctcaactatgctggggatggacttgaaccgagcaaggaaattggcaaccttcttgaactcaggtccaagctcaattgaagggttagctggattcgctctggatgggttgcggatgacaaagccatcaaccaaggtgtaaagatcagactgcacaagcaacagatcagatgtagccttcactgggagaaaccttgagcggggaacattaattncaatcgctttgtc

SEQ ID NO: 34363 - DNA, 346 bp, Zea mays
  Clone ID: LIB3059-062-P1-N7-C1
cagccgcgtgcgtagctggaccctagacggccgcctagctttctttcttttaggtaatctgtggttcgtcttctggtggcccagcagcagcaaaccacgcggcagagcaactgggccggcggcacaacaaccccacacgacggggaagacccacagccaacaacgggggtaacgcccgacgaccgccacccacacaaaagacaggccgacacagggacaggccggcccagacgcgcgacaagaacatttaatgggcgaacccccccctctagagggccggggccccgagaggggggaaaggaccgccgtcgggcccctgccggccccggggaagtgcccccccccc

SEQ ID NO: 34364 - DNA, 531 bp, Zea mays
  Clone ID: LIB3059-062-P1-N7-C10
tggtttttttttttttttttttttttttttgattcattaaaaccaaaactttattatgaccatgcatatattattggtcataccacacatgataatgtgtgtcgtcttactgcattattacatatatagatagagagagatggatagagggggatggggcaaatatcatgaatcagtagtagggcggaatggcagcggagacgccacaggggttggtgcggtagctgggcagctggtactggtagagtccacccatggccggcatgttctgcgccatcatcatggccatggggttgagaccctgggctgccagcagctgctgctgctgctgcatcagagctggctcgtacaggctgctgctggcggcagcggcacgctcaagctgcatcatcatctgcagctgctgcgcgacggactgcacgtccatcatcctcatctgctgctggcagcactgttgccggagcggctggaacatggcgctcggctgcccacacccggcgttgtagggcgccgccgccagcgggctgcact

SEQ ID NO: 34365 - DNA, 573 bp, Zea mays
  Clone ID: LIB3059-062-P1-N7-C11
cgggtggttttttttttttttctggaaatgtaacttcttatttctggttggccacatacatcatccaaaaactttattattgaattacaactaataagcaatctaaaagaggcaccaccaatgatgtgttgttggtaggaggccgctgggtctgggagagagcaagttggacaaagggcaacaattgttgtagttgtaagagggttgcggggttagccgcaaactgctggtagaaaggcagcaactgttgctgtgtcaagaaggaagcacggtttgctgcagctagctggctaaatggtagtagtatttgctgctgcaaataagcagcggggttcagtgcggccaattggttaaatggaagaagttgttgttgctgagagtaggcagtagctagctggctgaatggtaatagttgttgctgcaaataagcagcagggttcagtgtagacagttggttgaatggaagaaattgttgttgctgagagtagggagaaaggtttgccagagcttcttggttgatcacaggtagcacgagttgctgcagctgctgtgccctgatggttttaccaatga

SEQ ID NO: 34366 - DNA, 437 bp, Zea mays
  unsure at all n locations
  Clone ID: LIB3059-062-P1-N7-C2
tttttacatatgccttatcgcttgcactttcaaccagtctcacattcagtcatacacacatgagaagataattcaacttccacaaaatttaaatgtttttttatctagaacgttgtagccaatgacagacaaggccactgccaccaaaatgccttcatagagattatacactgataaccaatggctcaatgcttgatctaaaatgagtggtggcattagtaacagaataagcatataagaatttcaatcagcgacattcaccctaaagatgaacaccttccgctcctcaactggttactctgtacttcttgacagtgtttagtagaactttggcttcgttgttgttgttgnagtgatcacgaacaggctgcaaaatttcatttattgcttttgccagtgctggtttgccatccgccggctgcaaagcaccagtctca

SEQ ID NO: 34367 - DNA, 135 bp, Zea mays
  unsure at all n locations
  Clone ID: LIB3059-062-P1-N7-C3
ggggggggggggttttttttttttttttttttttttttttccncggggggggggggtggtgtttctgggcgtttggctgttgtttgggtttgtgttgttttttgtggtgttctgcttggggtggggggggtctgt

SEQ ID NO: 34368 - DNA, 580 bp, Zea mays
  unsure at all n locations
  Clone ID: LIB3059-062-P1-N7-C4
aagatctagaaatgtactttcttatttctgggaagccacaaacatcatccaaaaaacttcattattgaactataactcataagcaatctaaaagaggcaccgccaatgatgggttgttggtagaacgttgttgggtttgtcaaagcaagttggttgaatggcagcaattgttgcagttgtaagagggtgccagcgttaggcgcagcgtgcaggtagaacggcaacaactgttgttgtgtcaagaaggcaacagggctcacatcagctagctggctgaatggtggtagctgttgctgttgtaaataagcagcagagttcaatgctgccagttggttgaatggaagaaattgctgggggtaggcagcagctagctgactgaatggtagttgttgttgcaaataagcagcagagttcaatgcagccagttggttgaatggaagaaactgctgttgctgagagtaggcagcaaggtttcctagcacaagttgttgtagttgntgtgccttgatgttttgtgccatctatgcaccaaagtaactgctgtaatagggctgacggttgttggaggaacaagggtgat

SEQ ID NO: 34369 - DNA, 444 bp, Zea mays
  Clone ID: LIB3059-062-P1-N7-C5
gaaaccaaatctcagcaatttgagtacttgacatttatacccgcagaacagaaacagctgataggtcagcactatccttttttcgtacccatttcaacatatttaatagtaggtcacccacgaatggacttaggtaggtgcaccacatgacatgactgcagtgcgtttgttttacaaactgggaacaaaactgcatgatttatcatacactcctctacttcttaaaagaaaactttcccttcttcctagcttttctcttgtctttcttgatcttcaaatgaagctgcaccttcttcttgctaatgctgccaagtggcctcaagaaggtcttagacctgttgttccctgcatcagacatctccacatccatagccgaggccgagctagctgcgcgggagctgccggcatcctggggtggcggtggcccgcggcccgggtgcgggg

SEQ ID NO: 34370 - DNA, 457 bp, Zea mays
  Clone ID: LIB3059-062-P1-N7-C6
ggggcacaaaataaaaattaaaaagaaaaaaaaaaaaaaaggggggggggggggggggcccaaaaaaagggggggaaaaaaaaagggggggaaaaaacctttcccgggaaattggggggaaaaccctaaaccccaaaaggggggggggaaaaaaccccccttttttaaccggggggggaaaaaaaaacccttggggggccccccctttggggggcccccaaaggaaccttttccccccaaaaaaaaaaaaggggggaaaacttcccccttttgttttggggggcctaaaaaattttcccccaaaaaggccccccccccctttggggggtcccacaaaggggtggggaaaaaaactgtttttttccccctggccgggggggcccgccccccctttttttgggggcccccgggggtccttttcccgtggccccctgaacctgcggtaaaattttttttt

SEQ ID NO: 34371 - DNA, 414 bp, Zea mays
  Clone ID: LIB3059-062-P1-N7-C7
gattaacttggactcaaaatattgtatttttttcatctgagacaaacacacgatccggtaacaccacatcaaactccaaatatacttgtccatccgtttccagttcacgtacgcttcacgacattggtaccttcttggccaagaactttgatcattcaacctttttcttgtcatcctctccgccgccggcttcgtcctcctcctcctcatcctccttgtcgacgaggatcttcttgcacgcctcgtagcacatgaaggcgatgccggcggcgggcatgagcttgatgcagctagggccgagacctcggtacaggccgccggcgccctccttcttgaggatgcagtagatagcgtggaggacgttctggtacacctgcctcccgcccacagcgcccacctgcatctgcttgcggg

SEQ ID NO: 34372 - DNA, 521 bp, Zea mays
  unsure at all n locations
  Clone ID: LIB3059-062-P1-N7-C9
gggggggggttttttttcagaatatatcgagataaatctcaatcaatatattgattatttttaggaaacacatgccgttatgagggcaccattctcgagtgcatttcatatgtaatctaaaagatggcaccaccaaccatgggttgctgccacgacggggcagggttcatcaaagagaactggttgtatggcagcaattgttgctgctgtaggaaggcaccgaccaatgggttagccaccgctagtggattaagtaactgttgtcgctgttgtaggtacgcagcagagttcgacacagtcagttggttgaatggaagtagttgttgcaagtaggcagcagggtttgccacagctagctgagtaagagctggtacaatttgttgcagcaactgttgttgcaacaactgttgttgcaggtatgtaggtgcattgcccatagcgagcgggctatatgaaagaagtngttgctgttgttggtaggcgatagggttcaccatggcttgttgactgaacgctggccg

SEQ ID NO: 34373 - DNA, 267 bp, Zea mays
  Clone ID: LIB3059-062-P1-N7-D1
gcagccgcgtgcggagctgggaccctaggcggccgccttgtttttttttttttttttttttttggtggttttgtttttctttgtgggaggccggcgagcgccgccccgaaaacaaggggcaggggcgtgccccggggggggccgcgccgcccccgcggggggcccggggggggggggggggtccgtccgggcgggccgccgccggcgggggggggggccggcctcggcgggggcctgggggggggcgggccggggcccgcgggccgc

SEQ ID NO: 34374 - DNA, 476 bp, Zea mays
  Clone ID: LIB3059-062-P1-N7-D10
aaatctcaatcaatatattgattatttttaggaaacacatgccgctatgagggcaccattatcgagtacatctcatatgtaatctaaaagaggcaccaccaacgatgggttgctgctgtaggaggggggggaccaatgggttagccaccgctagtggattaagtaactgttgtcgctgttgtaggtacccagcagagttcgacacagtcagttggttgaatggaagtagttgttgcaagtaggcagcagggtttgccacagctagctgagtaagagctggtacaatttgttgcagcaactgttgttgcaacaactgttgttgcaggtatgtaggtgcattgcccatagcgagcgggctagatgaaagaagttgttgctgttgtaggtaggcgatagggttcaccatggctagttgactgagcgctggcagaaactgttgcaactgttgttgttgttggtttgcagctacgtttgcc

SEQ ID NO: 34375 - DNA, 445 bp, Zea mays
  Clone ID: LIB3059-062-P1-N7-D12
acggccgtgggggctaagttgtttgtcttgctgaacgtttccctttgaatctaagggcggcaaaagaagctgtatgaggttgggaccgtgacagcaatttgtgttacctgctttctgataagatgtgttgtggtcgcgctatctgcatttgatgctgggggggtgtcgaggttttggatcatccagtcctagatttcttctattatatgtttgcggagatactcccttctgcgctggttctcttcgtccttcggaagcttcctcccaagcgggtatcggcgcaataccaccctattaactagggagttctttgtttttatgatgttacatgctaagaactccggataagctggaactgctgaaaacctacatccggttgtattgctgtgctattttatggaagcatcccatggctggcaagaggcgtcatcaccttcatgctcta

SEQ ID NO: 34376 - DNA, 334 bp, Zea mays
  Clone ID: LIB3059-062-P1-N7-D2
ggaaagtaacttcttatttctggttggccacatacatcatccaaaaactttattattgaattacaactaataagcaatctaaaaggggcaccaccaatgatgtgttgttggtaggaggcccctgggtctgtcaaagcaagttggacaaagggcaacaattgttgtagttgtaagagggttgcggggttagccccaaactgctggtagaaaggcagcaactgttgctgtgtcaagaaggaagcacggtttgctgcagctagctggctaaatggttgtagtatttgctgctgccaataagccgcggggttcagtgcggccttttggttttttggta

SEQ ID NO: 34377 - DNA, 303 bp, Zea mays
  Clone ID: LIB3059-062-P1-N7-D4
ataaaatatttttttttttttttggcacactgggggggggggaatactacttatgttcttatataattaagcaatgactagtaaattgtttttgtttaaagtttctaaatatgtggaggcacactttataggggacaatcttttacaggtaccttaaaacccgagaatcttaaagttctatttattaccaataacagcctgaatttggaaagttccattttttttgcgctcatcaccttggagctgaatgacctggatttgctctgggtcctgatatacaggatctttgtttcttaatttctc

SEQ ID NO: 34378 - DNA, 357 bp, Zea mays
  Clone ID: LIB3059-062-P1-N7-D5
tttttgtttttttgttttgtttgtgacattttttacttatgttgctttcttctgtgaagttgttgtgttgtgttacatttctggggaaaaaaggaacgtcggaagaaaattccacccccggggggtccaccggcgcggagaggaagaaccgacaaagggcggaccagtttatgggggggaaatgaaggggggaccgccctggggaaaaaaaaaggggcgggcccaatcgaattttggggtccccgggttttttcccccagggggcaaaaggtgggccccccccgggggccgtttttgggcccccggtttcccctgggggggggggggggggggggccccggcctgccccccccgttg

SEQ ID NO: 34379 - DNA, 337 bp, Zea mays
  Clone ID: LIB3059-062-P1-N7-D6
ggggagaaggctttattattagctcataatacttttgatgcatcaataggcctctcccacctcacattagtctcaacattgacttcatattatacaaccctaagaagggtgatcggctgcaacaattgaaatctaaagactacgtcaagcgcttccctcttgcgatatcatcagtttgctggaaccttgtagcttccgcactggaagccatgctcaaatggccttttacactgctcagcaacatacacaaccttttccatgcacacaaccttttcagtttctttggggaccttggagcacaagcaagaaacgtttgccttcttgatcggacccgtgg

SEQ ID NO: 34380 - DNA, 392 bp, Zea mays
  Clone ID: LIB3059-062-P1-N7-D7
tcttttttttttttgttttttttttttttttttttttttttgggaccgctaagcagccatattagttaaccactgggaaacacgatccaaaaaaggggttctgagcccagctcacacagcacaccctctggcggggggggggcctcaaacaaacgtatccatatttttcttcaccaatctatgcccaaattccttggggggaaaagggcatcaacatagcaaattactggggctgatgacctgacaaagttctgcatttgaacccttgctgattccccatcttcattcaatttcttcaacagctgggactttgggggaagggcgtaccttccagcaaaaactggtttcctttttgcccatccctgggggggggccaaggcccgggcctaagc

SEQ ID NO: 34381 - DNA, 584 bp, Zea mays
  Clone ID: LIB3059-062-P1-N7-D8
tttttttttttttttttttttctttttttttttcttttttttttttttttttttttttttttttttttttttttttttttttttttttttttttttttttttttttttttttttaaaaaaaaaaagccctgggggggggggggggggccaaaacccttccaaaaaaaatttttttgggggcttaacccaaaaggccctaaaaaagggggccccccaaaaagggggggggggggaaaacgggggggggtttgcaaaaaaagggggggggggggggaaaaatgggggcagtggaaagggggggccggggtggggccccgggggcggggaaaccggcaaaactggggggggggttaaagggggaagggggctccctctcttttggggggggggggggggggcccgcccctccctttttgggtggcccccgcccggggggcgggggctcccttttggggtggggggccttcccggggggtgtcaggggggggcgtcccgcgggggcgcccccgccccctgcggggttgtttcggggtgtgtgtccgtgtgttccgccggcccgcccggggcccgggggggccgcccgg

SEQ ID NO: 34382 - DNA, 206 bp, Zea mays
  unsure at all n locations
  Clone ID: LIB3059-062-P1-N7-E1
cggggggggggagcggtgcccattatttgggcatgttcaaaaagggggcagtgggtatttggggggttggggggacccaagtggctgggggggggggttcctagggttgggttttgttttttgggggggggagttggggcccttctaaaaggacgtgttcccgggggggggggtttttttttgcgtncggggcccggggggtttgg

SEQ ID NO: 34383 - DNA, 583 bp, Zea mays
  unsure at all n locations
  Clone ID: LIB3059-062-P1-N7-E10
tcgctgcacgcgtgcgtaagcttggntcctctagcacggccgggggtggtggtttttttttttttttttttttttgtggtttttttttttttttttttttttttttttttttttttttttttttttttttttgggggccaagggccccagtcttttttaagaggggatctttgggggctccaaaaaaaagggggggggggggggggggtcaccaaatccacatgccgggggggacagttccccaaggccccaggtgcgggggggggtctaacccttttcccgggggtggggggggcttacacaggccttggggggggggccacggggggggggaaaaacctttgctttgcctggtgtgtcccccggccccccccgggggggctttcccggggcccctttttgggcttcggtgcgggggaaccggtggggccgttctgggccttccgccggcttgggggggggggggggggcccctggccccctgtggtttgggggggncccggggggccctggggggggggggggggtcccgggcgggcgttgggggggggggggccccggtgtccttttggggggggttttg

SEQ ID NO: 34384 - DNA, 607 bp, Zea mays
  unsure at all n locations
  Clone ID: LIB3059-062-P1-N7-E11
ttgtttttttttttttttaaaaatattttttttttttttttttttttttttttttttttttttttttttttttttttttttttttttttttttttttttttttttttttttttttttttttttttttttcccccccccttaaaaaatttttttttgtttggggggccccccccccccttttttttttcaaaaaaattttctaaaaaaattttttatttctccatttttttctccccctttttttctctctctttttttttttttttttttctcctttttttttttttttttcttttttttttctttctctctccntccnttccccccccccttttttntttttttctttcctctcccccctttttcctctttttttttttttttttttttttttttcctctctcttttttttttctttccccccccccctttttttcttctttttttttnnccttttttnnnctcctttctcnctttttttttttttcctttttttttttcttttttttctcctttttttttttttatttttttttntntttttccttttcttcttttttttttttttttcttctcctcttttctccccttttcctttttcttttcc

SEQ ID NO: 34385 - DNA, 489 bp, Zea mays
  unsure at all n locations
  Clone ID: LIB3059-062-P1-N7-E12
gggtgtgggggggtttttttttttttttttttttttttttttttttttttttttttttttttttgcgggcgaaggcctatgatcattgatcagggcttcatgaacaaagcatacaactcacaccagttgaacaaaaaatcaaccccctcccaaagggtaagctggggggtaantttcacccatataccccttcttattacacacaaagacacaaacacaagggccgggggtttctgaagttccttaaaccgcccccctgtttgatgatctcattgtttttgccctgcttcctagaagggggaaaggaaaatgcagtactggcatattctggtctacagacttcctcagctcatcggtggtttccatgggtccctgcggccgtcccatcatgccctttgctccccctggggccctgtgacccccgaggggcccttccggggagatctttcccccctcggaaccttttgccccgggttggggttttggggg

SEQ ID NO: 34386 - DNA, 423 bp, Zea mays
  Clone ID: LIB3059-062-P1-N7-E2
cgtacgtaagctgggacctctacgcggccgcccttgctttttttttctttttttttttttcttgggttttctcttttttttttttttgtcttggggagggaacttactgaacattatgctaattcggcttgtgacatgggggggtattattaataaaaccacggctcttccggaaaatgggggggggggtggcagctggcagcctggcactaaccccgcccccccaaaccgggggctgccacaatgtttgccctctcattcagggccgcaggtctttgccaaataccccaacaatggctcggccggggccctcttgcttcaccgggggttcccccccctaaccgggggaaacgcccgctttcgggcccttggctccttctcccggggtgagcgggccgggttctccgcccgccaaagttcctt

SEQ ID NO: 34387 - DNA, 434 bp, Zea mays
  unsure at all n locations
  Clone ID: LIB3059-062-P1-N7-E3
ccccccaaaaaccttgatgggggaatgccccccattaacccgggggggggcagcaaccgggggggggggggggccccagcaccggggggggcctttcccccgggggggggggggtacccccgcacccctttaacaacaccgggcggggggggcgccccgggaatcccggcccggccccggggggggccccggctttcccttggggggggggttttaggggggggggtggcccggggcatggggggtccgggggggaaatggtttccccccccccttcccccccaccatccggcccgggggcttaaggggggagggggggggggccccgggggggggccccccccccattattggggggggcccccccggcccggctcnggggggggcacccggtcgcgccccgttnttttggggtcgccccccccggggggggg

SEQ ID NO: 34388 - DNA, 357 bp, Zea mays
  Clone ID: LIB3059-062-P1-N7-E4
accacagcaagcacaagtcatctcattacccaaggcaatggtaggttaatgttggactagaactcggatcctagagatggatcggagaatgcacaaggaacagaagaacatacgtccccgataacagtttcatgggcaacaccacaatcgtctgcatttagccagtaacgccgaacatttcatcccatggcgtacttctgggtccagctgcgggctgtcgcctcgtacttaggccgatccgtcttgtacatgtgagcaatctcagggacaagagggtcgtctgggttgggatcagtaagcagggagcagatagaaagcaaaaccttagagattgtcaaagcagggctccactgctcc

SEQ ID NO: 34389 - DNA, 627 bp, Zea mays
  Clone ID: LIB3059-062-P1-N7-E5
ttttttttttttttttttttttttttttttttttttttttttttttaaaaactagaaatgtacatttttttatttcttggggaagccaccaaacatcattccaaaaaactttattattgaactataactcataaacaatttaaaagagggcaccgccaatgatgggttgttggtaaaacgttgttgggtttgtcaaaacaagttggttgaatggcaacaattgttgcagttgtaaaagggtgccagcgttaggcccaacgtgcaggtagaacggcaacaactgttgttgtgtcaagaaggcaacagggctcacatcaactagctggctgaatgggggtagctgttgctgttgtaaataagcagcagagttcaatgctgccagttggttgaatggaaaaaattgctgggggtgggcagcacctagctgactgaatggtagttgttgttgcaaataagcagcagagttcaatgcaacccgttggttgaatggaaaaaaatgctgtttgctgttagttggcaccaaggtttcctaacacaagttggtgtaattgtttgggcccttgattttttgggcccaccattcccccaaagtaaccggtttttaacgggcctaccgttttaatgaag

SEQ ID NO: 34390 - DNA, 616 bp, Zea mays
  Clone ID: LIB3059-062-P1-N7-E6
ttcgattctaatagcatttgcattatcacatgaatcattactctgccaaaaactcaggatggtgttggtatccaaaattaaaccaaagaaggcattctttctcggcttcttcaatcatgtctacctactgaatccggtgatcattttctaggtctttgatgtaactcccagttaaggccagctaaatatccacccgctgattatcaccagttcggagtctgttggaacgaactatgcatgcatgcatgattgtcactgtactgttagggccaagccgaagacaggaatactgagatacagctctttatacacatgatagaatccacctgtgcaagatgtatttacatgattgagcatatgcatgtatccaaatattcatcatctgagtcacttgagtcactgtaaaatatggaaaaggtaaaatcatagttagagcaggatattaaaatagtttgtacaaagtagtaaggttcagtaggtctcttgaaactccaacataaacaagatcagcatggcagtttaatatagcatggaggcttttaaagcagtagcaattggaaaatatcaaaatttatctgatttgttatagagataatcaacttgaaggcttaatgac

SEQ ID NO: 34391 - DNA, 616 bp, Zea mays
  Clone ID: LIB3059-062-P1-N7-E7
tgcacgccgtacgtagccttggcatcctctacacggccggcctgtgtgtttttttttttttttttttttttttttttttttttttgtttggcaaggaaaaaataaatcaactcaacggttgactgtgtttgtgtaccttggtgcagtttttttattacaaaaaaaggaggagcaacattcataggtgtagcttacggggggggggcgcttgaaaccaaaaccaaagaaaaaaaaatcacaggggggctgggtgatttgcaatgcctcaaaggttatcgtcgatcaggcctacaggaagtttcggatgtccagtttcctgacatcaggcatttccttatcttggaactcctccctcttgagttgagtctccattgcctcaacacattccttcttaagttcagtcagctcacttttggcaatctccaattcaagttctttctcgatcttaggaagatcctccttccgaatgccaagctttgcgttaatcttgtcaaactctgccataaggggggccatgttcttcttgtcactccttaaaagtggtttcttaatatccttctcaatctttttaagagctttcatcatcaaagggttcgttccaatttgatctataaga

SEQ ID NO: 34392 - DNA, 429 bp, Zea mays
  Clone ID: LIB3059-062-P1-N7-E8
caagttaatatcattattagtgccggcttttagcttttttttttttttactccagacgatacagcctcacgacaactgttgaaaagggaaaatcagtacatgatggccacaaccacaaacatgcaagagctgaaagtaaatgccgagtagaggtcgctatctcgagtccacaacggtgccttctggaagcgcggacaggtgcacaagaggggcatgtgatttcatggaagcattggcaccagtgatcttggtctcctttgttctgttgagcaccttcctcacctcgtttgcaagctctatgatcgaatcatcttcgtggctaatgctggctaatgccttctccattgagaacaggtaatccctattacagccaatggccctactggctataatagggattacctgttatagccagtggggccattggct

SEQ ID NO: 34393 - DNA, 542 bp, Zea mays
  unsure at all n locations
  Clone ID: LIB3059-062-P1-N7-E9
ttagcacacaggatgagcacactaattccatattccgtagnatgaatacaactagtattccagtgatcatacaaactaagtggacaacactaaactcagttcacagcatcaccacttgacttcacatttcagttgattttgcgcaaacataacaacatataataaaaagttgacacccacgagcaactagagtttttgggtaccctcatgtcaaagaacaggccaaaaacagcagctctgactagcagccctcatgtcagcaggtcttgaaggcgtccaccgcatctagttcttcagtctgatctaagctgggttcttctcagtttctcttctgcttctgtttcgtggataaacaatcacagcaaagtttgctcagattaaatgcaatagaagttgttgagtgcaaaagtgcaggtagtagtacaaggtaatatttacttacatatgcatgtaagtgtgccacatagcagcgagtaaggttctatgagctaagtgatgggccacaggggcggatctaggattttttggtcaaaggtgtcacc

SEQ ID NO: 34394 - DNA, 432 bp, Zea mays
  unsure at all n locations
  Clone ID: LIB3059-062-P1-N7-F1
gctgtcgaacgacttttaaccaacactaggaatgccgaggggaagtagcaccctcgatcacattatcatacaatacaattacaggctccgtgccgctaatagcagagccctggtaggtacgggtccgacaaatacaaaagcgcaacagcaatgactaggaaagaacgcaaaagaaaacacgacaagcccaacacaatcccacagctaatctcgcctttctagttcccttccagcagctaacctcgcgctgcagggcacgccacttggctcacttgtactccaggatcatgttgttctctggggccagcccaacgcaggccctcatgatgttctctcagctcgccctttgcttggccagagcgttcaccaccggtgtgccagggggaaccaggggtgccttggtgnggtagctcaggatggtggcccccgggt

SEQ ID NO: 34395 - DNA, 291 bp, Zea mays
  Clone ID: LIB3059-062-P1-N7-F10
tcctgcaccgactgctagctactattctttgatgacttgaaaattttgcttcgtgaactcgatcggagagttatttctgttttcttttttttccatgtacaatcgtctgttcttatgctgctacagctacacacacgtgggtggtaatagtagtaacaagctgtatcagagcgtgagcgtgagatggtccggcaacgacgccggacggcggtagggcgaaccgcgcgtggcgacccggcccttgcgcctctccatgaactgctgcagcgacaccttcctcgccatgggcag

SEQ ID NO: 34396 - DNA, 124 bp, Zea mays
  Clone ID: LIB3059-062-P1-N7-F12
aaaacggccggcctgtttggtgtggttttttttttattttttttgtgggtgttttttttttttttttttttttttttttttttttttatttttaaacatttaaagttaagaagattaatagggg

SEQ ID NO: 34397 - DNA, 596 bp, Zea mays
  unsure at all n locations
  Clone ID: LIB3059-062-P1-N7-F2
tgaaacctcattgtttatattcttaacaaagcacaaaagaactagaacttagtgaattcgttacaggacggtagcagataagttaaacacaaaaagacaacgtgtccaaaaccagcatggatccagcgtccaggggcaccgttcacatttattctcagcatagacaagcagcaaagatggtctgcgaccaaaggccattggggacgacccacgatagggaggcagaaatatctctctctactgggtcttgaacatgtggctnnntttttttttttttttttttnnnnnnnnnnnnnnnnnnnnnnnnnnnnnnnnnnnnnnnnnnnnttttnnnntnttnttttntttttnnnttttnttntntttttttttttttttttttttttttttttttttttttttttttttttttttttttttntttttttttntttttttttttttttttttttttttttttttttttttntttttttttttttttttttttttttttttttttttttttttttttttttttttttttttttttttttttttttnttttttttttttttttttttttttttttttttnnttttttttttttttttttt

SEQ ID NO: 34398 - DNA, 437 bp, Zea mays
  Clone ID: LIB3059-062-P1-N7-F3
taatataaatgtttattattaaacaatcacgaatacatgaaaacaatatcaaattacagttgtaccttgagcgcgacagaaggcaagggcaaaagtaagatgtgaaaaagcgtgaacagtacgggggtactgttcatctatttatagacacaggacgcagcctgtgagaaatacattcatgccctttacaaatggttacaatcataacacaggttgtcatggaccgattggtcatttcatctttaagtcggtgcatctggagatacgctacgaagctccctgattgatagcttcagcattgtgtttttggccttccgaaggtgtttcttctcacaggaccttcggcgacgaagcatacactattctgcacagggttttgatagcagagaccgtctgtctccttttaagttttaacagcaaattaaaaggattggagg

SEQ ID NO: 34399 - DNA, 477 bp, Zea mays
  unsure at all n locations
  Clone ID: LIB3059-062-P1-N7-F4
cgaaaacttatttatttcttaaaatgggagatttgggtgttacataatattttggtgaaacagcatctagctagcctcatctctcgccgtctgtctccgcagtatcatgatgtctccgcagtatcatgaattcatgatgatggttgacaactcgccacgcagagcaccaagctcttatagcacttattagtctttctgcagacgtactcattaagaccggaatctagatagcatggcccgtcgtcattacggctaacaagtatgttgcccgatgccctcgtcttggtcatcgtcatgttcctagcattgctgtcctctttggtgtgcccacttgttgtgcgtgcatgagcaacaaaggatgctagaagaatcatggaaagcaaccattttaatccttggaagctgctgcacttcgccatgggtgacagatgatatgagctacaatantccggacgcgtgggcggacgcgtggggcga

SEQ ID NO: 34400 - DNA, 597 bp, Zea mays
  Clone ID: LIB3059-062-P1-N7-F5
agaaatgtactttcttatttctgggaagccacaaacatcatccaaaaaacttcattattgaactataactcataagcaatctaaaagagggcaccaccaatgatgggttgttggtagaacgctgttgggtttgtcaaagcaagttggttgaatggcagcaattgttgcagttgtaagagggtgccagcgttaggcgcagcgtgcaggtagaacggcaacaactgttgctgtgtcaagaaggcaatagggctcacatcagctagctggctgaatggtggtagttgttgctgttgtaaataagcagcagagttcaatgctgccagttggttgaatggaagaaattgctgggggtaggcagcagctagctgactgaatggtagttgttgttgcaaataagcagcagagttcaatgcagccagttggttgaatggaagaaactgctgttgctgagagtaggcagcaaggtttcctagcacaagttgttgtagttgttgtgccttgatgttttgtgccaacaaatgcaccaaaggtaactgctgtaatagggctgacggttgttggaggaacaagggtgataaaagtaagatgcctgctgcg

SEQ ID NO: 34401 - DNA, 617 bp, Zea mays
  Clone ID: LIB3059-062-P1-N7-F6
ggaaatataacttcttattctaggagccacatacatcagccaaaaacttcattattgaatgacaactaataagcaatctaaaagaggcaccgccaatgatgtgttgttggtagaaggctgctgggtttgtcaaagcaagttggacaaagggcagcaactgttgcagttgtaaaagggttgcggggttagccacaaactgctggtagaacggaagcaattgttgttgtgtcaagaaggaagcggggcttgttgtagctagctggccaaatggtagtagtatttgctgctggaaataagcagaggggttcagtgcggcgaattggttaaatggaagaaattgttgctgctgagagtaggcagtagctagctggctgaatggtagtagttgttgttgctgcaaataagcagcagggttcagtgtagacagttggttgaatggaagaaattgttgttgctgagagtagggagaaaggtttgccagagctacttggctgatcactggtagcacgagttgctgcagctgttgtgccctgatggtttgtaccaatgactgcaccaaagatagggctggcgattgttgaaagaacagggtgataaaggtaagttgcttgttgcaa

SEQ ID NO: 34402 - DNA, 440 bp, Zea mays
  unsure at all n locations
  Clone ID: LIB3059-062-P1-N7-F7
gctgcacgcgtgcgtgagctgggntcctctagcgcggccgcccggtgggtttgttttttttttttttttcttgtgggtgtgttttttgtggttttgattttttgttttttttgttgttggtttttgtttttgttttgtgtttgtgttttgttgttgtttgtgcgcttgaaacgcaaatgttttgcccccggggggggggggggggggcgccccgcccgggagcggggggggcgtctccggggggtgccccctttttggggggggggggggggtggggggggttcccccaattttgggggttggctgggggggggggggggggggggcgcccccacgggggggggggggggggggggccccggggtccgggggggccccccccgggggggggggggggggggctcgtctgtggggcggggggtgcgccccggggggggcct

SEQ ID NO: 34403 - DNA, 221 bp, Zea mays
  unsure at all n locations
  Clone ID: LIB3059-062-P1-N7-F8
tcgctgcagcgtactaagcttggaccttaaacggcgccctttttttttttttttttttttttttttttttgttgtttttttttttttttttttttttttttttttttttttttttttttttttttgttttttttggtgttttttttttttgtgggttttgttttttgtttttgtttttttntntgggggggtggggggggggtnttttttttttttttttt

SEQ ID NO: 34404 - DNA, 365 bp, Zea mays
  unsure at all n locations
  Clone ID: LIB3059-062-P1-N7-F9
cctctacacggccgcccggtgggtgggttcttttttccttttcctgggggggtgctgtttttttcttcttttttttctgttgtatctttcgtaggtcgagctcgcggcgctggtggcggcccaggttgcgcagccgctgacggcgatgtgcggcctgcacctgcagggggggggggggggcccttgcaacgcanctgccggcggtgtctacgtactgcggaaactctgttctgcggtcatcgtgcngtggcgccgctggcttgctgcctagctcgctcgttgcctcaggtggcggccctgtgttccgtcgtgtcccccgtcccctggcgtggccgtgtgtgccttggcctgcgtggccccttgtc

SEQ ID NO: 34405 - DNA, 529 bp, Zea mays
  unsure at all n locations
  Clone ID: LIB3059-062-P1-N7-G10
ccctgggtttttttttttntagagataaaaggaacttgttttattgttaataataatgagtcacacgcgatggcatgtcaactcattatttggtacaacacaaatatttctatctagaatgcagcaccaacaaaggttgctgtaagaacatgggggggatggtgatggccattgggttgaacatgaatggtaactgctgttgcagcataatctgcgagacggcgtcgcagtgacattgtggcatcatcatttgcgacatcatgctcggcaagaccattggtgacatcatgctcggcatcatcaatggtgacatcatgttaggcgtcatcatctgtggcatcatcactggcatcgtctgaagcggtaaggccaacagttgctgcagcatcagggacggacacgccatcaagctggcaagcccctgttgcatcatgcagtactgcatgcatgggttcatggtacccaatggcatgactggtggcaagtgccctggaatatgcgtcgcactagtggcgcttgcattgttcgc

SEQ ID NO: 34406 - DNA, 472 bp, Zea mays
  unsure at all n locations
  Clone ID: LIB3059-062-P1-N7-G11
gcgtgggtgtttttttttttttttttttttttttttttttttttttttttttttttttttttttttttttttttttttttttttttttttttattttttttttttttttttttttttttttttttttttttttttttttttttacaaaaaataggggggggggggggattataaaacttttcaactcaaccttttacataaaaaaaaaacgttttttcaaccttgaaaaaattttaaaaaaaaattttttttatttttttataangnnnnnnnttttaaaattnnaaaatttttttttttttttttgtgttggtttttttttggtgggattaaattttttaagacgngnttaattgggttaatnnnccccncgggggtgttgtatatgtggggctcttttggggggtgtcttttttttttttntttcgtggttttttgggggggtcccctttttccctctttgggggcgttt

SEQ ID NO: 34407 - DNA, 578 bp, Zea mays
  Clone ID: LIB3059-062-P1-N7-G12
ctggggggttttttttttttttttttttttaggaatctggaaatgtaactttttatttctggttggccacatacatcatccaaaaactttattattgaattacatctaataagcaatctaaaagagggcaccaccaatgatgtgttgttggggggaggctggggggtttgtcaaagcaagttggacaaagggcaacaattgttgtagttgtaagagggttgcggggttagccgcaaactgctggtagaacggcagcaactgttgttgtgtcaagaaggaagcacggcttgctgtagctagctggctaaatggtagtagtatttgctgctgcaaataagcagcggggttcagtgcggccaattggttaaatggaagaagttgttgttgttgagagtaggcagtagctagctggctaaatggtaatagttgttgctgcaaataagcagcagggttcagtgtagacagttggttgaatggaagaaattgttgttgccgggaggtgggagaaaggtttgcccagacttcttttgttggttcccggttgcacgagttgcttccgctgttgtgcccttttcggt

SEQ ID NO: 34408 - DNA, 433 bp, Zea mays
  Clone ID: LIB3059-062-P1-N7-G2
atcgcatccaagggccacatttaaaatcaatatgataggaacaaaaggtgtctctgccaagtggatttatgtgggggtagatatcatttgacctcaaaaaagagattgcaaaaaagctggcgcactactaatcatcatgtgatcctgaattcctcctggtatcagctaacgagcagagtcaggtactattcctgtgaccgaagaaccatgtcgggcactaattattatttgcaaacttaacattgcttagaactggaactgcatctcctttgtgtagttgagctcgtcaaggtgtgcagccatggccttgttcatcggggggggaccacatctcaggatctgaatgtcctcagcaggcgctggacaatgggattggatcatttccttagacacaaacccaacaccaccggtccagttctcaggagggctggtt

SEQ ID NO: 34409 - DNA, 207 bp, Zea mays
  Clone ID: LIB3059-062-P1-N7-G3
gaattccaaccggaacggtgtttcgaattaaagcaaattaactctggtactggtacattcgactcgaataggatccaaaatactcacggcaatatcactggccacacaaagcagacatatagctatggaaaaattaggctggtgcattgcccagccaccaccttcccctggggtgctggcgatcccacgcgtccgcccacgcgtccg

SEQ ID NO: 34410 - DNA, 201 bp, Zea mays
  Clone ID: LIB3059-062-P1-N7-G4
agtacaaaagaatgcaaaccactactgtttcagacaaggaaatagctttcagacagatcactcgtctcgagctgaggtatcatcctcccaagagtgagatccatttactaacagcaccagcagcacatatatttgtagtatatgccagaaaggaagaaaacaagaaaagaaaaaaatagaaggccaaaaatggaacatgaa

SEQ ID NO: 34411 - DNA, 589 bp, Zea mays
  unsure at all n locations
  Clone ID: LIB3059-062-P1-N7-G5
taagctggacctctacacggnccccttttttttttttttttttttttttttttttttttttttttttttttttttttttttttttttttttttttttttcaccaaagcagggtcctagcacagaaaaaacatgcgtcaacagcgacggaagggccacgggggggggcccctgggggggcaagaggcaacaaccgaagggaaccccgaactcatggggggccgcttgccctaagaccacaagggttaaaacgaaaacagccctcccctaaaatgtaatgggcctgcacctcctcctgggccttggacacctccttggcgggaggcgcgtcctgggactggtgggacccccacacgagggcgttcatgttgctttcggccccggggaaccccatattggccatgccctcgcccgggtaccagggcaagaaagccttcctcctgaacatggcagggaactggtcgctcaccctccggaacatttcctggatggggggcgggttgcccataaagggggaccccatggacaggcccctgggggggatggtccacaccctggacttgacattggtgggggatcccccccccaaaa

SEQ ID NO: 34412 - DNA, 616 bp, Zea mays
  Clone ID: LIB3059-062-P1-N7-G6
taatcgataattgatgatgtattgaagaacagagttttgaaccatggagcagtttggaagttttacatgactggggaaaaaaggacatgggattgtagcttttatgagcactgctactagtaatgttcacatagcatggctctgtaataatactgttgatcaccacatccaccagcagcaggcaatccggttgccaatgaggaggcagcctcagacaagcacctgagctgcagctagcctagcaatcggaaccctgaaaggggagcaagaaacgtaatccagcccagccttcgcgaagaaggccacagaggaaggctctccaccgtgttctccacaaatgcccaccttcaagttaggcctagctttgcggcccctctctgtagcaagcttcaccagctcgcccactcccctctggtccaggacctcgaaggggtcatgttggagaatgccctgagcaagatagacgggaatgaactttcccacatcatccctgctgtacccaaaggtcatctgcgtcaggtcgttcgttccgaaggagaagaattcagcctgctccgctatctcatcagccaccagagctgccctggggatctcaatcattgttccaactttgtac

SEQ ID NO: 34413 - DNA, 350 bp, Zea mays
  Clone ID: LIB3059-062-P1-N7-G7
ccccggtacaaccatacaggtttagcattcttttactttaattttagcaaacgacatagaccagttagcaaagtttggggggggggggggaattttggggacaagatcccagcctaccccaccaaagggcaggtccacgggggtccaggggcgaataaagagacatggaaagattggggggggggggggagggcctaaaagaatgaacaagggtcgccccagcttccatttcaacgggaacataagggtttggcaccccctttcttggggggcttaaggtttttatcttccgccggggggggggaaccggcccccgaccccaggagggccccttggggtgctggttcggg

SEQ ID NO: 34414 - DNA, 404 bp, Zea mays
  Clone ID: LIB3059-062-P1-N7-G8
gggccaacaaaaacttgaatttttaccccaacttattttatttcattccccaacaaagttcgcatttttttaaagcaggggggggggggaagtaaacagattccagcccttaatccgggtcccgaccccagacacacatatgaaaagcttttatgcccgagttgtttgatcttgccccccatttaaggaaccactcctggtcatcatgaggctgaaaaagttcccgccccaatcgggtgggcaaatttttcggccccggaacactcagggtctttggtgaaagcgaggcctttggtttttccctcctcgggttttttcacaaaccccacccccaggcgttcaaaggggtcacatgccttgggggccttgtcccctgtttcttttttttggcccaacccccgggg

SEQ ID NO: 34415 - DNA, 442 bp, Zea mays
  Clone ID: LIB3059-062-P1-N7-G9
gcctgggtttttttttttttttttttttttttttttttaaccaagaaatgtaggatttattagccatgatacataaaagtaggctttgtttatttggcctatagataaggcatatccttgtcagccaactgttggagtctaggcaacaatatcaacgaagatgcgaacacgatcagggcgaaagtcttgggtcacaagcgagccaaccggtagaacttgaatgttagcgttgggcatgtctttaagaatgatctctcttgcctccttgatggacatgcccaccacctcaggccatgatgtcttattctccctaccagtagcacccaaaacaacggaactcattttcaatgatggaatatattttctgttaattacttgagatcacctggttgtggatatgtgacattagtggagtagtagtgtatatttgcggacgcgtggg

SEQ ID NO: 34416 - DNA, 446 bp, Zea mays
  unsure at all n locations
  Clone ID: LIB3059-062-P1-N7-H1
aggcagtcataaattagattatatatctgattcatactatcaattggctaggtgcattttattgcgaaacctctataaccttcctctcaacataataatgcggatctttttggacaaggggtaaaacaataaggatgcacagcgacaatgacaacacaaaaactaatgctccacgcctctcatctctgtatacaacacatataccaccccactccaaaaacggtgcctctattcctgagttctactgtccgagcaaacattatgctccatagtgatgtggaatcgccacttcgctgtctccttatgcagaaatcgaactcgttttggtgcctacaatccatctactgnccgtttttctttttcaggatctgggccctcagggtctcttgcttttgcgtttgccagcctgaccctcaggccatgttgcctttgcnttcgcctggccc

SEQ ID NO: 34417 - DNA, 544 bp, Zea mays
  unsure at all n locations
  Clone ID: LIB3059-062-P1-N7-H10
agactagcacgtcgcttgcacgcgtgcgttaagcttggntacctctagnacggcggcccgtttggggtgtttttagataataaatagagctcttcattcacacttgacattatactaatcttgtctcttgaaaaaaaactgcatcaacaacaagctggaagcaagaaagaaagaaagaaaaaaagggcaaaataatggaagcaagaaccggggggggggggcacncaattcaagaagcagcaagcaagcatgctagaagcagaagaggcctccccaatctcaaggggggaggggngaaaaaagctaaaagaagcagaaaaaaaactagtgtagtgtagtgtagctcatcagcgcccaagcaagatctggagccacgtgactacatacgcagagcaaagcagaccagatcagatcagagcatcctgttgaggagcagagcggcggcggcggcggcagccatgggcgtggcagcgaggagtgacggtggcggcgcggcgctggtcttggccttggacttcttggcgggcggcgagggggaggaaga

SEQ ID NO: 34418 - DNA, 511 bp, Zea mays
  unsure at all n locations
  Clone ID: LIB3059-062-P1-N7-H11
tcacattaaaaatctgggaatgtaacttcttatttctggttggccacatacatcatccaaaaactttattattgaattacaactaataagcaatctaaaagaggcaccaccaatgatgtgttgttggtaggagggcgggggggggggcaaancaagttgnaccaaaggcaacaattgttgtagttgtaagagggttgcggggttagccgcaaactgctggntagaaaggcagcaactgttgctgtgtcaagaaggaagcacggtttgctgcagctagctggctaaatggtagtagtatttgctgctgcaaataagcagcggggttcagtgcggccaattggttaaatggaagaagttgttgttgctgagagtaggcagtagctagctggctgaatggtaatagttgttgctgcaaataagcagcagggttcattgtagacagttggttgaatggaagaaaattttgttgctnngagtaggggagaaagtttgccanagctacttggttgat

SEQ ID NO: 34419 - DNA, 460 bp, Zea mays
  unsure at all n locations
  Clone ID: LIB3059-062-P1-N7-H2
tttagaaatgtactttcttatttctgggaagccacaaacatcatccaaaaaacttcattattgaactataactcataagcaatctaaaagaggcaccgccaatgatgggttgttggtagaacgttgttgggtttgtcaaagcaagttggttgaatggcagcaattgttgcagttgtaagagggtgccagcgttaggcgcagtgtgcaggttgaacggttacaactgttgttgtgttatgtaaggtttctgggctcacatnagctagctggtttgaatggtggttgttgtggtggtgttacatgtgcttgttgctgttttttcattgttttcttagatattgtttcatttaggttcttgcctttcatggctcaccgtttttttttttgttgttcctttttatcctggtttttagtattctttttttgtttttttttttgttttgcttctgttgcttttttt

SEQ ID NO: 34420 - DNA, 625 bp, Zea mays
  unsure at all n locations
  Clone ID: LIB3059-062-P1-N7-H4
tcgttgcacgcgtcgttagcttggtcctctanacggccgggggggggttttttttttaaaataaaacaccattgtaaaccaatacaatactagaacagtgactcgggcattgataggattacaatttggttctgcatttttcggatgccgttttgtgaccaaagtttgactcttgtatttttaaattctaaacctaaataacactgaaaaccgaaccgtttttcgtttgactcttgtattattaaattctaaacctaaataacactgaaaacggaaccgtttttggtttccgggtcagtagcgggaacaagaaaatttaaaggcaggaaaccggtgtttctcgagcgagaaactcatcccattctgcattcgcctaaactcgacgcgacggtgccacgtcagactccattagatgtttggactcctaattctattttaatgactacgagtaagcctaaaccatgtgctagcttttgtttggaacgacccatgcgacctaaggatttagctattgtcatggactacgagtaatgcctacttgtttcttctattctgatctcgngatgagatgtttttttgttgcgatnngnggaagcagggagcgcgcgtcgccgtcggcggccag

SEQ ID NO: 34421 - DNA, 454 bp, Zea mays
  unsure at all n locations
  Clone ID: LIB3059-062-P1-N7-H5
cacgcgtgacgtatagcttggcacctctagcgcggccggcctgtttgggggttttttttttttcttttttggtttttttttttgctttttggcttcttttttttgggcccccggggccccactaaaagggctcctaaggtttttggggtacctgggtaagggccctaaaaatagccctcaaacctctggggggggggggggggggggggggaaccaaacaccccccttatactcccgggggccggcctcaggaaaggggcccccccccacacaaaaggggggggatgggttagattgttgatgggggggggcccccccccgcggggcccatgggttggccgctcgcgggggggaccccccccgcgcttcgnattggttgcccggggcgcccccggggggccggggggggcccgccccccccgctcgcggggggcggcccgggggtccgggccgg

SEQ ID NO: 34422 - DNA, 317 bp, Zea mays
  unsure at all n locations
  Clone ID: LIB3059-062-P1-N7-H8
aggaacaaatccggatcccctttaattattgttccggatgaacgatccgagaaagcattcatcttcttgctgtgcttattattcagacatatgagctagctacaagctcattcctgagggggggggggtgttcccanttacttggagggcatcgttccgccgccgagaatccaggggcattcggcgacgccgctgatggtggccaggttgcactcggcctccgtgacgagggtggcggcgaatcccctttgcaccttccgcgggcagcccggcgggtcctttaggcgggccttcagctgcgcgtccgggcccggggg

SEQ ID NO: 34423 - DNA, 573 bp, Zea mays
  Clone ID: LIB3059-063-P1-N7-A2
ggaaacaacaagcaatttaaaatgtgccaaacattagaaacacatttagcataagaaccctggctttggtccagcgagtacagcaaagatctccaaattttcttttttcttgttctagctgatccactaagcaaagttacacagattcagaatatgcttgtatgaatgcaggatgcaagatcactcctccatagcatcaccaccctcggcgacctcaaccttctgctttagaagtgtgacctttgaagacagtacctcagtctgccccttggtgaaactgtatccctttgaactagcataagtcctgggattcggcaactggtggtttctcaagtattctgtcttccccttggttatcacgcagacgtccacgttgctcccactacccaagtcattgaaaataccagcacagattgcttcgcacacaatctgtattccctcctccctagtaaggccttctttgtacttcgattcaaacactgacattgcagcaagagaaccagagcccatggtggcaaaaggaagagtatcagtgggacccgtgttggataaacagtgtgtaaatgtggccca

SEQ ID NO: 34424 - DNA, 561 bp, Zea mays
  unsure at all n locations
  Clone ID: LIB3059-063-P1-N7-A4
ttttaaaggtaagtgacaagaacatgctgcagccacaagatcatagatctactagtttcagctggatacagcaccagaaattaagaatctaggcaaacggaaatgggttccgattcaaccatagacaaagtaccaagaacagataaatttattacagagaagacactagacaatctgatggttcaccctgaatcgcacgagtccatacaggcagcagtttgtgtcccgctccaggatatggaccatttaagcatcagcataccccagttcggagagcttgaggtgggcctctttgtagtcatcaaagaatgccttctcatctgcagcatatttctccacaagagggcggaagacagggtcgctcagcagggctttgtcacttgggagctgaagaaggccctccttgtcaccactcagaagttccttgaagtaagagttgtcaaagaccaaagggttcgtagtccaggcaccctcaaaaccagaccgctctttgtggcaccttcccaaggtgtggttttttttttggcaacgangggctgatcactcaaaacccatctgctt

SEQ ID NO: 34425 - DNA, 468 bp, Zea mays
  unsure at all n locations
  Clone ID: LIB3059-063-P1-N7-A5
tttaggcttgaaacgaggacattccattgattacagcagcgangaattacagcacatggactagaaactagaacgatgcagtacaaccaccacagaaaacagcaccgataaagacaacacagactaactagaccaagaacacaacacgaccgccaccgccaccacgtaattcgccaccgggagaggggcgacctaaccgccgaaaccgtagagggtgcggccctggcgcttgagagcgtagacaacgtccatggcggtcacagtcttgcggcgggcgtgctcggtgtaggtgacggcgtcgcggatgacgttctcgaggaagatcttgagcacgccgcgggtctcctcgtagatgagcccggagatgcgcttgacgccgcccctcctcgccaacctgcggatcgccggcttggtgatgccctttatgttgtcacgcagcaccttgcggtggcgcttggcgccgccctt

SEQ ID NO: 34426 - DNA, 203 bp, Zea mays
  Clone ID: LIB3059-063-P1-N7-A8
ggggggttttttttttttacttaatctaacattacccaaactgacattatgacaatgttagccgatgatgacgacaatggaaacagtaatctaggtacaagcaggcgcctctgctggctggcaagtgtgaccacacacaaacacaccagaccagaggcaggaaccacccgccagtggcgccaacgaggagcgctatccgttat

SEQ ID NO: 34427 - DNA, 424 bp, Zea mays
  unsure at all n locations
  Clone ID: LIB3059-063-P1-N7-B1
tgtaagcaaaaacaatttcagtcattgcaactacaccgatagcaaattggtatacctcttttttttcttttccttgttagaaatactcagtcaagatactgatggatgggagcatcaatcaacagaagaaatgttatgttaaaagttaaaactgtatccatccaatgaagataacagattcgaacatctacttttctgtggggagcaagtcttcatatttgacacagtcacggcaaagtttccccaaacaaaacgactcttggaacacattggcaatgtctatacatctcccacatagcaaacatctccagatgcaaacaatacaccctctgcaagtactatgtctgctgttcttgcactcctttgatgggcaatcataaacaagtttggagttnggacaaagagggcccttcttctttttttg

SEQ ID NO: 34428 - DNA, 401 bp, Zea mays
  unsure at all n locations
  Clone ID: LIB3059-063-P1-N7-B2
ggaacaatacttttttcttttcatttcaattgttcattcaggtcattgctcacactgacactgccacccatggtgatgcgtgacacattattactcaatcatcgccgctaaatgactcaactagctagctagccagcggctatactacagcacatagtttcttcagtgggggacaccgccggcagcagcgtaggggcatggagtcggctgctgcaggccgcacatcgccgtcagttgctgcgctatctgcgccgccaacagccccgcgacctggccgctttgcggctgctgctgcaggatggactggnggaccaagccgaagatcgcctggtcccggtgctgcggctccacctgcctgagctgctggcaactctgttgccgcttcgtctgtttctgcggcg

SEQ ID NO: 34429 - DNA, 569 bp, Zea mays
  Clone ID: LIB3059-063-P1-N7-B3
agaactagaaagtactttcttatttctgggaagccacaaacatcagacaaaaactttattattgaactataactcataagaaatctaaaagagggcaccaccaatgatgggttgttggtagaatgctgctgggtttgtcaaagcaagttggttgaatggcagcaattgttgcagttgtaagagggtgccagcgttaggcgcagcgtgctggtagaacggcaacaactgtggttgtgtcaagaaggtagcagggctcacaccagctagctggctgaatggtagtagttgttgctgctgtaaataagcaggagagttcaatgctgtcagttggttgaatggaagaaattgctgggggtaggcagcagatagctggctgaatggtagttgttgttgttgcaaataagaagcagagttcaatgcagctagttggttgaatggaagaaactgctgttgctgagagtaggcagcaaggtttgctagcacaagttgttgtagttgttgtgccctgatgttttgtgccaataaatgcaccaaaggtaactgctgtaatagggctgatgattgttgga

SEQ ID NO: 34430 - DNA, 444 bp, Zea mays
  Clone ID: LIB3059-063-P1-N7-B6
agaaatgtactttcttatttctgggaagccacaaacatcagacaaaaaactttattattgaactataactcataagaaatctaaaagagggcaccaccaatgatgggttgttggtagaacgctgctgggtttgtcaaagcaagttggttgaatggcagcaattgttgcagttgtaagagggtgccagcgttaggcgcagcgtgctggtagaacggcaacaactgtggttgtatcaagaaggtagcagggctcacaccagctagctggctgaatggtagtagttgttgctgctgtaaataagcaggagagttcaatgctgccagttggttgaatggaagaaattgctgggggtaggcagcaggtagctggctgaatggtagttgttgttgttgcaaataagaagcagagttcaatgcagctagttggttgaatggaagaaactgc

SEQ ID NO: 34431 - DNA, 574 bp, Zea mays
  Clone ID: LIB3059-063-P1-N7-B7
gcgggggttttttttttaattagaaatggactttattatttctgggaagccacaaacatcagacaaaaactttattattgaactataactcataagaaactaaaagaggcaccaccaatgatgggttgttggtagaacgctgctgggtttgtcaaagcaagttggttgaatggcagcaattgttgcagttgtaagagggtgccagcgttaggcgcaacgtgcaggtagaacggcaataactgttgttgtgtcaagaaggcagcagggctcacaccagctagctggctgaatggtagtagttgttgctgctgtaaataagcaggagagttcaatgatgccagttggttgaatggaagaaattgttgggggtaggcagcagctagctggctgaatggtagttgttgttgcaaataagcagcagagttcaatgcagctagttggttgaatggaagaaactgacgttgctgagagtaggcagcaaggtttgctagcacaagttgttgtagttgttgtgccctgatgttttgtgccaataaatgcaccaaaggtaactgctgtaatagggctgttgatt

SEQ ID NO: 34432 - DNA, 406 bp, Zea mays
  unsure at all n locations
  Clone ID: LIB3059-063-P1-N7-B8
tccttatatattattcctttccatttcaatggttcattcaggtcattgctcacactgccacccatggtgatgggtgacactacgttactcatcgccgctaaatgagtaaactagcgagctaggtagctagccagcgggtggcttacattattactacagtacatagtttcctcagtagtagacaccgccggcagctgcgttgcaagggcagggacctggctgctgcagctgcaggccgcacatcgccgtcagctgctgcgctacctgggccgccatcagcgccgcgagctcgccctgcggctgctgctgcaggaaggactgctggaccccaccgtatgtcgcctggtgccggtgcagtggctccacctgcctgntctggtggctgcccttttgctgccgcgcctgg

SEQ ID NO: 34433 - DNA, 544 bp, Zea mays
  Clone ID: LIB3059-063-P1-N7-B9
gcgggtgttgtttttttttaccaaatagcgtttattcaaacatgttctgataaagaagcaagccatcgaggttcgacggagcctcgtagtacaagattcgacacgacggcaacaagcatacacgcagggagggggctatatgtgttatgtgtaataggggggacgcgcaggcggcgtactaggcctgcttgtagtacacagccagatagatatgctccacctcagatattatatataataagctggccctgcatgcagggttggtttgctatggacccggcggttgctcagaaaccatgaatcttgatgtgctccttcttcacaatgccggcctggacgaggaaattcgagacgttcttcctctgatcaccctggagctgaatgacctgtccaagttctgggtcctggaccactgtaccattgcagcagaactctttcttgagatctttgaggatcttgctgtagctgaactccttcttcaatccctggacggtagtcaggctcttgcgaccattacgctgctggatgcgcacgtgtacgtagt

SEQ ID NO: 34434 - DNA, 289 bp, Zea mays
  Clone ID: LIB3059-063-P1-N7-C1
ctaaaaagtactttcttatttctgggaagccacaaacatcagacaaaaactttattattgaactataactcatagaaactaaaaggggcaccaccaatgatgggttgttggtagaatgctgttgggtttgtcaaagcaagttggttgaatggcagcaattgttgcagttgtaagagggtgccagcgttaggcgcagcgtgctggttgaacggcaacaattgtggttgtgtcaagaaggtagcagggctcacaccagctagctggctgaatggtagtagttgttgctgct

SEQ ID NO: 34435 - DNA, 141 bp, Zea mays
  Clone ID: LIB3059-063-P1-N7-C10
gcctgttttgttttttttttggagcgaggaagaagcgtcctttatggaacacaagggtaatacccagaatcacaaaaatacaaagctcctgaccatccataacaaggatatatagtggaattcccaatgaactcggttaca

SEQ ID NO: 34436 - DNA, 484 bp, Zea mays
  Clone ID: LIB3059-063-P1-N7-C11
cgtggtgttttttttttttttttttttttttttttggggccgccaccacgctacgcgctgcttatatttcatactttcttcaataacaaggattcatgttcggaatgacttacagggaagaaacaccagaggctgggaagcaatagcagacaaggagggggggcatcaatgtaaacgtcggctttacatgtccaattattaaccagccagatttcaagtacaacaaatacaggtctttaaacagctgatccttaatgaaaaatgaagctttatccgtgcccccgtgacatgatggcattcagtgcctgcaacaggcccttaccaaacctcagggcggggctcaccagtagccgggggcatccatttcccagagttgtacacgctctcgccgacctttcaccctggaacgtctttcatgatcctcgcctcctcctccggacacttcttccactctttggcagatctttccttctcttctgcttgg

SEQ ID NO: 34437 - DNA, 381 bp, Zea mays
  Clone ID: LIB3059-063-P1-N7-C3
gcgtgcgtgaagcgggcacctctagcgcggccgccctactgcgttcggtcgtttccactcttgtctttctttttttttgtttttgttggtttttttgttttttttgtgctttttttgggggggggggggcaagtttaccataaaaggggctgaaacaacagggctggcggggccgggcggccatggtgggggggggggggggggggtatcgggggggggggcgcgggttaggggggcgggggggggggggatacctcggggggccggggtgtgggggggggggggggggtccccgggggggggggggggccccgggggtttggggggggtcccggggggggggcccgcctcccccttgggggggggggtttgcgggggggg

SEQ ID NO: 34438 - DNA, 347 bp, Zea mays
  unsure at all n locations
  Clone ID: LIB3059-063-P1-N7-C5
gcgtgcgtatgcttggntcctcttgcgcggccgccctttgtgttttttttcttatttttttttttactggttcttttcttgctttttcttttttttttttatttttttttttttttttttttttttcttttctttttgttgtttttttttttttttttttttttttttttttttttttttttggggggggggggggggggtgccttttttttggggggccccgccccccccggcagcgttttttttttttccctttttcgctggtgccctttttatggggggcccccccctttgtgggtggggggggggccccctgggggtttttgcggcctttttggggggggggg

SEQ ID NO: 34439 - DNA, 595 bp, Zea mays
  Clone ID: LIB3059-063-P1-N7-D10
ggcgggggtttttttttttttttttttttttttttttttaagctgtaaacgcacaaagcacttttatttatagacggggccaccgaaaaaaaaaaccaacaacacgtcactgacaaggcgcagtaacaagagtagaaacactttccgggggcgcggggggggggggggaagccaagagtccaagactgaaagatcaagcagctcactccgccgccgcctgctcgacaaccatcggcagggactcctctttctccctccctttcttcccatgctcctcctcctccttcccaggagagggcgggataatcagggcctcccgttgcgcacgcaccagcttactgaactccttttcgcgagcgccgaacgcgggggggatctccggccctagcatggtccggagcaccgagggggcgccgaccaggaactgcggccggttgcggcgcgccggggtggtgaagccgaagaactcgaagggcccggcccgcgccgccacctggcagaaggggaagtagcgcgggatccataacacgttggcggggcgcaccaccttgcctatggccagggacccgttcgggaacccccctgggaccggcct

SEQ ID NO: 34440 - DNA, 611 bp, Zea mays
  Clone ID: LIB3059-063-P1-N7-D11
gccttgggtttttttttttttttatttttttttttttttttttttttttttttttttttttttttttttttttttttttttttttttttttttttttttttcttttttttttccatcttttttttttttttttctttttacctttatcaccctggggggggggggggccttttttccttttttttttttttctctttttttcttttgttggctcatttcttcaatgcgccgcggcccccccccctctttctccgaaacctttctttcttctctttccttctgccttttcttttcttccccccccctccttgttttgctttttgtcccctctttgtgttcttcttcccctccctttctttttcttccttctttcctcctgctctttttcttttcctttcttttgctctttcctcgtcttctttttcttttcctctttcttcctcttttgtcctttttcccgtttccctgtttttttcctctttgttcttttttcccctcttctggttttttcctttcttctttttctctctttctttttcctttaccccttttttttttgcgtttgttttgtttttttctcctccctttctcctctgtctttctccctacct

SEQ ID NO: 34441 - DNA, 65 bp, Zea mays
  Clone ID: LIB3059-063-P1-N7-D2
ttcggttttttttttcatgttctgttttttttttttttttttcctcttctttttttttcttttct

SEQ ID NO: 34442 - DNA, 488 bp, Zea mays
  Clone ID: LIB3059-063-P1-N7-D6
cttaaaagcaaaacaaacgggaacttatagattcatcgcgacacgatcttcaccagaaaaggttacaagagacatgtagagatttattctatggagacagcaaaaaccccagtcgatatatcagataggatgattggtgataccaagggaggaagcaaacacaaacacacaaagtttcagaagcacagctactgcttgctccctcaggcgaccttgacctcgatggtcttgggcttcttgggctccggcgggggcagcttctcgacggtcaccgtgagcacgccgtccctgcacacggcggcgaccttgtcgacgtcggcgttgtccggcagcacgaacttgcgcatgaacttgcccatccgccgctccatgcgcaggtacttggcgtcgtcctcgcgctcctcccggcgccgctcgccgctgtccaccagcacccgctcgtcctccacctgcccccggttgtcgcccgtgcccagtcccggcttgtc

SEQ ID NO: 34443 - DNA, 215 bp, Zea mays
  unsure at all n locations
  Clone ID: LIB3059-063-P1-N7-E2
ggccgacctaggcgttcgttcagttgttagtgctgtgtttattctcggctccagcagacccatgcattaaacagctggttctgcggttcgttgggtgctgtttctcttgtttggcttttttctgggggggtcttgggggcccccggtgctccttggggggggggggggggggggcctgngggggnnnncnnnnttcctntggggggggggggggg

SEQ ID NO: 34444 - DNA, 622 bp, Zea mays
  Clone ID: LIB3059-063-P1-N7-E3
tgcacgcgtacgtttgcttggctcctattacacggccgccctggttttttttttttagctatgaccgatttgcattggattttattagtagactgggcaccggtaccaaaatgtgccacggacccacgagcaacaaacatgttattttatttatgtacaagatgctcctgcagtttaagtttcacaactgacgccaatggatgctgatcaagtctgctgagatctcaaatgcggttgcatcaggtgttttcgtacggcatccacgtttgcagaaaacaccgagatccacgcgcaacatttctgctggattaaccaaaattgattccctgggctagaggtagctcgctcccatagttgattgtgcaagtcggccttctcatgtactgcttccaggaatgactccctgcttgtcgtccaccaccagttgctttttcttcaccaagtgctctaccgatggcagcaccattcgtcggtgtgttcacattcactatgcgccaatcactgccatggggcccgtgcctcttaaaaataatatctggcctctttgtaaatattgaactgctcaatccttgtggaacagagtttttgatttcaattgcttccttccgggtctgtgtttttt

SEQ ID NO: 34445 - DNA, 298 bp, Zea mays
  Clone ID: LIB3059-063-P1-N7-E5
ggccgccctatgctttcttttttatgtttttttgtgaacagtattcttttacttttcaaatagatgttttcatgccgaatcttaaactggactttctttgtgatgtttgagagttatttgttgttttttcagttttgcttgatcttgctgtatgttaacatgggggggggggggtataacgaaagattaacatgtgctggaagcggtttcatacctactcggcgccgcggctgttttaaaaggttgcgcggaacaggtacttttgtgctaaatgcgctgacgctttttgtttttcccc

SEQ ID NO: 34446 - DNA, 481 bp, Zea mays
  Clone ID: LIB3059-063-P1-N7-E6
ctggtttttttttttctcaagagtgaatcatgattatttacgttttatttgatgaactaacccatacctaaggaagacctgctggatctgcaaccttatgacttattgcaagcatatattatcaatcacaggtgggcaaaattaggctgacacgcgggcgggggtagaaaacctatcacatacgagccaagaggtcaaaaaccaatccagtggtccggtcagtttcgagtaagacagtcagtgccagggcacaccacagcagcaaacgaatcgaagcctacatccgagagcgacggatcatgtcgctctcggtgataacgcgatcgcgggtgatatctttcagcgacgcgcagccgctcagcgccatggtgatctcgagctcatccctcagcatccgcagcgcattgctcacccctgccctgccgtccacggcgagggcgaacagtacgggccttccaatctgccagaggacatgcatgaa

SEQ ID NO: 34447 - DNA, 551 bp, Zea mays
  Clone ID: LIB3059-063-P1-N7-E9
ctgggtggttgtttttttttttttttttttaaaggagggaccgttgcctcaacctatgtattcccatgtaatcacaaaactcaaaaaaagttctgcgtccaacatagttgtacaggtgcagaattacatggaattttgttgcccaaacaataaggtggtgaccatgcggcggtgcaaccttattgtcttaatctgttccacgaataatactaacatttgtttcaattagtatcccccagttccttgacgaacttatccttcagcaagctgtttgatcctgccattcttcgcgacatcaaatcaaactctccgccgtttgggtcaaaaacaaggccaccggcttcctgaagaattacagcaccagcagcaacatcccatggaccaccaaatcctatctcataacacaaatttagtctaccacaggcaactccacacatgtttaaagccaatgatccacacatccgtatggatcgaatcttgtatagtagcctgttgattctgttggttagatcatccacagtggtcttggctctattggttccagcctctgt

SEQ ID NO: 34448 - DNA, 591 bp, Zea mays
  unsure at all n locations
  Clone ID: LIB3059-063-P1-N7-F11
aaactatcacgtctcttgcacgcgtacttttgcttggnatcctctnagcgccggccgccggggggtgggtgtgtttttttacccaaaaaagggtggcggtcggacgatctgttattccgccaaagacacctagaaacatcttcttgttttacaacaagtcaacaacacacggggagcacgaagagacgacgccaacgcgacgacagacgcacacgaggggggggggcgcgcacgcacaggcatggccacggatgccaaccacacaaacgaccgcctgtcgggaaagcctacagcagcgacgactaagcaaaaacaacatgggacacactaagttgacgaatttgcctacttgtacttgatggcagctctagcgatggcactgcagtaagccttcgtctctgtgcccaaatgatctctcttcccgtctaaaagactgacgactaacgattagataggtcgacggagactttggggcgagtaccgtctcctcctcctggttcctgctcccattcctatggtagcgtcctttcagctctgcgagcggcggcggctcgaacttcttgttgttccagtagacgctcttgcggttcc

SEQ ID NO: 34449 - DNA, 517 bp, Zea mays
  Clone ID: LIB3059-063-P1-N7-F4
ggtcaaccgatgcagcatttaaatcaacaaattgatatggcgatacatgaaggatgattgcaacgatatgctactatcactgagattacaagttccttctgaatgccaggtccagctaccgcgttttcctcgctttgggtttcagatgatctgtgccacagagagcgatgtatggttgccagggctgtgaagatgagtgcctgagtacgcatttcaagcaagcgcaagttcattcctcgctttatatatagaatatcagtgccacagagagagcgatgagtgccaggactgtgaagatgagtgccgcaacagctgatgcagctagcccagggcgctctcgaggatccttgttgtagtacttgcagcagtaaagagtggctgcaaagtaccaaatcaaaggacacaagaaccctaaaatataactgcaaccacagtatgcttattggacaattgtgaaccgaagtttatatgaagactggagtagtaaagcatacttacgaagaccatcctatttttt

SEQ ID NO: 34450 - DNA, 539 bp, Zea mays
  unsure at all n locations
  Clone ID: LIB3059-063-P1-N7-F6
aaaatctggaaatgtaacttcttatttctggttggccacatacatcatccaaaaactttattattgaattacaactaataagcaatctaaaagagggcaccaccaatgatgtgttgttggtaggaggccgctgggtctgtcaaagcaagttggacaaagggcaacaattgttgtagttgtaagagggttgcggggttagccgcaaactgctggtagaaaggcagcaactgttgctgtgtcaagaaggaagcacggtttgctgcagctagctggctaaatggtagtagtatttgctgctgcaaataagcagcggggttcagtgcggccaattggttaaatggaagaagttgttgttgctgagagtaggcagtagctagctggctgaatggtaatagttgttgctgcaaataagcagcagggttcagtgtagacagttggttgaatggaagaaattgttgttgctgagagtngggagaaaggtttgccagagctacttggttgatcacaggtagcacgagttgctgcagctgctgtgccct

SEQ ID NO: 34451 - DNA, 395 bp, Zea mays
  unsure at all n locations
  Clone ID: LIB3059-063-P1-N7-F9
caaggaaacnnagccaaggngacacagggcagcagcnncaggacgaaaacaccggncagaagcacagnnnaaagagcggggggggggggggagcgcgcgagccccaagccccagcgccacggccgnagcggcccccagccagagaacagccgccgccancanacaagccgggcaaacccaccccaggagncgacaacgaggccccacacggnccacggcngcggaaacgagcaggcgngnngncncnncgcgaaagcagcccgcagcggcnccgccgccggagccagagccacaagagccngcnccaaagccngaaccngcgcaggcagcnccggcgncgccgnncgcgcaaacgcaagggncgccccagccnnggagcaggcnggacacagcgc

SEQ ID NO: 34452 - DNA, 414 bp, Zea mays
  Clone ID: LIB3059-063-P1-N7-G4
ggggggctaaaaacaccaggcaaattttattcctacatttttgcatagagcactggcgaacccaggtcatttgactcagggaaaaggcttctcacaagtgccggtgggcctatccttcctaaatgagggtacagttgcaactgtccaaatgcaatctgtttggattgcaacccactttataccaagaaaataaataaattaaagctcttgttattggcccacagaaggaaagaatgtactgccctgtttgaaacaaatgaaccagacatgcatttccatcagcaacccacttggtcaacaaagggggtccagcctgttctagagataaattgcgtcgattcaagaaactagaacattaaccgccacggcaaagggcagagttaaaatgttgcttaatatccccattggcctttg

SEQ ID NO: 34453 - DNA, 524 bp, Zea mays
  Clone ID: LIB3059-063-P1-N7-G5
gaaaggaaatatcattattagggccggctttaaactttttttttttttcactccagaacaataacaagcctaacgaacaacgtgttgaaaaggggaaaaatcagtccatgggggccaaaaccacaaacatgcaagagctgaaagaaaattccgggtagaggtcgttatttggagcccacaagggtgccttttggaagcgcggacaggggcacaagaggggcatgtgatttaatggaagcatgggcaccagggatctgggcctcctttgttctggggagcaccttcctaacctggttggcaagctttatgatcgaataattttcggggctaaggctggctaaggccttctccatggaaaacaggtaatccctattatagccagtagggccatgggctgaagaaatttgccttgccatatccggcaaaggagcagggccaaaatagtacttgtggccaatgggatctggaggggaaacgaacactaaaacccccgtcacagttggtttaaagggaaccccttcctt

SEQ ID NO: 34454 - DNA, 233 bp, Zea mays
  Clone ID: LIB3059-063-P1-N7-G7
gtggggggggggggtgttttttttttttttttttttttttgtgaagggtgccggctacctacaatttctttttttttggccaaacaattttgggtttgggggcccctttctggggccccttttttttgttttaaaaagaaggccccccactcagtttgttttttcgggggggggtttttaaaaaaaaagggggtttgggtgcaaccatttggttgtttcttcgggggggggct

SEQ ID NO: 34455 - DNA, 301 bp, Zea mays
  unsure at all n locations
  Clone ID: LIB3059-063-P1-N7-G8
gccaggtgaacgagcaggcatttttattcgaagcaaaggtgcagccaattcccaccatactaggnaaccaggccagcgctgcccaaaacgctcaaacaaggaaaaaaacgagaaggaacccaaagttcttggaaaccaagtacacataactccaatacacgactaacaatgcgaattgcggtgaaacagatcgaaatgcaggcgatggttctccggcctgggcttcttcttcttcttctttccccgtactaatcgaaggacagcggaacctggcttgccaggctacggtacttcagggcgt

SEQ ID NO: 34456 - DNA, 562 bp, Zea mays
  unsure at all n locations
  Clone ID: LIB3059-063-P1-N7-H2
aantacaatgtactttcttatttctgggaagccacaaactcagacaaaaactttattattgaactataactcataagaaatctaaagagggcaccaccaatgatgggttgttggtagaatgctgttgggtttgtcaaaggcagttggttgaatggcagcaattgttgcagttgtaagagggtgccagcgttaggcgcagcgtgctggtagaacggcaacaattgtggttgtgttaagtaaggttgcagggctcacaccagctagctggtctgaatggttttagttgttgttgtttgtttataattttgtatagtttatagttgttttttttttttttggtttaattttttgttgttggttattttattttggtttttaggttgttgttgtttgtttcaattttgtagttcgtttttttgtttttctgtttttntttaagttaattattttttttcgcttttctttttgtgttaggtttttttgtgcttttttgtttgttttttgtgtttttttttttttgttgttttcttttttctttttttttgttttttcgttctttttt

SEQ ID NO: 34457 - DNA, 440 bp, Zea mays
  unsure at all n locations
  Clone ID: LIB3059-064-P1-N7-A1
gtccccgtcggctgactcacggttcattgttcacccacgagcgnggcgccaatnatttttttttgtctgnncttttcttttnaacccggcctnaagnccttttttctttttttttgtccccctttttttttnttttttttttttttttttnnngttnnnnnnnntttntttttttttttttttttttttttttttttttttttttttttttnnnnttttnnnnttttttttttctttttttnttttttttttttttttttttntttnnnttcnnnnnnnnnnnnnnntnnnnnttttnnntttttttttttttttttttttttttttttttttttnttnnnntctnttttttttttttttttttttttggggtttgttcgcttcttttttntttttctttttttttcttttttttttttnntttttttttttttttttta

SEQ ID NO: 34458 - DNA, 482 bp, Zea mays
  Clone ID: LIB3059-064-P1-N7-A10
gccgtggtttttttttttaacaaaccattgatgcattggaagttggggcaaaataccacgaggtggttcaatacattactaacaaacaatgtttcggtcaaaaatactttgccatgtctagtttctagaggtagggaaaaaacacagttgataatctgtgggtgccacattcatgaacttgaaatgctttatttcttcttgtcagtgtgcgtaccagccgatctcatcttcctgaggacccatcatctcctctctcttcttctttgccctcttgtgagttccaagctttctcttggcaagcttcagagcgcgcttgtccttgccaaccttcagaagctcggtgatacgcttctcataaggagcaaagccagcaacctctctgatcaggcccctgaccatggacaccctctttgttgctttccccttgcggtgggacgggcgcttaggcagctcgcgcttggtgacgacatggcccttgtttg

SEQ ID NO: 34459 - DNA, 587 bp, Zea mays
  unsure at all n locations
  Clone ID: LIB3059-064-P1-N7-A12
cgtgcgttagccttggntacctctanacggccggcctgttgtgtttttttttagaactggnaaagtaacttcttatttctggttggccacatacatcatccaaaaaacttattattgaattacaactaataagcaatctaaaagaggcaccaccaatgatgtgttgttggtaggaggccgctgggtgtggggaagcagttgnacaaagggcaacaattgttgtagttgtaagagggttgcggggttagccgcaaactgctggntagaaaggcagcaactgttgctgtgtcaagaaggaagcacggtttgctgcagctagctggctaaatggtagtagtatttgctgctgcaaataagcagcggggttcagtgcggccaattggttaaatggaagaagttgttgttgctgagagtaggcagtagctagctggctaaatggtaatagntgttgctgcaaataagcagcagggttcagtgtagacagttggttgaatggaagaaattgttgttgctgagagtagggagaaagtttgcccagactacttggttgttcagaggtagcacgagttgctgcagcttttgtgccc

SEQ ID NO: 34460 - DNA, 234 bp, Zea mays
  unsure at all n locations
  Clone ID: LIB3059-064-P1-N7-A7
tctggtcacgcctgcggtgtcaccggttccggtaattccccgttgctactccgaaaaagggtgtcttagggttgatggttcacgtcggtggggccgtccgccctgttagccggtcgttttggccctttgnacgcttggggtccacggtgtcttcgataggtggcctcttgtctcctgtctggncgcgtcacgtcacccctttcgtngcgtgcttttcttggggggggggggggg

SEQ ID NO: 34461 - DNA, 508 bp, Zea mays
  Clone ID: LIB3059-064-P1-N7-B11
gggggtgggtttttttttacgaaaccgaaccagaataccgtattacttaaaacgcgtgccacgataatattgttcaccaacaaaaggttctaacgcggatacaccgcgacgacgacgataaatcgagcagcgactgggccagccagccactgcaggggaggggcgagactgacacaaaccgcttagtccacctcctcgatcttggggccagggccaccgcttccagccggagcgtcctcgtccatgccgccggagcctcccatgtcggcacccgcgccctggtacatcttggcgatgatggggttgcaaaggctctccagctccttcatcttgtcatcgaactcgtccgcctcggcgagctggttggcgtccagccagctgatggccgcgtcgatggcgtcctcgatcttcttcttgtcgtcggcagccagcttggacgcgatcttctcgtccttgatcgtgttgcgcatgttgtaggcgtagttctccagccggacgcgtgggtgcg

SEQ ID NO: 34462 - DNA, 62 bp, Zea mays
  unsure at all n locations
  Clone ID: LIB3059-064-P1-N7-B12
ccccccccccccctcccccccccccccccccccccccccccctccccctcccccnccccccc

SEQ ID NO: 34463 - DNA, 533 bp, Zea mays
  unsure at all n locations
  Clone ID: LIB3059-064-P1-N7-B5
acactaacatgacatgcatatcaacatctcagtaatacagtaaggaatcaggttcaggtcagcttgcaacgttccattgtccacaccacataatacaacatccatgtgtaatacaaagttgtaaaagcgcgggaaatgcccaacgcctaatattcataaaaagatgacagcgcgctaggattgtcatttgtccttcacaatataggatcttgatggattaattggcatgctgcagccttaggattggtcctaaatccagtgtaacgcttcagcagctgcaacatgaggtaccgttaatcagacaaacattgccaactctggacgactaaagatgttatccccatcgtcttccagggcnggataagaagcaacaagtgcatcctgcgcgccgttgtacaaagagttgtttatttttttatacacttnncggcctttccttgctgggtggaagagaccttgcgggcaataattttaaatcacagccgccccttgggcggccctcttccccttattgctctcctgccggctttttt

SEQ ID NO: 34464 - DNA, 206 bp, Zea mays
  Clone ID: LIB3059-064-P1-N7-B6
gggaaaaacaaaattgggttccacccaaacaagggggggggggggggaaaatttcttccaaaaaaatttggggcaaaccggtttaaatttttttttccgtttttcgaccctttggttttttgcccccaaaaaaagggggccctcccaatttggggcctcggctctggggcctccccttttcttttttttcctttttttgggggccc

SEQ ID NO: 34465 - DNA, 458 bp, Zea mays
  Clone ID: LIB3059-064-P1-N7-B9
ctggtttttttttttttttttttttttttttttttttttttttttttttttttttttttttttcgggaaagaaacttcttatttatgggggggccccatacctcactccaaaaaactttattttggaattccaaccaagaaccaatctaaaagagaggggggcggcaaggatgtgttgttggcaggaggcccctgggcctgccaaagcaagttggccaaagggcaacaattgttgtagttgaaagagggtggcggggttagccccaaactgctggtagaaaggcaccaactgttgctgggtcaagaaggaagcccggtttgctgcagctagctggctaaatgggggtagtatttgctgctgcaaataagcggcggggttcagggcggcccattggttaaatggaagaagttgttgttgctgggcgtgggcagtacctagctggctgaatggaaatagt

SEQ ID NO: 34466 - DNA, 452 bp, Zea mays
  Clone ID: LIB3059-064-P1-N7-C11
gccgttgtttttttttttttttttttttttttttttttttttttttttttttttttttttttttttttttttttttttttttttttttttttttttttttttttttttttttttgtggcaaaaaaaaaaatttttttaaaaaactggggggggggggggggggggatttcacaaattttcaaaagggggtaataaattttttggaacgggggcaaaaaaaccccagggtttccaaatttgggggggcccaaagcttaagaacctcaaaaaggaaacccccgttcccctgagagccaaggtttccctaaactttttttgggcccctggctcaaaatttgtcggaaaaaaaaaccccctgacttttggttttgggtttttttttgggccggggctccaaggatacctctctctaggctcgcccccccggggggccctaactttttttttggggt

SEQ ID NO: 34467 - DNA, 487 bp, Zea mays
  unsure at all n locations
  Clone ID: LIB3059-064-P1-N7-C6
agcaagaactacaaggagacattaaccacataatgagatcttcaaagctcaggtcacagacacacaggttcacattatgttccagaactctcatccaggcacagagcagttttcaaataacataaaacctgtatcacataatcattggtagcaaaaactaaagagatgaggaaaaggcggtacgacaaccatcagatgaccgtgaagagcctagtcgatctcctggagagaggcgccggtggcggcgccaccagcggcggcggcagcgacgtcgtcggcagtaaacttgcccttagccttgtcggcggcgcggccccgggccttgcggtccaggagcgccttgcggtccttgtcgagcttcagcttagtgacgatcaccttggaggggtggatgcccacgttcacggtggagccgttcaccttctcgcgggtgatccgctcgncggggatgacccagcgggggcggtggacctgccccacctttccc

SEQ ID NO: 34468 - DNA, 262 bp, Zea mays
  unsure at all n locations
  Clone ID: LIB3059-064-P1-N7-D1
gttgtaattcaataataagcaatctaaaagaggcaccaccaatgatgtgttgttggtaggaggccgctgggtctgtcaaagcaagttggacaaagggcaacaattgttgtagttgtaagagggttgcggggttagccgcgggctggggggagaaaggcagcaactgttgctgtgtcaagaaggaagcacggtttgctgcagctngctggctaaatggcagtagtatttgctgctgcccatccgcggcggggttcagtgcggc

SEQ ID NO: 34469 - DNA, 443 bp, Zea mays
  unsure at all n locations
  Clone ID: LIB3059-064-P1-N7-D10
agcacgttcaaccaaaatattataaggcaaagttaacacatcacagccttgtttcgctacaaatcacatagccacaagtctttaaacaaaataaggacagcctactaacatgggcagtctttccagactcgcttggatctcccatgcttcaccttcatggactcgaatggacctgcgactcacttggccaccatgcttctccttcatgggctcagttgggcctgcaactcatttggccccatgcttcgccttggggtgggcctgcggagccctctcactattgaatgtcttgctgcgtgttttgcagggggctgccccacccgattttggggncttctccggtggtttggccttgtttgcgggggtcttgcctttngctgggggtggggctgccacatggggggggcccttgttgccccctggttttttggggtggcgggggg

SEQ ID NO: 34470 - DNA, 592 bp, Zea mays
  Clone ID: LIB3059-064-P1-N7-D12
gccggggggttttttttttttttttttttttgaccaagcatgagtttataattacgatttgatgttttcaattatttatatgatgaacatagttcagaaatatattgagataaatctcaatcaatatattgattatttctaggaaacacatgcggggggggggggaccattatcgagtacatctcatatgtaatctaaaagatggcacctccaacgatgggttgctgcctcgacaagacagggtttatcaaagagaactggttgtatggcagcaattgttgctgctgtaggaaggcagcgaccaatgggttagccactgctagtggattaagtaactgttgtcgctgttgtaggtacgcagcagagttcgacatagtcagttggttgaatggaagcagctgttgcaagtaggcagcagggtttgccacaactagctgagtcagagctggtacaatctgttgcaacaattgttgttgcaggtatgtaggtgcattggccacagcgagcgggctagatgaaagcagttgttgctgttgttggtaggcggcagggttcaccatggcttgttgactgagcgctggccgaaactgtg

SEQ ID NO: 34471 - DNA, 291 bp, Zea mays
  Clone ID: LIB3059-064-P1-N7-D2
tgcacgcgtgcgtgtgctgggctcctctagcgcggccgcccttcgctttctttgttttattattccttttgcttttttttcttcttttcgctttttttctccgttcgtcacctgttgggtgttgttcgttgccctcgctctcctggctctcgctgtgtgcgcctcctcctcgcttacaagcggctgttgtgggtgggggggggcgccgcctgttcattttccgccgtcggtgcgtttgggggggggggttctcctgccccctcccgcccctggggggggggcggttctttt

SEQ ID NO: 34472 - DNA, 160 bp, Zea mays
  unsure at all n locations
  Clone ID: LIB3059-064-P1-N7-D4
ctgctcgtcttattgccagtctttgcggcagcagtgttgccagcagctctagctgtttttgtgggggggggggtcccantctatcttcggcttggtccttcattccattctgcagcagcagccgcatagcggccgggtcgtggggctgttggcggtgcat

SEQ ID NO: 34473 - DNA, 327 bp, Zea mays
  Clone ID: LIB3059-064-P1-N7-E12
tggcgagactagtgcgtccagctagctagggcggtagtttgatggtctctcgctcaggcctgaagaaccctgggtgcggacggccggtgccctggaaggaggtgtccttgaggtgctccggcgcgttctcgtacgagtgctgcctcgccagcgaggaggaggtgcttgtccgccgcgatgaagtacgccatgccagcaactgtggagacgatgagggcctggccagcggggttgatgttggccttggcccatggcagcatcctgacgctaaccagggtgggaactgcagaggcgacggtcgcgacagctgctgccttgaaccctgcg

SEQ ID NO: 34474 - DNA, 342 bp, Zea mays
  unsure at all n locations
  Clone ID: LIB3059-064-P1-N7-E2
agagtcaaatactagcagaatccattacatcacagaactgtagtgcgcccatatatatagggtactagtactgatacaataacagtacgtagcctctattcggctcatgttcattggcatggcttattctagtcgcgcgggggggagacacacggtctactcgctccctcgcaacatactagtatactactataggggtccataggaacaggngagaagcattattataatantagaaacantaataggattagctcgacacgtgattgacggggaacatcgncgtggtcgcttcggccctcccgtgtccgtgtggttgtggggggcgcggtggcccgggtg

SEQ ID NO: 34475 - DNA, 440 bp, Zea mays
  unsure at all n locations
  Clone ID: LIB3059-064-P1-N7-E6
aagctcaaggtggacgcatggttcggcacccgccgcaccatggccgccatccgcaccgccatctcccacgtccagaacctcatcaagggggtcaccaagggctaccgctacaagatgaggtttgtctacgcccatttccccatcaacgcgtccatgagcggctgcaacaccgccatcgagataaggaacttcctcggcgagaagaaggtcagaaaggtggacatgcttgacggcgtgaccatcctccgctccgagagggtcaaggacgagcttattctcgatggcaacgacgtcgagttagtctctcgctccgccgccctcatcaaccagaaatgccatgtcaagaagaaggatatcaggaagtttttggatggtntctatgtgagcgacacgggtgtgctcgaagaggagctgcgcgggaccnttcgtttgttatcgtt

SEQ ID NO: 34476 - DNA, 351 bp, Zea mays
  Clone ID: LIB3059-064-P1-N7-E8
gtggggggggggggggtttttttgggtggcaaacctaattggccaaaaaaaatttttttttgtattcaaaaaaaaggctgcggaaaaagggggaaaccccaaatagattggttggggtgggggcgcgtggggtttgaaaaacaatttggtaaagggggcaaaatttttggttttaaaaaaggggggggggggtaaccaaaaatttttagtgaaaagaataaaataattggttgaaaaaaaaagaaacccgggttggctccccctgggtgtcttaaggggaaaaaattttggtggcaaaaaaaacaagggggtttggggggcccattgtttttataaaaaaatatttttttt

SEQ ID NO: 34477 - DNA, 543 bp, Zea mays
  Clone ID: LIB3059-064-P1-N7-E9
gtttgaaagcaactccgggttttgagctccagattaaaatattcacgagtacaaaaataaatccatgcaggattcaggtaacaagaaacatatgtccatgttttagatggactataatttatttaggatttgcaaagttaagactgaatctaaaagacagacaatttaagatgacaccaattaaccggtcaatgcagcattgagcgcactgtgaacatcgacaccgatctgagcctcagccttctccaggtcagtagaggccgaaccaagcttggcagtgaattcagcgagacccttctgaacaaaagctgggtcgatctgatccacagggacagcctcaacagccacaatatcagcaatggagtttgcatggacgaaagcaaatccactgctcacaaagtacttggtcacatcgttcccctcatgtactgagagaacaccaggcttgagctctgcaatcgtggcaacatggcctggcaaaacgcccatctgaccagttgtagctggtacaattaccatgtccacctccttgttggcgatctc

SEQ ID NO: 34478 - DNA, 352 bp, Zea mays
  Clone ID: LIB3059-064-P1-N7-F10
ctgtgtgtttttttttttttttttttttttttttttttttttttttttttttttttttttgggtttttttttttttttttttttttttttttttttttttatttttttttttttttttgtttttttttttttttttttttttttccagttgggggggggggggggggacctggggggggctcccccccccctttaaaatttttttcaaaaaaaacggggggggttccctttttcccaattcccaaacgggggccttgggggggggtttttcgggggggcgaaatttggtcccccccccggggttgggggggcgcggttggggtttctccggcctccccccccccctgggggg

SEQ ID NO: 34479 - DNA, 235 bp, Zea mays
  unsure at all n locations
  Clone ID: LIB3059-064-P1-N7-F12
tgccgcgttcttttacttggaacctctngaacggccgggggggggggggggtttttngcgtcccctccttgcggggtgccttgcttctctgttctgtggtgcgccccttttttttgggtgcttgttctgtttctgtttccgtccgtggcctcgtttcggcttttgtttcttggcttttcttcttcttggggggggggggggggggggctctttttctttctccctctcttctttc

SEQ ID NO: 34480 - DNA, 437 bp, Zea mays
  unsure at all n locations
  Clone ID: LIB3059-064-P1-N7-F2
ggaacaactttttttttggtggggaggacgagtgtaatgcagacacgaggcacgacgaacacgaacagcgcgcgggggctgactacgtacaccgtacacgtaccaacagggtgggcggggacgaggaggctacaagaacacaggcagcagaagaattttttaccaccacaccacgcacgcaccagctactgggttacaaatcgtcaagtcctttatttatctaccatgtttcgatgcctttcgtcttgccttgatccggggatcgacaccgatcgtcgtagcggtggcagtngagcggnctccatgcacacacacgcgcgcgcgcgcttttttttttcgggcggggaataaccgggcgcttctgggtggggcactcgggggggcggccctgttggctgcgcttggggccggtgccgtngttggtgttcttgttcttg

SEQ ID NO: 34481 - DNA, 147 bp, Zea mays
  Clone ID: LIB3059-064-P1-N7-G10
gctgggtttttttttttttttttttttttttttttttttttttttttttttttttgggggccttaaacaaccaaaatagcacaaaacatagacagggcagttctgaagcatggaacaatccatagacgaccggacccggacccctgg

SEQ ID NO: 34482 - DNA, 648 bp, Zea mays
  unsure at all n locations
  Clone ID: LIB3059-064-P1-N7-G12
gcgtgcgttagcttggntcctctanacggccgccgttgggtgttttttttggaacaatacttttttcttttcatttcaattgttcattcaggtcattgctcacactgacactgccacccatggtgatgcgtgacacattattactcaatcatcgccgctaaatgactcaactagctagctagccagggggtgtgctacagcacatagtttcttcagtgggggacaccgccggcagcagcgtaggggcatggagtcggctgctgcaggccgcacatcgccgtcagttgctgcgctatctgcgccgccaacagccccgcgacctggccgctttgcggctgctgctgcaggatggactggaggaccaagccgaagatcgcctggtaccggtgctgcggctccacctgcctgagctgctggcaacactgctgccgcaacgactggcactgaggcgagcagtagggcgtcgccgtcgggctgcactgatgcctcaggaactcgacgcactggcccaggatcggggtgctgccaacgccgcaggttccctgcagctggcacgggcttggatgcggctgttggcacgggcatgggtgtggctggggatgaggctgaggccggggcggttgagtagggtagtggcatggtggcggc

SEQ ID NO: 34483 - DNA, 338 bp, Zea mays
  unsure at all n locations
  Clone ID: LIB3059-064-P1-N7-G2
ccccccccccccnnnccccccccccncccccccncncnccccccnccccccncccccccccccccnncnnnnccccccccccngncccccccncccccnnncccccnnnnccncccccccccccccncccccccccccccccccnccccccccccccccccccccccccccccccccccccccgcgncccccccccccccccccccccgncccccnccccccncncgccgccccccccccccnccccccnccgcccccccccccgnnccccccccccccccccccccnnnnccccccccnccccccccgncccccccggccccgnccccccccccccc

SEQ ID NO: 34484 - DNA, 530 bp, Zea mays
  Clone ID: LIB3059-064-P1-N7-G4
gcaagaaatcaatcctacatagaactggggccattcattcattcttttatttatttcattcattcatttcacccatgacaaatattatctcttcttatttcccacaacatttactggacattgtcatgatgttcagattagaagaatggcgcacgttggggaattcccttgcgtctgtgacgagcaaccctttttggtggtggttcttcgtagttcttgtcattgcagctgttttggtcatttgtagtacttgaaccaacattgtcaatcctagccacatgatccataccattggaccgagggttgttgccaaccatagcttgcataccagcttccatatttaagcctctaagattgcatccaagagagcagaagcgaaatgcatcaagtagcacacggctacatgtctcacagctatgtgttgatgatgtgggtgccttacaaatggggacactagaagcacgcagttgtggccgctcattcaggaatacaatccttgcactattgattacataagtttgcacatcgct

SEQ ID NO: 34485 - DNA, 585 bp, Zea mays
  Clone ID: LIB3059-064-P1-N7-G8
ctgccataatgtgctgcagcagttgatcggtagccaccactgtatccatagccaccaccactgctgttcccagaaaagccattgccaccactaccacggtatgaatcacgatgaccaccaccacgactgtgtcttccatttgagcttgaatcacccacaccaggtttttttggttcagctttcttaatttcaacctgtttccctccaagatcatgcattctcccctctgacataaccctttcaacagcatcctcgctttcaaatgtgacaaatccaaagccacgtgagcgtccagtgctatggtcaagcataatctgatgctcaaccaccttcccatacgatgagaagtgctcctttaatttatcttcggtaagagatggtggaataccacccacaaagatcttttttgtcttaggaccgtctttcgatgacatttcctcttttggaacagtccttttgacttcaactgttcttccatctatgacatgttcatcctctagaaccctgtcaagcacagatggatcggaaaatgtaacaaatccaaatccgcgaggcatcctagtatgcttgtccttcatgatcaca

SEQ ID NO: 34486 - DNA, 185 bp, Zea mays
  unsure at all n locations
  Clone ID: LIB3059-064-P1-N7-H1
gcacgcgtncgtaagcttggttcctctagcacggccgccctttgttttgttttttgggaacaatactttgtgctgtggatttcaattggtcattcaggtcattgggcacactgcccctgccacccatggggatgcgggtcccagttttcctcagtcgtcgccgctcagcgactcaactggctggc

SEQ ID NO: 34487 - DNA, 460 bp, Zea mays
  unsure at all n locations
  Clone ID: LIB3059-064-P1-N7-H10
gggtgtgtttttttttttagaaatgtactttcttatttctgggaagccacaaacatcancaaaaactttattattgaactataactcataagaaactaaaaggggcaccaccaatgatgggttgttggtagaatgctgctgggtttgggaaaggggggtggttgaatggcagcaattgttgcagttgtaagagggtgccagcgttaggcgcagcgtgctggtagaacggcaacaactgtggttgtgtcaagaaggtagcagggctcacaccagctagctggctgaatggtagtagttgttgctgctgtaaataagcaggagagttcaatgctgtcagttggttgaatggaagaaattgctgggggtaggcagcagatagctggctgaatggtngttgttgttgttgcccttagatgcggcgtgcactgcagctggttggttggctggtaggacctgctgt

SEQ ID NO: 34488 - DNA, 521 bp, Zea mays
  Clone ID: LIB3059-064-P1-N7-H3
gaacgctcaacgaagcagtttacataggcaaggaaactcaaaaccagtaaacaacaaagaacttgttcatatctacagacaaacaaacatagagaatggtcttgtaaatctggatactacatttttgcccccgagtgtacagaaaactgaggtgtctaggtgttacacttccacttggatgttggcacgcagttcaggtagtggcaccaatggcagccatcgttcccgttcttccctttgaaaagcatcaccagtgaaatcacaaacccaactaacagcaagacgagtgccacaacccacaaaatatactggtatgctttgtacttgggaggttggttagtgtgtggcaactcatgactttccatccagctaaattgaggccttgccaacagaacaaaacccaagaggaaacccgtcgcgaatccaccattgtgagcaaagttgtcaacgtggggtagtatcccaatagccaaattgtgtgccctaataaacaaccgtgttattatagctgctgccttgtt

SEQ ID NO: 34489 - DNA, 304 bp, Zea mays
  Clone ID: LIB3059-064-P1-N7-H4
gggccccaattttggggaaactgatcccttaattgggggggaaaaaaggggggggggcggaaagccctttttttccatttaacctgtgcaaaaaagggcctgtccatttttttcggggttgggggggtggcccttcccctttattcgggacaaaaatttttttttttttgctccaaacttccttaatggggtttggggggcccgtggttttccccggggtttttggtccgggctttgggggggttccattttttttatattgggggttttttgttgttttggggtgtcttggggtttgtgtttt

SEQ ID NO: 34490 - DNA, 147 bp, Zea mays
  Clone ID: LIB3059-064-P1-N7-H7
cccacgggggggcgcttcttcttccttcttcgctgtgatcctagcttggtagttttggtgctctctcgcatgctcttctcggccgcccttctcgttttgctgccgctgctgtccctccctccgggggggggggggggggggttcttt

SEQ ID NO: 34491 - DNA, 58 bp, Zea mays
  unsure at all n locations
  Clone ID: LIB3059-064-P1-N7-H8
gactatccacgtcgctgcacgcgtgcgtatgcttggntcctctanaccccgggggggg

SEQ ID NO: 34492 - DNA, 266 bp, Zea mays
  Clone ID: LIB3059-064-P1-N7-H9
acttccaagtataacaggaatcgttaattatatcacaagaacaaatccggatcccctttaattattgttccggatgaacgatccgagaaatgcattcatcttcttgctgtgcttattattcagacatatgagctagctacaagctcattcctcatgcactatgctcttcgcagttacttggagggcatcgttccgccgccgagaatccaggggcattcggcgacgccgctgatggtggccaggttgcactcggcctctgtgactag

SEQ ID NO: 34493 - DNA, 547 bp, Zea mays
  Clone ID: LIB3059-004-Q1-K1-G10-SP6A
aaaacaagcacaaaagcaattgaccagactgtaagatcaactatcctgtatgtctttttccagcatgtaccacaacaaagaaatgcctagggtagttaacatctacggccaaattgaaaagtattgtttggttgatcagctgagtcagtaataggaggccagcagctccaagattttattgcctgctctttttgtagctgcaatcagggcacttgtagggctttatctgttctgcttttgctggggttatcctcacacatttgccgtggaaccaccgctcacaaatgtcgcatccaatccagaactcacttgagttgtagagaccactgcaagaaccacaaagggtttcgctgtggtcttcatcattctcatacctacattcaccaactgccactcttgagttctttatctttccatcatttgatcgcttcgttgagtgcctggatttgctgctgttatcaacaccaggattattctcccttcccttccgggcagccattatttcatacacagatggatgatcattaatcatgttgaataatcgctt

SEQ ID NO: 34494 - DNA, 591 bp, Zea mays
  Clone ID: LIB3059-004-Q1-K1-G10-T7A
ggagtctgcaattctgacaacagtggtcgtgctcagccttaccgcatacactttctgggccgtgaataggggcaaagacttcagcttcctgggtcctttcctgttcgccgccatcatagtgctgcttgtgttcgcactcatccagatcctgttcccactgggcaagctctcccagatgatctacggcgggctggcgtcgctcatcttcagcgggtacatcgtctacgacacaaacaacatcatcaggcgctacacgtacgaccagtacgtctgggctgcagtctccctgtacctggacgttatcaacctcttcctgtccctgatgaccctcttcagggcagccgactagcccctctgctctcgtcctgtctatctacgagtcggtgcctgaatgctcccgtggttaagctccggtacccagaattccagttccaagaatagagttgtatataggtacctgcgttgcctttctactagtatggacttattcggcttggctcggttcgatcagagtcttgatacgtagttggatcgcgaacaaatgaacctgcatggaattatggagagccatctgctttatgatcctcattt

SEQ ID NO: 34495 - DNA, 563 bp, Zea mays
  Clone ID: LIB3059-030-Q1-K1-H12-SP6A
tgtttttggaaatgtaacttcttatttctggttggccacatacatcatccaaaaaactttattattgaattacaactaataatcaatctaaaagagggcaccaccaatgatgtgttgttggtaggaggctgctgggtttgtcaaagcaagttggacaaagggcaacaattgttgtagttgtaagagggttgcggggttagccgcaaactgcttgtagaaaggcagcaactgttgctgtgtcaagaaggaagcacgacttgctgcagctagctcgctaaatggcagtagtatttgctgctgcaaataagcagcggggttcagtgcggccaattggttaaatggaagaagttgttgttgctgagagtaggcagtagctagctggctaaatggtaatagttgttgctgcaaataagcagcagggttcagtgtagacagttggttgaatggaagaaattgttgttgctgagagtagggagaaaggtttgccagagctacttggttgatcacaggtagcacgagttgctgcagctgttgtgccctgatggtttgaccaatgactgccc

SEQ ID NO: 34496 - DNA, 432 bp, Zea mays
  Clone ID: LIB3059-030-Q1-K1-H12-T7A
tgactaccgagagattgcaagtgatgtgcagatggcagccagcgctggtactgtccatcttgcctctgccgtgtctgcctgtgcgacacggacgatgaccagatcatcctgtgtgactgctgcgatcagggctatcatctctactgcctcagtcctccaagaagaaaggtgcccaaggcgattgggactgcgaaccctgcaaggagcggagggagaaggagaagaggatactgatgctccacaggaaggattacgatgaagacatcctgaagagtggcgagttccatggaccgaacttgctgcttaaggccgcgaaaaaggtgaagcgcgatgaggaggtgaaggtggctaagactaagagcaccagaaagtaagaggcatggagattgtgagcgagcggattttgtgttctctgcccatgatcaagctagc

SEQ ID NO: 34497 - DNA, 63 bp, Zea mays
  Clone ID: LIB3059-037-Q1-K1-A3-SP6A
gacgtaagctcggaatctgtctcgaggcccgcggagtcttttttttaccacggtgacgcccat

SEQ ID NO: 34498 - DNA, 404 bp, Zea mays
  unsure at all n locations
  Clone ID: LIB3059-037-Q1-K1-A3-T7A
gaccgccgaattcgtcgcccacgcgccgccacgcgcgggcgggngtgctatgcgacgccgaggtcggctcatcatctttcaacgcgaagtctacgagttccagcccagagatgccaaaaacacttgaaaagtaccaaaaatgcagttttgcagggcctgaaacagcactccagaatagagagaatgagcaactgaaaagtagccgcaatgagtacctcaaactgaaggcacgtgttgataatttacagcggactcaaaggaacttgcttggagaagatcttgagtcattaggcataaaagagctggacacctggagaagcagctcgattcgtccttgaagcacataagatctacaaggacacaacacatggttgatcaactgacagaacttcagaaaaaagaac

SEQ ID NO: 34499 - DNA, 325 bp, Zea mays
  Clone ID: LIB3059-030-Q1-K1-H12-F3A
ggtggggccgtagaaacctgtgctttctgaactgaatggttagagaacatgaattcgctagaattgctccagtctatttctttacaatcgtttctttcaacccggcagggtcatacttgacaaacttgccagcgcctgaacttgagaaggttggatcacccgtgatgcttttaaaccccgtgatgcttttaatggtttatgaaactggatcttggtagacttaattacccgtgatgcttttaatggtttatggaactgaatcttggtagaattaaagtatctgttgctgtgttgagaaatgttatggtttctagttcgttcttgc

SEQ ID NO: 34500 - DNA, 331 bp, Zea mays
  Clone ID: LIB3059-030-Q1-K1-H12-R3A
tcggcttacctttttcgcggcctaagcagcaagttcggtccatggaactcgccactcttcaggatgtcttcatcgtaatccttcctgtggagcatcagtatcctcttctccttctccctccgctccttgcagggttcgcagtcccaatgccccttgggcacctttcttcttggaggactgaggcagtagagatgatagccctgatcgcagcagtcacacaggatgatctggtcatcgtccgtgtcgcacaggcagacacggcagaggcaagatggacagtaccagcgctggctgcccatctgcacatcacttgcaatctgctcggtagtca

SEQ ID NO: 34501 - DNA, 580 bp, Zea mays
  Clone ID: LIB3059-029-Q1-K1-B11.F2
gaacacaataattacttaatctaacattacccaaactgacattatgacaatgttagccgatgatgacgacaatggaaacagtaatctaggtacaagcaggcgcctctgctggctggcaagtgtgaccacacacaaacacaccagaccagaggcagaaccacccgccagtggcgccaacgaggagcgctatccgttatagcacgacaaaagtaaaaataaaacatcacgatgtggagtgaaactgaataattctagtacatggatataggctccttttttgtgatcgccacggggccttgtgtagccgctccattgttggatgaagcacggtccattgtctcgaggagctccatcactcgtcatcatcttcatcctcctcactaccctcttcatcatcctcgtcattgacctccgacttggacttgtcagactcctcttcatcttcctcctcttcctccttggcaggagccttcttagctgcagtgctctcgccctttgttgtaggcagcgatggcctttgttgtactcgagcttgagcttgttagccttggctacatagggagccttgtccgactcgctc

SEQ ID NO: 34502 - DNA, 400 bp, Zea mays
  Clone ID: LIB3059-042-Q1-K1-A7.F2
agacattgcaacctcagagaaacaaggcatttcttcttccattctaaatagcaaaggacaacttgcagcaggacacatacacatacaagcacattcgtcccatctgcagcctacgcatcaccgcatactggtaacaaggtactgctaaacatcagatcactccggacagtcagtctatgccttcttaggggacttggcggccttcttgggcgactttgcctccttgctcccgccactggacgccttctccgccgtcttcttgggcagcagaacagggttgatattggggagcacaccgccgtgagcgatggtcacgccgcccaacagcttcccaagctcctcgtcgttccggatcgccagaagcacgtggcgcggaataatgcgagtcttcttgttgtcc

SEQ ID NO: 34503 - DNA, 423 bp, Zea mays
  unsure at all n locations
  Clone ID: LIB3059-042-Q1-K1-A7.R2
ttcccgggtcgacccagcgtccgggnacacaanaagactcgcattattccgcgccacgtgcttctggcgatccggaacgacgaggagcttgggaagctgttgggcggcgtgaccatcgctcacggcggtgtgctccccaatatcaaccctgttctgctgcccaagaagacggcggagaaggcgtccagtggcgggagcaaggaggcaaagtcgcccaagaaggccgccaagtcccctaagaaggcatagactgactgtccggagtgatctgatgtttagcagtaccttgttaccagtatgcggtgatgcgtaggctgcagatgggacgaatgtgcttgtatgtgtatgtgtcctgctgcaagttgtcctttgctatttagaatggaagaagaaatgccttgtttctctgaggttgcaatgtct

SEQ ID NO: 34504 - DNA, 610 bp, Zea mays
  Clone ID: LIB3059-045-Q1-K1-B4.F2
tcgggaactgataaccgagaacttcattgccattgcatagtcatagttaaattacagcagggtagacccaactacatcatgatttgaccgataacccaaactacagaacccggcacatctctacaccttctagccagacagtgatgacagaaacggccactactacttccacctccaccgggacgacgcctaggccctctccccacggatacggcgggcgagctggatgtccttgggcatgatggtgacgcgcttggcgtgaatggcgcagaggttggtgtcctcgaagagcccgacgaggtaggcctcggacgcctcctgcagcgcggcgacggcggagctctggaagcggaggtcggtcttgaagtcctgggcgatctcacgcaccaggcgctggaacggcagcttgcggatcagcagctccgtgctcttctggtacttgcggatctcccggagcgcgacggtgccggggcggaaacggtggggcttcttcactccgccggtcgccggggcagacttgcgcgccgccttggtggccagctgcttccttggcgccttgccgccagtggacttcctcgccgtctgcttcgtgcgggccatcgggacagta

SEQ ID NO: 34505 - DNA, 649 bp, Zea mays
  Clone ID: LIB3059-045-Q1-K1-B4.R2
gtctcaatctccctagcaatctctagcagcagatcctcgtgcgaagcaaagcgctagcccccttcgtactgtcccgatggcccgcacgaagcagacggcgaggaagtccactggcggcaaggcgccaaggaagcagctggccaccaaggcggcgcgcaagtctgccccggcgaccggcggagtgaagaagccccaccgtttccgccccggcaccgtcgcgctccgggagatccgcaagtaccagaagagcacggagctgctgatccgcaagctgccgttccagcgcctggtgcgtgagatcgcccaggacttcaagaccgacctccgcttccagagctccgccgtcgccgcgctgcaggaggcgtccgaggcctacctcgtcgggctcttcgaggacaccaacctctgcgccattcacgccaagcgcgtcaccatcatgcccaaggacatccagctcgcccgccgtatccgtggggagagggcctaggcgtcgtcccggtggaggtggaagtagtagtggccgtttctgtcatcactgtctggctagaaggtgtagagatgtgccgggttctgtagtttgggttatcggtcaaatcatgatgtagttgggtctaccctgctgtaatttaactatgactatgcaatggca

SEQ ID NO: 34506 - DNA, 620 bp, Zea mays
  Clone ID: LIB3059-049-Q1-K1-E4.F2
aagaaaacggcatttcctattccattaggaatgacataaagcaacttgagcgaagcagatacacagccaatcacattgcccgcttacaacctacacatgacaacatcggatccgcctccaaaccctatgccttcttgggggacttggcggccttcttgggcgacttggcctccttgctcccgccgctggacgccttctccgccgtcttcttgggcagcaggaccgggttgatgttgggcaacacgccgccgtgggcgatggtcacgccggtcagcagcttcccgagctcctcgtcgttgcggatcgccagcagcacgtggcgcgggacgatgcgcgtcttcttgttgtccttggcagcgttgccggcgagctccaggacctcagcggcgaggtactccaggacggccgcgaggtagacgggggcaccgctgccgacgcgctgcgcgtagcggcccttcttgaggtagcgcccgatgcggccgacggggaactggagcccggccttcacggacctcgtcaccgacttcttcctcggcccgccggccttgcgaccgggcgctcccttctttgccttccctccagctccagtgccggtgggcgtccatggccgcaactgcgct

SEQ ID NO: 34507 - DNA, 658 bp, Zea mays
  unsure at all n locations
  Clone ID: LIB3059-049-Q1-K1-E4.R2
tcccgggtcgacccagcgtccgcctcctcagnacccganagcgcagctgcggccatggacgccaccggcactggagctggagggaaggcgaagaagggagcggccggtcgcaaggccggcgggccgaggaagaagtcggtgacgaggtccgtgaaggccgggctccagttccccgtcggccgcatcgggcgctacctcaagaagggccgctacgcgcagcgcgtcggcagcggtgcccccgtctacctcgcggccgtcctggagtacctcgccgctgaggtcctggagctcgccggcaacgctgccaaggacaacaagaagacgcgcatcgtcccgcgccacgtgctgctggcgatccgcaacgacgaggagctcgggaagctgctgaccggcgtgaccatcgcccacggcggcgtgttgcccaacatcaacccggtcctgctgcccaagaagacggcggagaaggcgtccagcggcgggagcaaggaggccaagtcgcccaagaaggccgccaagtcccccaagaaggcatagggtttggaggcggatccgatgttgtcatgtgtaggttgtaagcgggcaatgtgattggctgtgtatctgcttcgctcaagttgctttatgtcattcctaatggaatggaaatgccgtgtttctt

SEQ ID NO: 34508 - DNA, 489 bp, Zea mays
  Clone ID: LIB3059-054-Q1-K1-B5.F2
acacgcactggaacacaattcttgacattaacgaacaaatcggccacagcattgcgcgcaaggtccagcagcgcacataacactgctagtccagacggggggggcatagttaacttaagtattcgaccctagcaataacaccagcaaaggtagcagcaacagtagcagaagaaaaacttgcgatccacaaaacaaaccctactcatatgtccttacaatggcaccagattaacaataaccccaggacttcatgtttttgtcacgatgtttgagggggcgattaggccctctcgccggggatcctccttgccagctgaatgtcctttggcatgatggtcacacgcttagcatggatggcgcacaggttggtgtcctcaaacaggccaacaaggtatgcctcagcagcctcctggagggcaagcaccgcatggctctggaaacgcaaatcagttttgaagtcccccacgcgtccgcccacgcgtccgccca

SEQ ID NO: 34509 - DNA, 523 bp, Zea mays
  unsure at all n locations
  Clone ID: LIB3059-054-Q1-K1-B5.R2
cggccgcgtgggcggncgcgtgggcggacgcgtgggggacttcaaaactgatttgcgtttccagagccatgcggtgcttgccctccaggaggctgctgaggcataccttgttggcctgtttgaggacaccaacctgtgcgccatccatgctaagcgtgtgaccatcatgccaaaggacattcagctggcaaggaggatccgcggcgagagggcctaatcgccacctcaaacatcgtgacaaaaacatgaagtcctggggttattgttaatctggtgccattgtaaggacatatgagtagggtttgttttgtggatcgcaagtttctcttctgctactgttgctgctacctttgctggtgttattgctagggtcgaatacttaagttaactatgcgctgacagtctggactagcagtgttatgtgcgctgctggaccttgcgcgcaatgctgtggccgatttgttcgttaatgtcaagaattgtgttacaggtgcgtgtnnnnanaaanaannnnnnnaannaa

SEQ ID NO: 34510 - DNA, 485 bp, Zea mays
  Clone ID: LIB3060-053-B9-F2A
acgagtctacgaatgcaccttgcgggacgcgtacggaatcgacttttaagaaccggactgctgattgacgcttgtcacaggtaccgcataaaaacatgcctcacgcttcatggccgtgctgaccactaggcaccatgagcaccatgccatacgccggatgaggcacaaccgatgacttcgacgacgacacactgaggttgacggagtgatcagagtacaaaagctggtggcctgcaaaggcgagctatgatgggccgctctacaggacgcaaatagtcttgacgccatccatggaaagcgcgatgtacacgtcaagagacgaagcgaagtacaagaagaacacgtgcgtcaagaaacatactttctgacattggtcggcattggcgaggagccactaagactgatataactaactattgcaactgatggatgaagataaaaacaaaggccgcgaggcgaatagctagctcgcgtaccccagaatt

SEQ ID NO: 34511 - DNA, 252 bp, Zea mays
  Clone ID: LIB3060-053-B9-F1A
gtctcctgcgtacgccttgcgggacgcgtaccggatcgtcttctcgaacccgctgctcttgcgcttcccccggtaccgctcaccgcgcctccgctcaggcctctgccactgcaccatggggccatgcagacgcgcgtcggaaaccgtgctcgacgatgaccactgggttcacggagtgatcggagtagaagagcttggtgcccgcaaagtcgagctctggtggcccgctcttcttgacgccgattggtcttg

SEQ ID NO: 34512 - DNA, 59 bp, Zea mays
  Clone ID: LIB3060-053-B9-R1A
ggaattgccgagcgagcgagcttgcgccgtgcgcgatggagggtgacgagaagtcggcg

SEQ ID NO: 34513 - DNA, 176 bp, Zea mays
  Clone ID: LIB3060-053-B9-R2A
ccacgcgttcagtaattgccgagcgagcgagcttgcgccgtgcgcgatggagggtgacgagaagtcggcgggcggggcccctgcttactgggggctgggcgcacagtcctgccatccgttcggtaccaacgcgggacggcttttctgccactcggactcctgatttgtgaaccccc

SEQ ID NO: 34514 - DNA, 446 bp, Zea mays
  unsure at all n locations
  Clone ID: LIB3060-026-Q1-K1-G5
caaagctggcaattgttcttgtgtgtggcggttggtctctgggctggcctagtcattggtttggttactgagtactacacaagcaatgcctacagccctgtacaagatgttgctgattcctgcagaactggagcagctactaatgtcatttttgggcttgctttgggttacaaatcagtcattatcccaatttttgctattgcgtttagtatcttcctcagcttcagccttgctgccatgtatggtgttgctgtggctgctcttggaatgctgagcaccattgccacaggtcttgctattgatgcatatggccctatcagtgataatgctggaggaatagctgaaatggctgggatgagccatangattcgtgagagaactgatgctctagatgctgcaggaaataccacggctgcaattggngagggttttgccattggctctgc

SEQ ID NO: 34515 - DNA, 430 bp, Zea mays
  Clone ID: LIB3060-010-Q1-K1-G9
ggctctgcagccttggtttcccttgcactatttggtgcgtttgtaagccgggctgctatctccactgttgatgttctgactcctaaagtattcatcgggcttattgtcggtgctatgctcccgtactggttctcggcaatgaccatgaagagtgtgggcagtgctgcgctcaagatggtggaggaagttcgtcggcagttcaacaacatccctgggctcatggaaggcaccacaaagcctgactacgcaacttgtgtcaagatctcaacggatgcatccatcaaggagatgatccccccaagtgctcttgttatgctcacaccactgatcgttgggattctatttggggttgagaccctctctggagtccttgctggtgcccttgtctctggtgttcagattgccatttctgcatccaacactggtggtg

SEQ ID NO: 34516 - DNA, 425 bp, Zea mays
  Clone ID: LIB3060-015-Q1-K1-G3
ggatgagccataggattcgtgagagaactgatgctctagatgctgcaggaaataccacggctgcaattgggaagggttttgccattggctctgcagccttggtttcccttgcactatttggtgcgtttgtaagccgggctgctatctccactgttgatgttctgactcctaaagtattcatcgggcttattgtcggtgctatgctcccgtactggttctcggcaatgaccatgaagagtgtgggcagtgctgcgctcaagatggtggaggaagttcgtcggcagttcaacaacatccctgggctcatggaaggcaccacacagcctgactacgcaacttgtgtcaagatctcaacggatgcatccatcaaggagatgatcccccccagtgctcttgttatgctcacaccactgatcgttgggatt

SEQ ID NO: 34517 - DNA, 283 bp, Zea mays
  Clone ID: LIB3060-038-Q1-K1-B1
ggctctgcagccttggtttcccttgcactatttggtgcgtttgtaagccgggctagtatctccactgttgatgttctgactcctaaagtattcatcgggcttattgtcggtgctatgctcccgtactggttctcggcaatgaccatgaagagtgtgggcagtgctgcgctcaagatggtggaggaagttcgtcggcagttcaacaacatccctgggctcatggaaggcaccacaaagcctgactacgcaacttgtgtcaagatctcaacggatgcatccatca

SEQ ID NO: 34518 - DNA, 430 bp, Zea mays
  Clone ID: LIB3060-032-Q1-K1-D3
gccgcgttggtggtggtatttataccaaggctgctgatgttggtgctgaccttgtggggaaggtagaaagaaacattcctgaggacgatccaagatacccagctgttattgctgacaatgttggtgataatgcttgagatattgctggaatgggatcagatctctttggctcatatgctgaatcatcatgtgctgctcttgttgtggcctctatctcgtcttttggaatcaaccatgaatttactccgatggtgtaccctcttctcgtcagttctgttggtattatagcatgtctcataacaacgctgtttgcaactgatttcttcgagataaaggctgtggatgaaatagagcctgctctcaagaaacagctcataatttccacaattgtgatgaccattggcattgcactaatcagttggcttggtct

SEQ ID NO: 34519 - DNA, 405 bp, Zea mays
  Clone ID: LIB3060-029-Q1-K1-E10
gagaattcttaattcatgagttgtaaggagggtcttatggcaccacaaaccggaactggaaccaggggtggatttaaagctggtggtaaaggttataaattggcttactacaccccggagtacgaaaccaaggatactgatatcttggcagcattccgagtaactcctcagctcggggttccgcctgaagaagcaggagctgcagtagctgcggaatcttctactggtacatggacaactgtttggactgatggacttaccagtcttgatcgttacaaaggacgatgctatcacatcgagcccgttcctggggacccagatcaatatatctgttatgtagcttatccattagacctatttgaagagggttctgttactaacatgtttacttccattgtgggtaac

SEQ ID NO: 34520 - DNA, 403 bp, Zea mays
  Clone ID: LIB3060-026-Q1-K1-C3
caaatgcacggtttaataacgaaccgtgttaacttaccataacaacaactcaattcctatcgagttccgtcctatcgaattcctatagtaaaattcctataggatagaacgtacacagggtgtacacattatatatgaatgaaacatattcattaacttaagcatactcctttttttatttaatgagttgatattaattaaatatcttttttttttagatttttgcaaaggtttcatttacgcctaatccatatcgagtagaccctgtcgttgtgagaattcttaattcatgagttgtaaggagggacttatgtcaccacaaacagaaactaaagcaagtgttggatttaaagctggtggtaaagattataaattggcttactacaccccggaatacgaaacc

SEQ ID NO: 34521 - DNA, 438 bp, Zea mays
  Clone ID: LIB3060-020-Q1-K1-A10
caaatccacggtttaataacgaaccgtgttaacttaccataacaacaactcaattcctatcgaggtccttgctatcgaattcctatagtaaaattcctataggatagaacgtacacagggtgtacacattatatatgaatgaaacatattcattaacttaagcatactcctttttttatttaatgagttgatattaattaaatatctttttttttagatttttgcaaaggtttcatttacgcctaatccatatcgagtagaccctgtcgttgtgagaattcttaattcatgagttgtacggagggacttatgtcaccacaaacagaaactaaagcaagtgtgggattaaaggctggggttaaggatattaaattgacttactacacccgggagtacgaaaccaaggatactgatatcttggcagcattccgagtaact

SEQ ID NO: 34522 - DNA, 406 bp, Zea mays
  Clone ID: LIB3060-009-Q1-K1-F8
gagggacttatgtcaccacaaacagaaactaaagcaagtgttggatttaaagctggtgttaaggattataaattgacttactacaccccggagtacgaaaccaaggatactgatatcttggcagcattccgagtaactcctcagctctgggttccgcctgaagaagcaagagctgcagtagctgcggaatcttctactggtacatggacaactgtttggactgatggacttaccagtcttgatcgttacaaaggacgatgctatcacatcgagcccgttcctgggtacccagatcaatatatgtgttatgtagcttatccattatacctatttgaagagggttctgttactaacatgtttactttcattgtgggtaacgtatttggtttcaaagccttacgcgctc

SEQ ID NO: 34523 - DNA, 407 bp, Zea mays
  Clone ID: LIB3060-020-Q1-K1-H7
ctcagctcggggttccgcctgaagaagcaggagctgcagtagctgcggaatcttctactggtacatggacaactgtttggactgatggacttaccagtcttgatcgttacaaaggacgatgctatcacatcgagcccgttcctggggacccagatcaatatatctgttatgtagcttatccattagacctatttgaagagggttctgttactaacatgtttacttccattgtgggtaacgtatttggtttcaaagccttacgcgctctacgtttggaggatctacgaattccccctgcttattcaaaaactttccaaggtccgcctcacggtatccaagttgaaagggataagttgaacaagtacggtcggtctttattgggatgtactatttaaaccaaattggga

SEQ ID NO: 34524 - DNA, 431 bp, Zea mays
  unsure at all n locations
  Clone ID: LIB3060-052-Q1-K1-B5
gtaactcctcagctcggggtttcgcctgaagaagcaggagctgcagtagctgcggaatcttctactggtacatggacaactgtttggactgatggacttaccagtcttgatcgttacaaaggacgatgctatcacatcgagcccgttcctggggacccagatcaatatatctgttatgtagcttatccattagacctatttgaagagggttctgatactaacatgtttacttccattgtgggtaacgtatttggtttcaaagccttacgcgctctacgtttggaggatctacgaattcccgctgcttattcaaaaactttccaaggtccgnctcacggtatccaagttgaaagggataagttgaacaagtacggtcgtcctttattgggatgtactattaaaccaaaattgggattatccgcaaaaaatta

SEQ ID NO: 34525 - DNA, 183 bp, Zea mays
  Clone ID: LIB3060-004-Q1-K1-D4
cgttcctggggacccatatcaatatatctgttatgtagcttatccattagacctatttgaagagggttctattactaacatatttactttcattgtgggtaacgtatttagttgcaaagccttacacgctctacttttggaggatctacgaattccccctggtgattcaaaaacttttcaagg

SEQ ID NO: 34526 - DNA, 163 bp, Zea mays
  Clone ID: LIB3060-005-Q1-K1-A3
ggtacatggacaactgtttggactgatggacttaccagtcttgatcgttacaaaggacgatgctatcacatcgagcccgttcctggggacccagatcaatatatctgttatgtagcttatccattagacctatttgaaaaaggtttctggtactaacatgttt

SEQ ID NO: 34527 - DNA, 230 bp, Zea mays
  Clone ID: LIB3060-004-Q1-K1-E12
gtcaaggtcatctcctggtactacaactagtggggctactcgcagagggtcgtcgacctcgctgacatctgcgccaaccagtggaagtgaagcgttgcattgtaatagcactttgtaactcctcacccttcacagggctttgggattcaccccgaaatgactcactttcggtgaaattcacccgttatcggcgagggcgttttatttttcttgtcaaatgatttcattgg

SEQ ID NO: 34528 - DNA, 386 bp, Zea mays
  Clone ID: LIB3060-011-Q1-K1-A10
ggttgaggtggcttcttacacacaatgttatatttttcccgggactgataataacggggctctggtggcttataaaattgcatctcttgctgacctttatgtcaatgatgcttttggcacggcacacaaagctcatgcttcaacccaaggagttaccaagtatttgaagcctgctgttgccggcttcctcatgcataatgaacttgactaccttgttggaactgttgccaacccaaagaagccatttgccgctattgttggtggatccaaggtctcaagtaagattggtgtcattgaatccttgctggcgaaagtcgatatccttatccttggtggtggtatgatctacacattttacaaagcacaaggatattctgttggaaaat

SEQ ID NO: 34529 - DNA, 429 bp, Zea mays
  unsure at all n locations
  Clone ID: LIB3060-012-Q1-K1-H11
gttctgctcctagagaatgttagattctacaaggaggaagagaagaacgaacctgaggttgctaagaagctagcatctgttgctgacctttatgtcaatgatgcttttggcacggcacacagagctcatgcttcaaccgaaggagttaccaagtatttgaagcctgctgttgccggcttcctcatgcagaaggaacttgactaccttgttggagctgttgccaacccaaagaagccatttgccgctattgttggtggatccaaggtctcaagtaagattggtgtcattgagtccttgctggcgaaggtcgatatcctcatccttggtggtggtatgatctacacattttacaaggcacaaggatattctgttggaaaatctctcgtggaagaggataaactngagctcgcaacttctcttattgagaac

SEQ ID NO: 34530 - DNA, 434 bp, Zea mays
  Clone ID: LIB3060-017-Q1-K1-G5
caaggatattctgttggaaaatctctcgtggaagaggataaacttgagctcgcaacttctcttattgagaaggcgaaggcaaagggggtttctcttttgcttcccactgatattgtagtagcggacaagtttgcagctgatgctgagagcaagattgtccctgccactgctatccctgatgactggatgggtcttgatgttggccctgatgccaccaaaacattcaacgaagcattggacaccaccaagactgttatttggaacggccccatgggagtgtttgagttcgagaagtttgcagctggcactgaggcgattgccaagaagctagctgagcttacaaccacgaagggtgtcactaccatcatcggcggcggcgactctgttgctgctgtcgagaaggctgggctggccgacaagatgagccacatttc

SEQ ID NO: 34531 - DNA, 395 bp, Zea mays
  Clone ID: LIB3060-053-Q1-K1-H6
agctcccatatccgctcccctacctctccagcatcctcccgtctccgtcgtctcgtctccgctcctcacctcgccagccatgggcaagatcaagatcggaatcaacggtttcggaaggatcggcaggctcgtggccagggtcgccctgcagagcgaggatgtcgagctcgtcgccgtcaacgaccccttcatcaccacggattacatgacgtacatgttcaagtacgacaccgtgcacggccaatggaagcacagcgacatcgccctcaaggactccaagacgcttctcttcggcgagaagccggtcaccgtctttggcatcaggaaccccgaggagatcccgtggggtgaggctggtgctgagtatgtcgtggagtccaccggtgtcttcactg

SEQ ID NO: 34532 - DNA, 384 bp, Zea mays
  Clone ID: LIB3060-014-Q1-K1-D9
agctcgatctactactactactagctgttacacatactagccatcctgccaggcagcgtgccatggcgcccaccgtgatgatggcctcgtcggcaaccgccgtcgccccgttccagtgtctcaagtccgccgccagcctccccgtcgtccgccgcagcaccaggagcctcggcaacgtcagcaacggcggaaggatccggtgcatgcaggtgtggccggcctacggcaacaagaagttcgagacgctgtcgtacctgccgccgctgtcgacggacgacctgctgaagcatgtggactacctgctgcccaacggctggataccctgcctcgagtcagcatgctcgggttcgtgtaccgcgagaactccacctacccgtgctacta

SEQ ID NO: 34533 - DNA, 250 bp, Zea mays
  Clone ID: LIB3060-023-Q1-K1-H3
gcaagctcgatctactactactactagctggtacacatactagccagcctgccagccagcttgcgatggcgcccaccgtgatgatggcctcgtcggcaaccgccgtcgccccgttccagggtctcaagtccgccgccagcctccccgtcgcccgccgcagcaccaggagcctcggcaacgtcagcaacggcggaaggatccggtgcatgcaggtgtggccgggctacggcaaccagaagttcgagacgct

SEQ ID NO: 34534 - DNA, 316 bp, Zea mays
  unsure at all n locations
  Clone ID: LIB3060-034-Q1-K1-B7
ctactagctggtacacatactagccagtctgccagccagcttgccatggcgcccaccgtgatgatggcctcgtcggcaaccgccgtcgccccgttccagggtctcaagtccgccgccagcctccccgtcgcccgccgcagcaccaggagcctcggcaacgtcagcaacggcggaaggatccggtgcatgcaagtgtggccggcctacggcaacaagaagttcgagacgctgtcgtacctgccgncgctgtcgacggacgacctgctgaaacaggtggactacctgctgcgcaacggctggataccctgcctcgagt

SEQ ID NO: 34535 - DNA, 368 bp, Zea mays
  unsure at all n locations
  Clone ID: LIB3060-028-Q1-K1-D3
caagcaagcagcgagtacatacatactaggcagccaggcagccatggcgcccaccgtgatgagtggcctggtcggccaccgccgtcgcttccgttccaggggctcaagtccaccgccagcctccccatcgcccgccgctcctccagaagcctcggcaacgtcagcaacggcggaaggatccggtgcatgcaggtgtggccggcctactgcaacaagaagttcgagacgctgtcgtacctgccgncgctgtcgacggacgacctgctgaagcangtggactacctgctgcgcaacggctggataccctgcctcgagttcagcaaggtcggcttcgtgtaccgcgagaaccttcactccccgtgctacta

SEQ ID NO: 34536 - DNA, 425 bp, Zea mays
  Clone ID: LIB3060-003-Q1-K1-D9
ctctggtccgtggccatggcgtcgtccatgctctccgctaccaccgtgccactccagcaggggggcggcctgtccgagttctccgggctcaggagctccgcgtcgctgcccatgcgccggaatgccacctccgacgacttcatgtccgccgtctccttcaggacccacgcggtcggcacgagcggcgggtcgcggcgggcgccgacggaggcgaagctgaaggtggccatcaacgggttcggccgcatcgggcgcaacttcctgcggtgctggcacgggcgcggcgacgcctcgcccctcgacgtcatcgccatcaacgacaccggcggtgtcaagcaggcgtcccacctgctcaagtacgactccacgctcggcatcttcgacgccgacgtcaagcccgtcggcgacaacgccatcttcgtcga

SEQ ID NO: 34537 - DNA, 408 bp, Zea mays
  Clone ID: LIB3060-041-Q1-K1-F6
gtggccatggcgtcgtccatgctctccgctaccaccgtgccactccagcaggggggcggcctgtccgagttctccgggctcaggagctccgcgtcgctgcccatgcgccggaatgccacctccgacgacttcatgtccgccgtctccttcaggacccacgcggtcggcacgagcggcgggtcgcggcgggcgccgacggaggcgaagctgaaggtggccatcaacgggttcggccgcatcgggcgcaacttcctgcggtgctggcacgggcgcggcgacgcctcgcccctcgacgtcatcgccatcaacgacaccggcggtgtcaagcaggcgtcccacctgctcaagtacgactccacgctcggcatcttcgacgccgacgtcaagcccgtcggcgacaacgccatc

SEQ ID NO: 34538 - DNA, 401 bp, Zea mays
  Clone ID: LIB3060-047-Q1-K1-C9
tggcgtcgtccatgctctccgctaccaccgtgccactccagcaggggggcggcctgtgcgagttctccgggctcaggagctccgcgtcgctgcccatgcgccggaatgccaccttcgacgacttcatgtccgccgtctccttcaggacccacgcggtcggcacgagcggcgggccgcggcgggcgccgacggaggcgaagctgaaggtggccatcaatgggttcggccgcatcgggcgcaacttcctgcggtgctggcacgggcgcggcgacgcctcgcccctcgacgtcatcgccatcaacgacaccggaggcgtcaagcaggcgtcccacctgctcaagtacgactccacgctcggcatcttcgatgccgacgtcaagcccgtcggcgacaacgccatc

SEQ ID NO: 34539 - DNA, 394 bp, Zea mays
  Clone ID: LIB3060-029-Q1-K1-B7
gcgtcgtccatgctctccgctaccaccgtgccactccagcaggggggcggcctgtccgagttctccgggctcaggagctccgcgtcgctgcccatgcgccggaatgccacctccgacgacttcatgtccgccgtctccttcaggacccacgcggtcggcacgagcggcgggtcgcggcgggcgccgacggaggcgaagctgaaggtggccatcaacgggttcggccgcatcgggcgcaacttcctgcggtgctggcacgggcgcggcgacgcctcgcccctcgacgtcatcgccatcaacgacaccggcggtgtcaagcaggcgttccacctgctcaagtacgactccacgctcggcatcttcgacgccgacgtcaagcccgtcggcgacaacg

SEQ ID NO: 34540 - DNA, 374 bp, Zea mays
  unsure at all n locations
  Clone ID: LIB3060-042-Q1-K1-A10
ctctggtccgtggccatggcgtcgtccatgctctccgctaccaccgtgccactccagcaggggggcggcctgtcgcgagttctccgggctcaggagctccgcgtcgctgcccatgcgccggaatgccacctccgacgacttcatgtccgccgtctccttcaggacccacgcggtcggcacgagcggcgggtcgcggcgggcgccgacggaggcgaagctgaaggtggccatcaacgggttcggccgcatcgggcgcaacttcctgcggtgctggcacgggcgcggcgacgcctcgcccctcgacgtcatcgccatcaacgacaccggcggtgtcaagcaggcgtcccacctgctcaagtacgactncacgctcg

SEQ ID NO: 34541 - DNA, 416 bp, Zea mays
  Clone ID: LIB3060-018-Q1-K1-F11
gctcttcgctaccaccgtgccactccatcaaggtggcggcctgtacgagttctccgggctcaggagctccgcgtcgctgcccatgcgccggaatgccacctccgacgacttcatgtccgccgtctccttcaggacccacgctgtcggcacgagcggcgggccgcggcgggcgccgacggaggcgaagctgaaggtggccatcaatgggttcggccgcatcgggcgcaacttcctgcggtgctggcacgggcgcggcgacgcctcgcccctcgacgtcatcgacatcaacgacaccggaggcgtcaagcaggcgtaccacctgctcaagtacgactgcacgctcggcatcttcgatgccgacgtcaagcccgtcggcgacaacgccatctgcgtcgacggcaaggtcatcaaggtcg

SEQ ID NO: 34542 - DNA, 375 bp, Zea mays
  Clone ID: LIB3060-022-Q1-K1-E7
gctgcctccgcctctcgagtctcgtccacccgtcgtcctcctagctcctctactcgccagtcggcatgggcaagattaagatcggaatcaacggcttcggaaggatcggcaggctcgtggccagggtcgccctccagagcgaggatgtcgagctcgtcgccgtcaacgaccccttcatcaccacggactacatgacctacatgttcaagtacgacaccgtccacggccactggaagcacagcgacatcacactcaaggacctccaaaaccttcttttccgtgaccagcccgtcaacggctttggcatcaagaaccctgaagaaatcccgtggggtgaggcttgcccttaatatgtcctggagtccaacggcgttt

SEQ ID NO: 34543 - DNA, 408 bp, Zea mays
  Clone ID: LIB3060-043-Q1-K1-C11
gtccgtggccatggcgtcgtccatgctctccgctaccaccgtgccactccagcaggggggcggcctgtccgagttctccgggctcaggagctccgcgtcgctgcccatgcgccggaatgccacctccgacgacttcatgtccgccgtctccttcaggacccacgcggtcggcacgagcggcgggtcgcggcgggcgccgacggaggcgaagctgaaggtggccatcaacgggttcggccgcatcgggcgcaacttcctgcggtgctggcacgggcgcggcgacgcctcgcccctcgacgtcatcgccatcaacgacaccggcggtgtcaagcaggcgtcccacctgctcaagtacgactccacgctcggcatcttcgacgccgacgtcaagcccgtcggcgacaacgc

SEQ ID NO: 34544 - DNA, 374 bp, Zea mays
  Clone ID: LIB3060-020-Q1-K1-A12
ctccagcatctcccgtctccgtcgtctcgtctctgctcctcacctcgccgccagccatgggcaagatcaagatcggaatcaacggtttcggaaggatcggcaggctcgtggccagggtcgccctgcagagcgaggatgtcgagctcgtcgccgtcaacgaccccttcatcaccacggattacatgacctacatgttcaagtacgacaccgtgcacggccaatggaagcacagcgacatcaccctcaaggactccaagacgcttctcttcggcgagaagccggtcaccgtctttggcatcaggaaccccgaggagatccccgtgggtgaggctggtgctgagtatgtcgtggagtccaccggtgtcttcactgac

SEQ ID NO: 34545 - DNA, 407 bp, Zea mays
  Clone ID: LIB3060-046-Q1-K1-C4
cagctcccatatccggtccccttaccttctcagcatctcccgtctccgtcgtctcgtcgctgctcctcagctcgccgccagccatgggcaagatcaagatcggaatcaacggtttcggaaggatcggcaggctcgtggccagggtcgccctgcagagcgaggatgtcgagctcgtcgccgtcaacgaccccttcatcaccacggattacatgacctacatgttcaagtacgacaccgtgcacggccaatggaagcacagcgacatcaccctcaaggactccaagacgcttctcttcggcgagaagccggtcaccgtctttggcatcaggaaccccgaggagatcccgtggggtgaggctggtgctgagtatgtcgtggagtccaccggtgtcttcactgacaaggac

SEQ ID NO: 34546 - DNA, 445 bp, Zea mays
  Clone ID: LIB3060-012-Q1-K1-E9
gctgcctccgcctctcgagtctcgtccacccgtcgtcctcctagctcctctactcgggagtcgccatgggcaagattaagatcggaatcaacggcttcggaaggatcggcaggctcgtggccagggtcgccctccagagcgaggatgtcgagctcgtcgccgtcaacgaccccttcatcaccacggactacatgacctacatgttcaagtacgacaccgtccacggccactggaagcacagcgacatcacactcaaggactccaagacccttctcttcggtgacaagccggtcaccgtctttggcatcaggaacccctgaggaaaatcccgtggggtgaggctggcgctgagtatgtcgtggagtccaccggcgtcttcactgacaaggacaaggctgctgcacatctcaagggtggtgccaagaaggtgttatctctgccccaa

SEQ ID NO: 34547 - DNA, 417 bp, Zea mays
  Clone ID: LIB3060-001-Q1-K2-C11
agctcccatatccgctcccctacctctccagcatcctcccgtctccgtcgtctcgtctccgctcctgacctcgccagccatgggcaagatcaagatcggaatcaacggtttcggaaggatcggcaggctcgtggccagggtcgccctgcagagcgaggatgtcgagctcgtcgccgtcaacgaccccttcatcaccacggattacatgacgtacatgttcaagtacgacaccgtgcacggccaatggaagcacagcgacatcgccctcaaggactccaagacgcttctcttcggcgagaagccggtcaccgtctttggcatcaggaaccccgaagagatcccgtggggtgaggctggtgctgagtatgtcgtggagtccaaccgtgtcttcactgacaaggaccaggctgctgcaca

SEQ ID NO: 34548 - DNA, 410 bp, Zea mays
  Clone ID: LIB3060-036-Q1-K1-B9
cgccgacttctccgggctcaggccggggtcgtgctccgtgagcgctgccgcgcgggaggcgtccttctccgacgtccttggcgcgcagctcgtcgccaaggccaccggggagaacgccgtgagggcgcccgcagaggcgaagctgaaggtggcgatcaacggcttcggccgcatcggccggaacttcctccggtgctggcacggccgcgaggactcgccgatcgacgtcgtcgtcgtgaacgacagcggaggcgtcaggaacgcgtcccacctcctcaagtacgactcgatgctcggcaccttcaaggccgacgtcaagatcgtggacgacactaccatcagcgtcgacggcaagcccatcacggtcgtctccagcagggacccgctcaagctcccatggggtgagctcg

SEQ ID NO: 34549 - DNA, 400 bp, Zea mays
  Clone ID: LIB3060-035-Q1-K1-F2
atccgatcccacccggcagcggcgctgcgcaatggccacccacgcagctctcgccgcgtcccgcatccccgccggcgcccggctgcacagcagggcgccggcgtcgtccaggcacggcgtgcagaggctggacttcgccgacttctccgggctcaggccggggtcgtgctccgtgagcgctgccgcgcgggaggcgtccttctccgacgtccttggcgcgcagctcgtcgccaaggccaccggggagaacgccgtgagggcgcccgcagaggcgaagctgaaggtggcgatcaacggcttcggccgcatcggccggaacttcctccggtgctggcacggccgcgaggactcggcgatcgacgtcgtcgtcgtgaacgacagcggaggcgtcaggaacgcg

SEQ ID NO: 34550 - DNA, 390 bp, Zea mays
  unsure at all n locations
  Clone ID: LIB3060-023-Q1-K1-D9
ccgatgccacccggcagcactcggcagcggcgccgcgcaatggccacccacgcagctctcgccgcctcccgcatccccgccggcgcccggctgcacagcagggcggcggcgtcgtccaggcacggcgtgcagaggctggacttcgccgacttctccgggctcaggccggggtcgtgctccgtgagcgctgccgcgcgggaggcgtccttctccgacgtccttggcgcgcagctcgtcgccaaggccaccggggagaacgccgtgagggcgcccgccgaggcgaagctgaaggtggcgatcaacggcttcggccgcatcggccggaacttcctncggtgctggcacggccgcnaggactcgccgatcgacgtcgtcgtcgtgaacgacagc

SEQ ID NO: 34551 - DNA, 386 bp, Zea mays
  Clone ID: LIB3060-021-Q1-K1-F4
gtccgtggccatggcgtcgtccatgctctccgctaccaccgtgccactccagcaggggggcgggctgtccgagttctccgggctcaggagctccgcgtcgctgcccatgcgccggaatgccacctccgacgacttcatgtccgccgtctccttcaggacccacgcggtcggcacgagcggcgggccgcggcgggcgccgacggaggcgaagctgaaggtggccatcaatgggttcggccgcatcgggcgcaacttcctgcggtgctggcacgggcgcggcgacgcctcgcccctcgacgtcatcgccatcaacgacaccggaggcgtcaagccaggcgtccacctgctcaaggacgactccacgctcggcatcttcgatgccgacg

SEQ ID NO: 34552 - DNA, 319 bp, Zea mays
  Clone ID: LIB3060-025-Q1-K1-B12
ctctggtccgtggccatggcgtcgtccatgctctccgctaccaccgtgccgctccagcaggggggcggcctgtccgagttctccgggctcaggagctccgcgtcgctgcccatgcgccggaatgccacctccgacgacttcatgtccgccgtctccttcaggacccacgcggtcggcacgagcggcgggtcgcggcgggcgccgacggaggcgaagctgaaggtggccatcaacgggttcggccgcatcgggcgcaacttcctgcggtgctggcacgggcgcggcgacgcctcgcccctcgacgtcatcggcatcaacg

SEQ ID NO: 34553 - DNA, 301 bp, Zea mays
  Clone ID: LIB3060-046-Q1-K1-B12
aacttcccttcatactctccatcttcccctccccagctctaatcaagcctacgacagaatcaacatgggtgtcattgagaagctcagccgcaaggccggtgtcatcgtcggtgacgatgtcctccgcctcttcgagtacgctcaggagaagcagttcgccattcccgccattaacgtcacctcttcctccaccgtcgtggctgccctcgaggccgctcgcgaccaaaagtcccccattgccctccaggtctcccagggtggtgccgctttcttcgccggtaaaggtgtcagcaacgatggc

SEQ ID NO: 34554 - DNA, 398 bp, Zea mays
  Clone ID: LIB3060-018-Q1-K1-F10
gctcttcgctaccaccgtgccactccagcatgggggcggcctgtacgagttctccgggctcaggagctccgcgtcgctgcccatgcgccggaatgccacctccgacgacttcatgtccggcgtctgcttcaggacccacgcggtcggcacgagcggcgggccgcggcgggcgccgacggaggcgaagctgaaggtggccatcaatgggttcggccgcatcgggcgcaacttcctgcggtgctggcacgggcgcggcgacgcctcgcccctcgacgtcatcgtcatcaacgacaccggaggcgtcaagcaggcgttccaccttgctaagtacgactgcacgctcggcatcttcgatgccgacgtcaagcccgtcggcgacaacgccatctgcgtcgacg

SEQ ID NO: 34555 - DNA, 148 bp, Zea mays
  Clone ID: LIB3060-008-Q1-K1-F1
cgtggccatggcgtcgtccatgctctttgctaccaccgtgccactccagcaggggggcggcctgtccgagttctacgggctcatgagctccgcgtcgctacgtatgcgccagaatgccagttttgacgacttgatgttctacgttgca

SEQ ID NO: 34556 - DNA, 429 bp, Zea mays
  Clone ID: LIB3060-016-Q1-K1-F3
agcccatcacggtcgtctccagcagggacccgctcaagctcccatggggtgagctcggcattgacatcgtcatcgagggcaccggagtcttcgtcgacggccccggcgccggcaagcacatccaggccggcgcgaagaaggtgatcatcacggctcccgccaagggcgccgacatcccgacctatgtcgtcggcgtcaacgagggcgactacgaccacagcgtcgcggacatcatcagcaacgcgtcctgcacgaccaactgcctcgcgccattcgtcaagatcttggacgaggagttcggaattgtcaaggggaccatgacgacgacgcactcgtacaccggcgaccagaggctgctggacgcgtcccaccgcgacctccggcgggcccgcgcggcggcgctgaacatcgtgccgacgagcacgggcg

SEQ ID NO: 34557 - DNA, 438 bp, Zea mays
  unsure at all n locations
  Clone ID: LIB3060-001-Q1-K2-A9
ctctggtccgtggccatggcgtcgtccatgctctccgctaccaccgtgccactccagcaggggggcggcctgtccgagttctccgggctcaggagctccgcgtcgctgcccatgcgccggaatgccacctccgacgacttcatgtccgccgtctccttcaggacccacgcggtcggcacgagcggcgggtcgcggcgggcgccgacggaggcgaagctgaaggtggccatcaacgggttcggccgcatcgggcgcaacttcctgcggtgctggcacgggcgcggcgacgcctcgcccctcgacgtcatcgccatcaacgacaccggcggtgtcaagcaggcgtcccacctgctcaagtacgactccacgctcggcatcttcgacgccgacgtcaagcccgtcggcgacaacgccatctncgtcgacggcaaggtcatc

SEQ ID NO: 34558 - DNA, 399 bp, Zea mays
  Clone ID: LIB3060-025-Q1-K1-F6
cgcttagatttcagtatctacttggacatcagtgatgaagttaagtttgcatggagaatccagcgggacatggcagagcgtgggcacagccttgaaagcatcaaggccagtatcgaggccaggaaaccagattttgatgcctttattgatccgcagaagcagtatgctgatgctgtgattgaagttctgccgacccagttgattcccgacgacaacgaaggaaaggtgctgcgtgttaagctcatcatgaaagaaggggtgaagaacttcaacccggtttatctctttgacgaaggatcgaccatcagctgggtgccttgtggaagaaagctcacatgctcttaccctggcatcaaattttcctatggcccggacacttacttcggaaacgaggtatct

SEQ ID NO: 34559 - DNA, 432 bp, Zea mays
  Clone ID: LIB3060-054-Q1-K1-G1
accttgtgaaagggcggggtggtgctcttcttcgtgagaagatggttgaggcagcatcggacaagtttattgttattgttgacgagacaaaactagttgatgggttaggaggtagtggtctagccatgccagtggaagttgtgcagttctgctggaagtacaaccttgtaagattgcaggaactgtttaaggaggaaggagtcgaggcaaagctaaggtttgaaggcgacaagccctatgttactgacaactcaaactacatcgtcgatttatacttcaagacgccaatcaaggatgcgttggcagcaggacaggaaattgcagctctggaaggagttgttgaccatgggttgttcttgaacatggcgagttcagtgatcattgctggaacggacggtgtcagtgtcaaaacgaagtgagtttttgagttgc

SEQ ID NO: 34560 - DNA, 403 bp, Zea mays
  Clone ID: LIB3060-022-Q1-K1-G2
ggaggtggcaggatgcgactggattcatgtcgatgtcatggacgggcgctttgtgccaaacatcacaattggacccttggttgttgatgctctgcgtccagtgactgatcttccgttggatgtacatctgatgattgtggaacctgagcagcgagtccccgattttatcaaggcaggtgctgatattgttagtgtccactgtgaacagacatcgaccatccatttgcaccgaacagtcaatcagattaaaagtctaagagcaaaggcagggaattgtttgaatccagcgacttcacttactggaattgattatggtcctgatggtggtgacctggtgctgattatgtctgtgaatcctgggtttggtggccaaagctttattgagagtcaagttaaggaaatt

SEQ ID NO: 34561 - DNA, 419 bp, Zea mays
  unsure at all n locations
  Clone ID: LIB3060-034-Q1-K1-D3
gtgaaagccgtggaggtggcaggatgttactggattcatgtcgatgtcatggacgggcgctttgtgccaaatatcacaattggacctttggttgttgatgctctgcgtcctgtgactgatcttccattggatgtacatctgatgattgtggaacctgagcagcgagtccctgattttatcaaggcaggtgctgatattgttagtgtccactgtgaacaaacatcgaccatccatttgcacagaacagtcaatcagattaaaagtctaggagcaaaagcaggagttgttttgaatccagcgactccactcaatgcaattgattacattcttgatgttgttgacctggtgttgattatgtctgtgaatcctgggtttggtggccagagctttatcgagagtcaagtnaggaaaattgcaga

SEQ ID NO: 34562 - DNA, 424 bp, Zea mays
  Clone ID: LIB3060-018-Q1-K1-B5
atcgcttaccgcccccgaagcgtctcggttcgcatagcagagctgctcttgcaacaagccaaacaacccagtggctgctagccgagacaggggatagattgagagagaggcgcgcagatggcgacgccgtcgtcgtcgctttgctccagcttcgcctccctgcggaccgcctccatcggccacccccgtggcatcgcctcctccacgcccaggaaggcattccatgtgagggcatcagctcgggttgacaaattctcaaagagtgacatcatcgtgtccccttcgattctgtctgcaaactttgcgaagcttggtgatcaggtaaaagctgtggaggtggcaggatgcgactggattcatgtcgatgtcatggacgggcgctttgtgccaaacatcacaattggacccttggttgttgatgctc

SEQ ID NO: 34563 - DNA, 390 bp, Zea mays
  unsure at all n locations
  Clone ID: LIB3060-013-Q1-K1-A2
caacaagccaaacaacccagtggctgctagccgagacaggggatagattgagagagaggcgcgcagatggcgacgccgtcgtcgtcgctttgctccagcttcgcctccctgcggaccgcctccatcggccacccccgtggcatcgcctcctccacgcccaggaaggcattccatgtgagggcatcagctcgggttgacaaattctcaaagagtgacatcatcgtgtccccttcgattctgtctgcaaactttgcgaagcttggtgatcaggtaaaagctgtggaagtggcaggatgcgactggattcatgtcgatgtcatggacgggcgctttgtgccaaacatcacaattggacccttgngttgtgatgctctgcgtccagtgactgat

SEQ ID NO: 34564 - DNA, 423 bp, Zea mays
  Clone ID: LIB3060-013-Q1-K1-A12
agctccctcacctgcctggcacctcgatcgagggcgtggagaagggcgggtacaccatgtctgacaactcgaccggcaacaagcctgacctcattgtgatgggcaccggctccgagctggagatcgcggccaaggccgccgacgagctgaggaaggagggcaagacggtccgcgtcgtctcgttcgtctcctgggaactctttgatgagcagtcggatgagtacaaggagagcgtcctccctgctgccgtcacagcgaggatcagcatcgaggccgggtccactcttggctggcagaagtacgtcggagcccagggcaaggccattggcatcgacaagttcggcgcgagtgctcctgccgggacgatctacaaggagtacggcatcaccgtggagagcatcattgcagctgccaagaagcttt

SEQ ID NO: 34565 - DNA, 430 bp, Zea mays
  Clone ID: LIB3060-010-Q1-K1-D2
gatcaccaccacacctctatcctgctagctaggtagctgaattcggagccagggtcgagcgagggggtgcggaggcgagatggaccacgcggcggacgcgcaccggacggacctgatgaccatcacgcggcacgtgctgaacgagcagagccggaaccccgagtcccgcggcgacttcaccatccttctctcccacatcgtcctcggctgcaagttcgtcgcctacgccgtcaacaaggccgggctcgcccagctgatcgggctcgccggcgagaccaacgtgcaaggagaggagcagaagaagctggacgttctgtccaacgaggtgttcgtcaaggccctcgtcagcagcggtcgcacctgcgtccttgtgtccgaggaggactaggaagcaacgttcgtggactctaagctgcgttgaaggtactgc

SEQ ID NO: 34566 - DNA, 430 bp, Zea mays
  Clone ID: LIB3060-030-Q1-K1-H11
aagaagacgagtgtcaagtgaacctgaaactttcggtgtcactggctggtagcctgagtgtgagtgagtgatcgagctagctgagctccgatcctcgctagctaggataccgccataccacaagtcttcttcacaagtttaggagtgacagcaacaagagatcgatggcctctgccaccgtgctcaagtcctccttccttcccaagaagtccgaatggggcgccaccaggcaggccgccgcgcccaggccgcccaccgtcttcatggtcgtccgcgcctccgcctacgccgatgagctcgtgaagaccgcgaaaacaatcgcgtcgccggggcggggcatcctggcgatggacgagtcaaacgcgacttgcgggaagcggctgacgtccatcgggctgaagaacacggaggccaaccggaaggcttaccg

SEQ ID NO: 34567 - DNA, 435 bp, Zea mays
  Clone ID: LIB3060-018-Q1-K1-E6
cgcgtttggattttgctcctttgctcccttctgaaagggtcaccatgtctgcctttgtggggaagtacacagatgagctgatcaagaccgccaagtgcctcgcaacgccgggcaagggcatcctggcctccgacgagtcgacgggcaccatcggcaagcgcctgtccagcatcaacctcgagaacgtggagtcgaaccggcaggcgctccgcgagctgctcttcacggcgcccggcgtgttcgactacctctccggggtcatcctcttcgaggagacgctgtaccagaagacctccgacgggaagccgttcgtggacgtgctcatcgcgggcggagtggtccctgggatcaaggtcgacaagggcaccgtggagatcgcgggcaccgacggcgagaccaccacgcagggcctcgactccctgggcgcacgctgcg

SEQ ID NO: 34568 - DNA, 384 bp, Zea mays
  unsure at all n locations
  Clone ID: LIB3060-044-Q1-K1-F10
cgcgtttggattttgctcctttgctcccttctgaaagggtcaccatgtctgccttggtggggaagtacacagatgagctgatcaagaccgccaagtgcctcgcaacgccgggcaagggcatcctggcctccgacgagtcgacgggcaccatcggcaagcgcctgtccagcatcaacctcgagaacgtggagtcgaaccggcaggcgctccgcgagctgctcttcacggcgcccggcgtgttcgactacctctccggggtcatcctcttcgaggagacgctgtaccagaagacctncgacgggaagccgttcgtggacgtgctcatcgcgggcggagtggtccctgggatcaaggtcgacaagggcaccgtggagatcgcgggca

SEQ ID NO: 34569 - DNA, 411 bp, Zea mays
  Clone ID: LIB3060-017-Q1-K1-F3
cgagtgtcaagtgaacctgaaacttgcggtgtcactggctggtatagcctgagtgtgagtgagtgatcgagctagctgagctccgatcctagctagctagctaggataccgccataccacaagtcttcttcacaagtttaggagtgacagcaacaagagatctcgatggcctatgccaccgtgctcaagtacttcttccttagcaagaagtccgaatggggcgccaccagtgcaggccggcgcgcccaggccggacaccgtctacatggtcgtacgcgcctactgctacgccgatgagctcgtgaagaccgcgaaaacgatcgcgtcgtcggggcggtgcatcctggcgatggacgagtcgaacgcgacgtgctgtaagcggctggcgtccatcgagctggagaacacgga

SEQ ID NO: 34570 - DNA, 382 bp, Zea mays
  unsure at all n locations
  Clone ID: LIB3060-041-Q1-K1-G7
cggagctgcgaggcaagcgcccgctgctgcccccggaccttccccagaccgacgagggcgccgacgtcatcggcgcgttccacgtcctcgcggagctcccgcccgacagcttcggcccctacatcatctccatggcgacggccccctcggacgtgctcgccgtggagctcctgcagcgcgagtgcggcgtgcgccagccgctgcccgtggtgccgctgttcgagaggctggccgacctgcagtcggcgcccgcgtccgtggagcgcctcttctcggtggactggtacatggaccggatcaagggcaagcagcaagtcatggtcggctactccgactccggcaaggacgccggccgnctgtccgcggcgtggcagctgtacag

SEQ ID NO: 34571 - DNA, 271 bp, Zea mays
  Clone ID: LIB3060-023-Q1-K1-G11
gggaggagcacctgtgcttccagactctgcatcgcttcacggccgccacgctggagcacggcatgcacccgccggtctctcccaagcccgagtggcgcaagctcatggacgagatggcggtcgtggccacggaggagtaccgctcggtcgtcgtcaaggagccgcgcttcgtcgagtacttcagatcggctacaccggagaccgagtacgggaggatgaacatcggcagccggccagccaagaggaggcccggcggcggcatcacgaccct

SEQ ID NO: 34572 - DNA, 401 bp, Zea mays
  Clone ID: LIB3060-009-Q1-K1-C11
aagagatgtatgcttgctggccagaatgatggctgcaaacttgtacatcgatcagattgaagagctgatgtttgagctctctatgtggcgctgcaacgatgagcttcgtgttcgtgccgaagagctccacagttcgtctggttccaaagttaccaagtattacatagaattctggaagcaaattcctccaaacgagccctaccgggtgatactaggccatgtaagggacaagctgtacaacacacgcgagcgtgctcgccatctgctggcttctggagtttctgaaatttcagcggaatcgtcatttaccagtatcgaagagttccttgagccacttgagctgtgctacaaatcactgtgtgactgcggcgacaaggccatctcggacgggagcctcctgg

SEQ ID NO: 34573 - DNA, 434 bp, Zea mays
  unsure at all n locations
  Clone ID: LIB3060-052-Q1-K1-B6
gctgtcggagctgcgaggcaagcgcccgctgctgcccccggaccttccccagaccgacgagatcgccgacgtcatcggcgcgttccacgtcctcgcggagctcccgcccgacagcttcggcccctacatcatctccatggcgacggccccctcggacgtgctcgccgtagagctcctgcagcgcgagtgcggcgtgcgccagccgctgcccgtggtgccgctgttcgagaggctggccgacctgcagtcggcgcccgcgtccgtggagcgcctcttctcggtggactggtacatggaccggatcaagggcaagcagcaggtcatggtcggctactccgactccggcaaggacgccggccgnctgtccgcggcgtggcagctgtacagggcgcangaggagatggcgcangtggccaagcgctacngcgtcaagc

SEQ ID NO: 34574 - DNA, 436 bp, Zea mays
  unsure at all n locations
  Clone ID: LIB3060-012-Q1-K1-B10
gaaatttcagcggaatcgtcatttaccagtatcgaagagttccttgagccacttgaggtgtgctacaaatcactgtgtgactgcggcgacaaggccatcgcggacgggagcctcctggacctcctgcgccaggtgttcacgttcgggctctccctggtgaagctggacatccggcaggagtcggagcggcacaccgacgtgatcgacgccatcaccacgcacctcggcatcgggtcgtaccgcgagtggtccgaggacaagaagcaagaatggctgctgtccgagctgcgaagcaagcgcccgctgctgcccccggaccttccccagaccgacgagatcgncgacgtcatcggcgcgttccacgtnctcgcggagcttccgcccgacagcttcggcccctacatcatctccatggcgacggccccctcggacgtgc

SEQ ID NO: 34575 - DNA, 399 bp, Zea mays
  Clone ID: LIB3060-019-Q1-K1-G7
ccgggtgatactaggccatgtaagggacaagctgtacaacacacgcgagcgtgctcgccatctgggggcttctggagtttctgaaatttcagcggaatcgtcatttaccagtatcgaagagttccttgagccacttgagctgtgctacaaatcactgtgtgactgcggcgacaaggccatcgcggacgggagcctcctggacctcctgcgccaggtgttcacgttcgggctctccctggtgaagctggacatccggcaggagtcggagcggcacaccgacgtgatcgacgccatcaccacgcacctcggcatcgggtcgtaccgcgagtggcccgaggacaagaggcaggagtggctgctgtcggagctgcaaggcaagcgcccgttgttgcccccgga

SEQ ID NO: 34576 - DNA, 425 bp, Zea mays
  Clone ID: LIB3060-035-Q1-K1-E11
cttggatgggtggtgaccgcgatggaaatccaagagttaccccggaggtgacgggagatgtatgcttgctggccagaatgatggctgcaaacttgtacatcgatcagattgaagagctgatgtttgagctctctatgtggcgctgcaacgatgagcttcgcgttcgtgccgaagagctccacagttcgtctggttccaaagttaccaagtattacatagaattctggaagcaaattcctccaaacgagccctaccgggtgatactaggccatgtaagggacaagctgtacaacacacgcgagcgtgctcgccatctgctggcatctggagtttctgaaatttcagcggaatcgtcatttaccagtatcgaagagttccttgagccacttgagctgtgctacaaatcactgtgtgactgcggcgac

SEQ ID NO: 34577 - DNA, 426 bp, Zea mays
  Clone ID: LIB3060-012-Q1-K1-F9
gagttccttgagccacttgagctgtgctacaaatcactgtgtgactgcggcgacaaggccatcgcggacgggagcctcctggacctcctgcgccaggtgttcacgttcgggctctccctggtgaagctggacatccggcaggagtcggagcggcacaccgacgtgatcgacgccatcaccacgcacctcggcatcgggtcgtaccgcgagtggtccgaggacaagaggcaggagtggctgctgtcggagctgcgaggcaagcgcccgctgctgcccccggaccttccccagaccgacgagatcgccgacgtcatcggcgcgttccacgtcctcgcggagctcccgcccgacagcttcggcccctacatcatctccatggcgacggccccctcggacgtgctcgccgtagagctcctgcagcgcgag

SEQ ID NO: 34578 - DNA, 461 bp, Zea mays
  unsure at all n locations
  Clone ID: LIB3060-021-Q1-K1-E1
cgagtacttcagatcggctacaccggagaccgagtacgggaggatgaacatcggcagccggccggccaagaggaggcccggcggcggcatcacgaccctgcgcgccatcccctggatcttctcgtggactcagaccaggttccaccttcccgtgtggctgggagtcggcgccgccttcaagttcgccatcgacaaggacgtcaggaacttccaggtcctcaaagagatgtacaacgagtggccattcttcaaggtcaacctggaacctgctgagatggttttcgccaagggagaccccggcattgccggcttgtatgacgagctgcttgtggcggaagaactcaagccctttgggaagcagctcagggacaaatacgtggagacacagcagcttctnctncagatcgctgggcacaaggatattcttgaaagcgatccattcctgaagcaagggcttgtgc

SEQ ID NO: 34579 - DNA, 251 bp, Zea mays
  Clone ID: LIB3060-009-Q1-K1-C3
ggcatcgggtcgtaccgcgagtggtcctaggacaagaggcatgagtggctgctgtcggagctgcgaggcaagcgcccgctgctgcccccggacctttcccagaccgactagatcgccgacgtcatcggcgcgttccacgtcctttctgagctcccgcccgacagcttctgcccctacatcatctccatggcgacggtcccctcggacgtactcgccgtagagcttcctgcagcgcgagtgcggcgtgcgcc

SEQ ID NO: 34580 - DNA, 413 bp, Zea mays
  unsure at all n locations
  Clone ID: LIB3060-014-Q1-K1-D4
gcagcacgtcgtgccgctccaaccatctcgcttccgtgcttagcttcccgccgcgccggggcgtcgaccaaggctcccggccccggcgagaagcaccactccatcgacgcgcagctccgtcagctggtcccaggcaaggtctccgaggacgacaagctcatcgagtacgatgcgctgctcgtcgaccgcttcctcaacatccttcaggacctccacgggcctagccttcgcgaatttgtccaggagtgctacgaggtatcggccgactacgagggcaaaggagacacgacgaagctgggcgagctcggcgccaagctcacggngctggcccctgccgacgccatcctcgtggcgagctccatcctgcacatgctcaacctcgccaacctggccgaggaggtgcagatcgcgca

SEQ ID NO: 34581 - DNA, 388 bp, Zea mays
  Clone ID: LIB3060-029-Q1-K1-H6
cgcagcagcacgagcagcacgtcgtgccgctccaaccatctcgcttccgtgcttaggttcccgccgcgccatggcgtcgaccaaggctcccggccccggcgagaagcaccactccatcgacgcgcagctccgtcagctggtcccaggcaaggtctccgaggacgacaagctcatcgagtacgatgcgctgctcgtcgaccgcttcctcaacatccttcaggacctccacgggcctagccttcgcgaatttgtccaggagtgctacgaggtatcggccgactacgagggcaaaggagacacgacgaagctgggcgagctcggcgccaagctcacggggctggcccctgccgacgccatcctcgtggcgagctccatcctgcacatgctc

SEQ ID NO: 34582 - DNA, 449 bp, Zea mays
  unsure at all n locations
  Clone ID: LIB3060-011-Q1-K1-G8
gcagcagcacgagcagcacgtcgtgccgctccaaccatctcgcttccgtgcttagctgcccgccgcgccatggcgtcgaccaaggctcccggccccggcgagaagcaccactccatcgacgcgcagctccgtcagctggtcccaggcaaggtctccgaggacgacaagctcatcgagtacgatgcgctgctcgtcgaccgcttcctcaacatccttcaggacctccacgggcctagccttcgcgaatttgtccaggagtgctacgaggtatcggccgactacgagggcaaaggagacacgacgaagctgggcgagctcggcgccaagctcacggggctggcccctgccgacgccatcctcgtggcgagctccatcctgcacatgctcaacctcgccaacctggccgaggaggtgcagatcgcgcaccgncgncgcaacagcaaactcaa

SEQ ID NO: 34583 - DNA, 431 bp, Zea mays
  Clone ID: LIB3060-007-Q1-K1-E2
cgcagcagcacgagcagcacgtcgtgccgctccaaccatctcgcttccgtgcttagcttcccgccgcgccatggcgtcgaccaaggctcccggccccggcgagaagcaccactccatcgacgcgcagctccgtcagctggtcccaggcaaggtctccgaggacgacaagctcatcgagtacgatgcgctgctcgtcgaccgcttcctcaacatccttcaggacctccacgggcctagccttcgcgaatttgtccaggagtgctacgaggtatcggccgactacgagggcaaaggagacacgacgaagctgggcgagctcggcgccaagctcacggggctggcccctgccgacgccatcctcgtggcgagctccatcctgcacatgctcaacctcgccaacctggccgaggaggtgcagatcgcgcaccggc

SEQ ID NO: 34584 - DNA, 304 bp, Zea mays
  unsure at all n locations
  Clone ID: LIB3060-026-Q1-K1-H9
gaggtatcggccgactacgagggcaaaggagacacgacgaagctgggcgagctcggcgccaagctcacggggctggcccctgccgacgccatcctcgtggcgagctccatcctgcacatgctcaacctcgccaacctggccgaggaggtgcagatcgcgcaccgncgccgcaacagcaaactcaagaaaggtggcttcgccgacgaaggctccgccaccaccgagtccgacatcgaggagacgctcaagcgcctcgtgtccgaggtcggcaagtcccccgaggaggtgttcgaggcgctcaaga

SEQ ID NO: 34585 - DNA, 274 bp, Zea mays
  Clone ID: LIB3060-020-Q1-K1-F11
catcgcagcagcacgagcagcacgccgtgccgctccaaccgtctcgcttccctgcttagcttccggccgcgccatggcgtcgaccaaggcacccggccccggcgagaagcaccactccatcgacgcgcagctccgtcagctggtcccaggcaaggtctccgaggacgacaagctcatcgagtacgatgcgctgctcgtcgaccgcttcctcaacatcctccaggacctccacgggcccagccttcgcgaatttgtccaggagtgctacgaggtc

SEQ ID NO: 34586 - DNA, 440 bp, Zea mays
  unsure at all n locations
  Clone ID: LIB3060-007-Q1-K1-C8
agcacgagcagcacgccgtgccgctccaaccgtctcgcttccctgcttagcttcccgccgcgccatggcgtcgaccaaggcacccggccccggcgagaagcaccactccatcgacgcgcagctccgtcagctggtcccaggcaaggtctccgaggacgacaagctcatcgagtacgatgcgctgctcgtcgaccgcttcctcaacatcctccaggacctccacgggcccagccttcgcgaatttgtccaggagtgctacgaggtctcggccgactacgagggcaaaggagacacgacgaagctgggcgagctcggcgccaagctcacggggctggcccccgccgacgccatcctcgtggcgagctccatcctgcacatgctcaacctcgccaacctggccgaggaggtgcagatcgcgcaccgncgncgcaacagcaagc

SEQ ID NO: 34587 - DNA, 264 bp, Zea mays
  Clone ID: LIB3060-042-Q1-K1-E5
cgcgaggcaagcgcccgctgctgcccccggaccttccccagaccgacgagatcgccgacgtcatgggcgcgttccacgtcctcgcggagctcccgcccgacagcttcggcccctacatcatctccatggcgactgccccctcggacgtgctcgccgtggagctcctgcagcgcgagtgcggcgtgcgccagccgctgcccgtggtgccgctgttcgagaggctggccgacctgcagtcggcgcccgcgtccgtggagcgcctct

SEQ ID NO: 34588 - DNA, 421 bp, Zea mays
  Clone ID: LIB3060-053-Q1-K1-D6
gttccttgagccacttgagctgtgctacaaatcactgtgtgactgcggcgacaaggccatcgcggacgggagcctcctggacctactgcgccaggtgttcacgttcgggctctccctggtgaagctggacatccggcaggagtcggagcggcacaccgacgtgatcgacgccatcaccacgcacctcggcatcgggtcgtaccgcgagtggtccgaagacaagaggcaggagtggctgctgtcggagctgcgaggcaagcgcccgctgctgcccccggaccttacccagaccgacgagatcggcgacgtcatcagcgcgttccacgtcctcgcggagctcccgcccgacagcttcgggccctacatgatctgcatggcgacggccccctcggacgtgctcggcgtagagctcctgcagcgc

SEQ ID NO: 34589 - DNA, 293 bp, Zea mays
  Clone ID: LIB3060-023-Q1-K1-E7
ccaagggcttgaaatgtgagtatgctttcctttgcgagattgtcatccatgctcagcgcttgcgtcaacatctacaaacacaaccagggtctcttccttttgatgagatcctgttctgcaacattgggaatcctcaatcccttggtcagcaacctgtgacgttcttcagggaggttcttgctctttgtgatcatccatgcctcttggaaaaagaggaaaccaaatcattgttcagtgctgatgctatttctcgagcaaagcagattcttgcaactattcctggacgggcaaca

SEQ ID NO: 34590 - DNA, 430 bp, Zea mays
  Clone ID: LIB3060-036-Q1-K1-D2
cggacgcgtgggcggacgcgtgggcgaagccgcactgtgagagagggacgcggccggttgtcctcggcttgtacgcaatccttccgtcgctgcgaagctgatccctcgtgttcgccatggcccccagcgtcgccgtggaaaacctcaaccccaaggtcttgaaatgtgagtatgcagtccgtggcgagattgtcatccatgctcagcgcttgcagcaacaactacaaacacaaccagggtctcttccttttgatgagatcctgttctgcaacattgggaatcctcaatcccttggtcagcaacctgtgacgttcttcagggaggttcttgctctttgtgatcatccatgcctcttggaaaaagaggaaaccaaatcattgttcagtgctgatgctatttctcgagcatagcagattcttgcaactattcc

SEQ ID NO: 34591 - DNA, 424 bp, Zea mays
  Clone ID: LIB3060-002-Q1-K2-C11
gtttcgctgccccgattcgccacgaagccgcactgtgagagagggacgcggcccgttgtcctcggcttgtacgcaatccttccgtcgctgcgaagctgatccctcgtgttcgccatggcccccagcgtcgccgtggaaaacctcaaccccaaggtcttgaaatgtgagtatgcagtccgtggcgagattgtcatccatgctcagcgcttgcagcaacaactacaaacacaaccagggtctcttccttttgatgagatcctgttctgcaacattgggaatcctcaatcccttggtcagcaacctgtgacgttcttcagggaggttcttgctctttgtgatcatccatgcctcttggaaaaagaggaaaccaaatcattgttcagtgctgatgctatttctcgagctaagcagattcttgcaacta

SEQ ID NO: 34592 - DNA, 427 bp, Zea mays
  Clone ID: LIB3060-001-Q1-K2-F11
gtgtggtaaaagaggaggttacatggagattactggcttcagtgctccggtaagagagcagatctacaaggtagcttcagtgaacctgtgctccaatatcactggtcaaatccttgcgagcctcgtcatgaatccaccaaaggtctgctattatggcattatgccctgattagaattaggaaacgccaaactgtccagttaaaacccattgcctcattcttcaggttggggacgaatcatatgcttcctacaaggcagagaaagatggaatccttcagtctttagctcgccgtgcaaaggttcgcctggttgcatttctactatagatttgagtaacttcctaaacatattcaaggtcttttttttggtcgttttacaggcactggaagatgcattcaacacgcttgagggattttcatgtaacaag

SEQ ID NO: 34593 - DNA, 435 bp, Zea mays
  Clone ID: LIB3060-015-Q1-K1-B3
gtgtgtttgtgtgtgtgtgtgtgtgcgcgcgcgcgcgcgcgtaggtggtggcgctgtgccaggctccgttcctgctcgacgatccccacgtcggcctcatgttcccggcggacgccatcgctagggccaagcactatctcgccatggcgcccggcggtctaggtgcgtacagtgactcccgcggcatcccgggaatcaggaaggaagttgccgacttcatccacaagcgtgatggatatcccagtgatccggaactcatctacctcacagactgtgccagcaaaggtgtgatgcagatcctgaacaccatcattagaaacgagatggacgggatcttggtccctgttcctcagtacccactttattccgccaccatttccctctatggtggttctctggtcccgtactacttggaagaagaggctaactggagcc

SEQ ID NO: 34594 - DNA, 424 bp, Zea mays
  unsure at all n locations
  Clone ID: LIB3060-017-Q1-K1-F12
atcctgttctgcaacattgggaatcctcaatcccttggtcagcaacctgtgacgttcttcagggaggttcttgctctttgtgatcatccatgcctcttggaaaaagaggaaaccaaatcattgttcagtgctgatgctatttctcgagcaaagcagattcttgcaactattcctggacgggcaacaggtgcatatagtcacagtcagggtatcaaaggattgcgtgatgcaattgctgctgggatcacctcacgtgacggattccctgcaaatgcagatgacattttcattacagacggagcaagtcctgnggtccacatgatgatgcaattactgattaggaatgagaaagatggcattctgtgcccaattcctcagtaccccttgtactcggcctccatagctcttcatggtggagctcttg

SEQ ID NO: 34595 - DNA, 318 bp, Zea mays
  Clone ID: LIB3060-005-Q1-K1-C1
gttggtgcctataggacagaagagctgcagccatacgtgctcaatgtagtcaagaaggctgaaaatcttatgttggagaaaggagaaaacaaagagtatcttcccattgaaggtttagccgcgtttaacaaagcaacagcagagctattgcttggagctgataaccctgttattaatcaaggactggttgctacacttcagtctctctcgggcactggatcactgcgtctcgctgcagcattcatacaaagatactttcctgaaactaaagtgctgatatcgtcgcctacctggggtaaccacaagaatatcttcaat

SEQ ID NO: 34596 - DNA, 412 bp, Zea mays
  Clone ID: LIB3060-013-Q1-K1-G5
ctcccctgctccggctccggctccggctctgccatgggcctttcaacagtttagtcgcgcggccggaccgcgcctcgtgccggcccctctcggccgctgccgctctgcccagccccgccgcccgcgccgggcccagctcgccaccgtccggtgctccgtcgacgccaccaagcaggcgcaggatggcgtggcgacggcggtcgcgacggaggcgccagcgtcgcggaaggagtgcttcggggtcttctgcaccacctacgacctcaaggcggaggacaagaccaagtcgtggaagaagctagtgaatgttgctgtgtcaggcgcggccgggatgatatcaaatcacctgctgttcaaactcgcttctggtgaagttttcggacaagaccaaccaatagcacttaaactactc

SEQ ID NO: 34597 - DNA, 444 bp, Zea mays
  Clone ID: LIB3060-023-Q1-K1-E6
ccaaggtcttgaaatgtgagtatgcagtccgtggcgagattgtcatccatgctcagcgcttgcagcaacaactacaaacacaaccagggtctcttccttttgatgagatcctgttctgcaacattgggaatcctcaatcccttggtcagcaacctgtgacgttcttcagggaggttcttgctctttgtgatcatccatgcctcttggaaaaagaagaaaccaaatcattgttcagtgctgatgcctattctcgagccaagcaaattcttggcactattcctggaccggccacaagtgcctatagtcacaagcagggtattaaaagattgcctgattcaattgctgcttggatcaccttacgtgacggattccctgcaaatgccaatgacattttcattacagaccgagcaagtcctggggtccacatgatgatgcaattactga

SEQ ID NO: 34598 - DNA, 388 bp, Zea mays
  Clone ID: LIB3060-016-Q1-K1-C12
ctctaccgtcctatgcatccggtacgcccagcatccatccactactgacatgctgggggtccggctgcggctccggcatgggcctttcaacagtttactccgcggccggaccgcgcctcgtgccggtccctctcgaccgctgccgctctgcccagccccggcgcccgcgccgagccccggtcgccaccgttcggtgctccgtcgacgccaccaagcaagcgcatgatggcgtggcagactgcggtcgcgactgaggcgccgtagtcgcggaaggagtgctctggggtctactgcaccacctacgacctcaaggccgaggacaagaccaagtcgcggaagaagctagtgaatgttgctgagtcaggcgcggccgggatgatatcaaatc

SEQ ID NO: 34599 - DNA, 444 bp, Zea mays
  Clone ID: LIB3060-021-Q1-K1-F9
gcgagcgcgcggtgtccaccactccctctcctctcccgtcctatccatccggcacgccgagcggccatccactcctcccctgctccggctccggctccggctctgccatgggcctttcaacagtttactccccggccggaccgcgcctcgtgccggcccctctcggccgctgccgctctgcccagccccgccgcccgcgccgggcccagctcgccaccgtccggtgctccgtcgacgccaccaagcaggcgcaggatggcgtggcgacggcggtcgcgacggaggcgccagcgtcgcggaaggagtgcttcggggtcttctgcaccacctacgacctcaaggcggaggacaagaccaagtcgtggaagaagctagtgaatgttgctgtgtcaggcgcggccgggatgatatcaaatcacctgctgttcaaactcgcttctggtg

SEQ ID NO: 34600 - DNA, 337 bp, Zea mays
  Clone ID: LIB3060-051-Q1-K1-H4
gtgaacgttctcgtcatctattgacatctggaatttctgagattccagaggaggcaacttttactaacgttgaacagtttctggaacctcttgagctatgttatagatcattatgtgcttgtggtgacaaacctatagctgacggaagtcttcttgatttcttgcgtcaagtatcaacttttggtcttgcacttgtgaagcttgacatcaggcaggaatctgatcgacacacagatgtccttgattcgataacgacacatcttggaattggctcctatgctgaatggtctgaagagaaacgccaggattggttggtgtctgaacttgagggcaaacg

SEQ ID NO: 34601 - DNA, 466 bp, Zea mays
  Clone ID: LIB3060-041-Q1-K1-A12
gcagatcgcgcaccgccgccgcaacagcaaactcaagaaaggtggcttcgccgacgaaggctcggccaccaccgagtccgacatcgaggagacgctcaagcgcctcgtgtccgaggtcggcaagtcccccgaggaggtgttcgaggcgctcaagaaccagaccgtcgacctcgtcttcaccgcgcatcccacgcagtccgcccgccgctcgctcctgcagaaaaacgcgaggatccggaattgtctgacccagctgaatcccaaggacatcactgacgacgacaagcaggagctcgatgaggctctgcagagagagatccaagcagccttcagaactgatgaaatcaggagggcacaacccaccccacaggacgaaatgcgctatgggatgagctacatccatgagactgtatggaagggcgtgcctaagttcttgcgccgtgtggatacagccctgaagaatatc

SEQ ID NO: 34602 - DNA, 389 bp, Zea mays
  Clone ID: LIB3060-036-Q1-K1-G2
cgcttcatcactcgtttcctttcgaaagcccgcgcacgcacgtcggtcgtcccgagcaggacctcgatcggccgagatggcgacgccgaacgggcttgcgcggatcgagacgaccgggaagaagaagcaggacaacggcgtgtggtacgacgacagctcggcgccggtgcgcgcgcagaccatcgacgagctgcactcgctgcagcggaagcggtcggcgcccagcacgcccaagcggtcggcgcccaccacgcccatcaagggcggcgcccactcgcccttcgccgtcgcgatctccgaggaggagcgccacacgcagcagatgcagtccatcagtgcgtcgttggcgtctctgacgcgtgaaaccgggccgaaagtggtcaagggcg

SEQ ID NO: 34603 - DNA, 378 bp, Zea mays
  Clone ID: LIB3060-008-Q1-K1-H3
ggagcgaaagtattaacaaacattggtacccaagattgttcgctttcacaacgttacaacatatatatcatatatgcatggacaggtacaatgcctctccagcagcaccagcaacaagggtggttagcagcagggactataaacaacagagtaccatccgcgttgatagatctttattactgcaaaattgatccccgcagcactaccggtagttgcggtagacgggagtgtacatgcagttctctgcatatttcaccaggtcgctggggggaggcagacgggtcgccagaccgagctcgtaggcttttgcagccacggctgcagcgatgtgcgcagagatctttatgatgctggtgaagggtgggaagatggaaccct

SEQ ID NO: 34604 - DNA, 408 bp, Zea mays
  Clone ID: LIB3060-024-Q1-K1-D9
tgctcattgacaacgtcgaggagttacttccaatcgtgtacactccaaccgttggcgaggcctgccaaaagtatggatccatatttagtcgccctcagggtctttatatcagtttgaaggagaagggaaagatccttgaggtgttgaagaactggccagagaggagcattcaggttatagttgttactgatggtgaacgtattttggggcttggagatctcggatgccaggggatggggattcctgttggtaaactttccctttacactgccctgggaggagttcgtccatctgcttgcttgccgatcacattggatgttggtacaaataacgaggagctgcttaatgacgaattttacattggcttgagacaaagaagagccactggccaggagtacactgattttc

SEQ ID NO: 34605 - DNA, 445 bp, Zea mays
  Clone ID: LIB3060-021-Q1-K1-G10
gttctacattggactccggcaaaaacgtgcgactggcgaggagtatgatgagcttattgaagagttcatgtctgctgttaagcaattctatggtgagaaagtcctcattcagtttgaggactttgccaatcataatgcctttgatttgcttgaaaaatatagcatgagccatcttgttttcaatgatgatatccagggcacagcatcagtggtccttgcaggtttgttagcagcactcaagatggttggtgggaccctggcagagcagacttatttgttccttggtgctggggaggctggaactggtattgcagaacttattgctcttgagatttcgaaacagacgaatgctccaattgaagagtgccgcaagaaggtttggctggtggactcaaagggtttgattgttgactctcgtaaaggctcccttcagccattcaagaaa

SEQ ID NO: 34606 - DNA, 362 bp, Zea mays
  Clone ID: LIB3060-034-Q1-K1-A5
ctggtttcgctgccccgattcgccacgaagccgcactgtgagagagggacgcggcccgttgtcctcggcttgtacgcaatccttccgtcgctgcgaagctgatccctcgtgttcgccatggcccccagcgtcgccgtggaaaacctcaaccccaaggtcttgaaatgtgagtatgcagtccgtggcgagattgtcatccatgctcagcgcttgcagcaacaactacaaacacaaccagggtctcttccttttgatgagatcctgttctgcaacattgggaatcctcaatcccttggtcagcaacctgtgacgttcttcagggaggttcttgctctttgtgatcatccatgcctcttgtaaaa

SEQ ID NO: 34607 - DNA, 264 bp, Zea mays
  Clone ID: LIB3060-042-Q1-K1-E4
atggccgccagcgtcaccgtggaaaacctcaaccccaaggtcttaaaatgtgagtatgcggtccgtggggagattgtcatccatgctcagcgcctgcagcaacaactacaaacacaaccagggtctcttccttttgatgagatcctctattgcaatattgggaatccccaatctcttggtcagcaacctgtgacattcttcagggaggttcttgctctttgtgattatccgtgcctcttggaaaaagaggaaaccaaatcattg

SEQ ID NO: 34608 - DNA, 414 bp, Zea mays
  Clone ID: LIB3060-011-Q1-K1-A9
cccgattcgccacgaagccgcactgtgagagagggacgcggcccgttgtcctcggcttgtacgcagtccttccgtcgctgcgaagctgatccctcgtgttcgccatggcccccagcgtcgccgtggaaaacctcaaccccaaggtcttgaaatgtgagtatgcagtccgcggcgagattgtcatccatgctcagcgcttgcagcaacaactacaaacacaaccagggtctctttcttttgatgagatcctgttctgcaacattgggaatcctcaatcccttggtcagcaacctgtgacgttctttagggaggttcttgctctttgtgatcatccatgcctcttggaaaaagaggaaaccaaatcatcgttcagtgctgatgctatttctcgagcacagcagattcttgcaacta

SEQ ID NO: 34609 - DNA, 354 bp, Zea mays
  Clone ID: LIB3060-030-Q1-K1-E1
cgctgcgccgattcgccacgaagccgcactgttagatagggacgcggcccgttgtcctcggctggtacgcaatccttccgtcgctgcgaagctgatccctcgtgttcgccatggcccccagcgtcgccgtggaaaacctcaaccccaaggtcttggaatgggaatatgcagtccgtggcgagattgtaatccatgcttagcgcttgcagcaacaactacaaacacaaccagggtctcttccttttgatgagatccttgtttgcaccattgggaatcctaaatcccttggtcagcaaccttggacgttcttcagggaggttcttgctctttgggatcatccatgccttttggaaa

SEQ ID NO: 34610 - DNA, 262 bp, Zea mays
  Clone ID: LIB3060-004-Q1-K1-A8
ggtttcgctgccccgattcgccacgaagccgcactgtgagagagggacgcggcccgttgtcctcggcttgtacgcaatccttccgtcgctgcgaagctgatccctcgtgttcgccatggcccccagcgtcgccgtggaaaacctcaaccccaaggtcttgaaatgtgagtatgcagtccgaggcgagattgtcatccatgctcagcgcttgcagcgacaacgtcgaacacaaccagggtctcttacttttgatgagatcctg

SEQ ID NO: 34611 - DNA, 403 bp, Zea mays
  Clone ID: LIB3060-041-Q1-K1-C8
gataaatccaggaaatcccactggccaatgccttagtgaagcgaatataaaggaacggctgcaattttgctaccgtgaaaacttagttctgctagcacatgaagtgtatcaacagaacatttatcaagatgaacggccatttataagcgcaagaaaggttatgttcgacatgggtccaccaataagcagtgagcttcaggttgtttctttccacactgtgtcgaaagggtactggggagagtgcggacaacgtggtggatacttcgaaatgacaaatcttcctgccaagacagtagatgagatctacaacgttgcatcgatagcactgagtccaaacgttcctgggcaaatttttatgggagtaatggttaaccctactaaacctggagatatcgtgtacctg

SEQ ID NO: 34612 - DNA, 431 bp, Zea mays
  Clone ID: LIB3060-044-Q1-K1-E2
gcaagatccatgggatacggcgaggatgatctccctctagtatcatttcagtctgtgtccgaaggatactatggagagtgtggtaaaagaggaggttacatggagattactggcttcagtgctccggtaagagagcagatctacaaggtagcttcagtgaacctgtgctccaatatcactggtcaaatccttgcgagcctcgtcatgaatccaccaaaggttggggacgaatcatatgcttcctacaaggcagagaaagatggaatccttcagtctttagctcgccgtgcaaaggcactggaagatgcattcaacacgcttgagggattttcatggtaacaggctgaaagagcaatgtaccttttccctcagatccatctgccacataaggcaattgaggctgctaaagctgccaagaaagcacctgatgc

SEQ ID NO: 34613 - DNA, 384 bp, Zea mays
  Clone ID: LIB3060-012-Q1-K1-C8
cggacgcgtgggtgctatttctcgagcaaagcagattcttgcaactattcctggacgggcaacaggtgcatatagtcacagtcagggtatcaaaggattgcgtgatgcaattgctgctgggatcacctcacgtgacggattccctgcaaatgcagatgacattttcattacagacggagcaagtcctggggtccacatgatgatgcaattactgattaggaatgagaaagatggcattctgtgcccaattcctcagtaccccttgtactcggcctccatagctcttcatggtggagctcttgtcccctattaccttgatgaaaaaactgggtggggtttggagatctctgatcttaagaaacaactcgaagatgctcggtcaaa

SEQ ID NO: 34614 - DNA, 431 bp, Zea mays
  Clone ID: LIB3060-054-Q1-K1-E4
ctcagtttgagaacccgtcggcgtacaaggatcaagtcattgccactggtctgccagcctcacctggggctgctgtgggccaggttgtgttcactgctgaggatgctgaagcatggcattcccaagggaaagctgctattctggtaagggcggagaccagccctgaggacgttggtggcatgcacgctgctgtggggattcttacagagaggggtggcatgacttcccacgctgctgtggtcgcacgtgggtgggggaaatgctgcgtctcgggatgctcaggcattcgcgtaaacgatgcggagaagctcgtgacgatcggaggccatgtgctgcgcgaaggtgagtggctgtcgctgaatgggtcgactggtgaggtgatccttggaaagcagccgctttccccaccagcccttagtggcgatctggga

SEQ ID NO: 34615 - DNA, 440 bp, Zea mays
  unsure at all n locations
  Clone ID: LIB3060-018-Q1-K1-B4
gtcgacggcctgcaacgggtggaggagtccatgggcgccacgctgggcgatccgcagggcccgctcctgctctccgtccgctccggcgccgccgtgtccatgcccggcatgacggacacggcgctcaacctggggctcaacgacgaagtggccgccgcgctggcggtcaagagcggcgagcgcttcgcctacgactgcttccgccgcttcctcgacatgttcggcaacgtcgccatggacatgccccgctcactgttcgcagagaagcttgagcacatgaaggaatgcaaggggctgaataacgacaccgacctcacggcctctgacctcanagagcttgtgggtcagtacacggaagtctacctctcagccataggagagccattcccctcagaccccatgaagcagctggagctagcagtgctggctgcgttcaactc

SEQ ID NO: 34616 - DNA, 366 bp, Zea mays
  unsure at all n locations
  Clone ID: LIB3060-001-Q1-K2-G11
cgctcgttccctttcgaaagcccgcgcacgcacgtcggtcgtcccgagcaggacctcgagcggccgagatggcgacgccgaacgggcttgcgcggatcgagacgaccgggaagaagaagcaggacaacggcgtgtggtacgacgacagctcggcgccggtgcgcgcgcagaccatcgacgagctgcactcgctgcagcggaagcggtcggcgcccagcacgcccaagcggtcggcgcccaccacgcccatcaagggcggtgcccactcgcccttcgccgtcgcgatctccgaggaggagcgccacacgcagcagatgcagtccatcaatgcgtcgntggcgtctctgacgcgtgaaaccgggcccg

SEQ ID NO: 34617 - DNA, 354 bp, Zea mays
  Clone ID: LIB3060-007-Q1-K1-A4
cactcgtttcctttcgaaagcccgcgcacgcacgtcggtcgtcccgagcaggacctcgatcggccgagatggcgacgccgaacgggcttgcgcggatcgagacgaccgggaagaagaagcaggacaacggcgtgtggtacgacgacagctcggcgccggtgcgcgcgcagaccatcgacgagctgcactcgctgcagcggaagcggtcggcgcccagcacgcccaagcggtcggcgcccaccacgcccatcaagggcggcgcccactcgcccttcgccgtcgcgatctccgaggaggagcgccacacgcagcagatgcagtccatcagtgcgtcgttggcgtctctgacgcgtg

SEQ ID NO: 34618 - DNA, 438 bp, Zea mays
  Clone ID: LIB3060-007-Q1-K1-D2
cgctcgttccctttcgaaagcccgcgcacgcacgtcggtcgtcccgagcaggacctcgatcggccgagatggcgacgccgaacgggcttgcgcggatcgagacgaccgggaagaagaagcaggacaacggcgtgtggtacgacgacagctcggcgccggtgcgcgcgcagaccatcgacgagctgcactcgctgcagcggaagcggtcggcgcccagcacgcccaagcggtcggcgcccaccacgcccatcaagggcggtgcccactcgcccttcgccgtcgcgatctccgaggaggagcgccacacgcagcagatgcagtccatcagtgcgtcgttggcgtctctgacgcgtgaaaccgggccgaaagtggtcaagggcgacccggccgcgaagggcgaggccgtcgcgcagggcgcgccatcgacgccgagggcgc

SEQ ID NO: 34619 - DNA, 350 bp, Zea mays
  unsure at all n locations
  Clone ID: LIB3060-013-Q1-K1-F1
gtcgtccacgagcatagacctcaacctcgccaggagggagatggtgatcatgggcacgcagggcgccggcgagatgaagaaggggctcttcggcgtcatgcactacctcatgcccaagcgcggcatcctctcgctgcactccggctgcaatatgggcaaggacggcgacgtcgccctcttctttggcctctcaggtaccgggaagacgacgctgtcgacggatcacaacaggcttctgatcggcgacgacgagcactgctggagcgacaatggcgtgtccaacatcgagggaggctgctacgccaagtgcatcgacctggcgcangagaaagagcctgatatttggaacg

SEQ ID NO: 34620 - DNA, 360 bp, Zea mays
  Clone ID: LIB3060-045-Q1-K1-E8
gcttcatcgctcgttccctttcgaaagcccgcgcacgcacgtcggtcgtcccgagcaggacctcgatcggccgagatggcgacgccgaacgggcttgcgcggatcgagacgaccgggaagaagaagcaggacaacggcgtgtggtacgacgacagctcggcgccggtgcgcgcgcagaccatcgacgagctgcactcgctgcagcggaagcggtcggcgcccagcacgcccaagcggtcggcgcccaccacgcccatcaagggcggtgcccactcgcccttcgccgtcgcgatctccgaggaggagcgccacacgcagcagatgcagtccatcagtgcgtcgttggcgtctctgacgcgt

SEQ ID NO: 34621 - DNA, 435 bp, Zea mays
  Clone ID: LIB3060-003-Q1-K1-C3
ctgacctcaaagagctcgtgggtcagtacaaggaggtctacctctcagccaagggagagccattcccctcagaccccaagaagcagctggagctagcagtgctggctgtgttcaactcgtgggagagccccagggccaagaagtacaggagcatcaaccagatcactggcctcaggggcaccgccgtgaacgtgcagtgcatggtgttcggcaacatggggaacacttctggcaccggcgtgctcttcaccaggaaccccaacaccggagagaagaagctgtatggcgagttcctggtgaacgctcagggtgaggatgtggttgccggaataagaaccccagaggaccttgacgccatgaagaacctcatgccacaggcctacgacgagcttgttgagaactgcaacatcctggagagccactacaaggaaatgc

SEQ ID NO: 34622 - DNA, 406 bp, Zea mays
  Clone ID: LIB3060-025-Q1-K1-F9
cgtcggtcgtcccgagcaggacctctatcggccgagatggcgacgccgaacgggcttgcgcggatcgagacgaccgggaagaagaagcaggacaacggcgtgtggtacgacgacagctcggcgccggtgcgcgcgcagaccatcgacgagctgcactcgctgcagcggaagcggtcggcgcccagcacgcccaagcggtcggcgcccaccacgcccatcaagggcggtgcccactcgcccttcgccgtcgcgatctccgaggaggagcgccacacgcagcagatgcagtccatcagtgcgtcgttggcgtctctgacgcgtgaaaccgggccgaaagtggtcaagggcgacccggccgcgaagggcgaggccgccgcgcatggcgcgccatcgacgccgagggcgc

SEQ ID NO: 34623 - DNA, 404 bp, Zea mays
  Clone ID: LIB3060-005-Q1-K1-G11
cactcgtttcctttcgaaagcccgcgctcgcacgtcggtcgtcccgagcaggacctcgatcggccgagatggcgacgccgaacgggcttgcgcggatcgagacgaccgggaagaagaagcaggacaacggcgtgtggtacgacgacagctcggcgccggtgcgcgcgcagaccatcgacgagctgcactcgctgcagcggaagcggtcggcgcccagcacgcccaagcggtcggcgcccaccacgcccatcaagggcggcgcccactcgcccttcgccgtcgcgatctccgaggaggagcgccacacgcagcagatgcagtccatcagtgcgtcgttggcgtctctgacgcgtgaaaccgggccgaaagtggtcaagggcgacccggccgcgaagggagaggcc

SEQ ID NO: 34624 - DNA, 412 bp, Zea mays
  Clone ID: LIB3060-016-Q1-K1-G8
tgctgcgtctcgggatgctcaggcattcgcgtaaacgatgcggagaagctcgtgacgatcggaggccatgtgctgcgcgaaggtgagtggctgtcgctgaatgggtcgactggtgaggtgatccttgggaagcagccgctttccccaccagcccttagtggtgatctgggaactttcatggcctgcgtggatgatgttagaaagctcaaggtcctggctaacgccgatacccctgatgatgcattgactgcgcgaaacaatggggcacaaggaattggattatgccggacagagcacatgttctttgcttcagacgagaggattaaggctgtcaggcagatgattatggctcccacgcttgagctgaggcagcaggcgctcgaccgtctcttgccgtatcagaggtctgact

SEQ ID NO: 34625 - DNA, 411 bp, Zea mays
  Clone ID: LIB3060-051-Q1-K1-E9
ctcccggtgaccatccgactcctggaccctcccctccacgagttccttccagaagggaacatcgaggacattgtaagtgaattatgtgctgagacgggagccaaccaggaggatgccctcgcgcgaattgaaaagctttcagaagtaaacccgatgcttggcttccgtgggtgcaggcttggtatatcgtaccctgaattgacagagatgcaagcccgggccatttttgaagctgctatagcaatgaccaaccagggtgttcaagtgttcccagagataatggttcctcttgttggaacaccacaggaactggggcatcaagtgactcttatccgccaagttgctgagaaagtgttcgccaatgtgggcaagactatcgggtacaaagttggaacaatgattgagatcccc

SEQ ID NO: 34626 - DNA, 448 bp, Zea mays
  unsure at all n locations
  Clone ID: LIB3060-044-Q1-K1-F8
ggttcctcttgttggaacaccacaggaactggggcatcaagtgactcttatgcgcggggttgctgagaaagtgttcgccaatgtgggcaagactatcgggtacaaagttggaacaatgattgagatccccagggcagctctggtggctgatgagatagcggagcaggctgaattcttctccttcggaacgaacgacctgacgcagatgacctttgggtacagcagggatgatgtggagaagttcattcccgtctatcttgctcagggcatcctccaacatgaccccttcgaggtcctggaccagaggggagtgggcgagctggtgaagtttgctacagagaggggccgcaaagctaggcctaacttgaaggtgggcatttgtggagaacacggtggagagccttcctctgtggccttcttcgcgaaggctgngctggattacgtttct

SEQ ID NO: 34627 - DNA, 435 bp, Zea mays
  unsure at all n locations
  Clone ID: LIB3060-005-Q1-K1-B6
tcgatgcacctcgcgccgaattgggaaaagctttctagaagtcaaacgccgatagcttggctttccgatgggtgccaggctatggtattgatcgtaccctgaattgacangagatgcaagncccggtgccattctttgaagctgctatagcaatngaccaaccagggntgttcaagctgttcccangagataatggcttcctcttgttggaacaccacaggaactggggcatcaagtgactcttatccgccaagttgctgagaaagtgttcgccaatgtgggcaagactatcgggtacaaagttggaacaatgattgagatccccagggcagctctggtggctgatgagatagcggagcaggctgaattcttctccttcggaacgaacgacctgacgcagatgacctttgggtacaacagggattatgtggggaa

SEQ ID NO: 34628 - DNA, 384 bp, Zea mays
  Clone ID: LIB3060-052-Q1-K1-H7
atcggaggccatgtgctgcgcgaaggtgagtggctgtcgctgaatgggtcgactggtgaggtgatccttgggaagcagccgctttccccaccagcccttagtggtgatctgggaactttcatggcctgggtggatgatgttagaaagctcaaggtcctggctaacgccgatacccctgatgatgcattgactgcgcgaaacaatggggcacaaggaattggattatgccggacagagcacatgttctttgcttcagacgagaggattaaggctgtcaggcagatgattatggctcccacgcttgagctgaggcagcaggcgctcgaccgtctcttgccgtatcagaggtctgacttcgaaggcattttccgtgctatggatgga

SEQ ID NO: 34629 - DNA, 431 bp, Zea mays
  Clone ID: LIB3060-052-Q1-K1-E8
cccacgcgtccggtgttcgccaatgtgggcaagactatcgggtacaaagttggaacaatgattgagatccccagggcagctctggtggctgatgagatagcggagcaggctgaattcttctccttcggaacgaacgacctgacgcagatgacctttgggtacagcagggatgatgtgggaaagttcattcccgtctatcttgctcagggcattctccaacatgaccccttcgaggtcctggaccagaggggagtgggcgagctggtgaagcttgctacagagaggggccgcaaagctaggcctaacttgaaggtgggcatttgtggagaacacggtggagagccttcctctgtggccttcttcgcgaaggctgggctggattacgtttcttgctcccctttcagggttccgattgctaggctagctgcagc

SEQ ID NO: 34630 - DNA, 429 bp, Zea mays
  Clone ID: LIB3060-016-Q1-K1-F8
gctcaacctggggctcaacgacgaagtggccgccgggctggcggccaagagcggggagcgcttcgcctacgactccttccgccgcttcctcgacatgttcggcaacgtcgtcatggacatcccccgctcactgttcgaagagaagcttgagcacatgaaggaatccaaggggctgaagaacgacaccgacctcacggcctctgacctcaaagagctcgtgggtcagtacaaggaggtctacctctcagccaagggagagccattcccctcagaccccaagaagcagctggagctagcagtgctggctgtgttcaactcgtgggagagccccagggccaagaagtacaggagcatcaaccagatcactggcctcaggggcaccgtcgtgaacgtgcagtgcatggtgttcggcaacatggggaacacttc

SEQ ID NO: 34631 - DNA, 422 bp, Zea mays
  Clone ID: LIB3060-045-Q1-K1-E3
cgccgatacccctgatgatgcattgactgcgcgaaacaatggggcacaaggaattggattatgccggacagagcacatgttctttgcttcagacgagaggattaaggctgtcaggcagatgattatggctcccacgcttgagctgaggcagcaggcgctcgaccgtctcttgccgtatcagaggtctgacttcgaaggcattttccgtgctatggatggactcccggtgaccatccgactcctggaccctcccctccacgagttccttccagaagggaacatcgaggacattgtaagtgaattatgtgctgagacgggagccaaccaggaggatgccctcgcgcgaattgaaaagctttcagaagtaaacccgatgcttggcttccgtgggtgcaggcttggtatatcgtaccctgaattga

SEQ ID NO: 34632 - DNA, 408 bp, Zea mays
  Clone ID: LIB3060-026-Q1-K1-D6
ggttgccggaataagaaccccagaggaccttgacgccatgaagaacctcatgccacaggcctacgacgagcttgttgagaactgcaacatcctggagagccactacaaggaaatgcaggatatcgagttcactgtccaggaaaacaggctgtggatgttgcagtgcaggacagggaaacgtacgggcaaaagtgccgtgaagatcgccgtggacatggttaacgagggccttgttgagccccgctcagcgatcaagatggtagagccaggccacctggaccagcttctccatcctcagtttgagaacccgtcggcgtacaaggatcaagtcattgccactggtctgccagcctcacctggggctgctgtgggccaggttgtgttcactgctgaggatgctgaagcatg

SEQ ID NO: 34633 - DNA, 427 bp, Zea mays
  unsure at all n locations
  Clone ID: LIB3060-044-Q1-K1-F6
gttcaactcgtgggagagccccagggccaagaagtacaggagcatcaaccagggcggtggcctcaggggcaccgccgtgaacgtgcagtgcatggtgttcggcaacatggggaacacttctggcaccggcgtgctcttcactaggaaccccaacaccggagagaagaagctgtatggcgagttcctggtgaacgctcagggtgaggatgtggttgccggaataagaaccccagaggaccttgacgccatgaagaacctcatgccacaggcctacgacgagcttgttgagaactgcaacatcctggagagccactataaggaaatgcaggatatcgagttcactgtccagganaacaggctgtggatgttgcagtgcaggacaggggaacgtacgggcaaaagtgccgtgaagatcgccgtggacatg

SEQ ID NO: 34634 - DNA, 409 bp, Zea mays
  Clone ID: LIB3060-052-Q1-K1-D5
catgacttcccacgctgctgtggtcgctcgtgggtgggggaaatgctgcgtctcgggatgctcaggcattcgcgtaaacgatgcggagaagctcgtgacgatcggaggccatgtgctgcgcgaaggtgagtggctgtcgctgaatgggtcgactggtgaggtgatccttgggaagcagccgctttccccaccagcccttagtggtgatctgggaactttcatggcctgggtggatgatgttagaaagctcaaggtcctggctaacgccgatacccctgatgatgcattgactgcgcgaaacaatggggcacaaggaattggattatgccggacagagcacatgttctttgcttcagacgagaggattaaggctgtcaggcagatgattatggctcccacgcttgagctg

SEQ ID NO: 34635 - DNA, 327 bp, Zea mays
  Clone ID: LIB3060-036-Q1-K1-H4
cttccttacgcgaactatgtattctttaatacacgagtatcctttcagaagggaacgttgattacattgttagtgaattatgtcctgagactccatccaaccaccaagattccctcgctcgaattgaaaagctttcacaagtaaacccgatgcttggcttacgtgggtacaggcttggtatatcataccctgaattgacagagatgcaagcccgtaccatttttgaagctgctatagcaatgaccaacctatgtgttcaagtgttcccagacataatgcttactcttgttggaacaccacagtaacttgggcatcaagtgactctta

SEQ ID NO: 34636 - DNA, 399 bp, Zea mays
  unsure at all n locations
  Clone ID: LIB3060-045-Q1-K1-H10
gcagctcaggtgcttgtctgaaccctgaaaggggagcaggaaacgtattccagcccggcctgggcgaagaaggccacagaggaaggctctccaccgtgttctccacaaatgcccaccttcaagttaggcctagctttgcggcccctttctgtagcaaacttaaccagctcgcccactcccctctgttcaggacctcgaaggggtcatgttgagatgccctgcgcgaattgaaaagcttcaaaggtaaacccgatgcttggcttacgtgggtgcangcttggtatatcgtaccctgaattgacaganatgcaagccctggccatttttgaagctgctatagcaatgaccaaccagggtgttcaagtgttcccagagataatggctcctcttgttggaaca

SEQ ID NO: 34637 - DNA, 418 bp, Zea mays
  Clone ID: LIB3060-051-Q1-K1-C1
cctctcaccttttcgctgtactcactcgccacacacaccccctctccagctccgttggagctccggacagcagcaggcgcggggcggtcacgtagtaagcagctctcggctccctctccccttgctccatatgatcgtgcaacccatcgagctacgcgcgtggactgccttccctgggtcggcgcaggaggggatcggaaggatggcggcgtcggtttccagggccatctgcgttcagaagccgggctcaaaatgcaccagggacagggaagcgacctccttcgcccgccgatcggtcgcagcgccgaggcccccgcacgccaaagccgccggcgtcatccgctccgactccggcgcgggacggggccagcattgctcgccgctgagggccgtcgttgacgccgcgccgatacagacg

SEQ ID NO: 34638 - DNA, 411 bp, Zea mays
  unsure at all n locations
  Clone ID: LIB3060-015-Q1-K1-G11
ccttttcgctgtactcactcgccacacacaccccctctccagctccgttggagctccggacagcagcaggcgcggggcggtcacgtagtaagcagctctcggctccctctccccttgctccatatgatcgtgcaacccatcgagctacgcgcgtggactgccttccctgggtcggcgcaggaggggatcggaaggatgacggcatcggtttccagggccatctgcgtacagaagccgggctcaaaatgcaccagggacagggaagcgacctccttcgcccgccgatcggtcgcagcgccgaggcccccgcacgccaaagccgccggcgtcatccgctccgactccggcgcgggacggngccagcattgctcgccgctgagggccgtcgttgacgccgcgccgatacagacg

SEQ ID NO: 34639 - DNA, 427 bp, Zea mays
  unsure at all n locations
  Clone ID: LIB3060-010-Q1-K1-H5
gctgtactcactcgccacacacaccccctctccagctccgttggagctccggacagcagcaggcgcggggcggtcacgtagtaagcagctctcggctccctctccccttgctccatatgatcgtgcaacccatcgagctacgcgcgtggactgccttccctgggtcggcgcaggaggggatcggaaggatggcggcgtcggtttccagggccatctgcgttcagaagccgggctcaaaatgcaccagggacagggaagcgacctccttcgcccgccgatcggtcgcagcgccgaggcccccgcacgccaaagccgccggcgtcatccgctccgactccggcgcgggacggngccagcattgctcgccgctgagggccgtcgttgacgccgcgccgatacagacgaccaaaaagagggtgttccactt

SEQ ID NO: 34640 - DNA, 380 bp, Zea mays
  Clone ID: LIB3060-045-Q1-K1-C7
gcggcggcggtttccagggccatctgcgtccagaaaccgggctccaaatgcagcagggacagggaagcgacctccttcgcccgccgaacggtcgcggcgccgaggcccccgcgcgccaaagccgccggcgtcatccgctccgactccggcgcgggacggggccagcagtgctcgccgctgagggccgtcgttgacgccgcgtcgatacagacgaccaaaaagagcaaatggcgcctcagtctcccgcgcgcaagctacaacggttcaaggtccggtgctgcggcggctgagccgtctaccgtgggagacaccttggaacgggaggagggcggcggcacagaggcaggcgcttcggctgatgagtcatccaaccggaagca

SEQ ID NO: 34641 - DNA, 419 bp, Zea mays
  unsure at all n locations
  Clone ID: LIB3060-027-Q1-K1-E7
ggcggcggcggtttccagggccatctgcgtccagaaaccgggctccaaatgcagcagggacagggaagcgacctccttcgcccgccgaacggtcgcggcgccgaggcccccgcgcgccaaagccgccggcgtcatccgctccgactccggcgcgggacggggccagcagtgctcgccgctgagggccgtcgttgacgccgcgtcgatacagacgaccaaaaagagcaaatggcgcctcagtctcccgcgcgcaagctacaacggttcagggtccggtgctgcggcggctgagccgtctaccgtgggagacaccttggaacgggaggagggcggcggcacagaggcaggcgcttcggctgatgagtcatccaaccggaagcagccgnccnctgttgaccccaagattgagaaggagctca

SEQ ID NO: 34642 - DNA, 293 bp, Zea mays
  Clone ID: LIB3060-038-Q1-K1-H3
gggctgaagaacgacaccgacctcacggcctctgacctcaaagagctcgtgggtcagtagaaggaggtctacctctcagccaagggagagccattcccctcagaccccaagaagcagctggagctagcagtgctggctgtgttcaactcgtgggagagccccagggccaagaagtacaggagcatcaaccagatcactggcctcaggggcaccgccgtgaacgtgcagtgcatggtgttcggcaacatggggaacacttctggcaccggcgtgctcttcaccaggaaccccaa

SEQ ID NO: 34643 - DNA, 324 bp, Zea mays
  Clone ID: LIB3060-020-Q1-K1-F2
gtctcttgccgtatcagaggtctgacttcgtaggcattttccgtgctatggatggactcccggggaccatccgactcctggaccctcccctccacgagttccttccagaagggaacatcgaggacattgtaagtgaattatgtgctgagacgggagccaaccaggacgatgccctcgcgcgaattgaaaagctttcagaagtaaacccgatgcttggcttccgtgggtgcaggcttggtatatcgtaccctgaattgacagagatgctaggcccggccattgttgaagctgctatagcaatgaccaaccagggtgttcaagtgt

SEQ ID NO: 34644 - DNA, 396 bp, Zea mays
  Clone ID: LIB3060-054-Q1-K1-D4
ttcagtctgagaacccgtcggcgtacattgatcaagtgattgccactggtctgccagcctgacctgtggctgctgtgggccaggttgtgttcactgctgaggatgctgaaccatggcattcccaagggaaagctgctattctggtaagggcggataccagccctgatgacgtaggtggcatgcacgctgctgtggagattcttacagagaggcgtgagcatgacttaccacgctgctgcggtcgcacgtggctggtggaaatgctgcgtctagacatgctcaggcattcgcgtaaacgatgcggagaagctcgtgacgatcggaggccatgtgctgcgcgaatgtgagtggctgtcactgaatgaatagactggtgaggtgatccctgtgaagcat

SEQ ID NO: 34645 - DNA, 385 bp, Zea mays
  Clone ID: LIB3060-036-Q1-K1-H3
ctcccggtgaccatgcgactcctggaccctcccctccacgagttccttccagaagggaacattgaggacattgtaagtgaattatgtgctgagacgggagccaaccaggaggatgccctcgcgcgaattgaaaagctttcagaagtaaacccgatgcttggcttacgtgggtgcaggcttggtatatcgtaccctgaattgacagagatgcaagcccgggccatttttgaagctgctatagcaatgaccaaccagggtgttcaagtgttcccagagataatggttcctcttgttggaacaccacaggaactggggcatcaagtgactcttatccgccaagttgctgagaaagtgttcgccaatgtgggcaagactatcgggtaca

SEQ ID NO: 34646 - DNA, 391 bp, Zea mays
  Clone ID: LIB3060-004-Q1-K1-D9
cgctgaatgggtcgactggtgaggtgatccttggaaagcagccgctttccccaccagcccttagtggcgatctgggaactttcatggcctgggtggatgatgttagaaagctcaaggtcctggctaacgccgatacccctgatgatgcattgactgcgcgaaacaatggggcacaaggaattggattatgccggacagagcacatgttctttgcttcagacgagaggattaaggctgtcaggcagatgattatggctcccacgcttgagctgaggcagcaggcgctcgaccgtctcttgccgtatcagaggtctgacttcgaaggcattttccgtgctatggatggactcccggtgaccatccgactcctggacccatccctccacgagtt

SEQ ID NO: 34647 - DNA, 416 bp, Zea mays
  Clone ID: LIB3060-006-Q1-K1-C10
aagataaggagtgtctctcctttgccattctcctctctttcagctaagtccctgccccgtgtctttttcttacattcaggtcctcgcagctcctctcttttttcttgtttctttcgatctgcgagccgtacaagtccagtactcttctttccctcaaggaactcttgcagccggcccctctggtttcctcgaattcttgttccccggtccctacttctgtccccgcgtagatccgtccgtccgaggagcacaccgtgcccacccccatgtttacccaccagttcctctgacggacgccgtgctccgatgaagctgagcgtgctccgtatccgccgttcccactccttctccgtcgccttactttactgggtctacgtcttctcatgaacgcattggccctcttcaactgctgatcc

SEQ ID NO: 34648 - DNA, 436 bp, Zea mays
  Clone ID: LIB3060-046-Q1-K1-B2
ggagtgtctctcctttgccatcctcctctctttcagctaagtccctgccccctctcgtgttcttacaggcaggtcctcgcagctcctctcttttttcttgtttctttcgatctgcgagccgtccaagtccagtactcttctttccctcaaggaactcttgcagccggcccctctggtttcctcgaattcttgttccccggtccctcctcctgtccccgcgtagatccgtccgtccgaggagcacaccgtccccacccccatgtttacccaccagttcctctgacggccgccgtgctccgatgaagctgagcgtgctccgtatccgccgctcccactccttctccgtcgccttcctctactggttctacgtcttctcatgaacgcatcgcccctctccaactgctgatccttcgccgtctctccctctctctttctc

SEQ ID NO: 34649 - DNA, 360 bp, Zea mays
  Clone ID: LIB3060-001-Q1-K2-A2
cgaccgggtcgctgcctccgatcctcttgctgcccagcaccctggctacttcagccaggtagccaggtgagaccgactagctcgatctagctgctgaggcgtggccatggagggcgacgacgacggcccggagtggatgatggaggtgggcggcgcgggcgccacagggaagggaaaaggcggcgcgctggacaagaacaagaagcgcttcagcgaggagcagatcaagtctctcgagtccatgttcgccacgcagaccaagctggagccgcgccagaagctgcagctggcgcgggagctcggcctgcagccgcgccaggtcgccatctggttccagaacaagcgcgcgcgctggaagtc

SEQ ID NO: 34650 - DNA, 418 bp, Zea mays
  Clone ID: LIB3060-002-Q1-K2-G9
gctgcctccgatcctcttgctgcccagcaccctggctacttcagccagctagccaggttgagaccgactagctcgatctagctgctgaggcgtggccatggagggcgacgacgacggcccggagtggatgatggaggtgggcggcgcgggcgccacagggaagggaaaaggcggcgcgctggacaagaacaagaagcgcttcagcgaggagcagatcaagtctctcgagtccatgttcgccacgcagaccaagctggagccgcgccagaagctgcagctggcgcgggagctcggcctgcagccgcgccaggtcgccatctggttccagaacaagcgcgcgcgctggaagtccaagcagctggagcgcgactactccgcgctccgcgacgactacgacgcgctcctctgcagctacgag

SEQ ID NO: 34651 - DNA, 444 bp, Zea mays
  Clone ID: LIB3060-002-Q1-K2-G10
gctgcctccgatcctcttgctgcccagcaccctggctacttcagccagctagccaggttgagaccgactagctcgatctagctgctgaggcgtggccatggagggcgacgacgacggcccggagtggatgatggaggtgggcggcgcgggcgccacagggaagggaaaaggcggcgcgctggacaagaacaagaagcgcttcagcgaggagcagatcaagtctctcgagtccatgttcgccacgcagaccaagctggagccgcgccagaagctgcagctggcgcgggagctcggcctgcagccgcgccaggtcgccatctggttccagaacaagcgcgcgcgctggaagtccaagcagctggagcgcgactactccgcgctccgcgacgactacgacgcgctcctctgcagctacgagtccctcaagagggagagcacacgctt

SEQ ID NO: 34652 - DNA, 377 bp, Zea mays
  unsure at all n locations
  Clone ID: LIB3060-053-Q1-K1-G5
ctcttctctgtactagctttcttcttcttcctcctcttcctcctcccaaacagactggatttcatcaagataatcctgaaactggagccaacaagcagacagagaaagaagagcaagaagaccggctcccagccgatacaaggtaggagtgagcagcgttagatcagttttcatcacaggatcgatatggtgacagtgagagaggagactcgcaaggggccatggacagagcaagaggacctgcaactgggctcaaccggacaggcaagagctgccggctgcgctgggtcaactacctncaccctggcctcaagcgtgggcgcatgtctccccatgaagagcgactcatcctagagcttcacgctcggtggggaaac

SEQ ID NO: 34653 - DNA, 424 bp, Zea mays
  Clone ID: LIB3060-041-Q1-K1-C5
gcgatcaatgatcttcttatacaggttactgctaattctgttcggttagtcagttgggcctcccgggagttagtgaatcaatggaatgcaccagcaggattctcagtcaatgttgcttcagctaatgccagccaggttctgttggcaaccggtggtggccatcttgtttacctggaaattagggatgctaaacttgttgaagtgaagcatgctcagctagaacatgagatttcttgtcttgatttgaacccaattggggagaatccacaatatagttccctagctgctggtgggatgtggacagatataagtgttagaatattttcacttccagatcttgaattgataaggaaggaaaatttgggtggagaaattgttcctcggtctggtctgctgtgcaccttggaaggggtttcgtatttgc

SEQ ID NO: 34654 - DNA, 434 bp, Zea mays
  Clone ID: LIB3060-017-Q1-K1-C5
ctccacgcgagcggacgacactaagcggccatagccgcacgttgggatcctctccgctacgcctgtcgatggtctccgccagcgcgccgccgtcgcaggcccagtccgacgcggccggctcggcggaggaagtgagcaagaaggtgcggaagccgtacacaatcaccaagtaccggaagagctggacggatcaggagcacgacaagttgctcgaggccctgcagctctttgatcgtgactggaagaagatcgaggctgtcgatggctccaagactgtcatgcagattcatcttacatccataggaactctggcatgaacgtgcctgtttgttcatgggctcatagttacatcccacaagctgatgcttcatcaatggtgaaagatttatgtgctggaacaccaggttcaaacaatttctgctcaagtagtactg

SEQ ID NO: 34655 - DNA, 260 bp, Zea mays
  Clone ID: LIB3060-023-Q1-K1-F3
agcatgcctatcctctccccgcccgcccgtgccgccgccgcggcttcccttcctctcccgagcggagatgaatgttgaaaagctcaagaagatggcaggtgctgtgcgcaccggggggaagggtagcgtgcgcaggaagaagaaggcagtccacaagactacaaccacagatgacaaacggcttcaaagcaccttgaaaagaataggagtgaacagcattcctggtattgaagaggtcaacatctttaaaggatgatggt

SEQ ID NO: 34656 - DNA, 428 bp, Zea mays
  unsure at all n locations
  Clone ID: LIB3060-010-Q1-K1-A4
ctcttgggtcangagaggctgcattcacttttattcttgatgatcctgcaggaaacagctttattgagaatccgcatgctccgttattagatcctttactatctgtgagattctacgaaagaactcgtgaacaacaagcagcacttggttttcttgctgaaccaccaaaagaacaacctggagaggctgtattgcctgcttcagcagtggaatccaattctgatgggttgcaaagcgtgccccatggctcagttggagctgttgcaggtcgtcgtgctatagctcagggaaaccctgatgaagttgctgcagcattgtgtagatattcagcaccagaagaggttgatactttaccatcaacatgtggagcctgtggaacagaatgcgtcacacgtttctttgctacaaaaatcccatatttccgggag

SEQ ID NO: 34657 - DNA, 260 bp, Zea mays
  Clone ID: LIB3060-042-Q1-K1-C3
acgctgcagccgcagttgccgcacgcgggaacttggacgtgctactcgcgactgctctggtcggttcccgcgtaggattcgttcacaatggcccgtgtgtatgtcggcaacttggatgcacgcgtgacttccggggaactcgaagatgagttccgtgtgtttggagttctgcgaagtgttcgggtcgcacgcaaaccacctggttttgcatttattgattttgactacaggatggatgcagaggatgctattcgtgatct

SEQ ID NO: 34658 - DNA, 423 bp, Zea mays
  Clone ID: LIB3060-054-Q1-K1-C12
gacccaatcgccgcaaacccctccggaatttcttatcccccctcatctgctccacctccgacctcgcgcgagacgagcaagcccaagtatggccggagcagcagcagccgccgtggcgtccggggtctcggcccggccggccgcgccgaggagggcttctgcgggacgccgcgctcggctgtcggtggtgcgggccgcgatatccctcgagaagggcgagaaggcgtacacggtgcagaagtccgaggagatcttcaacgccgccaaggagctgatgcctggaggtgttaactcgccagtccgagccttcaaatctgttggtgggcagccagtagttttcgactctgtaaagggttctcgtatgtgggatgttgatgggaatgagtacattgattacgttggttcctggggtcctgcaatcat

SEQ ID NO: 34659 - DNA, 207 bp, Zea mays
  unsure at all n locations
  Clone ID: LIB3060-046-Q1-K1-G7
ggtggacaagggccttgtcccgctcgccggctccaacaacgagtcgtggtgccaggggctggacggcctggcgtcccgcgaggccgnctactaccaacaaggcgcgccggtccgccaagtgccccaccgtggcaagaatccttaacggcccttccaagttcgccgtcaaggaggccccttggggcttggaacgttaggccgcctttt

SEQ ID NO: 34660 - DNA, 430 bp, Zea mays
  Clone ID: LIB3060-052-Q1-K1-D11
gaccgcgagagtgtacgtgccaccaggagcagcagcagcaatggccgccgccgccaccacctcctcatcctcccacttgctcctactctcccgccagcaggcggcctccctacgatgccgcctctccttcctcggccagcccagaaggcccggcagggtcacggcccatgcgccggccgctaaggacgtgcggtgcatggcggccgtggacactactgcggcgtccacggcggcggcggagacgagccccaagtcgagcagctacgagatcgtgacgctcacgacgtggctgctgcaacaggagcggaccggcgcgatcgacaacgagatgaccatcgtgctggccagcatatccacggcgtgcaagcagatcgcggcgctggtgcagcgcgcgcccatctacaacctgacgggcgttcagggcgccgtc

SEQ ID NO: 34661 - DNA, 125 bp, Zea mays
  unsure at all n locations
  Clone ID: LIB3060-019-Q1-K1-D2
ccagttctggctcggcggctcgtcggacaatctccagaacttccttaagatgatcggcggctggtacntgcctgccctcaaaggcgccggcatcaagtacgacgacccccgtgctctacctcgac

SEQ ID NO: 34662 - DNA, 417 bp, Zea mays
  Clone ID: LIB3060-027-Q1-K1-D8
agaacctgctgtcaagactcttactttggacccgacaaaatggggaatgagtgtagggcctctatccgctccggccgccaactgccatatgtacactgcactctgaaagccacatgaaaggatcatggctctggatcttactcacggcgtacatcgttctcatggttaccacactgacactaagaagatatctgcaactccaatattatgtgagacaatgccttacagattggatgaaagcactggattgattgattacgatcagttggagaaaagcgctgatctttttaggccaaagttgatcattgctggtgcaagtgcatatgctcggctatatgattatgaccgaatgcggaagatatgcaacaagcagaaggcaatacttctagcacacatggcacatattagtgggcttgt

SEQ ID NO: 34663 - DNA, 420 bp, Zea mays
  Clone ID: LIB3060-027-Q1-K1-E1
cagccatggtgctcgcgccggcgtcctcgactcctcagtctggcgcgctgttttttggtccatgtccctgtgcgcgagctgattcagcttgtcggtcatccactgctcctcggcgctccttgctcggcctccgacggctgtcgtccctcgccacgccctggccgcatcgctggctcccctcggttccagccatcagttgccgcggcatcctctcagttctcggtcagagaattcgcgcgccctcaagcgtcagccgcgtcgacctccctgctcgctgttctccagctcgctctggccgcggacaccgtcgagtcgtcgaaccccgtcctcctctgctcgactcccaagcaggctccctgatccacgtccttctcgccgtcgatttcccacgcctgtggccacggcactcgctcctcggat

SEQ ID NO: 34664 - DNA, 386 bp, Zea mays
  unsure at all n locations
  Clone ID: LIB3060-027-Q1-K1-E10
gccgccgccgcctcgccgacgagcactttaagatcgcctcgttcggggacctgggggacaccgtgttcggcgcgcacgggcggttcgccgtggacgtgatgctggtgctcagccaattcagcttctgcgtcggctacctcatcttcatctccaacaccatggcgcacctctatccgattgccgcgtcgtcctcctccgcgctcctctcccccaaggcgctcgtcatctgggcgatgctgcctttccagctggggctcaactccatcaagacgctgacgctgctcgcgccgctcagcatcttcgccgacgtcgtcgacctcggcgccatgggcgtggtcctcggccaggacgtcgccgnctggctcgccaagcccgtgcccgtggtc

SEQ ID NO: 34665 - DNA, 417 bp, Zea mays
  Clone ID: LIB3060-027-Q1-K1-E12
aaaaaaaagaataagaagaaaggaatccctcctacgcggaagcgaagagattcgtcgcctcagccgcctctctgctcagatctgcggcggagcctcgccggcggcctgcgccccgcggcgccgccgatccaagatgccttcgtgcgtgcagggatgctgctgctgctcgtccctgcgccttctcccccgcgacgacgcgctctcgtccccctccgcctgcgcgcaccgcctgaagccttggtcttggcgtgcccaatcccccacctcgtcctcctaacgcttgtccccgcccgctccccaccctgatctacctgtctctacccttccctcctccatttctacatctccccgttgctgctctgctcctgctgccacaagagtattcgccttcaatcgttgctcgcgcctgtcatttcg

SEQ ID NO: 34666 - DNA, 422 bp, Zea mays
  unsure at all n locations
  Clone ID: LIB3060-027-Q1-K1-E2
ccttttgctgcaaatctttctctgaattgtgggtctccgacaatggcggcgctcgctgcatccaagattctgggcacccagctcaacttcgcgggctcctcccgctacgccaccgcagcgcccaccgcgggggctcagaagattgtctcccttttcagcaagaagcctgcccagaagcccaagcccgctgcggtatcgtcgtcttctccagacatcagcgacgagctcgccaagtggtatggtcctgacaggaggatctacctgccggatgggctgttggaccggtcggaggtgccggagtacctcaccggagaggtccctggagactatggctacgaccctnttggcctgggcaagaagccagaggacttcgccaagtaccaagcctacgagctgatccatgccagatgggccatgctcgg

SEQ ID NO: 34667 - DNA, 421 bp, Zea mays
  Clone ID: LIB3060-027-Q1-K1-E3
ctcgttcttgagttctagcgagagtgcatcgtgtgagtgttgtggttcatgttcacgtcggtgtttactctccccggccatcagtgtctcattgggaacgccgcggtgccgccggtgaacgccgctgggaatgatctcgacatggcagaccttgtttggggccggttgcgtgcgtgatctagggttggtctgctctatggtgagtcgctagtgcctgctccaccgtggttgggaactctactgcgtcgtcgttccggcttaacaccgtcagagttgggcgccgccggcacgcgcagaggaagcgcgggcgcgcgtggtgctggagcctagggctgtaagcgctatctgagtgggccagttttgcctggagttgggctggctgggtcagttctggcccgagactgttcatgtgtttagcatt

SEQ ID NO: 34668 - DNA, 420 bp, Zea mays
  unsure at all n locations
  Clone ID: LIB3060-027-Q1-K1-E4
cggacgcgtgggcttccgcggactagtttnttctgaagattcggcgatggcggcgacgatgcaatccgtgaaggcgcgccagatctttgacagccgcggcaaccctacagtcgaggtcgacgtgttttgctcagatggaacctttgcaagggcagctgttcccagtggagcatcaactggtgtatatgaagctctggagttgagggatggtggctctgactatttggggaagggtgtctccaaggctgtgaacaatgtgaattctgttattggacctgctctgattggcaaggaccctacagcacagactgagattgataacttcatggttcaacaacttgatgggaccaaaaatgagtggggatggtgcaagcaaaagcttggtgctaatgcgattctggctgtgtcattagctgtttg

SEQ ID NO: 34669 - DNA, 419 bp, Zea mays
  unsure at all n locations
  Clone ID: LIB3060-027-Q1-K1-E5
ccctgtcgttgtgagaattcttaattcatgagttgtagggagggacttatgtcaccacaaacagaaactaaagcaagtgttggatttaaagctggtgttaaggattataaattgacttactacaccccggagtacgaaaccaaggatactgatatcttggcagcattccgagtaactcctcagctcggggttccgcctgaagaagcaggagctgcagtagctgcggaatcttctactggtacatggacaactgtttggactgatggacttaccagtcttgatcgttacaaaggacgatgctatcacatcgagcccgttcctggggacccagatcaatatatctgttatgtagcttatccattagacctatttgaagagggttctgttactaacatgtttacttncattgtgggtaacgt

SEQ ID NO: 34670 - DNA, 419 bp, Zea mays
  Clone ID: LIB3060-027-Q1-K1-E6
caaatatcctcgctcgcagtcgcagctactacgccgccgcacctccgcccgccacctgcttcccggctccagcgatgtcgggggcgatcgggggcgccgaggtccacggcttccggggcgcagcggcgcagctcccgcggtcccgggtgctcgggaggccgatccgggtggcgccacccgccgcggcccggccgggcggtgcgtccgcgggtagcatacgcgccgtctccgcgcctgcgaagaaggacgcttctgaagttaagcgaagcaaggttgagataatcaaggaaaagagcaacttcctccggtaccctttgaacgaggagttggtctcagaggccccaaatatcaacgagagtgctgttcagctgatcaagtttcatggaagctaccagcaaactgaccgagatgtccgtggg

SEQ ID NO: 34671 - DNA, 220 bp, Zea mays
  Clone ID: LIB3060-027-Q1-K1-E8
cgacccacgcgtgcgcggatgtgctgtcacaatggtttagtttttacacctacccagctccaaatgggacaggtatcctttgaaccgactgatgatcgcgaccacaaacgctcgcgaactcgactctactttgcgctataaccaccaaacctatcatgtccaactccctttcgtgacagtaccatgattactcaactatcagcacccttgtcgaccccag

SEQ ID NO: 34672 - DNA, 244 bp, Zea mays
  Clone ID: LIB3060-027-Q1-K1-E9
gacgagctcgccccggccgtcgggaccggccttcctcattgactcgaggcaacgaaggggccggatgggaaccacaaccttacccttaccccattagcccggccggcatgctggttcccgtctgctccgtcgcgcccagcttggtccccctctggccggtgacggcctcgcacgtcgtcgcgcgggttgcgcggagggtggacgtcggcgccgcgctcaagtcctacgccgactcgctcgtcgc

SEQ ID NO: 34673 - DNA, 415 bp, Zea mays
  Clone ID: LIB3060-027-Q1-K1-F1
cacctttgttttgctgtaattttaaacaaataagtatcctgatgatagtgatgttttggtagatcatctgataatctctattactctatatgaccatatgcacttgacatccagaaaattggtttgacattcaggcaaagtaggaatgactggggactggcttgaacatttaacttttgcagtgtatttgcttccattttttcttttgcaattaaacctggtcctggtaagcaagcacgaaatgaccccaacttagcggcacaatagtagttgttacatagcatgattcttgtcatacacgtgcatcagcattgtttattgagccgtctcgctgaggagggggctcaagttccccagaggaccagtgcttgatgggttgacgtcgctgggccctaaggttctctcgatgctgatt

SEQ ID NO: 34674 - DNA, 386 bp, Zea mays
  Clone ID: LIB3060-027-Q1-K1-F10
ctcgatcctagcttcccttccaagaagtcgcagcgcccatggccatggccacgcaagcctccgccgccacgcgccacctgctggccgccgcctgggcgccggcggcgaagccgcggcagctgagctcgcagctcgcgctgccgtcgtcgtcctcccgcgggccggccccgctccgcgcgtccaccgaggaggcggtggaggcgcccaaggggttcgtggccccgcagctggaccccagcacgccgtccccgatcttcggcggcagcacgggcgggctgctccgcaaggcgcaggtggaggagttctacgtcatcacgtggacgtcccccaaggagcaggtgttcgagatgcccaccggcggcgccgccatcatgcgggagggcccc

SEQ ID NO: 34675 - DNA, 380 bp, Zea mays
  Clone ID: LIB3060-027-Q1-K1-F11
gtgcgcgctggcgtcaagaacgccccgttgggtttgttccttgtggctaaaggagaaggaccggcagctgtttaacctggtggagtgtgacctggagaagagccgcaggaaggcatcgtttcagccatcggcaatgcttccttggtggtgtgctccatcggtgcaagcgagaaggagatcctggatgtcaccggcccataccgcatcgactacatggccaccagcaaacttgtacaagctgcgactgctgccaagcaggtggagcacttcatcctggttacatccctggggaccaacaagatcggcttccctgcattcctcttgaacttgttctggggagttctgttctggaaaagacgagctgaagaagcactcatcgc

SEQ ID NO: 34676 - DNA, 397 bp, Zea mays
  Clone ID: LIB3060-027-Q1-K1-F12
gcaagatgaagatcaagatgatccagatgaacgacatgatcctgactctgatatggaagtggatgaccacaaggctgtggaagagtcatcgaggaggagcattctaggtataaaaatcaagagagaatttggtgaaaatgcgaccagagtacaggatggtggcagggttgcatctgaacatagaggactggaacccatggcagaagacattggttcctccaagcaagctcctgcagatgccagtgcaatggccatcgatgaaccaagcaatgtcaagaatgaacctgagagctcaactaaattgcaaggccaagcagctgcgtaccacaagccatagctgcgaccatcaagagttgctgggtttctgctaggcaacttcctgcttgatttggacagt

SEQ ID NO: 34677 - DNA, 415 bp, Zea mays
  Clone ID: LIB3060-027-Q1-K1-D7
gaaacgtgctttggaggctttccgtttggacccggcgaaatggggagtgaatgtgcagcctctatccggttcgcccgccaacttccatgtatacactgcactcttgaagccacatgaaaggatcatggctttggatcttcctcacggtggacatctttctcatggttaccagactgacactaagaagatatctgcaacttcaatattttttgagacaatgccttacagattggatgaaagcactggattgattgattacgatcagttggagaaaagcgctgttctttttaggccaaagttgatcattgctggtgcaagtgcatatgctcggctatatgattatgaccgtatgcggaagatatgcaacaagcagaaggcaatacttctagcagacatggcacatattagtgggctt

SEQ ID NO: 34678 - DNA, 412 bp, Zea mays
  Clone ID: LIB3060-027-Q1-K1-C12
aaggatttgcagtctattggttgtggggatttggatattgaaggtcttactgaatccatatatgttgcccacaaagatgagtacacagaatttgagcaggcatcactcaggcagctatttcagtcaaagatggctgaactgagagctgaggctaagcaacaatctgagtctactggctcaatcggacgtgcaaaaggagcatctttgaccacatcaccacagcatcagatatctgttactgtagtaacggaatttgttcgctggaatgaggaagccataaccagatgcacactactgttttctcagcctactactgttgcagctaacgtgagatccatatttgcatgcttgcttgatcaagtgagccaatacttaactgaagggcttgaccgtgctagagagagtttaaatg

SEQ ID NO: 34679 - DNA, 343 bp, Zea mays
  Clone ID: LIB3060-027-Q1-K1-C2
ctgagctgagctgagctcaccaccaccacacacgggagatagctatagctagcatagcaaggcggccagtcagcgacttagcagcagctagctagccatgctgccgtccttcgtgtcgccgacagcgagcgccgcggccttggtgacgccttacgcgcggccgataccaggcagctacgggccaccggtgctgggcccgctacgggaccggctcgactacttctggttccagagccaggacgagttcttccggaagcgcgcggcggcacaccgcagcaccgtgttccgcaccaacatcccgcccaacttccccttcttcgtgggcgtggacccgcgcgtggtc

SEQ ID NO: 34680 - DNA, 409 bp, Zea mays
  Clone ID: LIB3060-027-Q1-K1-C4
gccggaagcgagcggagaccgaggggagggggtgaagaagcaacgagacgcagcgagcaagcgaaagcataccagagcaccaagcataggggcgcgcgcgcttctccagttctccctccctgccctgcaaggcggctgcaactgttccagctagcccctctcccagcctctgggtcgtagacgtagtagtagcagccgcagcagcagaagcggcggcgagcatgctcttggcacccctccccggcgccgggcggatctgccggagggcggcggccggggcgcttggagcgcggcgctaaccgcgttcgacggacctcgggatctgacgccgggcctaccctaatcggtcgactccatcggtggcggcggcggccgaggcgccagcagccgggtctctcggctccgggac

SEQ ID NO: 34681 - DNA, 414 bp, Zea mays
  unsure at all n locations
  Clone ID: LIB3060-027-Q1-K1-C5
ggagcctgaaagatcgagaagccaaacccacaggcagagaatagcacggtttcgtcgatccgatccgcgacgatccacagccatggcgatggcttacaagatggcgacggaggggatggacgtgaaggaggagtgccagcgctggttcatggagatgaagtggaagaaggtgcaccgcttcgtggtgtacaggatcgacgactgccgctacgccgtcttcgacttcgacttcgtcagcgtcgacaactgccagaagagcaagatcttcttcatcgcctggtcaccggcggcgtcgaggatacgggccaagatcctgtacgcgacgtcgaagcagggcctgcggcggctgctggacggngtgcactacgaggtgcaggccaccgacccctccgagatgggcttcgacgtcatcag

SEQ ID NO: 34682 - DNA, 395 bp, Zea mays
  Clone ID: LIB3060-027-Q1-K1-C6
cagatcctgcggcgaattccttccaactccaggatcgagagcacacgcagatggcgaggcacccccgtgcgccgctgctccggcgtctgctcctcctgacggccctcgcggcctcctgctcctactacctcctcttcctgcaggcgcaggcctccgtcccgccgcggtacgacgggttcgcctacggcggcggcgccgcgacggcctggaaggacgccgtcctcgtcgaggcctttctcgacccgctctgccccgacagccgcgacgcctggcagccgctgaagctcgccgtcgagcgatacgcgccgcgggtctcactcatcgtccacccgttcccactaccataccacacatatgcattctatgcctgccgcgcactttacatagcttacaag

SEQ ID NO: 34683 - DNA, 388 bp, Zea mays
  Clone ID: LIB3060-027-Q1-K1-C8
gtgctgtagatacgagatcccgcagcgttcgttgttgcaccggccggctagctgctggcttgcgacaggactaggactaggaggaggaggaggtgtgtgactcctgctgccagaccacacaagctcctcctccgtgagccaccgcggcagcaagaataaccttgacgatcaagaagaagcagaggagcacgacctgctgcctccgccaggaggggacgacgtcgttgacgcgcacgacgacgagtgcaaggacatcggcgtcgtgccggacgacgaggccaagaagtcctcctccgtcgcgcctagcgctgccggcggcgatccgacgatagcctcatccgagggcgccgaggaagcgaaggaaccgttccagagccctgctgacgcc

SEQ ID NO: 34684 - DNA, 351 bp, Zea mays
  Clone ID: LIB3060-027-Q1-K1-C9
ctgcttcccatttttctttctttgctgtaagatgagttccctgatgttcgactcaacattataagcaaacttgatcaagttaaccaggttattggaattgacttgctgtcgcaatcacttctgccagccattgtagagctctctgaagataggcactggagagttcggcttgccataattgagtacatacctttgttggccagccagttaggtgttggtttttttgatgacaagttaagggcactttgcatgcaatggttggaaaataagggtttctcgatcaaagatgcttgtgccaataatttgaaacgtttgacagaagaatttggcccttaatgggcgatgcaacat

SEQ ID NO: 34685 - DNA, 380 bp, Zea mays
  Clone ID: LIB3060-027-Q1-K1-D10
catgtatacatcagatgattccaaatctgctgaaatgtgtttactagccttctgcgactataattgtatcacattggagtcccagaggatcgggctccttttatagccccaaggtgccctctcctggtatgcaagcatcacatgtgctcactacaactccgagactccacgaccacactgtttagtgatttgagagagattcgagcgcatttatgaactgtgactctatcgtcctattattgagctcttgtatttgctttcatgtgtgttgctgatgtgttatatacttgcgtgcgttctactgcctcccttactctgattttggattgtgatcatatcgtgtacggcgtgagagacttcgacttattaagatttctcac

SEQ ID NO: 34686 - DNA, 318 bp, Zea mays
  Clone ID: LIB3060-027-Q1-K1-D11
atgcaaaccagacagccagggattccctaattggtcattgcgttcttcctcttctttgttttggggttggccggcgcggttgccgccgccgtcgacgcggaggaccctgtgatccggcaggtggttcccggtggagatgacaacgatctggagctgaacgcggagtcccacttcctgagcttcgtgcagcggttcggcaagtgctacaaggacgccgacgagcacgcgtaccggctgtccgttatcaaggccaacctgcgccgcgcgcgccggcaccagctgctggacccgtcggcggagcacggcgtcactaagttc

SEQ ID NO: 34687 - DNA, 419 bp, Zea mays
  unsure at all n locations
  Clone ID: LIB3060-027-Q1-K1-D2
gattgaggacaagaagacagagctggagcccaaggtcgtggaggcctacgaagcatgtnctgctgaggtcaaggctctgttcaaggataagaagccagtcaaggtcagcaagaagaactcggctgcagtcaccaagttcctcgatgagctggctaagattgacttccctggagccaaggtggtgagcgaggcggtggccaagtccggcacctcgcccctgcttccggcgatcaccttcatcttggacaaggtcgcaccgtttatccccaaggaggagcccaaggcggagccggcggcggaggccacctnccgggaagtcgccgtggaggagaagaaagaggaggccgagccagctgcagcgaccgaggcggcaccggcgccggcagagacaccgtccgaggcggcggtggtagaggaga

SEQ ID NO: 34688 - DNA, 423 bp, Zea mays
  unsure at all n locations
  Clone ID: LIB3060-027-Q1-K1-D3
attagcctatgctgtggaccaaggttttcaaaggggaggtgaaccaccgtaagtgtttaaggcgcctaatggctaatttcaggaaaaaaatcaagggtgatgtgctgaagtatatgtggccttgtgcatgggcatgtacagatcatatgtatgatacactaatggagaaaattgcagcatctagtcctaaagcaattcactttctaaacaataaccacaagctaaaatggagtagatctaaattctccaaagaatgcaaggttgattatgtgaacaataacatctcagaatgcttcaacaattggattaaagattacaaagatctcccagtcgctgatctaatggataagattagggagaaaattatggagaagatttatacaaggcangagatagccaatcgaatggaaaggcgtatcctac

SEQ ID NO: 34689 - DNA, 407 bp, Zea mays
  Clone ID: LIB3060-027-Q1-K1-D4
agccaccatcgaccttcaagtctcgctacgtagcagtgcaataaaaaaagcagccgcaatggcgagcagcaccatggccctctcctccacggccttcgccggcaaggccgtgaacgtgccgtcgtcgtccgccttcggcgaggcccgcgtgacgatgcgcaagacggcggggaaggccaagccggcggcggcgtccgggagcccgtggtacggccccgaccgcgtgctgtacctgggcccactgtccggcgagccgccgagctacctgacgggcgagttcccgggcgactacggctgggacaccgcggggctgtcggcggacccggagacgttcgccaagaaccgggagctggaggtgatccactcccgctgggccatgctgggcgcgctcggctgcgtcttcccgg

SEQ ID NO: 34690 - DNA, 251 bp, Zea mays
  Clone ID: LIB3060-027-Q1-K1-D5
ggctcatgcatactcctggcctgtatataggtaagccgacgaggctgacgacgccgtcgagctgagaccctgtgatccggcacgtggcaccggcagataatacaacgaacacaatctgacacggattccaacttcctgagctaaatgcagcgactacgcaagcactacaaggacgccaacgagcactcgaaccaactgttccaattcaaggccaacctacgacgcgcacgccaacaccagatgctgcaccc

SEQ ID NO: 34691 - DNA, 422 bp, Zea mays
  Clone ID: LIB3060-027-Q1-K1-C10
gcatatggttttgagaaaccatctgctattcagcagagaggaattgttcccttctgcaaggggcttgatgtcattcagcaagcacaatctggtacaggaaagacagcaaccttctgttctgggatcttgcagcagcttgactatggtctggttgaatgccaggccctggttcttgctcccacccgtgagcttgcacagcaaattgagaaagttatgcgcgcacttggtgactaccttggtgttaaagtccatgcatgcgttggaggaacatctgttcgtgaggaccaaaggattctcgccagtggtgtgcatgttgctgttggtacacctggtcgtgtgtttgacatgctgcgtagacagtccctacgccctgataacatcaagatgtttgttcttgatgaagctgatgaaatgctttctcg

SEQ ID NO: 34692 - DNA, 423 bp, Zea mays
  Clone ID: LIB3060-027-Q1-K1-A5
cacacgttcacggtagcgagagcttatcgtcgtcggcggcgaagatggtgtcgctgaagctgcagaagcggctcgccgcgagcgtcctcaagtgtgggaaaggcaaagtctggcttgaccccaatgaagtcagcgagatctccatggctaactcccgccagaacatccggaagttggttaaggatgggtttatcatcaggaagcctcagaaggttcactctaggtcccgtgcaagaagggcacatgaggccaagcagaagggaaggcactctggatatggcaagcgcaggggtaccagggaggctaggctccccaccaagattctgtggatgaggaggatgcgtgttctgaggcgcctgctccgcaagtaccgtgaggccaagaagatcgacaagcacatgtatcatgacatgtacatgaagg

SEQ ID NO: 34693 - DNA, 342 bp, Zea mays
  Clone ID: LIB3060-027-Q1-K1-A6
cgcacgttcacggtagcgagagcttattttcgtcggcggcgaagatcgtgtgggctcgagctgcataagcggctcgccgcgagcgtcctcaagtgtgggaaaggcaaagtctggcttgaccccaatgaagtcagcgagatctccatggctaactccagccagaacatccggaagttgattaaggatgggtttatcatcacgaagcctcagaaggttcactctaggtcccgtgcaagaagggcacatgaggccaatcacaagggaaggcactctggatatggcaagcgcaagggtaccagggacgctaggcttcccaccaagattctgtggatgaggaggatg

SEQ ID NO: 34694 - DNA, 377 bp, Zea mays
  Clone ID: LIB3060-027-Q1-K1-A7
cacgcgtgcgccgatgtggaactattggtgtctgctttatctcgaatagtaacaccagctggaacctgtactatcgttgggtacattgaacgtgaccccttttacacccgtggtgagtgatcaagttggtacagagtgcactcctcgacttcaacgcaacccagctgtgtccagggaccttgttctatactgtaacttctacgaagtaatcggctcagatcagagtaaccataaacagtcatcttatggactatctactctaattatcatggaggaattttcttaactccacttataatcttaatagtatacgcttgtatttacatatcactacgtgtttataatataaccaaacacatctcagttatgattcatac

SEQ ID NO: 34695 - DNA, 415 bp, Zea mays
  unsure at all n locations
  Clone ID: LIB3060-027-Q1-K1-A8
gtaatgtgcgagatgtgaggaattccatatttgtgtggcgaggcaagccgtgcgacaagtgccagatgtacgatgaaatgattgaatcggagagcgtcaccgtttgtgtggattatcaagtcaggcaaataacggagtactatgtctgatcgctaaatcggctgtggtgcatatgtgttgctctatagcgacgttagggaagggttcctctctttttcctttgtatgatagtatgttgctcatgatgtagtgtgaaaagatatatcctatttgtgtggtggaacaaataatgcgtagaatactgattggaatgccttgctataaggtgctttatttgtcagaatcccaatntaattatgatggtatagttatgctagagagtataaattaagtacattctagttgtattgacatg

SEQ ID NO: 34696 - DNA, 383 bp, Zea mays
  unsure at all n locations
  Clone ID: LIB3060-027-Q1-K1-A9
aacaaggcattggtttaattggtttttcgaggtccaaaaggtgttggaatgccagaggggatgatgctggtgtttgcaaaaaattgccaagtactacaggtccctttgccctggataatgggttgagaaatggaacgagcagaaggagcatgggacgttttcaggacctntctgaatgtaccgaccgagaccttcagttggaccagtcaacaagttggccaggcagtcctactgttccattctgcattcctactttcagaatcgtaaatgccttttgtcccttgctctttaaccagtcaccacaaaactgttagtgatgcctctcgtatgcagctctaataatttggctacagttgccccacatgcagacttgttttgggtgt

SEQ ID NO: 34697 - DNA, 425 bp, Zea mays
  unsure at all n locations
  Clone ID: LIB3060-027-Q1-K1-B1
ctttgaggagagacgagatcatgaggaagcaatactcccctgtgctctccttgtgcgtgatggcccttgtcgtagctgctatggtctgtgtcatgtacaccacctcggcacaagcaggtaaggctgtgtttggaagtgtagttgcagttttgaaacaatactgtagtgtttagtgatactatagtattgtaactcaaaaggtgtttgttttgtacaggtaaaacatagttttaaatattatggtttacctaaaaccatggtatttttggaattttcgaaactccactcatcatcttagtgttcttttcttctctttacaaattactttgtttttctaatagaaccaaacagatctcggttttgagtaatactgtagttntattacaataatataataccgtagtatttatgtcatgtataattct

SEQ ID NO: 34698 - DNA, 405 bp, Zea mays
  Clone ID: LIB3060-027-Q1-K1-B10
agcaacagtagccccatcctcctcgttggtcgtcgtcgccgcctcacagcctcgcccgtgaccccgcccggcgccagatgcatacgaccaggaggtcagcgcccccgcctagcactagccgcatgcagcctggtggttagcacctcacctcactctagcctccagcctgcacctacaagggccccacaggcagcgcccctgcctggtagccagccacagtcggctaggcggtcaacgcccttgcccgccgcccatgccacacaccggcatccggccagccactgcttcactgtgctccagtagatggtgtgacgcccccatccctcgctctcgctcttcctggctctgatctgatccaccttctgcgttaggctcgattgcttaccggccatggtgcagtccatc

SEQ ID NO: 34699 - DNA, 416 bp, Zea mays
  Clone ID: LIB3060-027-Q1-K1-B2
ccaaagaattccctcccctagccgccgtcgccgctcgtctccctgagaggtgccgggaccgaggaactggccgagttctaggtagagaatcggttttgcttgtctcagcacggggtctgctgcgtctggtggtggtgaaggggagaaattcgtgagatctgttccggatcaggcgtgcgagctcgggaatcaggggtttcacacatagcttcgtcgatttgaatttgatgtactaatggagtctaagggtggcaaaaagtctagcagtagtcgttccatgatgtatgaagctccccttggctacagcattgaggacgttcgacctgccggaggcgtgaagaagttccagtctgctgcttactccaactgcgcgaagaagccatcctgatatcccttttggcttcctcattctagta

SEQ ID NO: 34700 - DNA, 420 bp, Zea mays
  Clone ID: LIB3060-027-Q1-K1-B3
ccgaagagttccattccctagccgccgtcgactatcgtcttcctcacaggttccggggccggggaactggccgagctctaagtagagaatccgttttcattgtctcagcacaggctctgctgcctctggtggtaatgaaggggacaaattcgagacatctcttccggatcaagcgttccaactcgataatcactgatttcacacatagcttcgacaatttgaatatgatgtactaatggagtctaaagctggcaccaagtctagcaggaaacgttccatgatgtatgaagcttcccatggctacagcattgacgacactcgacactgccggaggcgtgaagaactcccagtcatgctgcttactccaactgcgcgaagaagccatcctgatatccctttcggcttcctcattctagtagt

SEQ ID NO: 34701 - DNA, 241 bp, Zea mays
  Clone ID: LIB3060-027-Q1-K1-B4
cctagctgtaagtagagaatcgatgtacaccgcctcagcacaggcactgctgcgtctggtggtaattaaagggacaaattcgagacaacactgccggatcaagcgagccaactctagaatcactcattacacacatagcttggacaaatagaacataatgtactaaaggattctaaagctagcaccaagtctaacatgaaacgttccaagatgcatgaatcttctcatggctacagcattg

SEQ ID NO: 34702 - DNA, 402 bp, Zea mays
  Clone ID: LIB3060-027-Q1-K1-B7
gaccgacgcgcccgttttctcctgaaaacagaaggctccggcctccggcatccgccaaaaaggggaaaaaaaggagagagaacacacacacacaaaccccaatcccctgcggcggcgatggacccgtcatcggcgggctccggcggcaactccctcccgtccgtcggccccgacgggcagaagcggcgcgtgtgctacttctacgacccggatgtgggcaactactactacgggcagggccatccgatgaagccgcaccgcatccggatgacgcactcgctgctggcgcgctacggcctcctcaaccagatgcaagtgtaccgccccaacccggcccgcgaccgcgacctctgccgcttccacgccgacgactacatcaacttcctgcgctccgtcacgccg

SEQ ID NO: 34703 - DNA, 258 bp, Zea mays
  Clone ID: LIB3060-027-Q1-K1-B8
gtttcgctccccggcgccgtcgtcatgatgccgcagcagcagcagcccggcatggccggtcctcctccacaggccgaccccggagcgccgccacactggggcggcatcccgccgcctatggcccctcagcatcagtacgcgccaccaccgacccatcaggccgccgccccgacggagctgtggcgccaggcgcgctagtcctacgacccgactgaggccgagtacggacacgcgcagaggccgtcccaggccgcgtat

SEQ ID NO: 34704 - DNA, 249 bp, Zea mays
  Clone ID: LIB3060-027-Q1-K1-B9
ctgttagctgtgtgccttgcctgtatgctagtcggcattacattaacgaggctactctcgaaacgagactagacaaaagataatacttcaacgcattcctgatttagagctatgttgaagtacatcatcgcgccacttaccgaccaaacaatgcttctcaccactactcttatagcatactcaggtctacaacaggcatttgtatgggcggtattcacacagagtctcgtaacacccgttcttggcatc

SEQ ID NO: 34705 - DNA, 379 bp, Zea mays
  Clone ID: LIB3060-027-Q1-K1-C1
gtgagaggctccaactcgcaactccgtagctgagcacgccgaaaagctcatcagtgctcatcccctgctggcccgttctcagtcccagtgagaggctccatgaagatcctggtcgcggtgaagcgggtggtggactacgctgtcaaagtgcgcgtgaggccggacgggaggggcgtggagacggccaacgtgaagatgtccatgaatccattctgcgagatcgccgttgaggaggcgctgcggctccgggaggccggcgtcgccgctgaggtcgtcgccgccaccgtaggccctgcccagtccgccgacacgctccgcaccgcactcgccatgggcgccgatcgcgccgtccacgtgctccacgacccggaccctgcgc

SEQ ID NO: 34706 - DNA, 422 bp, Zea mays
  unsure at all n locations
  Clone ID: LIB3060-026-Q1-K1-G12
gagcattttactttcagtcaatgacctactggcatgctgcggttntatgtgcggcgatgggtgtgatggaggctatcctatagaggcatggcgctactttgttcaaaatggtgttgttacggatgagtgtgatccatacttcgacccggtcggttgcaagcatcctggatgcgaacctgcttatcctacaccaaagtgtgaaaagaaatgcaaggagcagaaccaagtttggcaggaaaagaagcatttcagcattgatgcgtacagaataaattcagatccacatgacataatggcagaggtctacaaaaatggtcctgtagaagttgctttcacagtttacgaggatttcgcacactacaaatctggagtgtacaagcacatcaccggtggcattatgggtggccatgccgtcaagttga

SEQ ID NO: 34707 - DNA, 203 bp, Zea mays
  Clone ID: LIB3060-026-Q1-K1-G4
accacgcctcctcctacaccagcttttcatttttaatctattcattgcctccgcttcgactaggtgctataggactggtcgaacggtacccttccatacctcccggatgtcctcaagatactactccatgacaagccctaaaacttattcctaatcctgcctaatcaccacgcaacctacgacatactccattactgacccta

SEQ ID NO: 34708 - DNA, 326 bp, Zea mays
  Clone ID: LIB3060-026-Q1-K1-G6
atttctttttttttgacacgaggaactcatcatgaatccactaattgctgctgcttccgttagggctgctggattggccgtagggcttgcttctattgggcccggagttggtcaaggtactgctgcaggacaagctgtagaaggtattgcgagacagccagaagcagaaggtaaaataagaggtactttattgcttagtctagcttttatggaagctttaacaatttatggactggttgtggcactagcgcttttatttgcgaacccttttgtttaatcctaaaaaagaaaatgagtcctttagattagatacttttttctttttt

SEQ ID NO: 34709 - DNA, 130 bp, Zea mays
  Clone ID: LIB3060-026-Q1-K1-G8
cccggtcgactccacgcgtccgcccagcgaccgtctccaccagcgattccgctctatcctatccatggcctccgcttcgactcgtggctgtaggatgcatcaaaccctaccgctccagacctcccggttg

SEQ ID NO: 34710 - DNA, 368 bp, Zea mays
  Clone ID: LIB3060-026-Q1-K1-G9
gcctgccatcagttcaatttgtttttctgctattttattgcatttggtcaaagttgatttcttttacatgcataacctcatgaatgcatgtaccttctctatgtaaatatatgatctaggtatctgataaagtttgaacacctttattttggtttactagttaatagcactatttttactctgggaatgccatggcatggattattgccattcacaaagtggtcatttatgtacatagcttaggtaattttttcatgaactatcttggttttcagaaggcctttgaagcaacaatattagaacaagtcttcatatttaaactgcatgttataggttttcacatttctatagggaaaactggaatatta

SEQ ID NO: 34711 - DNA, 418 bp, Zea mays
  unsure at all n locations
  Clone ID: LIB3060-026-Q1-K1-H10
ggaaaaatatccccaaaccctagctcccgatctcgatggcgaaccctcgcgtcttcgtcgacatgaccgtcggcggcgccccggcgggccggatcgtgatggagctgtacgccaacgaggtgcccaagaccgcggagaacttccgcgcgctgtgcacgggcgagaagggcgtgggcaagtccgggaagccgctccactacaagggctccaccttccaccgcgtcatccccgagttcatgtgccagggcggcgacttcacccgcggcaacggcaccggcggcgagtccatctacggcgagaagttccccgacgagaagttcgtgcgcaagcacaccgnccccggtgtgctctccatggccaacgccgggcccaacaccaacggctcccagttcttcatctgcaccgtcgcgaccccttg

SEQ ID NO: 34712 - DNA, 356 bp, Zea mays
  unsure at all n locations
  Clone ID: LIB3060-026-Q1-K1-H11
gcgagcgcacgcacgtaagcacgttgtcggaagctcaagttagaagaagcaccagtgcctgatcgatggcggcccaggctctcctctccggccggcagctgctgggccgccccgtgcagtcggccgtctctaggtcgtcggcgaggaaggcgcccttcgtcgtcagggccagctccagccctccagccaagcaaggtgccgacaggcagctgtggttcgcgtccaagcagtccctctcctacctcgatggcacgctgcccggcgactatggcttcgacccgctgggcctctcggacccggagggcaccggnggcttcatcgagcccaagtggctggcctacggcgaggtgatcaac

SEQ ID NO: 34713 - DNA, 400 bp, Zea mays
  Clone ID: LIB3060-026-Q1-K1-H12
aacccacctgtccatatgactggtagtggtaggcctaatgctccgccataccgtcttccagttcttccaatggacgatgatgaaatctcatccaaagttcttctagcagttgaactttgctaattgaagctgcaaaaggaacttcgatagatcagcattacgaggcacagcagtgaaagccccatgtttaccttttccacggcttactcctcttggcgaacctccttcaccaagagctgcacatgtagcaactgctgttgaaccatggtggtcattcagggtggaattggtccagctggcttatccgctgaggaccttcatgtcttgatcttaaacaacaacgaccgcgatggcatagagtggtggttcaaggtcctggtccatggtatggatatgtgat

SEQ ID NO: 34714 - DNA, 272 bp, Zea mays
  Clone ID: LIB3060-026-Q1-K1-H2
accactcctgttcgtggtgcacccacgcgggcgaacagtgaaaggcatcgtctcgacgtctcgtgaccgctgggctcggcgccgccccaggctagctcgatgattgggtgcgccaagccgctcgcggcgccgctgcaggcatgggctcgcccgccgtctcccgccggtcgccgcctccccccctcgttctgcgcccctgacacctgcccagctctcacccgtgccgtcgagagcccaggccagtctcagtctgacgaacgccccgcaccacg

SEQ ID NO: 34715 - DNA, 460 bp, Zea mays
  unsure at all n locations
  Clone ID: LIB3060-026-Q1-K1-H5
acgaagtatctcaggttgcgaggtgcgacaaaccgacaagccaacaatggcgtcgtcagctgcgacgaccgcgaagccgatcgcgctcccgccggcgccaacccgctgcggctgctgctgctggaggacacgcaggcccgcgatccccgcggaggcggcacgcctcaaggtctccgnctccgacggctcgtcggacgtgccggacttcctctcgtgcaattggcttgaaacccgcaagagaaagcccttcggtcccaggttgaattgtagtgcacaagaagcagtcgaataccagctagagtccttaagtacaatgatctgccccgaccagattatgggatagaggtcatgtaccggtttgcaggctttgaccctttcgagaggtcaacttactttggacgacagtttgatctatgacagttcgagcgctttcggcgtctgtttcaccactcaacctaca

SEQ ID NO: 34716 - DNA, 375 bp, Zea mays
  unsure at all n locations
  Clone ID: LIB3060-026-Q1-K1-H6
ataaaaccagtgcaagcagaagcagcgcaatggcgagcagcaccatggccctctccggcacaggcttcgccggcaaggcagtgaacgtgccgtcgtctctcttcggcgaggcccgcgtgacgatgcgcaagacggcggcgaaggcaaagccggcggcgagctccggcagcccgtggtacggccccgaccgcgtgctctacctgngcccgctgtccggcgcgcccncgagctacctgacgggcgagttcccgggcgactacggctgngataccgcggggctgtcggcggacccggagacgttcgccaagaaccgggagctggaagtcatccactcccgctgggccatgctgggcgcgttgggctgcgtgttcccgg

SEQ ID NO: 34717 - DNA, 330 bp, Zea mays
  Clone ID: LIB3060-026-Q1-K1-H7
cgcgttcgcgagaggagtccctacgcaagcctttacatttcctccatcgctctcgaccaccgccggctggggcgcctaggctgacccgcctgtgtccgatgcccccacgcgcgccaccgcgccggcagcctgctcccgacgcgggaggccccggcttcggcgactccgtgcgtgtgctgctcgcgctggccgggctctacgccgtcatgtcgctcctcgactaccgcgtcatccacatgcgccacgtcgcgccgctcggcgccgacgcgccgcgatgaaacttctccgacggacgcgtgctacatcacctccgacgcctcgctgttgaca

SEQ ID NO: 34718 - DNA, 369 bp, Zea mays
  Clone ID: LIB3060-026-Q1-K1-H8
gtcttgaattcccggggatggttctgccgttcaagagagttctagttgtgtatatgaggttgatgaagttaccactcacgatgatgtgggagaaaaacaggccttgggtccagctgttgatgcttacaccaatatagacctatgtatctcaaagacagggaacaatttacgttcaatgagctgttggattcaggatccatccagagcttcggaaggcctgaaggcagaccttatagcagttttgagcagaattgaaaaccagctcaaggaagaagggttaggttgggtgaatgttttgtacgttcacctctacatttcaagcatgaaggaatttggattggccaatgaagtttacgttagctttattac

SEQ ID NO: 34719 - DNA, 415 bp, Zea mays
  unsure at all n locations
  Clone ID: LIB3060-027-Q1-K1-A10
cgtgttccttgtcaagttctcataaactcataatccacaagtgcatcatatatacatagcttgctttgtgtgccgtcggaatcgcgaaatggcaagctctagttctgcacaaggcgcacactagacagaccctgagaaggtgaagctcgtcaccgtcctgagcatcgacggtggcggcgtcagagggatcatgcccgccaccatcctcgccttactagaagagaagctgcaagaactggatggaccggacgctaggatcgacgactactttgacgtcgttgccggcacgagcaccggtggtctcctggcggcgatgctcacagccactggcctgcatgaccatgacngacgtcgacagccgctcttcgacgccaaggatctggcgcagttctacatcgaccactcgcccaaaatc

SEQ ID NO: 34720 - DNA, 422 bp, Zea mays
  unsure at all n locations
  Clone ID: LIB3060-027-Q1-K1-A12
attgcatattatgtagtaggcactgaatgtaaattccttggcaattggcattaactgggttcttcattatgccattgtacttctgcttttctatttaaacattggtgcattgcatattatgtagtaggcactgaaagtaaattccttggcaattggcattaactgttttcttcattatgccattgtacttctgcttttctatttaactgtttcatgcagtgaggttggcaccagaagaggagtcacacaagcttactgggtttgtgcataacgctgtcacttgcatcgggatggaaacaaacataccggtaatgtaaatttatatttacattgcagctgttgaagcatgtacattgcanagatactactattaggtttagatcacaattaatagatttgtttgtgacataccgtgttttttg

SEQ ID NO: 34721 - DNA, 244 bp, Zea mays
  Clone ID: LIB3060-026-Q1-K1-G11
acatattacctcactctatatcactatatcatctacgcatatgctccaattctaacacctatattctggtttactatttaatcgcactatccatactcttgtaatgccattgcctcaattatttccattcacaacatgatcatttacatacataatttaactcaattctttcatgaactatattacttttaaaaaagcctttgaaccaacaatattacaacaaagtcttcatacttaaacttca

SEQ ID NO: 34722 - DNA, 405 bp, Zea mays
  Clone ID: LIB3060-026-Q1-K1-E12
ggcagcaagcaggagcagacaggaggcgccgagagcccagcgtcggagatctccggcgccatggagacgctggccagcgccatgcggcgcgagaaccgccggtccaaggccccgccctcctcctctgcttcctccgccctcgcctcgggcagggtccctctcgtcatggccttcctctcctgcctcgcctggctctacgtcgccggccgtttgtggcaggacgcgcagacccgggcgatcctgtccggcctcctcgagaagagctctaccagcgtcccgaaggtgctctcggtggaggacaagcttaggaaccttgggtgcaaggcgattggaaggaaaattgttgaggcggagatggacctgaccaaggccaagagcgaggggtacctgtgggggaacaggact

SEQ ID NO: 34723 - DNA, 445 bp, Zea mays
  unsure at all n locations
  Clone ID: LIB3060-026-Q1-K1-E2
ggcagacgcagatcggcggcgggataggctagcaatgatccccaattccgacttcctctagacgtgcctggcggtcgaattccgattcgattggagtagggaacgagaagggaacaaatacaccggcaccaccaccagaccagacagcacgtgcctccatactatggtttacgccccgtgccgctcatcgacgccgccgtcttcctcgccgatgctccacaagaacctncgcgccctcggacccggcttgaatcccttggctcccttcggcatgggcaactactcccggtagccgtttcttcctatcctttttcttccaattccatctcttagtgctttccgcttccgccccgggcggtttcttcatcggaacccatccccggtattttaactcccgtcggttcaatggtcccgtgctttggatctgaatcttgagaaccttccc

SEQ ID NO: 34724 - DNA, 407 bp, Zea mays
  unsure at all n locations
  Clone ID: LIB3060-026-Q1-K1-E6
ccaagtcacctccgcctcgggctccaaaaatccccacccgacctcgagactgagcggaccgacggtgatgtcgtcgtcggtgcccccgccaccgccccagcaggagctggagtcgccctccgccggcggcgacaaggtcctggccgcagcgcagcacatcgtcaagtccctcgccacctccaagaacgccgctgacgacatgatccgcatactctccggcttcgacaaccgcctctcctccatcaccaacgaccacctcttcccctcccccgaccttaccgncgactccgcctccgagatctccgccgccgccgcctccttcgacgccgccgaccagctcatccagctctgggacgccaccccggacgcgctcgtcttcgaggcccccgaggacgacatcgcgcagt

SEQ ID NO: 34725 - DNA, 397 bp, Zea mays
  unsure at all n locations
  Clone ID: LIB3060-026-Q1-K1-F10
cttgccgtgacgcacggctcctggaagcctctctccccaccgcatcttctatcttgggttgcttgctctgcaccgccgcctgctcatccatatcccatggtgcccagccgagcagcccatggaggcttcccacgcccagccctctctactgatggccgccgtccctactccatcttacggcactgctctctgcctctcccatggacgagctcgccctgccccccatctccttcaccacgctgctccctgcctccttgttggtcggccataccctctgctcctncccaccgtccgcagccccgacgtcgtcgccgtgtttagtcatggtgattcctaacccctttattttatttcactaattcttctaatgcgagcagatttttatggatgttgatat

SEQ ID NO: 34726 - DNA, 415 bp, Zea mays
  Clone ID: LIB3060-026-Q1-K1-F12
caccctccagcgcctccaccttcctcgccgcctcactccctctgaggtcgcagatgcgtccggttagacgaagccgcccgcacccatggcctccggtgagctcgcctgcacctacgccgccctcatcctcagcgacgacggcatcgccatcaccgccgagaagatcgccaccatcgtgaaggcggccaacatcaaggtcgagtcctactggccggcgctcttcgctaagctcctggagaagcgcagcgttgaggatctaatcctctccgtgggatctggtggtggcgctgctccagttgctgcttccgccccagctgggggtgctgcagctgctgctgcccctgctgcagaggagaagaaagaagagcccaaggaggagtctgatgacgacatgggcttcagcctgttcgactga

SEQ ID NO: 34727 - DNA, 391 bp, Zea mays
  Clone ID: LIB3060-026-Q1-K1-F2
agctacaagagggacgatgtcgtcccgtctgagacccccttggctgcgtacacgactggtgaggtgaaggccgacgagatcatgcgggctctgaagcaagtcttcaagacttccagcggcatgtgaatttgatgcttcttttacattttgtccttttcttcactgctatataaaataagttgtgaacagtaccgcgggtgtgtatatatatattgcagtgacaaataaaacaggacactgctaactatactggtgaatatacgactgtcaagattgtatgctaagtactccatttctcaatgtatcaatgtatatagaagttaacgtgcttgaggagataaaaaaaaaaaaataaagactgaaaaaaagggggggccgttttaaaggatcc

SEQ ID NO: 34728 - DNA, 406 bp, Zea mays
  Clone ID: LIB3060-026-Q1-K1-F3
attcctgtaagctcctgcgcctcctcctcgttgcttcactccaaatccaccgaggccaccgcgcgggcggggtggaacccctagcgccgtcgccggctcggtcgccctctcgcgcgcgcgtgcgtcgctccgacagcagctgcagccatggcgcagccgctcgtcgtgaagaaggacgacgacctcgacgaggaagagtactactcgccattcctgggcatagagaagggcgccgtgctgcaggaggcccgcgtcttccacgaccctcagcttgacgctcgtcgatgctgccaggttatcaccaaactcctgtacctgctcaaccagggtgacacctttaccaaggttgaagctacagaagtcttctttgcaacaaccaagctggtccagtctaaagatgtgggcc

SEQ ID NO: 34729 - DNA, 338 bp, Zea mays
  Clone ID: LIB3060-026-Q1-K1-F5
caaatacaccgaggccaccaccggggccgagatgaacccctagcgccgccgccatctcaatcatcctctcgcgcgcgcgtgcgtcaatccgacagcagctacagtcatggcgcagccgctcgtcgtgaataaggacgactacctcgacgaggaagagtactactcgccattcctgagcatagataagggcgccgtgctgcaagaggcccgcgtcttccacgaccctcagcttgacactcgtcgatgctgccatgttatcaccaaactcctgtacctgctcaaccagggtgccacctttaccaaggttgaggctacagaggtcttctttgcaacaacca

SEQ ID NO: 34730 - DNA, 460 bp, Zea mays
  Clone ID: LIB3060-026-Q1-K1-F7
ccttcgtggagacaccgccaggcgctatcttccggccgctgcccgcctgctcccccacgccgggaggcgaatgtgcaggtagcttgacgtctgatgaacgctcagccatgctgctgatgctacacgaaactcttcctttcgtgaggccgagttcttgccgggacccaaaactctccgagaagagtgcctctgctctccacggtaaattgggatgcagtgcggtctgcagttcagcggaaggccatcgtgtacagaagccacacatcgttcacagctacaaagttagcttcactaggaccagccatcatctgtgtaaaagcttaaacgagagaactacaaggcactgcctgcatcggttccatgttaatgcttcgcccgatgacgacgacttccgctcatcgcgtaacatagcgatcagtctattcaagcggtacaagaatgtcattgaccgaggaggtgg

SEQ ID NO: 34731 - DNA, 449 bp, Zea mays
  Clone ID: LIB3060-026-Q1-K1-F8
ccagaatgttcgtcctccgcaaaaccctcctccatgcgccgccggccgccgccgcggcggtcccctctcggatctcttccctcctccgcctcatcccctctgcatctttttctgaggtaagcggaggtggggaagaatggggcgcctcctcacccggaggcggcggcggcaggggtgggggtgggaacgaatggagctccacctggtctaccggcctcaccaaggaccatttcgacggatcctcgccctccgtcggccgttctgtcccttccgagtcagcgcccgtctctcgtgagcgggcggccattcgcgctatggatgagtgggacgagagggtccggaaactggaccgtaacaatgtcaaggcaaaggcgattgtggatccatggaccaaccgattccggaaaaccggtcccctgttgaaccaggtccggaacccggcccttcgg

SEQ ID NO: 34732 - DNA, 398 bp, Zea mays
  unsure at all n locations
  Clone ID: LIB3060-026-Q1-K1-G10
cgcccatttcgaagctcctcctcgcgattccaatccacgcacgccatctccgactgcgcgtgcgcctcgcgcaggacatatattcagtgatggaacacaaggaggccggctgccagcagccggagggcccaatcctatgcatcaataactgtggtttctttggaagcgctgccaccatgaacatgtgctccaagtgccacaaggagatgataatgaagcaggagcaggcccagttggctgcctcctccatcgatagcattgtcaatggcggtgataatgggaaaggacctgcaattgctgcaactgtaggtgtggcagttcctcaagtcgaggagaagactatcgccgtgcagcctatgcatgtcgctgaaaccagcgaggctgctgctgntatcgcg

SEQ ID NO: 34733 - DNA, 373 bp, Zea mays
  unsure at all n locations
  Clone ID: LIB3060-026-Q1-K1-C5
cacacgaactcgaatcacctccgcctcgccacctcttcatcttcttccccagtagccgctgccggcaccactgcagcagccaaaccacgtgacacctcccgcgccgctcaaccccacagcatccgctgccaccgccgctcacctccccggcgctcccggctacaaccactgcaagcatgaggcagccaaccagcgcgggcggcgacgctgggttcttgcgcgcggaccagatcgacctcaagagcctggacgagcagctcgagcgccacctcggacatcccgcggagcgggtagttggcccagtctctgggacagggagccgncgcggcgaaacggccaagctgggtccggaagagctgacgccactgcaacg

SEQ ID NO: 34734 - DNA, 463 bp, Zea mays
  Clone ID: LIB3060-026-Q1-K1-C6
ctcaagtcaccaccaccggagaacaggacgatgaagaaggcagcaatgtacgggatcggagccgccaccatcttctacatctccgtcggctgcgctgggtacgccgcgttcggttcgaatgctccgggcaacatcttggcggcaggcgggctgggtcccttgtggctcgtcgacattgccaacatgtgcctcatcctccacctgatcggtgcataccaggtatacgctcagcctgtcttcgcttcggttgagaggtgggccgcctcacggtggccagaagccaagttcatgagcagcgcatacaccgtgtccgtcagcatccccctcttgcagagaggatcggtcaccgtcgcgccgcacaagctcgtcctgaggaccgccatagtcggcgcgacgactgcggtggcgctggcgatacccttcttcaacgccgtgctggggctcctcggcgcgttcagcttct

SEQ ID NO: 34735 - DNA, 340 bp, Zea mays
  Clone ID: LIB3060-026-Q1-K1-C8
acgcgtacgtgcacggctcgttgatctgggtccttatctttgagtttggacgcattgaacaatgcgggataagctcattaatcttcgggctgttgcgccaaatggtgatcttgtcaagacaggctcccggtctcgaaaaaatgcagctgggtatgaccttgctcgtttgatcattgggagtgaatgcactctgggtgtaattacagaagtgactctacgacttcaaaagcttccatctcattctgtacttgccatgtgcaatttcaaaacaattaatgatgctcctgatgttgctattgcaacaatgctttctgggatacaggtttcaagagtgcaattg

SEQ ID NO: 34736 - DNA, 413 bp, Zea mays
  Clone ID: LIB3060-026-Q1-K1-C9
cccacgcgtccgcaaagctaaaacatgaaaatcttgttgagatgttgggttattgtgtggatgggaattatcgtatacttgcttatgaatttgcaaccatgggttcgcttcatgatgttttacatggaagaaaaggcgttcaaggcgcgcagcctggccctgtgcttgactggatgcagagggtcaaaattgttattgaggctgcaaaaggtatagaatatctgcatgaaaaggttcagccttcaatcatccatcgggacatcagatcaagcaatgtactgctgtttgaggatttcaaggcaaaaattgcagacttcaatcttttgaaccaagcaccagatatggcagctcgtctccattcaactcgtgtattgggaacttttggatatcatgcacctgagtatgctatgact

SEQ ID NO: 34737 - DNA, 316 bp, Zea mays
  unsure at all n locations
  Clone ID: LIB3060-026-Q1-K1-D1
gagacgagttaaagatttctttaagcattttgatcgacatgcactggatctgttagagaagatgttgagtttagatccatcacagaggatatcagcaaaagatgcacttgatgcggaatatttctggactgatcccttaccatgcgatccaaaaagcttgcccaagtatgaggcatcgcatgaattccagactaagaaaaagcgtcagcaacagaggcaagcagaggaagctgcaaagcgtcaaaaacttaaccatcctncaccacattctcgtttgccttcactccagcagcctggccaagcacatnctcaaatg

SEQ ID NO: 34738 - DNA, 407 bp, Zea mays
  unsure at all n locations
  Clone ID: LIB3060-026-Q1-K1-D10
gcgatgtgctcatctccctcctatcctctgctccccagctccgatccagcgctctgggctgtgctccctctctcctgcatgcgtgaggtgccagcggactgaccttccccatgcagctccttcctctcgctcccgctccagcttctctacgctgccgccgttccctcgcgcagcgtcgtcctagacccggctgggcgcgctcgggtcttgttggcgcggcggcggcgacccctgtggccgcagctcactcccggtgcttctctccctgcttcaatttttttccagccatggtgctcgcgccggcgtcctcgactcctcagtctggcgcgctgnttttttttccatgtccctgtgcgcgagctgattcagcttgtcggtcatccactggctctcggcgctccttgctc

SEQ ID NO: 34739 - DNA, 367 bp, Zea mays
  Clone ID: LIB3060-026-Q1-K1-D11
cttgcctcttgcctcttgcgccttgctagcttgcttgcctccctgctccctcctgcgcccgcttcctcgtcgcttctctgattcttcctggcctttgccggagcaaggctaggcgcgaggagagggtgctgtgctcagccagaggtcatcggcgctacgcgagcgcactgcctgtggacacaggagcctcatacattttgcaagaccactgaaacactggaacattcacaccctcaagaggttacacttgataaaacggtggcggggtcaacgctaataagtcatcaaaatgtgtgctgcactgccggagtatcaggggaaaacgctgaaatcatggaaatcaccttattgcatgatgaatctgatg

SEQ ID NO: 34740 - DNA, 421 bp, Zea mays
  Clone ID: LIB3060-026-Q1-K1-D12
cccacgcgttcgatagtgacattggttccattggcaaagttacgcgcccaatttttcgtgagacgacattgaccaaacctggaacccaaaagcaaatggtctttaaacttctggcagcattacggcactcccaggtactggatgcagacgctgttacgcgagtctagtggtgctatgttccatgcaacgacaatcagctccagctactcaggttcacttgcagcgtctgcgattacctggcaggactgcgagaacagcttcctaagagtaaaggtcataaacttcgggtcagatgctgtgaccctgacaatctgcacaagtgggctccaggccagtatcaacgctctgggatcaaccgccactgttctcacatcagcagatgtgatggatgataactccttcagcaacccaaccaagttgt

SEQ ID NO: 34741 - DNA, 411 bp, Zea mays
  Clone ID: LIB3060-026-Q1-K1-D2
ggaatgtgtgctactcgttgttctggttcattagctgtgagtttgtaggtatggaacaatgcgggatagtgtgattaatcttcgggctgttttgccaaatggtgatgttgtcaagacaggctcccgggctcgaaagagtgcagctgggtatgaccttgctcgtttgatcattgcgagtgaaggaactttgggtgtaattacagaagtgactttacgactgcaaaagcttccatctcattctgtagttgcaatgtgcaatttcaaaacaattaacgatgctgctgatgttgctattgcaacattgctttctggaatacaggtttcaaaagtggaatggttggacaaggttcaaataaaggcattaattttggcaaatggcaaaatttggcctgaagggccaacctggaggtt

SEQ ID NO: 34742 - DNA, 313 bp, Zea mays
  Clone ID: LIB3060-026-Q1-K1-D3
actcggtgccttacaccccactctttccccggaccaacccataacccatccgcatcgctgcccggcgcgccccaaccccaccaccggtctcctccgcctcctcccgctctgccgtcgcgcttgtgctcccgcgctcgtccgcctcgccgtttctgcctgctccacctccgccccgctcccatcggccgatcggtcggaggccgcgtcgtcgcttgagagatgcctcttgttgacggcagcggcgatggaaacgggggcgatgccaccagcctctgccccgccgcgcgccgtgccagtgatgaagggggacgga

SEQ ID NO: 34743 - DNA, 304 bp, Zea mays
  Clone ID: LIB3060-026-Q1-K1-D4
atcttactgcaaagttccctttgatgctcttttcattctaaggaacacaaacaatcctaagggtggaagtacttaaatcgggactcgggctaggaacaggtgatgttctacctaggttgattaaggattgaatgcgtatgtaggcgtgctgatcgaggaccctttaactggtcacatgcctcgtcatgggtaagccttgcctcatgcagactaaggccagaataagataacacggaatgggcgtggagcggtggcgagagtagcgtgtaccctccgtggcaagaggctggacggtgatgtatct

SEQ ID NO: 34744 - DNA, 461 bp, Zea mays
  Clone ID: LIB3060-026-Q1-K1-D5
gccgagaagactccgatccagcacgtccttcagcccccgacgatcgcctctttgcttgccattgccatcggcatggttcctgtcctgaaagattttgttttcggggctgatgcgccgctctcgttcttcaccgacagtttggagatcctagccgctgctgtggttccgtcggtgatgttgattctcggaggcatgctcgcggaaggcccaaaagacaacgccttgggcatgaggactatcatcggtatcattgtggccaggctcttggttctcccatgcattggcatcggtgttgtgaccctggcagacacgttgcatctggttctgggaggaaaaccatatggaccggtttgggcttttcctgcagtactcccacccgagtgctatcctgcttggagcgatcgccagtctcagaggctatggcgtcaaggaagcatccgcccttctgttctggcagcata

SEQ ID NO: 34745 - DNA, 426 bp, Zea mays
  Clone ID: LIB3060-026-Q1-K1-D8
ctgccgcctacactggacgacgcttgatgcatacgagatgatgagttggccggaggaaggaagaggctgaaagggcggcggagagagaaaggctataagagcgagctgggtccctcgaggatgccatcaagaaaccgcgtggaggggagggcgatgagatgagggatgctggccgcggtgatggactactttagctcctgctggggcccgcgatcgggtgccgggcaccgggaaaagggctccgacgccgctggccggcaggacggtctcctctggtacaaggacgtcgggcagctcgtcactggggagttctccatggccgtggtgcaggccaaccagctgctcgaggaccagagccaagtggagtccggatcgctctccctggctgacacgggcccgcagggcaccttcgtcggcgtctatgat

SEQ ID NO: 34746 - DNA, 423 bp, Zea mays
  Clone ID: LIB3060-026-Q1-K1-E10
ggacgcgtccgcctccgcgtccgcctcctcggcccgcaccagatccgccgccccgtggcgctccccgccgtcgagtcggaggtcgccgcctcgtccgcccaggaccgcgccaaggacatcctcgtcgtcgtctccggcctcctcttcggcttcggctgctgcgccctcaccgtcgcgtccatgtacctcgtatggtcgctcctcgccttcacctgcgcctccggatacgacgacgacgtctacagcgacgacgaggaccggctgttcgactccgagagccccaagaaggccggctacgtcatcatccacgacgctgacgagtacggcgccggtaagaactagggctggggatccgtcttcggtctcgccggcgggtcagcagaaggattttcgtaataacatttgcatgattgcttggaattg

SEQ ID NO: 34747 - DNA, 388 bp, Zea mays
  Clone ID: LIB3060-026-Q1-K1-C4
ggagaaccgagagcagagagacatggcgccccaccagcagcagcgggcgctgctcctgttcccgagtcggttcctcctcctcctccttgccccgcccctcgccggcgcgtggggaaaggagggccacatcatggtctgcaagatcgccgagaagtacctgtcggagaaggcggcggcggcggtgcaggcgctgctgccggagtcggcgggcggtgagctgtcgacggtgtgcccgtgggcggaccatgtgcgctggcactaccactgggccagcccgctccactacgccaacaccccccaagtctgcaacttcaagtattctcgggactgccacaattctcgtggccagcaagggaatgtgcgtcgtcggggctatcaacaactacac

SEQ ID NO: 34748 - DNA, 311 bp, Zea mays
  Clone ID: LIB3060-026-Q1-K1-A6
gctagccgccggtctattgctctgatagcttgctccaggacgtacgtacgtacgtagggcgatgcatcgatcgctagctagctgactgaccatggcgtccatgtgctctgccgccatcaccgcccgttccttcacggccgggcccgctcgtgcagtggtcaccacgaggtcctttaccgcgcgtgcctctctacgcaaggccactgccaccgccgctacggccgatgccgacagcgtactgcttgccggtcgcggcgccatggcccaggaggagctgctgggcagcaacgacggctgactagtcttcgagc

SEQ ID NO: 34749 - DNA, 468 bp, Zea mays
  unsure at all n locations
  Clone ID: LIB3060-026-Q1-K1-A7
atctcggcttgagcttgaactacggattgattgattgattgggttcctggcgttagtttgcgcgattcgggcagatttggtccaacaattctttgtttggccgcttgggctccggtctctcgattcttcgtagcttggtgggagggcgccggatccagcggccatcatggttgtcgacacggtcagcgcgagcacctccataatagccccccacctgttcgaccacaggtccaggggcgccggcgcttcccaccaccacctccgccggacgttccatgtcgtcgcctgccgacacctgcccaccgncttcgccggccgncgcctcgtggcccgggtcacgaggcagccgtcgtcgcgcctcgccgattggccggtcagggcgctggctatgggggtcacgaaggaggtcagggccagccctcgcagggagtaccgggggatccccggngatggtggcgacatggggga

SEQ ID NO: 34750 - DNA, 385 bp, Zea mays
  Clone ID: LIB3060-026-Q1-K1-A8
gcctcagtcacccattcacatctctaccctagtgcgcttcccttataaaacctagctcggcaggctccagacgcagtcggccgccgcagaccgggagtagccgacgcgccgtcactgaatcctcagatcacggctagccgtaatcacgacactctgctgactcccggcgagcagtgtaacattttccttcagccatgggcaaggagaagactcacatcaacattgtggtcattggacatgtcgactctggcaagtcgaccaccactggccacctgatctacaagctcggcggtattgacaagcgtgtgattgagaggttcgagaaagaggccgcggagatgaacaagcggtcattcaagtatgcctgggtgcttgacaagctcaa

SEQ ID NO: 34751 - DNA, 393 bp, Zea mays
  unsure at all n locations
  Clone ID: LIB3060-026-Q1-K1-A9
aaaatctttgtcaaagaagaaacatatagtgaaaaacatcaaagaacgtgactcggatcagagaaactacatacatgctagcgaggttattttatccatcctgctggacaaggacaggagcagctcgacaatcctctcgctgaaaaaggctggtcctgagatcactgaacttttaacgcaatgctctatcggcattgctggaactggactggctattctcctgtcagttatgtgcaagatgtctaatggcatgaggactccttttgcttctgcccgactgcttagcaccagcgtcggattcggactcttctggctatcctgggcagtcaatggattgcgtgacaccatcgncagcattttcagaagccgaaagtgcatgaatatcgaggatga

SEQ ID NO: 34752 - DNA, 369 bp, Zea mays
  Clone ID: LIB3060-026-Q1-K1-B1
ccacgcgtgcggtgacccaatgggagaggcctcgccgtcgatcgccaatgacgtcaccgagttgatcgggaacgggccagtggtgtacctcaacaaggtgaccgatgggtgcgtcggccgcgtcgccgccaagctcgagtccatggagccctgctccagcgtcaaggataggattggctacagcatgatcacggacgcagaggagaaagggctgattactccaggcgtgagtgttctgattgaaccaactagcggcaacacaggcattggactggcctttatggctgctgccaaaggcttacaacttacacttacaatgcctggcttcattaaccttgagaagaagatcatattgaaaggttttggggc

SEQ ID NO: 34753 - DNA, 424 bp, Zea mays
  Clone ID: LIB3060-026-Q1-K1-B10
accaaggagagtacgtggaggagcagccatggcttcatcggtggccgccgcggcgagcacattcctgggcacccgcctggcggacccggcgccacagaacgggcgcatcgtggcccggttcgggttcgggttgggcggcaaggcgaagcctgctccgaagaaggtggcgaagacatcgacctcctctgaccggccgctgtggttccccggcgccgtggcgcccgactacctggacggctcgctggtcggcgactacgggttcgacccgttcggtctcgggaagcccgtggagtacctgcagttcgagttggactcgctggaccagaacctggccaagaatgaggccggcggcatcatcggcacccggttcgagtccttcgaagtcaagtccaccccgttgcagccctacagcgaggtgttcggc

SEQ ID NO: 34754 - DNA, 419 bp, Zea mays
  unsure at all n locations
  Clone ID: LIB3060-026-Q1-K1-B12
gcttgcaagaagattactttttgacaaaagtgctaatgatgaacatgagaaaagtagtctggccaagctcaaacaacaatgtgggggacaggttacttcaaaaatggaaggcatgggtactgaccttactgtcgctagagatcatcaaactaagtttgaggagtttgtagctggacatccagagttgaatcctgggatagacttagctgttactgttttgacaacgggattctggccaagctacaaaacttttgacataaaccttcctgccgagatggtgaaatgtgtagaggttttcaaggagttctatcaaacaagaacaaagcacaggaagctgacatggatttattccttgggaacctgcaacatcaatgctaagtttgatgctaaacctattgaacttatttnntacacatatc

SEQ ID NO: 34755 - DNA, 397 bp, Zea mays
  Clone ID: LIB3060-026-Q1-K1-B4
cgatcgcgagcgcaagcacgtacgttgtcggaagctcaagttagaagaagcaccagtgcctgagcgatggcggcccaggctctcctctccggccggcagctgctgggccgccccgtgcagtcggccgtctctaggtcgtcggcgaggaaggcgcccttcgtcgtcagggccagctccagccctccagccaagcaaggtgccgacaggcagctgtggttcgcgtccaagcagtccctctcctacctcgatggcacgctgcccggcgactatggcttcgacccgctgggcctctcggacccggaaggcaccgggggcttcatcgagcccaagtggctggcctatgggcaggtgatcaacggccggtacgccatgctgggcgcggtgggcgccatcggcc

SEQ ID NO: 34756 - DNA, 358 bp, Zea mays
  Clone ID: LIB3060-026-Q1-K1-B6
gcgatcgcgagcgcaagcacgtacgttgtcgttagctttagttagaacaagcaccagtgcctgaggcgatgggcgcccaggctctcctgtccggcctgcaactgctgtgccgccccgtgcagtcggccgtctctaggtcgtcagctaggaaggcgcccttcgtcgtcagggccagctccagccctccagccaagcaaggtgccgacaggcagctgtggttcgcgtccaagcagtccctctcctacctcgatggcacactgcccggcgactatggcttcgacccgctgggcctctctgacccggacggcacctatggcttcatctagcccatgtgactggcctatggctaggtgatcaa

SEQ ID NO: 34757 - DNA, 448 bp, Zea mays
  Clone ID: LIB3060-026-Q1-K1-B7
gaagaagatgacgattaccattgaacagccccagctcgatgcggtggcggaggggaaagtccccggcggaggtgaccccgcggagctggtgctcgacgccggcttcgtcgtgccggacgccaacgccttcggcaataccttcagggactacgacgcggagtcggagcggaagcagacggtagaggagttctaccgggtgaaccacgtgaggcagacgcacgagttcgtggcgcggatgcgggcggagtacgggcggctggacaagacggagatgggcatctgggagtgcatcgagctgctgaacgagttcatcgacgacagcgacccggacctggacatgccccagatcgagcacctgctgcagaccgccgaggccatccgcaaggactaccccgacgaggactggctccaccttaccggactcatccacgacctgggcaaggtgctg

SEQ ID NO: 34758 - DNA, 408 bp, Zea mays
  Clone ID: LIB3060-026-Q1-K1-C10
gatcaatcttcctcgttccgccgctccctcgcctccggcagcgaggtgaggccaccgatcggaccttccctagcggcggcgcctaccaacctcaaggagcgatggctctgtctgcgacgctacggatttctcttagcgtcgcgttctttggggttctggcgttcgtgcttggtgtcatcgccgaaaacaaaaagcctgcttccgggactcctatcctaggaaaggatgtcgtcatctgcacgtttccaagtgatccgactcttgcgatggggagcctgtccattgtggcacttgtggtagctgccatcgtaggccatgttgccatcttctttccatactcgggcaagtcagttcctcgtggagcgctgtttcaaagcaccagcttgacagtgttctttggtgttgctg

SEQ ID NO: 34759 - DNA, 437 bp, Zea mays
  Clone ID: LIB3060-026-Q1-K1-A5
gcgtccgacgggggtcccgagcagaggctcaagtatctgcccaagctcatcagtggggagcatagggggggactggcaatgagtgaacccaactctggctctgatgttgtcagtatgaagtgcaaagctgagaaagtggacggcggctatgtccttaatgggaataagatgtggtgcaccaatgggccgtctgctcagacgctggttgtttatgcaaaaacagatctaactgcgggatcaaaaggaataactgcattcataatcgagaaagggatgcccgggttcagtactgctcagaaattggacaaacttggcatgataggaagcgacacatgtgaacttgtttttgagaactgctttgtgccacgcgagaatgtcctcggtgaaaaaggcaaaggtgtttatgtcatgatgtcagggcttgatctggaaaggct

SEQ ID NO: 34760 - DNA, 376 bp, Zea mays
  Clone ID: LIB3060-025-Q1-K1-H12
cggacgcgtgggcgctaacaattggtatcagattcgccgttccttggcgaggctcgatctggagcacggctacttcacgcgttcgcagcgacgcgcgggtgtgatggatcccaatgtcctgttcatcgttgatgagatggagaagtttgcatctatggatgtcaagtgggagaagcgcttgtcggagctggtggcagctaaggaggagcgcctgatctccctcgagcgcgtcagcggggagttggaagcatggtagcccacggtggatgtagcgatggatgataccaagttgcagctccgcaaggtgaatctgcagttggatcatgccgttctggaggcggctggcggagattctagtctgttggggaaaccggat

SEQ ID NO: 34761 - DNA, 382 bp, Zea mays
  Clone ID: LIB3060-025-Q1-K1-H2
cgcagcgtccgcccacgcgtccgcttccgacgacgatcacacacgcagaagatcgagttcgttcgatcgtgaccgtgacgcaggaagctataagctagccaagacaggaataataatggcggcgtcgacggtggcgagcctctctgtcccggtgacgacgacgaccttcgcggcggcgggcggcggcgacgtgctgatcgtcgtcccgaggagggcgggcgccaagcgcgtcgtctggttccccgcggcggcgcgccgcggcggcgggcgggtggtcgccgtgcggtccagcgggccggccacgccgccggagatctccgacaaggtgtcggagagcatcaagcatgcggaggagacgtgcgcggacgaccagaatggcgac

SEQ ID NO: 34762 - DNA, 437 bp, Zea mays
  Clone ID: LIB3060-025-Q1-K1-H3
gtcgcctcgtgacgtctgtccaagaacactcgctccccacctgttcgctgcttcttggtcttgccaatctgctccttcttctagctagatcttggatggagctggggatgacgatggaggtagcgaagatcatcgaggtatgtagagtacgcggctgctagttagttcaccaggccagcaagcgagctccagcttcgtccgatcgatagatgcgagctgtagcagcgtggcagccattcatcagttgtcagatcttagattccccccatccccgctactagttggtggttagcaaatcccaccaagcaggaagcagccgcgagcgagccatggccatggatcccgttctgaaagtggccctgggctcggcggcgttcgccgtgttctgggtgctggcggtgttcccggcggtgccgttcctgcccatcgggcgcacg

SEQ ID NO: 34763 - DNA, 447 bp, Zea mays
  unsure at all n locations
  Clone ID: LIB3060-025-Q1-K1-H4
ccaccacgtccagctgttctggctctcctagtccgagcagccgcggctgtggcacggccacgtcatcgtccgctctgaccgagtccgcgctgcggcaaagcggcggcgaagacgaagacgccgagctcgacgaggcgtccaccaccaccaccaccacggcaagccagcgtcaacaccaagacgacgaccaccaccagcagcagcaggagtgctacgcctcggactacttctggaacgacatcgcggcggcggaggcggccatctacatgttgatcgacggcggttggacaggagggtccggccccggccatcccgccgccgagccgccttcgtcgccggcgtgggagtactgctctgattactcgctctggaggatcgacgacgacgagtacttcgagaagatgctcgnactctncttctgattcaattatccagccatcacacgcc

SEQ ID NO: 34764 - DNA, 429 bp, Zea mays
  Clone ID: LIB3060-025-Q1-K1-H7
gccgtctcccttttgcgtgagcaaagaaagagagcgagaagcagtcgccatgtctggcatcatccacaagatcgaggagaagctccacatggggggcgaccacaagaataaggaggaggagcaccacaagaaggccgaggagcaccacaagaaggaggagggggagcaccacaagaaggacggcggggagcacaaggaaggcatcgtggagaagatcaaggacaagatcaccggcgagcacggcgacaagtccggcgaccacaaggagaagaaggacaagaagaagaaaggatagaagaagcacggggagggccacgaccacgacggggggcacagtagcagcagcagcgacagcgactgagatctggtgtcgcagcacaggtgcaacacaagtatgcttgcttgatggaggattcataccagctgatg

SEQ ID NO: 34765 - DNA, 440 bp, Zea mays
  Clone ID: LIB3060-025-Q1-K1-H8
ccgagctacttgttcttgcgagtgactgtctttggaaggtgatgaacaatcaagaggttgttttgtttcaaatatgccaggagatgttccccgagtatgtggtcagttggctgtctccagagcttttggagacaggaatctaaaatcactattgagatcagagcctgatataaaagtcgaagacatagatcacactgccgagctacttgttcttgcgagtgacggtctttggaaggtgatgaacaatcaagaggttgtcgatttggccaaaaggtacaaggatccctatgctgctgccaagcaattaaccgtcgaagcacaaaaaagagatagtaaggatgatatatcatgcatcgttgttcggttcaaggtgtaaatcggtctcgaaagattttcatcgagagcaaaaaccagtgaataggctgcctgacgatggtagt

SEQ ID NO: 34766 - DNA, 410 bp, Zea mays
  unsure at all n locations
  Clone ID: LIB3060-025-Q1-K1-H9
gagctccgcctgcgcgtgcgcggcggtagcgctcgcgtccttcccgtccgccgcctgcacctccgccccttcccgcgtctcggccagcagccaccgcggtcagcggcactccagggccgccaccgtcagatgttccagcacgtcgcccaacgtgtcccagggcgcgccggcgccggcgccgcccaagccgcaaatcgagctcgagttcgtcgggccgaagcccggtgccgacggctccttcccggtggaccgggcggaggcgaccagcggcgagaagctcctccgtgacgtcatgaacgagaacaagatcgagctctacgccgcatacggcaaggtgatgaactgcggtggcngcggaagttgcggcacttgcatcgtcgagataatcgatggaaaggagcttctgaatg

SEQ ID NO: 34767 - DNA, 407 bp, Zea mays
  unsure at all n locations
  Clone ID: LIB3060-026-Q1-K1-A10
cccgtcctcctcccaggcgcgaccgcgcgagacgcctgcccgagtgtaaccgtcgccgtcgagcccccatccgcattgcgtttttcgggcgcgttcaggcgggacgcatgatgcgctgctagcgtgttcaggccttcaaaacgcagcacacaccggtccgttgcttgccggcccaccgctggcggcgcgcggatcctctcccaccgcgtatctttccgtttggatccccgagtcggagctcgatcagatcggtgcctctgcctgcgtgcgtctgctctggtctactatatatgaccacgggcgcgggctgacgctccatcgcccacacgtcgaagcangtgattggcgatccttgtccgtcctcgctcgctagctgatcgacatggccgacgacgacccaagaacga

SEQ ID NO: 34768 - DNA, 404 bp, Zea mays
  unsure at all n locations
  Clone ID: LIB3060-026-Q1-K1-A11
ccgcggaagggaaaaggacaaaangaaaacagagagaggggagagtgggagacggtcggggacgggggcctcactcctccacactctcagtcgtcttccagtcccagcgctttcttggatcgcgaggaaaccactcggggagtttgcagttgcagagaactgtatcggccgaagtggttgcacggtgtgttggccttggccatgcgccacggcagggaacagagacgagcagcagggaggcagcaatggaggcgctcattgaccctgctctcgctgtaaagatagtcccgcggtgccctccgaattccacttgatccaactctcgacatgaagcggccacgcggcgctactccctccctgtctgcgatgcccaatcatcaggaagatgacggctacggcgtggt

SEQ ID NO: 34769 - DNA, 390 bp, Zea mays
  unsure at all n locations
  Clone ID: LIB3060-026-Q1-K1-A3
attccgggctacggcgtacgctcgagctctaccgctacgacccatgggagctcccatcaatggccgcgattggggagaaggaggggtagttctacgtgccgagggaccgcaagtaccgcaacggcgacaggcccaaccgggtgacggcgtcgggctactggaaggccacgggcgccgaccgcaccatcaaggcggacaacagccgncccatcgggctcaagaagacgctcgtcttctactccggcaaggcgcccaagggcgtncgcagcagctggatcatgaacgagtaccgcctcccgcccgacgacaccgaccgttaccacaagaccgaaatatccttttgccgcgtgtacaagcgcaccggtatcgacaacggcggccacgggcatc

SEQ ID NO: 34770 - DNA, 445 bp, Zea mays
  unsure at all n locations
  Clone ID: LIB3060-026-Q1-K1-A4
attgaggtcctttgaggaagttgactcactataagaatccaatgaaatcaacgaggatgaggagcttgcggagcaaatccagagtgaatttgctatgaagatatcaaattatgcaaacattgttctcttagcgttgaaggtatacgctacaataaaaagtggatcaattgctatagctgcctcaacactggattcactgcttgatctcatggctggtggtatcctttggttcacacatctgtcaatgaagagcatcaatgtctacaagtaccccattggcaaactgagggtacagcctgtaggcattatcatcttcgctgctgtcatggccactttaggctttcaaagtatntattcaagctgttgaaaaagctggtaagtgaatgaggcttcagaataactgaaccaaagtgcaaataatggtggctatattccaatcatgatc

SEQ ID NO: 34771 - DNA, 387 bp, Zea mays
  unsure at all n locations
  Clone ID: LIB3060-025-Q1-K1-H11
ctcaagttagaagaagcaccagtgcctgatcgatggcggcccaggctctcgtctccggccggcagctgctgggccgccccgtgcagtcggccgtctctaggtcgtcggcgaggaaggcgcccttcgtcgtcagggccagctccagccctccagccaagcaaggtgccgacaggcagctgtggttcgcgtccaagcagtccctctcctacctcgatggcacgctgcccggcgactatggcttcgacccgctgggcctctcggacccggagggcaccgggggcttcatcgagcccaagtggctggcctacggcgaggtgatcaacggccgctacgccatgcntggcgcggtgggcgccatcgncccggagatcttcggcaagatgggca

SEQ ID NO: 34772 - DNA, 335 bp, Zea mays
  Clone ID: LIB3060-025-Q1-K1-F3
cctgaaggcatactgtgagaagttcatagcatccaaagtgaatgacgacaatgctaggacccactacgccttcgcgcaccgtcacagcgcaaagcagctgctggaggcctcgctttctgtgctcatggccaacatgtctacgctatcggatcgtgaagaatacaaggagcttgtggagaaggacccaaggcttgttgtggagatttatgaagcatatctcaaccggcaagtcaacactgcagctgggaaggacacaaattgtagcaacaggaagtgataattacgaacagaactcgtgcagtaacaatattctaactatgcatttatgcattcat

SEQ ID NO: 34773 - DNA, 382 bp, Zea mays
  Clone ID: LIB3060-025-Q1-K1-F4
ggtctctcacgtcgcgccgtgactccctgctcgctcgcgcacagctcggagcttcgtcgccgcgctcgtctgccgcgcccgctgcttgctcctctgctgcgcgctccacctcgtctccatggccgagcgctccttcttctccacgcgttcagccagcgcctgatgcctctccctttctaacagcgcccacactcggagctcgtcggcatggtctgccgcggtgctcgccccagcctcgactcccgtccgggccttgctgtcgtgctgctatggtgcctaggtcctggcgcgctcgtcgtcggctcggcatctcctcgagctcgcccctgccttcctgctcggttacttgtgctcgcgtcgacctcagtcaccggggccgact

SEQ ID NO: 34774 - DNA, 411 bp, Zea mays
  Clone ID: LIB3060-025-Q1-K1-F5
ccaaaagatgttattttttgatcgttacaaggttggtgaattgaccggtttgttgagatctgatttgggttccttgaagagtgttgtaagtgataacatatccagagatcgtggactgagggcactctctgagatcattggtacactttgtatacttttcacactatcaactgagctagctccagttcttgggctccttatggtgtccgtctccgtgctagttgctattttcaagaggtcaactgttcccacttttaaatcttatggaatcgtgcaagcacgcatatcagactgtgcatcaaagacattttcagctattcgtactgttcgatcatttggtggtgaaaaacgacaaatttctttgtttgacaatttggcacatgcttaccaaaataatggcacaaaacttgg

SEQ ID NO: 34775 - DNA, 396 bp, Zea mays
  unsure at all n locations
  Clone ID: LIB3060-025-Q1-K1-F7
gggattcgctgttcttcggccggcgtcgcgctcacgtgcgcgggattcctgcctggcttcgctctgtatatttaaccaatcctcagctctcatcttccaaaagttctcacctgcgccgacggtcaccggtcggtcaccatgatctcacggccgctatgcgcgctgagagagaaaaatcgagtggaggagagagaaaattgggggctgcatgagttcatccgaagccgatccttggaccctgctatacctattgcttagcttccgcggctgtacaccatcgagcgccaagagcaccgtgccggcgtggccgatatcccccaggcaggaacttcaccttcgaactgaccacggcgcatggacctcggcgcgaggacacgtgtcatctgnaaagcaagt

SEQ ID NO: 34776 - DNA, 412 bp, Zea mays
  Clone ID: LIB3060-025-Q1-K1-G1
agacgccacagcttgcgcccgcaatggcactcgtctccgcctcctcgtcctccaccggcgccgtcacggcgctccccaggaatgggcagcgggcgtcgtcctccttcctcggcggcaagacgctgctgagacaggccgaggcggcccggccgtcgttcgccgtgcgcgccgcggcggaccccaacaggccgatctggttccccggcagcacccctccgccgtggctcgacggcagccttcccggcgacttcggctttgatccctggggcctcggatctgacccggagagcctgcggtggaacgtgcaggcggagctggtgcactgccggtgggcgatgctcggcgcggcgggcatcttcatcccggagttcctgaccaagatcggcgtcctcaacacgcccttctggtacac

SEQ ID NO: 34777 - DNA, 408 bp, Zea mays
  Clone ID: LIB3060-025-Q1-K1-G10
cacttatccgaggttccgtgcagcagtggaaaagagcagattttagcagagcagcgagggtcggagaagcctccccaagcttcgaatcgctatgcagcccgtcaaggtgtacgccgaccggcggtcgcaaccctcccgagctgtcatcatcttctgcagggtgaaccagatcgatttcgaggaggtcacggtggatctgttcaagtctcagcacctcacacccgaattcaaaaaaataaacccaatgggacaggtacctgcaattgttgatggaagattcaaactatttgaaagtcatgcgattttgaggtatcttgcatcggttttccctggagtagctgaccactggtatccttctgacttgttcaccagagccaaaattgagtcaatcttggattggcatcactc

SEQ ID NO: 34778 - DNA, 424 bp, Zea mays
  Clone ID: LIB3060-025-Q1-K1-G11
atactgaacagtccagtcagtcgtctctacctcatccgcctgacgaatcttgattcgtgagcttgattgggtgtcatctcttttagctgcaactgcagctggctgtgatcatggcatcgctgagtgctgacctcttttacgacatactcaagcgtctcgatgctgcagctctggcaagagcaggctgtgcctgcgctgattttcgtgccatatcaaatgaagaggatctgtgggaaaatgcctgcacatctctgtggccatcaatgagacgagatgacgttaggagcttaattgcctctgctggtgggttcaggaagttctatgcggattgtttcacacttatactgaacaaggacgtccctgtggttcaagccaatgaaactaacttctttgccgaagaatgggctgagtctgactactacta

SEQ ID NO: 34779 - DNA, 314 bp, Zea mays
  Clone ID: LIB3060-025-Q1-K1-G12
gccaattggcagaaatggagaagatccaggtttttcatcccgcaaaaagcgcattgaggatccagttcgcacaaatgttgaagatgcaggcttctcatctacgaaaaggctgtctgagaagcccatcagtgtaaacggagaagaggatcgtgaccattgtcatcaggagtcatctaaggaaccgagttgcggagttgagcaggatggtcaaggttactcatgcgatgaagaggctgtgaaaaagccagtttgtatggatagccacgatgcccaaagttcagatatctctgctgccactattgcttctgggggaa

SEQ ID NO: 34780 - DNA, 391 bp, Zea mays
  Clone ID: LIB3060-025-Q1-K1-G2
agagcttcttgcaaagagctgcaagtcactgatttcattgaagattagtgactgcgagctttcagatttgatagagttcttccaatttgccacagcactggaagaatttgctggagggacattcaatgagcaaggggaactcagcaagtatgtgaatgttaaatttccatcaagactatgctccttgggacttacttacatgggaacaaatgaaatgcccattatgttccctttttctgcaatactaaagaagctggatttgcaatacactttcctcaccactgaggaccattgccagctcattgcaaaatgcccgaacttactagttctcgcggtgaggaatgtgattggagatagaggattaggagttgttgcggatacgtgcaagaag

SEQ ID NO: 34781 - DNA, 427 bp, Zea mays
  Clone ID: LIB3060-025-Q1-K1-G3
ctgacctatgctgaagacattataggagttaaaggagcaaatattgcgtacatacgagctaatagtggggctgttgttacaattcaggagagtttgggtagtcctgatgatattactgttgaaataaaggggacatcttcacaggtgcaagctgcacagcagctcatccaggactcgttggctgcacaccgagaacctgtcaggagcagttatgtgggggcaggattagattcagtatataggtccagctactcacaatatggcagctcaatctatccctcgtcatcactgccgtcttattctagcatcgatgatgttagtagatacccgtcttcaggccttggtggctatggttcgagttaccggtactaatagcaatttgtcctcgggcttgaatgcttgatggcaccagtgatcattgtatccc

SEQ ID NO: 34782 - DNA, 431 bp, Zea mays
  unsure at all n locations
  Clone ID: LIB3060-025-Q1-K1-G5
ggccacacacactcacacacacacagtctaacatccccccgcagtcgcaacgggggcaccacacatgatgagactggagtagaggccgaaggtaggagccgacgggttgaaatcccccccgcagtcgcagcgtcgtgatggtacgaatgttgcggctggagtagagaccggtgtgtgctcgaagaagacgatagcccctagatgccgaggtagccgaagtcgaggtggtcgcggtcggaagacgcgcagcaaaagcctgatcttcgggagggtcgacgttcgagcgtcaacgatcagcagggcgacacaacaaaagagcaccggcaggccgaccttcctgcttcttcgatcgtccaggcgtcaaggagccccgccagggaggccgacggcagcgcacgcatctacgccggtcanggtgtccgcgcccgttg

SEQ ID NO: 34783 - DNA, 399 bp, Zea mays
  Clone ID: LIB3060-025-Q1-K1-G6
cttgcggcaaaaccttgcgcgcaacaatggccgcctccctcccgaccaccggcgcgcgcctcgcggccccggccttcgcctaccggtcgcccaaggctccctccgccaccgccctcccgcgtgccgccgccttccctgcaatcgccgtcgcggcggcgcccctgcgcccgcgccgcgcgccgaggccggtggcggcccgggccgggggcgaggagcgggagacgatactgctccccgggtgcgactacaaccactggctgatcgtcatggagttccccaaggaccccgcgcccacccgcgagcagatgatcgacacctacctcaacacactcgccaccgtcctcggcagcatggaggaagccaagaagaacatgtacgcattcagcacgaccacctaca

SEQ ID NO: 34784 - DNA, 402 bp, Zea mays
  Clone ID: LIB3060-025-Q1-K1-G9
gatggcgtcgcacgagtcgctgcctatctccaagttcgtgggcgtggcgggcgcggggcccagggacgcgcgcccgtcgcacaactgcctgtaccgcgccgtggacatctacctcaagacacacccggggctggacgagatcgagcgggagaaggtgtgcagcgtcatggacccgctcaggctgtcgtaccaggcgcggatgcacgcgtcgcagaacaagcggctgccgctgcaggccgtgctcagcgtgctctactacgaccagctgaagatccgtagcgcggacggcagcggcggcacggaggaaaggtgggagacacagtcggccgccgggaaggcccgtgcgcaggcgcgggcggacgtgtcgctggcaagggagaacgaggcgctgcggttggagct

SEQ ID NO: 34785 - DNA, 431 bp, Zea mays
  Clone ID: LIB3060-025-Q1-K1-F2
cgttgataaaaaatcatatcttctagtggataatccgaaaaggattgcagcaagatgtatctcctcttggttcatttttgacgtttgctcaacaattccatatcaagcgtttggtctactatttaaaaagcatgcaaatggcctcgcttacagaattcttaacatgctacggttatggcgccttcgtcgcctcagtgatctatttgccagactagaaaaggatattaggttggactactactggataaggtgcatcaaactaatatctgttactctttttacagtacattgttcaggatgtttcaattacctgatagctgatagataccccaatccagcaagaacctggataggagcagcaagaccagactacagatcagagagcctatgggttcgatatgttacatcgatttattggtctattacaacac

SEQ ID NO: 34786 - DNA, 398 bp, Zea mays
  unsure at all n locations
  Clone ID: LIB3060-025-Q1-K1-D7
ggagcctcatccccttgcccacttctacagcccctctgctgcagcaagaaggaaagaagctagcgcttatagcttgtcagccatggccaccgccgccgcgtctagcctcctcaagtcctccttcgcgggctcccggctcccggccgccacgcggaccacaccggcgtccctcgtggtggccaccggcccgcgcggcgccggcgcggggcccatctgcgcgtccatgtccatgtcctcctccaacccgccctacgacctgacgtccttccggttcagccccatcaaggagtccatcgtgtcccgcgagatgacccgtcgctacatgacggacatgatcacctacgccgacaccgacgtcgtcatcgtgggcgccggctccgcggngctgtcctgcgcgt

SEQ ID NO: 34787 - DNA, 410 bp, Zea mays
  Clone ID: LIB3060-025-Q1-K1-D8
agacgagtgtcaagtgaacctgaaacttgcggtgtcactggctggtatagcctgagtgtgagtgagtgatcgagctagctgagctccgatcctcgctagctagctaggataccgccataccacaagtcttcttcacaagtttaggagtgacagcaacaagagatctcgatggcctctgccaccgtgctcaagtcctccttccttcccaagaagtccgaatggggcgccaccaggcaggccgccgcgcccaggccgcccaccgtctccatggtcgtccgcgcctccgcctacgccgatgagctcgtgaagaccgcgaaaacgatcgcgtcgccggggcggggcatcctggcgatggacgagtcgaacgcgacgtgcgggaagcggctggcgtccatcgggctggagaacac

SEQ ID NO: 34788 - DNA, 405 bp, Zea mays
  unsure at all n locations
  Clone ID: LIB3060-025-Q1-K1-D9
ggaagctgcaggagggagacgagcagtcggcggtgagagcaacccggcccggcccgggcccaatggagacgcaagtggcggctccgccacaccaccaccagcagcagcagcagaaggcggccaacctggcgcgtaccttcaccaagctgctccgccgcaagcgcgccgaggccgcggcgcagggcggcgcgcccgaggcgcccgcttctgtggctccgggagacgcgttggaggaggagcggacggagcctncgcccgccatcccgtccctcagcaagctcaagctgtcggggaacctcgccgncgactactcgttcgacgccttcttccgcaacgccgncgagaagaaggcggcggcggcgggagggggagcggtccggcagcctgcgggtgcgggggaagtga

SEQ ID NO: 34789 - DNA, 401 bp, Zea mays
  Clone ID: LIB3060-025-Q1-K1-E11
acccacgcgtccgcgggagtagtcgacgcgccgtcactgtatcctttgatcactgctagccgtaatcacgccacggtgctgactcccggcgagcagtgtaacattttccttcagccatgggcaaggagaagactcacatcaacattgtggtcattggacatgtcgactctggcaagtcgaccaccactggccacctgatctacaagctcggcggtattgacaagcgtgtgattgagaggttcgagaaagaggccgcggagatgaacaagcggtcattcaagtatgcctgggtgcttgacaagctcaaagccgagcgtgagagaggtatcacaattgatattgctttgtggaagttcgagaccaccaagtactactgcactgtcattgatgcccctggacac

SEQ ID NO: 34790 - DNA, 389 bp, Zea mays
  unsure at all n locations
  Clone ID: LIB3060-025-Q1-K1-E12
gcgtggagcgcgcgaccccgtacgtttccaccgctgcaggaactcccccgctccccggcggcccgcgcgcccaccaaccatggcagtcgcagccgccgcccaccacctgcccgttgtgccgcaccgccttgtcccggtccggcacaccagtagcagcccgccgccgcatccggcctcccgctgctccgccgcggggaagccgcccgtccagctccacgcggcgcaagcgagggcgtctgggttcgccgcgcgcgtcgcgttcaacccttccgggaactacgacctgtccctctccatgggcgaagacgagaccccgcaggtccagccttcgncgccgnctacccaagggcgcttcgaaatcgttatcaacaacgacaacatccgaacgc

SEQ ID NO: 34791 - DNA, 175 bp, Zea mays
  Clone ID: LIB3060-025-Q1-K1-E3
cgccactcgcgcgcccgggctcctttccgccacgctcacgacgatgccgtccccggcgtggtatcttctcctgaatccctccaaaccctcctgcttccgacgactctcgggcccgcgcctgagccggttacatgtctcctgcgacgcgccacggggcgcgcggaaggcccgaggc

SEQ ID NO: 34792 - DNA, 402 bp, Zea mays
  Clone ID: LIB3060-025-Q1-K1-E4
ggcttcctcctcctcctcctcccccttcccgagctcctctctcttgccgtccacgctcgactgcgcgagacactggtcaacgcccgggtggcaggcggctctggtggtgtgttgtgtgtgtggtggtggggtcgggtgagtctagctccgtcgcttgcgccggaagaacttgtcgggagctgtctctagccctcgggttccatggggaggaacggtagcgtgaagcgctcggcgtcttcgagcgctgcgggtgctgctgcggggccgccgtccttctctgtgaatcccgccgactaccgggtgatggaggaggtggggtacggtgcgcacgccgtcgtgtaccgcgcgatcttcctgccgaccgaggatgttgtggctgtcaagtgcctggatctcgatcag

SEQ ID NO: 34793 - DNA, 432 bp, Zea mays
  Clone ID: LIB3060-025-Q1-K1-E8
cgctctcgctgcagaggaaaggcgaatatggcgatgaccgtcgaagtgcttgctgcgactcgcgttcatgttctccacgagtattctactgcagatactggcatgcgctttgtacagcaactggtggcccatgttagcagctctcatgtacgtccttgtaccaatgccatgcctgttttttggtggtggatccacacacttcttgaccagcagagaaggtggagggtggattaatgctgcaaaattcttgactggtgcatcggccatgggaagccttgctattccagcaattctgaggcatgctggcttaatcgagaccggggccatgttcatcgagttcacgtccttcttcatccttgtatgcacagtgctgtgcttccatagggcgactctggatgaagacttgttaatgcgcattttaccgacaccctg

SEQ ID NO: 34794 - DNA, 415 bp, Zea mays
  Clone ID: LIB3060-025-Q1-K1-E9
gtcggcacctccgcttcaagatgcagatctttgtgaaaaccctgactggcgggactatcaccctcgaggtggagtcgtctgacaccattgacaacgttaaggccaagatccaggacaaggagggcatccccccagaccagcagcggctcatcttcgctggcaaacagcttgaggacgggcgcacgcttgctgactacaacatccagaaggagagcaccctccaccttgtgctccgcctcaggggaagcatgcagatcttcgtgaagaccctgaccggcaagactatcaccctcgaggtggagtcctgcgacaccattgacaacgtcaaggccaagaaccaggacaaggaaggcatccctccagaccagcagcggctcatctttgcttggaagcagcttgaggacgggcgcacgct

SEQ ID NO: 34795 - DNA, 300 bp, Zea mays
  unsure at all n locations
  Clone ID: LIB3060-025-Q1-K1-F1
gtgccaagccgcggccaccttgatgcatccggccaagatcggcggccgggcgccgtgcgcctggctgccgtcgtcccgcccgtcgtcgcaactcgccagggcgttcggcgtcgacgccggcgccgccaggatcacgtgctccctccagtccgacgtcagggacgtcgccagcaagtgcgtcgacgccgncaagctcgccggcttcgcgctcgccacctcggctctcctcgtctcgggcgcgagcgcggagggcacgcccaagaggctgacctacgacgagatccagagcaagacgtacct

SEQ ID NO: 34796 - DNA, 411 bp, Zea mays
  Clone ID: LIB3060-025-Q1-K1-F12
gagccatcgacacgatcgcgagcgcatgcacgtacgttgtcggaagctcgagttagaagaagcaccagtgcctgatcgatggcggcccaggctctcctctccggccggcagctgctgggccgccccgtgcagtcggccgtctctaggtcgtcggcgaggaaggcgcccttcgtcgtcagggccagctccagccctccagccaagcaaggtgccgacaggcagctgtggttcgcgtccaagcagtccctctcctacctcgatggcacgctgcccggcgactatggcttcgacccgctgggcctctcggacccggagggcaccgggggcttcatcgagcccaagtggctggcctatggcgaggtgatcaacggccgctacgccatgctgggcgcggtgggcgcccatcgcccg

SEQ ID NO: 34797 - DNA, 429 bp, Zea mays
  Clone ID: LIB3060-025-Q1-K1-D5
cggacgcgtgggcttgagaggcctatcacaatggatgttggttccattgtgctcatggacctgctatggtctgatcctacagaaaatgatagtgtggagggtttgagacctaatgcacgagggcccggcttagtgacatttgggcctgatcgagtaacagaattctgtaaacgaaacaaattgcagttgatcataagagcccatgagtgtgttatggatgggtttgagcgtttcgctcatggacaattgatcactttattttcagcaacaaattactgtggtactgcgaacaacgcaggggccatacttgttgtcggcaggggcttagttatcgtgccaaagttaattcatccacttccacctcctgttaattcacctgagtcctcccccgaacgtggggatgccacatggatgcaggaacttaacatt

SEQ ID NO: 34798 - DNA, 427 bp, Zea mays
  unsure at all n locations
  Clone ID: LIB3060-025-Q1-K1-C1
aagtcgagcttaagctccggctttatggctccaaatccgtcgtcaaatacccccggtgtagcctcataaggcattcaacctacgccgacgccgaggaggaccaatcgatgttcatggcgttatcaagcatctggatgctgctcctcctgtttggtacctctgcagttcttgttcctactctgtacactctgagcatcgcgttcggggatgtgtttggggcaaggcaccttctgtacggtgaaaagtccctcgatgcggtaacaagagttaacgacttggctttggttggattggggtatctggttggttatcccatcgcatctgcgtccgttggcgcgctgcaaggcttattgtcaaacaatttggttgccctaaaagggtcctgcccaaattgtggcgagcangtatttgcattttgtcaagatgg

SEQ ID NO: 34799 - DNA, 403 bp, Zea mays
  Clone ID: LIB3060-025-Q1-K1-C10
cgtcctccagcccacctccgtggcgcccctctccctgctccagctccttccgaccagggagctgtcgcactggtgaagcagcaacgctcggcttcccctagcctccaacccttccgtcgtctttctcctctctctaatctccagcacatgcccagctcctctccacgccacgcgactgcagaccgaggagcagtccgcgccaggtgaaggcaaggagtccatctcccgcgacatgctccaggccagcggcgtgggtctggccgtggtggtcagcacggtggctatccggccatgtggagacgagcggtggtgagcagggcatccttccattgatttcctccctcggctccctccttgcttcactctctccctcagatttgtctgcgcgcagtcgtgggttcct

SEQ ID NO: 34800 - DNA, 210 bp, Zea mays
  Clone ID: LIB3060-025-Q1-K1-C11
tcgtcctcacagtctttacttcatctacgtatgactatgcctaaatcccatagctcttgaagaactcgacacatacgatctttcttgttctacttaccacttatactcaacgcaccatggggctcgcacatctcgcatgcccctatataactattcctgcttctaaattttcattttactctgccctttcaacatactcgttcatctaca

SEQ ID NO: 34801 - DNA, 240 bp, Zea mays
  Clone ID: LIB3060-025-Q1-K1-C12
atcctcagccccgaatgcgtgcctagtcaacttgcaccatgctcacggtaccataacctggcaccgttctctttaaattccactacctaagaccgatttacaatgttcgagcagaggctacacgatcacacacaccctggccatctctacaggtgctcttgcttctacaatactattgatcccctcgctatcgctaccaatccggagaaccttcaacgtttcaacgactctaaactctac

SEQ ID NO: 34802 - DNA, 435 bp, Zea mays
  Clone ID: LIB3060-025-Q1-K1-C2
cgtacctggagtttttggacagggtgcacacctctgagctgaagctgagggcacagagcctctgggaagttccacacccttggttgaatcttctgataccgaggagctcaatccgcagatttgctacggaagtctttggcaggatcctgaaagatagcaacaatggtcctatattgctttatccagtgaacaaatcaaagtgggacaacaaaacgtcagtggtcataccagatgaggaaattttctacctagtgggattcctttcttcagcaccgtctctctcaggtcacggcagcattgcacatgcgatgagcctgaacagccaaatagtagagttctgtgaagaggctgatattgggatgaaacagtatctagcacactacaccacacaggagcagtggaaaacccactttggaacaaggtgggagacatttg

SEQ ID NO: 34803 - DNA, 396 bp, Zea mays
  Clone ID: LIB3060-025-Q1-K1-C3
cgcttccttctccgccgggtcgcggtgcgccagccggcgaggcgcgcgctggtcgtggaggcccggggcggcaggggctggtcggagcggcagatgcagcagcagcgccgcgcgccgctgctgccgaaaatcgaggacgacggcaacccgcgattcgtcatcttcatccgcaccgccaatgtctacttctggtacccgctcaacatcatcacgggcggtacgacggcgaagatcatgctcgccgccaaggacaacttcctcggcaggtacatctacaaggacacgctcgccaggaacctcgccgccgtcatttacaaagacgaggatgagatcatagacacagcgaaagagcagtaccgtgtgctcaagaccgaaaatgagtttcggtatggctac

SEQ ID NO: 34804 - DNA, 426 bp, Zea mays
  Clone ID: LIB3060-025-Q1-K1-C4
cctgcctgcaggctcctgcaactgctttgtcggcgctcgggacgctctccggcggggccggcggtgtctccggcctcatccgcctccgccgtcgggtggcccccgcgctcgcggcgccgtcgcaccacgccgctgggacgttgaactgcgccgccttgcccgatgccgccccgctcgtctggggacgccagctccgcccgtcgctcctcctccccgccacactgctcccgtcgtcgtcgcagggcgccaggaggcacacgccacggcggcccgccgcagccgcaggggaggccaagtctgtgggtttcctggagaagtacccggccctggtcactggcttcttcttcttcatgtggtacttgctcaacgtcatattcaacatcctcaacaagaggatctacaactaacttgccctatccatacttt

SEQ ID NO: 34805 - DNA, 429 bp, Zea mays
  Clone ID: LIB3060-025-Q1-K1-C5
gcaaagaggttctttcaagtcagcatgacttagagagtcatgtagaaacacctgacagcaacagtgatgaaaacccatctgcacctaagaaggcatctggaagcaaactgtcagcttcagcgcctccattcaatccaggatcactcttatcaatgtcccacccatacagcacggtggcaatatatgatgctagtgctgttattcaggcagtaccaaaccaagcaatggagattctccctcatgccattgacactagagtgcctcgtggccctcggtccaccttgtactatcgtactgggcattccttccaaaggaagcaaggttacacgcacagccagagcactattgtaaggggtagttactcccccacaaccatgaacccccatgctgctgaatttgtgcctggaaaaacattcgcagcattctgat

SEQ ID NO: 34806 - DNA, 398 bp, Zea mays
  Clone ID: LIB3060-025-Q1-K1-C7
ggcagctccgctggtcgatcagctctcggctgaccactcatcgccagtgggtgccggccgaccaggtctcgccgccgccgcggtagaggggagggagagggagaaaaaactggcccagatcgagaggtacagcacgaaaaagagaggcaagagagataggggaccggagggcggcgggccggggcccaagaccgaggggctcgtgcgcaggaagctgatgaggctcctgtcgctcgtccccttcggctgccgtgctggacccatcgacgacgcgccgacgcccgtggaccacgctgccgccgccgccgcgaggaggcgccggaggaggagggccaacagagccgcccagctgctgggggctgctgcgggtgcgccgcagcagtggcgcccctcggtcg

SEQ ID NO: 34807 - DNA, 402 bp, Zea mays
  Clone ID: LIB3060-025-Q1-K1-C8
gaggagcagccatagctacattggagtacatcgaggttagcacattcctgggcaccggccttgtgtacccagtgccacacaacgtgcgcatggtggtcaggctgcaattccggttggaaggacaggggaatgctggtgacaagaacgtgctcacaacatagagctgctctgaccgggcgctgtgagaacacggcgccgcggcacctgactacctgcacggctcactgctccgagactaccgactggagccgctcgggctgcaaatgcccgtgcgatacctgcaactggagatcacactcgatggaccacaaccttctcatgattgacgacgtaggtatcatcggcacccggaccgtgatctgcgaagtcaagttcacccccatgcatacctactgcgaggtg

SEQ ID NO: 34808 - DNA, 393 bp, Zea mays
  Clone ID: LIB3060-025-Q1-K1-C9
ggcttctcctccccctcttaccaagttctcctcgggttagggttccttagggttttgtggaggggcgatggcggcggctgatgtggagtaccgttgcttcgtcggcgggcttgcctgggccaccagcaacgagtcgctggagaatgccttcgcctcctacggcgagatcctcgactccaaggtcatcaccgaccgggagacggggaggtctcgcggcttcggcttcgttaccttctcctccgagaactccatgctcgacgctatcgagaacatgaacggcaaggagctcgacggccgtaacatcaccgttaaccaggcccagtcccgtggcggtggcggtggcggcggtggctacggcggcggtcgcggcggcggcggctatggtggcgggcg

SEQ ID NO: 34809 - DNA, 340 bp, Zea mays
  Clone ID: LIB3060-025-Q1-K1-D1
ggcgcggctaggcgccgaggacctctggtgcatcaagcggctcgcggacggctacggcgccggcccgctcggcgactggaccaaggcgccggccagacgctccatattcatcgacccgagggagttttaggctgataagtagtaaatacacttaggcctagctttagggtttttttttggttctccccgggtcgtcgtccgttggatcccgtatccgacggctcctagtagctagctctagagaaggtcccacccttttgggtttcgtttcaaaacatgtggtaacgcgcgcttgcttaggcgtaatttctgctagagaaccggaataggtaaccttttc

SEQ ID NO: 34810 - DNA, 401 bp, Zea mays
  Clone ID: LIB3060-025-Q1-K1-D10
ctcgctgttgcttgccacccaccgcctcagctcgatcgcaacgcgctcgggatggcgtccgaggtgtggctatcgccggcgtctcgcctcccatccctctccaacgcaccacctcgcttacgctccaagcctgccaccacaaccgcctctttgctctctccctgtccccgccctgcccgcgccctgcctgtgctgcgtgtccgtcgccgccgccgacttcgcgccaccgagcagcaaggccaggttcaggagcaagatgacgaggtggtggacaggaacatcctcccctactgcagcatcgacaggaagcagaagaagacgctgggagagatggagcaggagttcctgcaagccctacaggccttctactatgaccagaaggccatcatgtccaacgagga

SEQ ID NO: 34811 - DNA, 379 bp, Zea mays
  Clone ID: LIB3060-025-Q1-K1-D3
cgcactttagtaagctatttctgcataagtatctaagttgattcttgctaaagccgtttccttgattcctatttaaccagcatatccttgagagtcattttcccttagtcgggtaaggcttgcgaaagtacactccgtactcagggttttcgaacccatgttgttgtaggtgatgagaagtactctaagtgttcctgtggctggagggcgtttccagttctgggggaggattagttaggcttgtgtataagctttggagggttcctaccttcctgctattgtaataagttatgcactttgagtatatcaggacttgtaataaatgtaactcttcctatgtaataagcttcagttttagaaataaaaaagaatgttttgt

SEQ ID NO: 34812 - DNA, 392 bp, Zea mays
  Clone ID: LIB3060-025-Q1-K1-A1
acgcgcaaagcaccccctctccccccgtcgccatggcgagcgataaccgcgcgtcgcgcctccccttcgccgccgccgtccttgtggtgctcctcgctggcggcgccgcggcggacgacgcttccagcgacgacgacgctgggacttcacggacacccggctgctccaacaagttccagctggtcaaggtgaagaattgggtgaatgggactgaaggtacaacttttgttggcctaagtgcaaaatttggagctcccttgccaagagatattcatgaagcaaaaaagtcatttgctgtcctatcaaatccaattgactgttgctccaacttgacatcaaagttaacaagttcagttgctatagcaacacgtggggaatgtgctttcacggga

SEQ ID NO: 34813 - DNA, 398 bp, Zea mays
  Clone ID: LIB3060-025-Q1-K1-A10
gcgacacgatcgcgagcgcacgcacgtaagcacgttgtcggaagctcaagtgagaagaagcaccagtgcctgatcgatggcggcccaggctctcctctccggccggcagctgctgggccgccccgtgcagtcggccgtctctaggtcgtcggcgaggaaggcgcccttcgtcgtcagggccagctccagccctccagccaagcaaggtgccgacaggcagctgtggttcgcgtccaagcagtccctctactacctcgatggcacgctgcccggcgactatggcttcgacccgctgggcctctcggacccggagggcaccgggggcttcatcgagcccaagtggctggcctacggcgaggtgatcaacggccgctacgccatgctgggcgcggtgggcg

SEQ ID NO: 34814 - DNA, 362 bp, Zea mays
  unsure at all n locations
  Clone ID: LIB3060-025-Q1-K1-A11
gacccacgcgtcctnggaaaaggtggaaacctttaccaattttgattttagctcaatggaagcgcctatggcatctggaagcacataagctgtacatggttatgggatcgtgttctagttagccgtggtgcatatggaggattttgtgattttgacacccattcaagagtgttctcatatttatcatatcgcgatccaaacttactgaaaacactagaggtctatgatgagacaacgagattccttatagagctaaaattggattatgatgcactcacaaaagctattattggaaccataagctatgttgacgcctaccatctaccataatctaaaggtgacagcatcctaatgagatattt

SEQ ID NO: 34815 - DNA, 429 bp, Zea mays
  Clone ID: LIB3060-025-Q1-K1-A6
ctgaaagtttcttggtttcgaggtgctcttattggttattggatcgctgtgtgtaaggtgtttctttccctttgagagcctttctagtttcttgggcaggctcttgagctaccaagcatgtcagattcaaatgtgaagtggattgatgggctccagttcacatcattgtactggcctccacccctcgatgcggagcagaagcaggcacaaattttggcatatgtcgagtactttggccagtttacagctgacaccgatcaattgcctgaagacataactcagcttatttcaaggtcctaatcatcaaaagaaaaatccttggtagaataaagtattggcaacttttggtcttcatcatccggagcatggtcatgcagttgcacatccaattctttcacgcatcatagatgggacgctgtgctatgatag

SEQ ID NO: 34816 - DNA, 407 bp, Zea mays
  Clone ID: LIB3060-025-Q1-K1-A9
gcgtgacagggcttctaactgtacatgttcgatggatggatttgaagaatggatcaggctctgaggggttgtttgcatcttattgatcttgctggtagtgagagggtagacaagtctgaagtaaccggcgatagattaaaagaagctcaatacattaacaaatcactctctgcgttaggtgatgttatttttgctttgtcacagaaaagtgcccatgtgccttatagaaacagcaagttaacacaagttcttcaaagttctttacgtggacaagcaaacactctcatgattgatcagataaatcctgatgttgagtcatattcagaaactatcagtactttaaagtttgctgaacggctgtctggagtagagttaggtgctgctagaagtaacaaggagggaaaaga

SEQ ID NO: 34817 - DNA, 384 bp, Zea mays
  Clone ID: LIB3060-025-Q1-K1-B1
gcgcctcttcctcgcaccaccaccgttactcaacacagcacaggcagctcgagagagagagagagagaaagatgtcgtggttcgggcaccaccaccacaaccagccggctcccccggcgtcgggccccaaccaggtgttcaagatcttctgccgcgccaacgagaactactgcctggccgtccgcgacggcgccgtcgtgctggccccggtcaaccccaaggacgaccaccagcactggtacaaggacatgcgcttcagcacccgggtcaaggacgaggaaggcatgccggcgttcgcgctcgtcaacaaggccacggggctcgccatcaagcactccctcggccagtcccacccggtcaagctcgcgcctttcaacccggacc

SEQ ID NO: 34818 - DNA, 395 bp, Zea mays
  Clone ID: LIB3060-025-Q1-K1-B11
aatggccgctagtggcctcggtctctccacctccttcctccccggccacgacacccgcctccggcgccggcgccggcggccggcgggccacgccgccgcgtcgttccggccggtgacggcggagctcggcggcgtcgcgacggagctgggccgccagctggtggaggcggtgggcgtggggctcccctgcaccgtcatgcagtgcggcgacgtcatctaccgcagcacgctcccccggaacgacgggctcaccatcacggcccccggcgtcgcgctcgcgctcgctaccgtgtcgtacctctggtccacgcccggcgtcgcgccggggttcttcgacatgttcgtcctcgccttcgccgaacgcctcttccgcccttccttccgcaaggatgact

SEQ ID NO: 34819 - DNA, 355 bp, Zea mays
  Clone ID: LIB3060-025-Q1-K1-B2
cgcacgcgtccgcccacgcgtccggcttggcgacggcggggctgaagctggaggcgggcgactccggcctgcagacgggtgaccccgccgggttcaccctcgccgacacgctggcctgcggcgccgtcggccacatcctcggcgtcggcatcgtgctcgggctcaagaacaccggcgccctcgaccagatcatcggctagatccctacgtcgccgttgttaagatcagactcagcagcctcgatcgcgccgccggccggcaggtgcaggtggtgactttgtaacgtgtgtgcgtgcgtacgtgtacattgcatccatcttggttccaatggacatatagctcctgttgctcctct

SEQ ID NO: 34820 - DNA, 402 bp, Zea mays
  Clone ID: LIB3060-025-Q1-K1-B3
cgagagagcagaggcgctcagcacggagcgagtccggagcatagcaacctcgctgggctcgggcccgcggagccgggatatactccagggaagtcgagcaaggagagcgtggattgtggactacaggggtaaagatcgagtgagcatcgctgcaccatgcgcccttctatctgctgtgcacctctttttcttctgctactattacatttggcatttgctagacctctctttcctctaccgagtaagacaaagaatgaagagaagaagcccatacagacgtttcggccatataacattgctcatcgtggatcaaatggggaaattcccgaggaaacagctgctgcatacatgagggctattgaagaagaggcggattttatagagtctgacatccttgctagc

SEQ ID NO: 34821 - DNA, 417 bp, Zea mays
  Clone ID: LIB3060-025-Q1-K1-B5
ggaacgtgtacgtggagttccgcgaggaggagcaggcggcccgcgccctggaggcgctgcagggccgctactactcgggccgccccatcatcgccgagttctcgccggtgactgacttccgggaggccacctgccggcagttcgaggagcacagctgcaaccgcggcggatactgcaactttatgcacgtcaagcaggtcggccgggacctgcggcggaagctgtttggccacctgcatcgctccctccggagccacagccggggcagccgcagcccgagcccataccgccgccgcggtagctcgtccaggtccagggaccgcgacgattactactactacaactaccgtagtggcagtggcagccgcaagagcagcgagaggcaccggaaccacgacagggacgggagccggcgtc

SEQ ID NO: 34822 - DNA, 410 bp, Zea mays
  Clone ID: LIB3060-025-Q1-K1-B7
ggcgcgtgcttcttactggcaacttggcaagtggcacggccgcacggatgcgtctgcatcgtcgaggcgaggacgaggaagcagatcgaagcacccaaccacaccacactggtggtgagtggttgctggcgatggccatggaagcgatgatgagcgggctcaactccggcgtggtgctcagcctgatcgccgtgctgtggacggtggtgtggcagaacctgcagcacctgcagctgcagcagttcttcgcgcggcagctgagccggcgcgcgcggcggctggcggcgatggtggacccgtacctgtcggtcaccatcgccgagtacgagggcgggcggatgaagcgcagcgacgcgtacgaggaggtcaaggcctacctcagcgacgccagcgcccacggcgtgcgccac

SEQ ID NO: 34823 - DNA, 255 bp, Zea mays
  Clone ID: LIB3060-025-Q1-K1-B8
cttctgctgaatgcacgctctctcacttggcatcatcatcttcatttggtggagtgtctgggacatgatcatcatctatcatctttattaggtggagtttcaggggcatgatcatcatctggctgacattgcattgtcaccaaaacatgctggtgttacttttttttagtaaaccagcgaaaccacatcaactattataatgaaaacacatcggtggaactgcacaaaggggaatacatgatactaatgctacaa

SEQ ID NO: 34824 - DNA, 410 bp, Zea mays
  Clone ID: LIB3060-024-Q1-K1-H8
cacgtcctcgcctaaatccacacgcacctgatgggatctatagctgccctggcgcagtccaagtctcgcccatggaaggaatcgtcgctggaagaaatcctcgccaaaatccacgctggatgggatctgtgtgggcaccgtgggtcgcctaaatcgatgccgcaccattggcaccttccatcctcgacgccttccatccatggatggaaatcgtcctttccatcggcggcgcccttcttctccccacacagcgccctgcctccccatccttctctgcatcccatctgcggtgcagccatacgcgctcacggtagagcaccgacgggggatccgacgcctgctcctgcatccctgcagagaggcctcctcgtcctcgcccttggcggcaccgtgaggtatggctacattcg

SEQ ID NO: 34825 - DNA, 399 bp, Zea mays
  Clone ID: LIB3060-024-Q1-K1-G2
gcaaaagccaaaaggcatcaccgccgcgacgacgatggcagcctcgctccaagccgcgggcaccctgatgcagccggccaagatcggcggccgggcgccctttgcctcgctgccgtcccgcccgtcgtcgcaactcgcctgcagggcgttcggcgtcgacgccggcgccgccaggatcacgtgctccctgcaggacgtcgccagcaggtgcgtcgacgccgcgaagctcgccggcttcgcgctcgccacctcggcgctcctcgtctcgggcgcgagcgcggagggcacgcccaagaggctgacctacgacgagatccagagcaaaacgtacatggaggtgaaaggcacgggcacggcgaaccagtgcccgaccatcgacggccgcgtggagtcgttccc

SEQ ID NO: 34826 - DNA, 329 bp, Zea mays
  Clone ID: LIB3060-024-Q1-K1-G4
ctcaattcggcggttccaaaactaggagctcaacattgcattatcaaatatctcataatctatacaactataactctcacattctaacttcatcaaattattctaataaattaataatctctaaataattcttaaaaatacaaattgctaattaattcattttcaatttacaaaaatttaaattcaaaaaaatgtgtcttaattatatcatatacaactactacacattcattcaagccattattccattttcttacaaaatattatatacaaattgatcaacccctatcttacaaatttcttccaaaatacaacacacctttttatac

SEQ ID NO: 34827 - DNA, 432 bp, Zea mays
  Clone ID: LIB3060-024-Q1-K1-G5
gcgccttcctcgcggcgctggcgtcgtcgcccgacgctgcgctggcggacgtggcggcggcggacgccggcggcgacagccgcggccagctgctgctcgtcgtggtggcgcccgccatcgggtgggtgctgtacaacatcctgcagccggcgctgaaccagctgaaccgcatgcgcagcagccaggccgtggccgccggcctgggcctcggcgccgccgccgacgtcgggatggcggccccgcccgaagcctccgtcgccgtggtgcaggacctcgcggcaatcgccgtcgacgcgcccgccgacgacagccgcggcctcctactgctcatcgtcgtcgcgcccgccatcggctgggtgctcttcaacatcctccagccggcgctcaaccagctcaaccggatgcggtccgactgaagctagctagctagcg

SEQ ID NO: 34828 - DNA, 434 bp, Zea mays
  Clone ID: LIB3060-024-Q1-K1-G6
gctctgccgacgttcctcctgatcaaggagggcgaggagcagcgcagggtcggcggggccaaggtcgaggagctcaacatggcattatcagatatcggataatctaggcagctatagcgctcacattctaacttcatcaaattattctaataaattaataagctggaaataagtcttaaaaatacaaatggctaattaatgcattttcgatttacaaagattgaaattcaagaaaaggtgtattaattatatcatatacaactactacacatgcatgcaagccatggttggattttgttacaaaatattgtgtacaaagtgatcaacccctatctgacagttttctcccaaaggacacaccccttgggagacactgcatccattgtatataagagatcctatttgcaataaagttgacaactgtcattcccttc

SEQ ID NO: 34829 - DNA, 426 bp, Zea mays
  unsure at all n locations
  Clone ID: LIB3060-024-Q1-K1-G7
cgcaccccatctctgatctgatctgatctctccccctggatctcgacctccgcctggctgctccgctctgcgtcgctcgccatggcgtcctcgacggggagcttggagcacggcgggttcacgttcacgccgccgcccttcatcacctccttcacggagctgctctctggggcagcagcggacatggtaggagccgcgggcgccgatcatcaggagcggtcgccgagggggctgttccaccgcgggggccacagaaggcggcggcgtaggcgttccccaagttcaagtccgcgcaacccgccagccttgccatctcgccgncgncgatgtcggcctnctnctacttctncatcccgccccgggctcagccccgccgagctgctggactcgcccgtcctgctccactcttcctcgaacttcttcgcg

SEQ ID NO: 34830 - DNA, 402 bp, Zea mays
  Clone ID: LIB3060-024-Q1-K1-G9
cgaccttcaagtctcgctacgtagcagtgcaataaaaaaagcagccgcaatggcgagcagcaccatggccctctcctccacggccttcgccggcaaggccgtgaacgtgccgtcgtcgtccgccttcggcgaggcccgcgtgacgatgcgcaagacggcggcgaaggccaagccagcggcggcgtccgggagcccgtggtacggccccgaccgcgtgctgtacctgggcccactgtccggcgagccaccgagctacctgacgggcgagttcccgggcgactacggctgggacaccgcggggctgtcggcggacccggagacgttcgccaagaaccgggagctggaggtgatccactcccgctgggccatgctgggcgcgctcggctgcgtcttccccgagct

SEQ ID NO: 34831 - DNA, 377 bp, Zea mays
  unsure at all n locations
  Clone ID: LIB3060-024-Q1-K1-H10
attcaacttcatctgcattttacttgtataattgcaggactgcgtccagcttaggagatgctggtgatggtcaattatgcagcacctcagaaacactagtggatgttgaaaatagaaatggagatttggcagctctgtctgaagacacgactgaaacaaatcgtcctcctatcagagttgtaccatttcctgtccctgttcaatgcttcacatttgatgggcagccgttctggaatggtacaccggtggcatctccattctacccacagtcagctccccccatttggaatagcaaaacaccaacgtggcaagaatcaaccncacaggcaacttcactggcgcanaaatcgcaacagaatgaacccagttgaatggat

SEQ ID NO: 34832 - DNA, 376 bp, Zea mays
  Clone ID: LIB3060-024-Q1-K1-H12
accgcactgattgggctccaagatcggccgctgccaactggggggcctcaccgccagccgttcttggaaaacagcacgctacttacttgaaagtaaagggagatacttgccgcgttgggattctccaactccaaccaagacgaacgatttcatcccactaatcctttttcttttcttttcgtttttatttttaatttcttggttcggttcttgatcacctgttcttccttatgaccttatccaggaaattagattatcaggtgcttctatttgtttgtgcatctcttgtttgcgcctgcgatctggaccttttttggctcctcaacaaaagagaagatgagcctttcttggtggtagttacaaccggtggcgtctc

SEQ ID NO: 34833 - DNA, 446 bp, Zea mays
  unsure at all n locations
  Clone ID: LIB3060-024-Q1-K1-H2
gccacagcttgcgcccgcaatggcactcgtctccgcctcctcgtcctccaccaccggcgtgacggcgctccccaggaatgggcagcgggcgtcgtcctccttcctcggcggcaagacgctgctgagacaggccgaggcggcccggccgtcgttcgccgtgcgcgccgcggcggaccccaacaggccgatctggttccccggcagcacccctccgccgtggctcgacggcagccttcccggcgacttcggctttgatccctggggcctcggatctgacccggagagcctgcggtggaacgtgcaggcggagctggtgcactgccggtgggcgatgctcggcgcggcgggcatcttcatcccggagttcctgaccaagatcggcgtcctcaacacgcccttctggtacaccgncggcgagcagcagtacttcaccgacaccaccaccc

SEQ ID NO: 34834 - DNA, 448 bp, Zea mays
  Clone ID: LIB3060-024-Q1-K1-H4
cttaattatctttcggacatgctacataatcacaatcagatgtgtgacatattatggtatgacatcctggatattcctttgcctgaactagaatctatgagatctctgaaggtcgctttccaaaatgccgcaaaccatgagatgtcgtttcacattatgcggttaccaaaaagtaactctctccttgatttgattgaagacttaaagtcaaaggttgaaatttcttgtaatgatgctgaatttcggttttttggagtctaccttcacaagatatgcaaggtgtatcaacctggagataagatagattcagttaatgaccatggacccttgtatattgaagaggttcccgaggatgaaaaaaatgccgggcctcatgaccgtttggttcatgtctatcattttgaatataatcatcatattcagtattttggtgaacctttcttcttcc

SEQ ID NO: 34835 - DNA, 448 bp, Zea mays
  unsure at all n locations
  Clone ID: LIB3060-024-Q1-K1-H5
cccacgcgtccgcggacgcgtgggcgccgccgccgcaagccgtccgccttgcccttgacgaaggcttggtcctgctccttgtatctccactccccccttcacagatccgttcctccagctagggttagcgttcctctgcagcgatggcgatcaagcggaccaaggcggagaagaagatcgcgtacgacaagaagctgtgcagcctgctcgatgagtacaccaaggtgctcatcgccctcgccgacaacgtcggttccaagcagctccaggacatccgccggggcctcaggggcgactcggtggtgctcatggggaagaacacgctcatcaggcgctgcatcaaagtgtacgccgagaagaccggtaaccacacctttgacccgctcatggacctnctggtcggcaacgtaggcctcatcttcaccaagggagacctcaaggaggtgcc

SEQ ID NO: 34836 - DNA, 460 bp, Zea mays
  unsure at all n locations
  Clone ID: LIB3060-024-Q1-K1-H6
agttcctcgtctctgcccaatccgaccacccccatccattcaccaacccgaaatagaaggccgtcgccggccaccagcctccggagttcctccggcgatccccgtccccttgtgtgcgcgctccaggagggccttctgcctccagcttgcagagcccacctaattgctgcgagatggatagagggcagaacgggagggatgacgtcttcggacgcagggatccattttctgggtttggcttcggcccccacaggagcttgttttctggtctccttggggggagggatccatttgacgatccgttctttacccatccgttcgggggtcggatgatgggtgaccatgacatgtttgtacctagtccttttgggccgatgggagggccttttggggacatgaggaacggtgggtttatcgagcaagctcctnctaggggtaacagaagaaggcctgtgatcac

SEQ ID NO: 34837 - DNA, 283 bp, Zea mays
  Clone ID: LIB3060-024-Q1-K1-H7
caagaaggtgaaagtcaaagaatatactgctggactctacgaacatttctctcgagggaaattggttaaagagactgcaaagatatagcttgttcgctttggattaaatccagctatttggactaatccttagagacaaaaacactgtataagtagtaaaagtcggtacgaattaaagctcaagctagtcgtatctatgtaatgaataagggtgaaacctttgcgatcctagataataaatgaaattaatttttaataaaataaagtgtatatagttcgttgc

SEQ ID NO: 34838 - DNA, 405 bp, Zea mays
  unsure at all n locations
  Clone ID: LIB3060-024-Q1-K1-G12
ctgccaaaagtatatctgtcacaaacttgtttggctgaactattgttgcccttgaagacacgagcctatgtgactgtcttggggatgcaactgtggagtccttgagatgaaactggatttacacaaaagtaaatcctttgtggactagcagtagttgcatatacatggatgggttgaagtttagccatcctggttcatattcatgtagtgcagttcatattcatgttgatatgcaatacaggttggtgtttgttcaacttgaatgcaagctaggatcggttgcttctatttatgtaactctgtattatctccagattagtatattcatatattcatcttgttatatggtgcactaggatcttgaacaataattntattggagctggttgttgtggcaatggagca

SEQ ID NO: 34839 - DNA, 434 bp, Zea mays
  Clone ID: LIB3060-024-Q1-K1-E8
cccacgcgtccgtgcgttggccacaaccacaaccttatcttctggccgcgcgcctgcttcttccgcacaaattgtccagctccctctgcgtttctctctgctcgcctcggcctccaactccggccatggtggccaccggaagcgcgtctcccggctccagctcaacggtctgcgttctccctgctctcccaagctgcgcgcccctgtcctgttccctgcgcgcgctgttcctgctcgctttggcatccgcgccatggagccctgcagggacgggccggtaaatttagaggccctgtactaaaattcagaagaggtcctatttcatagaaaaaaaatacaatcagaactatattgtaatagaattcatatattctaaattgcaaaacatttactagatgtgtttgaaaagcagcaagctagctgctaactaagtt

SEQ ID NO: 34840 - DNA, 387 bp, Zea mays
  Clone ID: LIB3060-024-Q1-K1-E9
agcaaaccaaaaaagaaagagagggggagagacacagaggcctcactccacacactggcttgtctctcagtcccagagctttcttggatcgcgaggaatccactggaaattttgcaattgtagtagagaactgtatcgtccgacgaaggtgcatggtgttggccatgggtcacggcagggaacagagacgagcaggtcggcgctctccccccagctcattgatcctgtcctcgctataaggtagtcctgcggtggcctccgaatttcactcgatcgaacacgacatgaagcggccacgcggcgccagtccccctctggctgcgatgaccaatccgaacgatgatggttacggcgtggtcgggatggaggcggacgcagacgcggacg

SEQ ID NO: 34841 - DNA, 399 bp, Zea mays
  unsure at all n locations
  Clone ID: LIB3060-024-Q1-K1-F10
gacatatcacagggacctcttcaggcttcaaggcagatccgcagcagatggaggcgaagagcaggctgccggaggtgaccatcgtcccggcggcacggccgttggctggcgacggcacagtcgacgcggcaaaggcggcggcaggcaaggagcccgtaagcccgggcactccgtcctcggtggccgccggccgcagcagctgtgaggagaggcgcgcggtggacggcgtcgccctgcctgggtggaagctcgacgccctctgccaggagtcctgcccgtcgccggccatgagggcgcgcttnccctactacttctgaagctttcctgttgcagtcctgcgtgagttcttgagcggcgacatctggtgcatgctcttgacgactgatggcgttctcttgg

SEQ ID NO: 34842 - DNA, 406 bp, Zea mays
  Clone ID: LIB3060-024-Q1-K1-F11
atggccgcctccgcctccaccgtcttcggcctcgccggcgcctccctggccagccggccggcgttctccaccagcttcacgcggggcagccgggtgtcggcgaggaaccccctgatgagcaggaacctggagaggaatggcaggatcacctgcatgacgtttccccgggactggctgcggagggacctgagcgtcatcggcttcgggctcatcggctggatggggccgtccagcgtcccggccatcaacggcaacagcctcacggggctcttcttctccagcatcggccaggagctggcccacttccccacgcccccgcccgtcacctcccagttctggctgtggctagtgacgtggcacctgggcctgttcatcgtgctcaccttcggccagatcggattcaggg

SEQ ID NO: 34843 - DNA, 443 bp, Zea mays
  Clone ID: LIB3060-024-Q1-K1-F5
aaagacacaatggtgggtctcacaccaatgagttttgcccgctcatatgcatgtgcggctgcattggatggtcacatatttgcttttggtggtggaggtggcaagtcatcatggtataacacagttcgaggaataacgagtggatagaatgcccctcgttgaaccgcaagaaaggaagtctcgctggtatcagtcttaatagcaaaatatatgctattggtgggggagatggaaatgaaactttttcagaagttgagatgtttgatccataccttgggaaatggttatgtggtccatctatgctgattcctcgatttgctcttgccgtggctgaattgaatggaacaatctacgccactggtgggtatgatggaagcatgtacttacaatcagcagaacggtatgaccaaagggagggtgtctgggtccgtcttcgaagcatg

SEQ ID NO: 34844 - DNA, 137 bp, Zea mays
  unsure at all n locations
  Clone ID: LIB3060-024-Q1-K1-F6
taaaccatnncntcctcctcggtccgcaactctctcatgcttcgatcaccatcaccgtctctctcatcctcatctaaccaccacagcacctactccttctcattccctaacccaccactcttcccataccttcattc

SEQ ID NO: 34845 - DNA, 245 bp, Zea mays
  Clone ID: LIB3060-024-Q1-K1-F7
cggacgcgtgggcgcgctcggctggaggctgagttctgccgagatctcggagctcgagtccgcagcgatggcggctccgaggaagatgatccagaatgtcttccagactgcctgaccgtgctgaatacatgtgtgtgtatgcatgtttctgcaatcgtctttactgaaaaatctgaaaccgggcagccgtgaaccttttcttctcgtaagattcataatatagatagtcactgccatgttctatt

SEQ ID NO: 34846 - DNA, 408 bp, Zea mays
  Clone ID: LIB3060-024-Q1-K1-F9
cgacggaagtagtagagcaggggccgtgggcggagcccatgtggcccggctgcggtggccggttttactgggcgccggaatcggcgccgctggtgcaggccaggggcgtcgcggtcctgttcgcgtgggtgtggagcgacgaggcgcagctgcggccgttcgttgagctgtactcctcgctcgggtggcgctgcctcgtctgccaccccgatctcgtcgcactatatctctctgagaaagcaatatcgctggcaactggtgttataaatgagctggttaaggaactgaaaataaaaattgtgccaattgttcttgcttccttttctggcggctcaaagggatgcatgtataaggttattcagttactagatggaatatgtgaaggagatgcaatcatgaaggactatc

SEQ ID NO: 34847 - DNA, 415 bp, Zea mays
  Clone ID: LIB3060-024-Q1-K1-G11
cggacgcgtgggcgactgacgactgaggtctgacgaggcgaaaacctcgctgactggccccgccgccgccccgccccgcccgcgcgtcctccgccgtcgtccccggaagtgttttcgcctcagggcatgtggatctgttagttcacctgctgcaagcaagtatagctacagggttgaccagtgtagaagtatgaatccttactttgttgggattcttgtccccgtcgcggtctccctgctgctccgcaagaagagaaaggccgaaaggatgaggggagtgccagttgaggttggtggggagcctggatatgcagtccgtaactatcgttttgaacaacctgttgagacacactgggagggggtgtccacacttgctgatctgtttgagcaatcttgcaaagagtatgtatacatg

SEQ ID NO: 34848 - DNA, 442 bp, Zea mays
  Clone ID: LIB3060-024-Q1-K1-D4
atgatgaatcattgcaaatctcttgaatatatttttcactgtaaaatactgccttggctgtgagctccttggttcacgtgcaatgtttctttgccctccgattttgcaggacctcgagttaagttgggcgaggagaggtggttcattccagcagggatccttctcgtgagcccagtcgatctgaccgtccttggtatctgggggggttgttctgtactctctctttaatttgtgagtcgtgacaggttcttgaagtgcaattgttaagagttttagttgtagaggaagagaaggatttgctaatatggcgttggcagggacctccaaagtagtgctgggatgtatcgcctttgggattttctgggtgatggccgtcttccccaccgtcccgttcatgcctgttgggcggacggctgggtccctccttggtgctatgctaatg

SEQ ID NO: 34849 - DNA, 392 bp, Zea mays
  Clone ID: LIB3060-024-Q1-K1-D5
cgtctcctccagtccttcgaaaaccctgaaaccttggtgaagccgagacgagtttggggcaattatccaagcagctagtgctagcatctatggcgacctccgttcgtggtttcagtagcgccccctgcagggatgtgccgggcagctacggccttccgctggtgggcgccgtccgcgaccgcctcgacttctactacttccagggccaggacaagtacttcgagtcccgcgtggagcgctacggctccaccgtggtgcgcatgaacgtcccgccgggccccttcatggcgcgcgacccgcgggtggtggcggtcctggacgccaagagcttccccgtcctcttcgacatggacaaagtggagaagaaggacctgttcacgggcacctacatg

SEQ ID NO: 34850 - DNA, 440 bp, Zea mays
  Clone ID: LIB3060-024-Q1-K1-D6
gccaccagcaaccaaccgagcgcatggaggccgcggcggcgaccgcgctcccgttggcggcggccgtccccactgcctggagggtgcgcgcgagcccgcggacgcggcggcgctccgtggcggcgaagctggagcgcgggctcggcaagggggttcccaccaccaactacgtggtgccgctcgacaaggccaccgggatgacgcgcccgctcgtcgagatcctgcgggacctcaacaagcgcgtccccgacaagatcatcgaccccgacactaacaccgtcaactggtaccatgccaacagaatgcttagcttttacgcaccaggttggtgtggagaagttcgtgatgttatctattctgagaatggaactgtaaccgtggtatatcgagtgatacttaaaggaactgatggagaggcatacagagatgccacgggcaca

SEQ ID NO: 34851 - DNA, 423 bp, Zea mays
  unsure at all n locations
  Clone ID: LIB3060-024-Q1-K1-D7
aaatctttcatcaaacaaatttagtggtgaaattcctggaactttaggacaacttgagacaaatacagaccattcaaatggaccaaaacattcttactggaaacattccgcccatatttagtcgactatatagcttgaacttgctcaatctttcccataacaatttatctggccccatgccaacttttctaagtggtctaaatcttagtaaactagatctatcctacaacaattttcaaggacaaataccaagaactggtgtattcaataatcccacaattgtttcactagatggcaatccagaattgtgtggaggagccatggatttgcatatgcctncgtgccatgatacttcaaaaagagtaagtagatcaaacttattgatcaaaatattgatcccaatttttgggttcatgtcactcg

SEQ ID NO: 34852 - DNA, 426 bp, Zea mays
  Clone ID: LIB3060-024-Q1-K1-D8
gtagaggagcacaagtgagctagctagctctagctaggccacgcactgctgcgctgggtcatcatcaggtcgtgctagctagctagctatagctgggccgggggacgtacgacatcagcgcgcggccatgggcgtggggaagctgatgaacgacgtgaagccatacctggcgatggtgctgctgcaggtggggttctccgggatgtacatcgtctccgtcgcctacctcaagcgcggcatgaaccacttcgtcctcgtcgtctaccgcaacctcgtcgccaccgtcgtcatggcccccttcgacctcctcttcgagaagcgagtgaagcccaagatgacgccgctcatcttcctcaagatcatggggctcgccgtgctcgagcctgtgctcgaccagaacatgtactacctcggcgcgaagctgac

SEQ ID NO: 34853 - DNA, 383 bp, Zea mays
  Clone ID: LIB3060-024-Q1-K1-E10
attcaaaccgcccgttccccgtgtccgtgccaagcaagccgagcccaacccccaagggccagctgctcggtgctccacgcgatggcgcagaaggagactaatggcagcaacggcgatcacatctccacccgcccgccgccgaccccctcgcccctccgcttctccaagttctttcaggctaacctgcggatcctggtcactggtggggcgggcttcatcggctcgcacctcgtagacaagctcatggagaacgagaagcacgaggtcattgttgctgataactttttcactggttcaaaagacaacctgaagaagtggattggccacccaagatttgagctcatccgtcatgatgtcaccgagccgcttcttgtggaagttga

SEQ ID NO: 34854 - DNA, 416 bp, Zea mays
  Clone ID: LIB3060-024-Q1-K1-E11
cgggagtagtcgacgcgccgtcactgaatcctcagatcacggctagccgtaatcacgccactctgctgactcccggcgagcagtgtaacattttccttcagccatgggcaaggagaagactcacatcaacattgtggtcattggacatgtcgactctggcaagtcgaccaccactggccacctgatctacaagctcggcggtattgacaagcgtgtgattgagaggttcgagaaagaggccgcggagatgaacaagcggtcattcaagtatgcctgggtgcttgacaagctcaaggccgaacgtgagagaagtatcacaattgatattgctttgtggaagttcgagaccaccaagtactactgcactgtcattgatgcccctggacaccgtgacttcatcaagaatatgattactg

SEQ ID NO: 34855 - DNA, 247 bp, Zea mays
  unsure at all n locations
  Clone ID: LIB3060-024-Q1-K1-E12
cagcagccatgtcgtgctcccacctctccaccgcctggtcctcctcggcgctcgccggcagggcctncaccaaccggtggcgcttccccccgcgctcgggtctcctggtgccgtgttccctccgggagctccgcacccgcatcgactccgtcaggaacacgcagaagatcacggaagccatgaagctggtggccgccgccaaggtccggcgcgcgcaggaggccgtcgtctnctctcgccctttctc

SEQ ID NO: 34856 - DNA, 419 bp, Zea mays
  unsure at all n locations
  Clone ID: LIB3060-024-Q1-K1-E2
gattgaagaagcacttgaagaggctcaatgcgcccaagcattggatgctcgacaagcttggcggagcttttgctcccaagccatcttctggacctcacaagtccagggagtgccttcctctgatcctcatcatcaggaacaggctcaagtatgctctgaactaccgtgaggtcatttctatcctgatgcaacgccatgtacttgttgatggcaaggtcaggactgacaagacctaccctgctgggttcatggatgtcatttccatccctaagacaatggagaactacaggctgctttatgacaccaagggccgcttccgtcttcacccaatcagggatgaagatgccaagttcaagctctgcaaggtgaggtccgttcagtttggccagaaaggcatccnctacctgaacacctacgac

SEQ ID NO: 34857 - DNA, 438 bp, Zea mays
  Clone ID: LIB3060-024-Q1-K1-E4
aaaccagaacttgacttatatactgaacacccatcatcactatgatcatactggtggaagcttggaattgaaggcaaaatatggtgcaaaggtaattggttctgagaaggataaggacagaatacctggcattgacatcacgcttaaggagggtgacacatggatgttcgctggccatcaagttcttgtactggaaactcctgggcatacaacaggtcatgtgtgctattatttcgctggttctggagctatatttacaggtgacaccttgttcaatctatcatgcggaaagctttttgaagggactccacagcagatgtatgcctcactccagaaaattacagctctacccgatgatacaaaagtatactgtgggcatgaatataccttgagtaatgcaaagtttgccttgagtgtagaaaccgggaaataaagcat

SEQ ID NO: 34858 - DNA, 441 bp, Zea mays
  unsure at all n locations
  Clone ID: LIB3060-024-Q1-K1-E5
ccctcttctctctccgtcttcctcttcttaccttgtcgcgtcatctcatcaagaaagtttgctcgacaacaggaaaccccatctctctctctctctctctctctctctctctctctctctgccttctgtttccaggacgtcccaactgcccagcgccgaccggccggccaccatgaagccgccatcatcactggtgcactacttcaagctgctggtcctgctggcgctcgccaggctgaccatgcacgtccccgacgaggacgtgctcttgtccctcggcgcgctgcgcctcgacggccatttcagtttccacgacgtctccgccatggcgcgggacttcggcaaccagtgcagcttcctgccggccgncgtgctccaccctggctcggtctccgacatcgncgccaccgttaggcacgtcttctccctgggcgaaggctc

SEQ ID NO: 34859 - DNA, 400 bp, Zea mays
  unsure at all n locations
  Clone ID: LIB3060-024-Q1-K1-D2
agtcgcagcagctagcgcccggccggccagtcgagtgagtccatcctccatcgccagccagatggccgccaccgccctgagcatgagcatcctccgcgcgccgccgccctgcttctcgtccccactcaggctcagggtcgcggttgccaagccgctggcggcccccatgcggcgccagctgctgcgcgcgcaggccacctacaacgtgaagctgatcacgccggagggggaggtggagctgcaggtgcccgacgacgtctacatcctggacttcgccgaggaggaaggcatcgacctgcccttctcctgccgtgcggggtcctgctcctcctgcgccggcaaggtcgtctctggctccgtcgaccagtccgaccagagcttnctcaacgacaaccaggtc

SEQ ID NO: 34860 - DNA, 432 bp, Zea mays
  unsure at all n locations
  Clone ID: LIB3060-024-Q1-K1-B7
ctgacatctcagttgctgaacgcctgaaccgcaagtcatccatgacctcttgtatgccgaagctgcttctcctgctcttctttctcagccatcgctctcccattgctcgcgcaggcgatgatggcagctacaaggttctgtccatgggctctccgagaactgactccgtctgttcccagtccaaagcggttccttcgtcgtccgccggtgccgccacggtgcccttgcatcaccgtcacggcccatgctcgccgttgccgaccaagaagatgccgacgttggaggagacgctccaccgcgatcagctccgagctgcctacatccagcggaagttctcaggcggcggtggcgctggtggtgacgtccagcgatcggacgccaccgtgccgacggccctgggcacctncctgaacacgctggagtacctgatca

SEQ ID NO: 34861 - DNA, 288 bp, Zea mays
  Clone ID: LIB3060-024-Q1-K1-C10
gctctccgctaccacagctccgctccggtaaattggcagcctgtccgagttctccgctctcatgagctccgcctcgctgtccatgctccagaatgccaccttcgacgacttcatgtacgccgtctccttcatgacccaccccgtcggcacgagcatccgttcacctcgggcaccgacggatgccaatctaaatgtggccatcaacggattctgccacatctgactcaacttccttcggtgctgacacggtcactgcgacacctctcccctccacgtcatctccatcaa

SEQ ID NO: 34862 - DNA, 406 bp, Zea mays
  unsure at all n locations
  Clone ID: LIB3060-024-Q1-K1-C11
gctgacgctgtcggcgacggtgccggcgctgcagccgtcgcacatgccctgcagggaggatggcgtctcgtcgtcgtcatgccaacccgggtggccgcaggtggccttcttctacgtgtccctgtacctgatcgccatcgcgcagggcgccgacaagccgtgcgggctggctttcgcggcggaccagttcgacgcggagcaccagggggagcgcgcctcccgcgggtccctattcaactggtggttcttctgcatggccatcggcatctccgtgtcagtctccgtggtgggctacatccaggagtacgtcgggtgggggctcggcttcggcgtcccctgcgccatcgtgctctgcgccttcctcgtcttcctgttgggcaccccgacgtaccgnctgtacgcaccc

SEQ ID NO: 34863 - DNA, 396 bp, Zea mays
  unsure at all n locations
  Clone ID: LIB3060-024-Q1-K1-C12
gcagcaatggtgatggcgtcgtcgagcgggctgaggagctgcagcgccgtgggcgtgcccagcctgctggcgccgtcgtcccggtccggccgcctggcgccgttctgcgccaacgccaccacctctggccgcgtcaccatgtccgcggagtggatgcccggccagccacgccctgcccacctcgacggctcctctcccggggacttcggcttcgatccgctgggcctcgcgaccgtgccggagaacttcgagcggttcaaggagtcagaggtgtaccactgccgctgggccatgcttgccgtccccgggatcctggtgccggaagctctgggcctgggcaactgggtgaaggcgcangagtgggcggccgtccccggcgggcaggccacgtacctg

SEQ ID NO: 34864 - DNA, 539 bp, Zea mays
  unsure at all n locations
  Clone ID: LIB3060-024-Q1-K1-C5
tcgtactcggttcccggaatttcccggcggaccagagatatgtgtctggtgctttttctttttaaacctggaaataaccgtagaacagtanataggtcttcagaaaagggcgtgggggtgttatanntcattgatatcatagtcggaagccatgccaagcgaaaggccctcttgagaagtgtctaagaatnngccctgtccactttactctctctgatctgtattccaaggagattacccttcaacataataacatnttacatgatgagcnttcacttcattctcatncgcgtttggagcaagtataatgataaaaacaanttggaaaccgctatctgaatggatcgaacttaaacttntgtcgctcaaggtggcacctaacatcatgcatncctttgagtgaggcaatgactttgctgtcaacttctcacgatgcgcttccacaaatctattttgttactgatgggtcagttgatgatgaacggaatatctgccatacattgaaaactcaacttattaaaagtggatctaagtctcct

SEQ ID NO: 34865 - DNA, 436 bp, Zea mays
  unsure at all n locations
  Clone ID: LIB3060-024-Q1-K1-C6
gacacgcctcacccccaccacaagaacaccaaagccacatcccatccatctgcgcggggaggcttgagcgatccgagcaaaaaaaatcatccgcgacgcagcgacgcaggtttgttctctgatctctctggttcttcttttagcagcagggacgcacaacacaagaaaaggtccggttcaagaggctcttctgttgggtttttttagaatcctcaagagaagcgtgttcttgggttaggatttttttctcacctcataacacctctcctaggaggaacagagatccagagaaccttttttctcttctggatccttgccgacttttggcgttcgaaagggggttgttttgcaataccctctctctggtntttttttctttcttggcacaaactcacctcgtttctctacttttattgaggaacagagctggttttcc

SEQ ID NO: 34866 - DNA, 448 bp, Zea mays
  unsure at all n locations
  Clone ID: LIB3060-024-Q1-K1-C7
cggtttcagaacttcatcaagcatctacgagagatgggcgatgaggtatcaactcgttcttctttgtctaagaaagagtgctatactatatgtatgagtgtttcttcaagaccatattattattccagaattcgcgtttagtgcagtatatgtatgagattttgttcatgaccatatttccacccacaattcacttcatctgcactttatggtcgtcatctgcgcttcttggtttaggtattggtggtgactacacacaagggagctcctgaggagttccatggtgcaaaggtcattggctcttggagctttccatgtcctctgtaccaaaatgttccactctcgctggcattgagccccagaatattntctgaggcgaataaattcaagccagacataatccatgcgacatcacctggaattatggntctccgtgctctggctataa

SEQ ID NO: 34867 - DNA, 377 bp, Zea mays
  Clone ID: LIB3060-024-Q1-K1-C9
gctaccgccatctctagcgttagcttctgcgtgtggccgtgggtgcccgcgcgcgggatgacgaccgccaccgccatcgtcgccgggcatggcctcgcgctgcgtcggagcctccccctccccaacccgccagggcgagccaccacgtcggtctccctctccgcgcgccccgtcactccagcccgccgcatgattgtcccggctagcccgtcgccgcggtcgccgcgccggtgccggtccatctactccgagagctccaccgaggcatccgctgcggctgacatcgtcgacgaagaagtggaggccgagaacaaggtggacccgcaggcggaggtgtgctacctggaccctgacgtggaccctgagtcgatccggga

SEQ ID NO: 34868 - DNA, 471 bp, Zea mays
  Clone ID: LIB3060-024-Q1-K1-D1
cgaattcccgcgggacccacgcgtgcgcggtttcagaacttcatcaagcatcttcgagagatgggcgatgaggtatcaagtcggtcttctttgtctaagagagagtgctatactatatgtatgagtgtttcttcaagaccatattattattccagaattcgcgtttagtgcagtatatgtatgagattttgttcatgaccatatttccacccacaattcacttcatctgcactttatggtcgtcatctgcgcttcttggtttaagtattggtggtgactacacacaatggagctcctgacgagttccatggtgcaaaagtcattggctcttggagctttccatgttctctgtaccaaaatgttccactctcgctggcattgagccccagaatattgtctgaggtcaataaattcatgccagacataatccatgcgacatcacctggaattatggttctcggtgctctggct

SEQ ID NO: 34869 - DNA, 354 bp, Zea mays
  Clone ID: LIB3060-024-Q1-K1-D10
caactgcacggcctactccttcagcaccgatggcaaatgctctgtctggaatggggacctgctcaacgtggaccaggccgacagcaccataagctcccaaggtgttctttaccttcgtctcgccaagagtgatttccagggtttgagcagaggcaacaagaggacaccgacggcggcgatcgctgcaggcgctgttggttctggaatactagtgctcgccgtgctagcgctcgtaatctggaggtgcaacaatgtgccgccgccgctacacgccggcgtcggagacggtggcggaatcatggcgttcaaacacaccgatctatgccgcgctaccaagaacttcagcgacaggct

SEQ ID NO: 34870 - DNA, 393 bp, Zea mays
  Clone ID: LIB3060-024-Q1-K1-D11
cagcgcaaacacaatggttgccctagagagtggcaacgagagtggaatccaaaatggtgacaggtctcgccgtgaagctgcgttgatgaagtttcgcatgaaaaggaaagatagatgcttcgagaaaaaagttaggtatcatagcaggaagaagctcgcagagcaaaggccaagagttaagggacaatttgtaagccaaaagctgaactcagctacaacaacagacgcagaagctgactcgtgaccggcgtcaagtcatcactgtaacttattcttcccttcccaccaggtgtgggcaatcggacttgtaagactgaaagctggcagaagttttttcccttccatggttagcctttctgcacaacgggtgaactcttgtgtcgggtgtttggt

SEQ ID NO: 34871 - DNA, 228 bp, Zea mays
  Clone ID: LIB3060-024-Q1-K1-D12
ccacgcgtccgcgcgctcttgcttgccaccctccgcttcaactccatcgcaacgcactcaggatagggttcaaagtgtcgctatcgcccgcatctcacctcccatacctcttcaacacaccacctcgcttacactccaaacctgccaccacaaccgcctctttgctctctacctgtccccaccctacccacgcccttcctttgctacgtttccctcccccactaccac

SEQ ID NO: 34872 - DNA, 434 bp, Zea mays
  Clone ID: LIB3060-024-Q1-K1-B6
atcgatctaaaccaatccattttatatatacatacgacatgccaacggttaaacaagttattagaaatgcaagacagccaatacgaaatgctagaaaatcggccgcgcttaagggatgtcctcagcgtcgaggaacatgtgctagggtgtatactatcaaccccaaaaaacccaactctgccttacgtaaagttgccagagtacgattaacctctggatttgaaatcactgcttatatacctggtattggccataatttacaagaacattctgtagtattagtaagaggaggaagggttaaggatttacccggtgtgagatatcgcattattcgaggaaccctagatgctgtcgcagtaaagaatcgtcaacaagggcgttctaaatatggtgccaaaaagccaaaaaaatacgtgattcggtttagcccttat

SEQ ID NO: 34873 - DNA, 409 bp, Zea mays
  Clone ID: LIB3060-024-Q1-K1-A12
cagatattctggttacgatgaactgaagcatgacgttgcccgtatgtttggaattgaggggcagctcagcgaccaaaacagagttggctggaaactggtttacgaagatcacgagaaggatgtcctattagttggtgatgacccatgggaggacttcgtgaactgcgtgcggtgcatcaggattctttcgccgcaggaagagaggcaaatgaggctggccagcgactacggagacagctttcttggcaaccaagcgtgtagcagctcggacgggggtcgtccgtggagggtcaccggcgactagaaatagcaggctatgcctgagcacaaatgtttgatataatccgtcccacgatagcaagaaaatgatacgcgatttctgagcacaaacttttgcactcagatgatc

SEQ ID NO: 34874 - DNA, 421 bp, Zea mays
  unsure at all n locations
  Clone ID: LIB3060-024-Q1-K1-A2
cgcagaaaaagaaaaagaaaagccaaaggcaaaggcaaaggaatcccaatcaggcaggcagggggaagaaccagctgctgcggccggagatgtcgtcgcagctgatcgaggagcaccggtcgggcgcggaggtgcacgtcgggcacgagctgtgcgagcgcaagtcgcgcgagttcatggtggagctgggcctccccgacgggctcctcccgctgcccagcctggacgaggtgggctacaaccggtcgacggggttcgtgtggctgcggcaggccgtcggcctgacccacaccttcggctccatcggcaagcaggtgtggtacgacagggaagtgacggcgttcgtggagcccgggcggatgcacggtctcgccggngtgaagagcaaggagctcctcatctgggtcaccatctccgagat

SEQ ID NO: 34875 - DNA, 443 bp, Zea mays
  Clone ID: LIB3060-024-Q1-K1-A4
gccttctgcttctcttcctctcctcgcgtccccccaccaaaccctaacccgagcacgcaggccctcctcgcgtctgctcgcgccggcctttggggctctcactctgagcggcagggacccgcagggctccggttgtgtccaggaaacatcccagttgttggcgagagaccaagaaatggcggagaaggagggagcgaaggttggagcggaagagatggaagagcgggagcaggaaggggaggcagaggaggtggaggtgaagtttcgtctcttcgatggctctgacatcggtcccgtgcgctgcaacgccgtcgacactaccgtagccgccctcaaggatcgcgtcgtcgccgattggcccaaagataaatcaattatcccaaagactgctagtgatgtgaaacctaatagtggaggcaaaattctagaaaatgacaagaatg

SEQ ID NO: 34876 - DNA, 421 bp, Zea mays
  Clone ID: LIB3060-024-Q1-K1-A5
acgaagcggccggatgggagcagcagcctgaccctgacgcgatgagcccgcgcgcgatgctgctgcccgtctgctccgccgcgcccagctgctcccccctctgcccggtgacggcctcgcacgtcgtcgcgcgggtggcgcggagggtggacgtcggcgccgcgctcaggtcctacgccgactcgctcgtcgcgcaggtgcccgaccgcccgccgctcgccgactcctccatactctgcccctacatcgccgcgccggacgacatcgcgcgagccttcggcgcccccgcctccgagctcccgccgctccccagcgccgaccccagccctgggctatgttgcacgggcaccgaccagccgctggcggcagtcgcggacctggccgcaactgccgtggtcaactcggctcccaccgacgccgt

SEQ ID NO: 34877 - DNA, 427 bp, Zea mays
  Clone ID: LIB3060-024-Q1-K1-A7
cagacacgcaaacgagaggactcgatagagattccgccgccaccaccgccgggtcggatgccgccgccgcaggcgggcatgaccctatgccgccttcccaaggccacccttggccttcccctttctctgccctctttgctatatcgacccaccctgtccatctccgcacgtcgcaccaaggccgtctactccagggcctcctactactctccatcaccggactcttccttcggatcgcggatggaggattccgtcaagaatacggtggccgataaccccgatgtcatctactctaagtcatggcgctcatattccatggacctgaagtcactcttcaagcggatcggtgtgcagccccacgtcatcgagctcgacaatctcggagctcaaggaccacaactacaaaaggtattagaaaggctgactg

SEQ ID NO: 34878 - DNA, 366 bp, Zea mays
  Clone ID: LIB3060-024-Q1-K1-A9
ggggagaagagctagagggatgggtggcggcacggtggtgtgtgtcaccggcggcagcggctacctcgggagctggctcgtccacgccaccctgcggagcctcgcggacgagaagaagacggggctgctccgggcgctccccggcgcggcggagcggctgcggctgttcgaggcggacatgtacgacgccgacaccttcgagcccgccatcgccggctgccacttcgtcttcctcgtcgccacgcccctgacgcacgaccccaccagcaccaagtacaaaaacacgacggaggcggcggtggacgcggcgcgcatcaatcctccgcagtgcgcgctgtccggcacggtgaagcgcgtcatccacac

SEQ ID NO: 34879 - DNA, 297 bp, Zea mays
  unsure at all n locations
  Clone ID: LIB3060-024-Q1-K1-B1
caattagctagcttcttctagctctagctaggctcgtctgctgcaagaaggtaacagtagcagcaggcatggaggggaaggaggaggacgtccgcctgggcgccaacaagttctcggagcgccagcccatcggcacggcggcgcanggcacggacgacaaggactacaaggagcccccgncggcgccgctcttcgagcccggngagctcaagtcctggtccttctaccgcgccggcatcgccgagttcgtcgccaccttcctcttcctctacatctccatcctcaccgtcatgggcg

SEQ ID NO: 34880 - DNA, 401 bp, Zea mays
  unsure at all n locations
  Clone ID: LIB3060-024-Q1-K1-B10
gctgcctccccctcgcccagcagcagggagcagccatgccaggggaccacggctccgggggcgacatctccttcgccggacgcttcacggccagcgccatcgcagcatgcttcgcagagatatgtaccatcccgctcgacacggccaaggtcaggctccagctgcagaagaacgtcgtcgccgccgccgcctccggggacgccgcgccagcgcttcccaagtaccgcggcctgctcggaactgccgccaccatcgctagggaggaaggggccgcagcgctctggaagggcatcgtcccgggcctncaccgacagtgcatctacggggggctccgcattggcctctacgagcctgtcaaatccttctacgtcggcaaagaccacgtttgggatgtccctttg

SEQ ID NO: 34881 - DNA, 356 bp, Zea mays
  Clone ID: LIB3060-024-Q1-K1-B12
ccgcacctagccacctaccctgctgttccccgtgccgtcgccgatggagtccttgggcgtgctgctgctccaccccttcaacgcgtacctggagcaggagctggaccgccgcttccgcctgtaccgcttctgggagacgccccgcgaggagttcctccgcgcgcacgcgggcgccgtgcgcgccgtcgtcggcaacgccagctacggcgccgacgccgcgctcatcgacgcgctcccggcgctcgagatcgttgcctccttctccgtcggcatcgaccgcgtcgacctcgccaagtgccgcgaccgcgggatccgggtcaccaacacccccgacgtcctcaccgacgacgtcgccg

SEQ ID NO: 34882 - DNA, 418 bp, Zea mays
  Clone ID: LIB3060-024-Q1-K1-B3
gccggcggctctgtacaaggtgaaagaccccgcggtgaggcggttcatcgacaggggcctggcgccggcgtcgcggcggccgagcgcggccgagctgctcagcgacccgttcctgcagctggaagacggctgcggcctcggctacggagacgacgcggactacagcgccatgtacaactacctgcaccagcccgcgtgcctggaccaccaccaccatgccggcagcattggctccacggcgagcaacggggtggtgtccaatggcggcggcggcggcggcggcagatgggacgacgagtccgaggacgaggacgacgatggcagcatgttccaaggcatcgaccagctgttcaacgagcacgaagacgacgagctgcacgttgctggtgtcgacatcaccatcaagggcaagaggatg

SEQ ID NO: 34883 - DNA, 329 bp, Zea mays
  unsure at all n locations
  Clone ID: LIB3060-024-Q1-K1-B4
gcaggcagaggcaagaggcccctcaccctcaggtgatcaggtcgctagctcccggcgtaagtagtaggcagccatgaatttcggtgggaatggcaacgcgacgatccggtgcaagtactgcagggcgagcctgagcgtgatccccggcgagcgcgccatccagtgcgcgcaatgcaactgcgtgacccgcatccggcgggccgaccgcatcccgcttggcgggncgnnncacgtgccgncggcgntncagcgcgcccggngcangaagcgcgcnncgcctggcggcatcacgtacgccggcgcgcgccggggctggcgggacctgaggg

SEQ ID NO: 34884 - DNA, 146 bp, Zea mays
  unsure at all n locations
  Clone ID: LIB3060-023-Q1-K1-G12
acccacgcgtccgaggatgagcacctgcacatccatactctacttcgaggttcacacanctatctctagcactgcagacacctgtcaaatctctacaaagacacactcacacatgctcaaagaccatacacctacagaggacacac

SEQ ID NO: 34885 - DNA, 460 bp, Zea mays
  unsure at all n locations
  Clone ID: LIB3060-023-Q1-K1-G2
gcgtccgctccatgtcctgctccagacctccacgatctttccttttccacctctcgccggccgaggacgagccncgggcatcagagcgcgcgccccggagccgaaaagcggtgggcgtcatgaagcccccggccggcgccagcggcaagggcggcgcggtggacccctctctgccgcggttcaggtgccaggagtgccgccgcgccctcgtcgtcgtcggggtccaatcctaccccgacagaactgccccacaagccgggccccgtaatcattcctcttctgttcaaggcaatggtattggtgccagccagattgacaactcttatggtgggctatctaaaccgaaccaatcttaaggtcctagaatttcttcacgcccaacaagtgcaacaaccgcacatgcttatcccaaccaatcaacaataaccatagaagggtcatatatagtgcttccaccttc

SEQ ID NO: 34886 - DNA, 395 bp, Zea mays
  Clone ID: LIB3060-023-Q1-K1-G3
cggacgcgtgggcgccagggccgcagagctttccctccagctcctccctgaactctgcccctcggatggcgtccggccggagttccttggcctgaccccatgctgcgttcgcccatggcgttttcccctgctcggcgtccggtcctggctcacccgagctccctgcgcgactgccgctactccctcctgcaactcggtgcctctcacctgctccctctgatctctctctgacccgcgcctgttccacttcgtggctcagggccccagttggttgggccttgaacttccattgcttaatggccctggtcaaggttttgggcgccaagttccttaagttggttcttccattggttgcttgtccgggcggcctggttcttttcctttcttccggtttc

SEQ ID NO: 34887 - DNA, 307 bp, Zea mays
  unsure at all n locations
  Clone ID: LIB3060-023-Q1-K1-G5
cccgggcggaccggagtcaggcagccgaagctagaaaagcaagcggctttggaagttggaatccgatggcgtccacctcgtgcttcctccaccagtccaccgcccgcgtggccgcgccgtcgccgcgcctcgccgccccgccgcgcagcgcgcaactgttcgtctgcaaggcccagaagcagcaggccgccgcggcggagagcgacgtgtcgcgccgcgccgcgctcgcgctcctcgccggcgtcgcggccgtcggcgccaaggcgagctccgccgncgccgnctacggggaagcagccaacgtgtt

SEQ ID NO: 34888 - DNA, 347 bp, Zea mays
  Clone ID: LIB3060-023-Q1-K1-G6
ccggatcgagcgacgcgtacgcccgggcggaccggagtcaggcagtcgaagcttgaaaagcaagcggctttggaagtgggaatcgatggcgtgcacctcgtgcttgctccaccagtccaccgtccgcgtggccgcgccgtcgccgcgcctcgccgccccgccgcgcagcgcgcaactgttcgtctgcaaggcccagaagcagcaggccgccgcggcggagagcgacgtgtcgcgccgcgccgcgctcgcgctcctcgccggcgtcgcggccgtcggcgccaaggcgagccccgccgccgacgtctacggggaaacagccaacgtgttcggcaagacccagaagaaca

SEQ ID NO: 34889 - DNA, 260 bp, Zea mays
  unsure at all n locations
  Clone ID: LIB3060-023-Q1-K1-G8
atcttggcctcgtcaatccaccaccaccgtcgtcgctgagctcctcctccggcttcgcttcggtgtcttgcctcctcctcggtcgaagaagaagaagaagaaaacatgtgtccgggatccgtggagtcgtcgtcggcggcggcggcgggcaagagcgtgtgcgtgatggacgccgcggggccgctgggccacgcgctcgtggaccgnctnctccggcgcgggtacaccgtccacgccgncacgtacgcccgcgacaggga

SEQ ID NO: 34890 - DNA, 260 bp, Zea mays
  Clone ID: LIB3060-023-Q1-K1-G9
ctcttgtcactcatcagcacggttagtatagctagccaccatgaaggtagagcgcgatctccagatgagcgcggggcgacggcgaggacagctacgcctccaactcaaggcttcaggagaagtccatactgaagacgaggccggtgctgcacaaggccgtggcggcggcgcacgccttgtcgctctcctcaggaggacccggctgcggctccatggtcgtcgcggacctcagatgcttgtcggggcccaacacactgatc

SEQ ID NO: 34891 - DNA, 462 bp, Zea mays
  Clone ID: LIB3060-023-Q1-K1-H1
ctctgttgtaacacccttgttctcggtgctctattgatagtgtgtgccctacgtttggaggaagtgatcctggggtacgggcagaagttgtccattcattgaaagaggaattgaatctgatgtgtggcctctcttgctcgcggcatccataagttaatactgctctatctgtaacctttacttaacattttggattcgtcctttttaaaataatagttggaatgtaacttactgccttactttttacatggcaaatggaacaatcaaggtgaaccggccaattggccagttttgaatggtaattaacttggaaaccacttttaattaccttggaaaggccgccgtatttggtcaacttgatggggggtttgaagtgggaatctttaaaattcaagggttgaacttgaccttccaatggggattttatggccttaaccatggttggggctcattagttggggg

SEQ ID NO: 34892 - DNA, 416 bp, Zea mays
  unsure at all n locations
  Clone ID: LIB3060-023-Q1-K1-H10
gaaacttgtgattaccccttcttcttcttcttctttgctactgctaggctgctaatcctcactgcatctggcccatgttctctagcttccatgcatgtggcatactggcatggatgacgccgtcgtagtaccttggtcagctacttacttattcaagcaaagaagccatgagagctggtgttagcgccggacaccggcggcatgtgcggcatctgggcggccagaatgctctgcaggagcatcctgtcctccgccgacgcggggaagacgtcgcttgcgccgccgncttgcaccaggccgctgctgtagccgccgaacggcgacgcgccggcgtactgctgctgctgcctgtggaccggcggcgcttcaaggtgttgtggctccggtggaagctgtggtcgaagaaggacacgttg

SEQ ID NO: 34893 - DNA, 430 bp, Zea mays
  unsure at all n locations
  Clone ID: LIB3060-023-Q1-K1-H12
gggctcctcctcctccttctcctggcactggcagcgaagatccaaagatagcgcaatcggatctcacacgccgagctatttctactttgagagaatccccttctcccacaaggagcgagtaatttgaggcagagaccgacacagatggcagcggttatggtgtctcgccaaggccgggagctgcagcggtacagcgcgagcacgggcgggcgcgtggtggtgggctgcgtcccgtaccgcgtgcgcgggggcgacggcgaggtggaagtcctggtgatcagctcgcanaagaagggccccgccgggggcgtgctgatccccaagggcgggtgggagctggacgagtccatggacgaaggcggcccgcgcgaggccgcggaggaaggccgcgtgctcggcgagacgggccccgcgctgggccgctgtgcta

SEQ ID NO: 34894 - DNA, 465 bp, Zea mays
  Clone ID: LIB3060-023-Q1-K1-H2
gatgtgtgcgatatggagtaaaatccttggagaattatgtggagaagaaggttaagttcaacagtccttaggtgttcgatgatatgctcgaactggtggccgtctaagttcttgctgaaatcgagtcggagcatgatgtggttcgttacacgtgatgcgaaggacaagagccgagttgatcccaaaatgatgctagtgaacgaacctaaagatggatgatctgatagaatgccagaatgggaaaatctcaccaagtggtcgtcaattaacaacacttacttaatggtatcccaaggtataattttggtctggtatggatgctgctaaatgcccgtgggctcaatcttcttatataagtatattccatctttagcttctttattgaggattgtcacttaagctagcatgtatttgaaaacctataaatattttatacattttaaattgtgattttttttgaatcac

SEQ ID NO: 34895 - DNA, 472 bp, Zea mays
  unsure at all n locations
  Clone ID: LIB3060-023-Q1-K1-H6
gcgtccgctccgcgctagctgaggacggtacagcggctcagaggtgcgacgtacgacgacgacggctcaggcgccacacatggcatcccagctctccgccgccgtgccccggttccacggcctccggggctacgccgcgcccaggtccgcggtggcagcgctgccgtccgtgagggtgggcaggaagaggtcgtcgtcgcagggcatccgctgcgactacatcggctccgccaccaacctgatcatggtgacgacgacgacgctgatgctgttcgcggggcggttcgggctggcgccgtccgcgaaccgcaaggccacggcggggctgaagctggaagcgcgcgactncggcctgcagacgggtgaccccgccgggttcaccctcgccgacacgctggcctgcggcgccgtcggccacatcctcggcgtcggcatcgtgctcgggctcaagaacaccggcgccctcgaccag

SEQ ID NO: 34896 - DNA, 242 bp, Zea mays
  Clone ID: LIB3060-023-Q1-K1-H7
tccgggctatctcatgacagtacatcggcttttacgtgctacatacgacgacgacggggcaaggtccactctatacattcgagctgtcctccgccttgccccgtttccacggcctccctggctacaccactcccaggtccacattggcagctctaccttccgtgagggtgggcatgaagaggtcgtcgtcacatgtcatccgctgcgactacatctgcttcaacaccaacctgatcattgtt

SEQ ID NO: 34897 - DNA, 235 bp, Zea mays
  Clone ID: LIB3060-023-Q1-K1-H8
agatcgtactggaccaatctgccaccacactttgatcacacacagacacaggaagttgggatcggaaaaatgcaggctgccgctactgccgccgggttctcggccgtgctgcccgccaagggcaggccggcggcgaagagcaaggtggtggcccgtgtccccgccacaaggaggagcgtccgcgcagctgccgtcgtcgcgaccgaagccgcgcagatcgactacagctcaagcg

SEQ ID NO: 34898 - DNA, 417 bp, Zea mays
  unsure at all n locations
  Clone ID: LIB3060-023-Q1-K1-G10
acaaagtgtatcggctgtggcttgcggcgccgcggcagtnccgccacaagcacatcgcgcacacagttgggccaagcgcctacancctatcagaggagagacataggtcttgccgtccgtcgcgtgcgccggaagaggggaccggagggaagaaggctgtccagcaatcagagatnggaggtggggttcttgggggtctgggcatcatngggcataggcaatgtgcgaccatacctnctncgccacgggcttccgcgtcaaccgtctggaacagggaccctcgccaagtgccaagagctcgccgcgctcggcgccaccggtcgggagacgcctgcctncgtcgtctccaagtgcagatacaccatcgccatgctctncgaccccagcgcncgcctatcagtcgtcttcgacaaggat

SEQ ID NO: 34899 - DNA, 289 bp, Zea mays
  Clone ID: LIB3060-023-Q1-K1-H9
gacacgatcgcgagcgcacgcacgtaagcacgttgtctgaagctcaagttagaagaagcaccagtgcctgatcgatggcggcccaggctctcctctccggccggcagctgctgggccgccccgtgcagtcggccgtctctaggtcgtcggcgaggaaggcgcccttcgtcgtcagggccagctccagcccttcagcctagcatggtgccgacaggcagctgtggttcgcgtccaagcagtccctctgctacctcgatggctcgctgcccggcgactattgcctttaccc

SEQ ID NO: 34900 - DNA, 397 bp, Zea mays
  Clone ID: LIB3060-023-Q1-K1-E10
agcaaccggtccagcactttcacgctcagctccagcaatggctgcctccaccatggcgatctcgtccacggcgatggccggcacccccatcaaggtgggctccttcggcgagggccgcatcaccatgcgcaagaccgtgggcaagcccaaggtggcggcgtccggcagcccctggtacggccccgaccgcgtcaagtacctcggccccttctccggcgagcccccgagctacctcaccggcgagttccccggcgactacggctgggacaccgccgggctgtccgccgaccccgagaccttcgccaagaaccgcgagctggaggtgatccactcccgctgggccatgctcggcgcgctcggctgcgtcttccccgagctgctcttccgcaacggcgtc

SEQ ID NO: 34901 - DNA, 287 bp, Zea mays
  Clone ID: LIB3060-023-Q1-K1-E12
ctcttgcctcccacacgctcggccctctgtcccggcgaaaatctggtcgctggtagaaaaaaagggtcccatttgtaatgtcaggaggatcttaaccatcatcaaggcgaaacagctttaattctttgtctaaggacctagaccttccttcagagcaaggttgtctctccattgttgtacttggggcttctggtgaccttgctaagaagaaaacattcccagccctctaccaacctctttgaccagggattcatacacatctggagaagtccatatatttggttatg

SEQ ID NO: 34902 - DNA, 384 bp, Zea mays
  unsure at all n locations
  Clone ID: LIB3060-023-Q1-K1-E5
gtttggaggattataaatatgaatattgctttccaattagctgtttttgcattaattgcgactgcctcagttttagtaattagtgtaccccttgtatttgcttctcctgatggttggtcaaataataaaaacgttgtattttccggtacatcattatggattggattagtctttctggtagctattctgaattctcttatttcttgaatttgtttagtatttagtaacccgatacaaaataaataaaaagaaaggccctttttcgaaaaanattaggatttttatacacattaaaatgctattttcgttccgaattattacctcttctctttcattattatgaaattctattgccattagaatattgattgatagacagttaat

SEQ ID NO: 34903 - DNA, 430 bp, Zea mays
  Clone ID: LIB3060-023-Q1-K1-E8
gagccccagatgaagtattgtttcagcctttcaggtagtgtggtcagggcatgcacgaccatggttagttgttttattgtgagctttacctctttgcttatggcatggcttaaattttaaaatttactattgttatcaaccaaatccaacttagcaagctatcattcaatttactgcatttttaattgttgtatttcaactttatttttttctctcaaacgcgcagaagagctacacatcattatattaagagaggaaaaaaggtccaaagtggaccaaagtacaatgcctaatgggcagacccgaccagtttgaaaaccttaaaaatcaggaatagccaaagccctaataaaagccgcagcaagggccagaactatattcttaagattagccctattccaaccacttaacttattttaaaaccaacttt

SEQ ID NO: 34904 - DNA, 321 bp, Zea mays
  Clone ID: LIB3060-023-Q1-K1-E9
atcttggtaagtccggatataacagtttctttgatgttcaggaaacttctgtagtcactacccggaagccggcacataatgaacctaaaactcctgccaaaagccaaagtcaggctactggttcaaagactatttttgttgggaatttagcctacagtatagagcgtgaacaagttaaggaattttttgaggaggctggtgaagttgttgatgttcgtttggctacttttgatgatgggagtttcaagggttttggacatgttgaattcgctactgttgaagctgctcagaaggctcttgaaattgttggtcatgacctga

SEQ ID NO: 34905 - DNA, 281 bp, Zea mays
  Clone ID: LIB3060-023-Q1-K1-F1
ctcggcccagagaggggggtggggggataactgaaaggcgttcgtctttgctcaccataaaagggccttgtcgggaagctcccactactttttgttaggacaagactcacccccatgccgtgtcatgccattgccacccatccttgggagctgcagctgcctatataataccaacagtgccgaagcaagaacatccaccctgcaccaccaccgccgggcaccagcgtcgtcgaagctgctcactccatcgccgctccaagctgtgagtccgagcatcaaca

SEQ ID NO: 34906 - DNA, 355 bp, Zea mays
  Clone ID: LIB3060-023-Q1-K1-F10
ccatgaatgaagatcagtctctaagtagcaccttattccttctgttaaaacaactttccgggctcgagtctggtagctcttctgagcaaatcaaccatcctaattctttggttaaccttttgaagaaccttgctgctattgctagcacacatgcatatcaagatgttctaaagaatgcaacttcaatatcatcaaatgatggtaataatgctgcaaatggctctataatgcatgagcaaaccatacggtcaattcctgtcaggagagaatcattagcagaagagcctgcggtgaaaagacgagtacaggactttgatttgaacgattcatgcattgaagaggccgagagccgaac

SEQ ID NO: 34907 - DNA, 454 bp, Zea mays
  Clone ID: LIB3060-023-Q1-K1-F11
ggggaggcaatggttcctgatgatggctgggaagaatatctgaacaataagtgggacaggaatattgttgtagcagaaactgtgagcttttctgagctgaagcttcagccagagacagaacagcgcccgcacaaggtcagcttttttgttgataagaagaatgcccaggaagtgataaaatctgttgccgagagattggacaaatgtgggctagatgccaaaataatatatagtggtggccaggaccttgatatattacctcaaggagctggaaagggccaagcacttgcatatttgcttaaaaagctaagctcatgtggaaaaccgtccaacaatactcttggttggggtgactctggtaatgatgcagaattattcagcatccctggtgtacatggtgtcatggtcagcaatgcccaagaggaactacttcagtggtacacagaaaatgcga

SEQ ID NO: 34908 - DNA, 397 bp, Zea mays
  Clone ID: LIB3060-023-Q1-K1-F12
ccataggctgcagccctccatccacgaactttcgttctccatttccagccatggcggtgtcgagcgagcgcaccaaggagtacggctacgtcgtgctggtgctggtggcctatgtcttcctcaacctttggatgggcttccaggtcggcaaggcccgcagaaagtacaaggtgttctaccccaccatgtacgccatcgagtcggagaacaaggacgccaagctcttcaactgcgtgcagagggggcaccagaactctctagagtggatgcccgttttcttcgtcatactgctgctgggcggtctgcagcacccgaccatcgccgccggtctgggcggcatctacatcgtcgcgagggtcttctactccaagggatacgcaaccgccgttccggacaa

SEQ ID NO: 34909 - DNA, 454 bp, Zea mays
  Clone ID: LIB3060-023-Q1-K1-F4
gtggcacccacgcacactcttctcccccacgagtccggaccccggaggagccaagccatggcgtgcacctcctgctgcctcctccaccagtcaaccgcccgcctcggcgcgtcgccgcgcctggccgccgccccgccgcgcagcgcccagctgctcgtctgcaaggcccggaagcaggaagccgccgcggaccagagcgacgtctcgcgccgcgccgcgctcgcgctcctcgccggcgtcacgggcggcgccggcgccaaggtgggtcctgccgccgcggcatccggggaaccagccaccgggttcggaaggccaaaggcaaccccggattccttgggtaccagggcgaccggtttaagctggtgatcccgttcaagtgggaccccagcaaggagccggagtttcccgggcaggtgctccgctacgaggacaacttcgacgccaacagcaatgt

SEQ ID NO: 34910 - DNA, 458 bp, Zea mays
  Clone ID: LIB3060-023-Q1-K1-F5
gtgaagatgaaggaccgttccatctaggcctgctaatggcaaaaaatccaatccactcgcaccggtacccaaatctaattactttgatatccatcccacacccaaccaaaaatactagagggaagttaaacccaacccacccaataacattattgatcccaaaccaacccgtaattgggtggaaatccatggaaaacccgtgggtttaacttattgtctcacatcgagccaactgcatacatattttaaaaatcaaattttaaagcagtaaattaattcaaataaaaaagttttcaactataaattggaataactcatcatgatgtccatttaatattttgaacatttcttcgtatgataaactaaaaataaattggttcataaaacctatatctctctcatagtttatggaactacgagagatatgtatagaatttgtgcatattgttagaactatc

SEQ ID NO: 34911 - DNA, 471 bp, Zea mays
  Clone ID: LIB3060-023-Q1-K1-F6
ccgggatccaagcaacaaacttggcagtcttgcctgttcttaattattgcctggacaggagaaacaaagatgaggcctcagctggtactcgtcggcactctggctgttctcgccatcctcgcagctctcggcgaaggctcgtcgtcctggccctgctgcaacaactgcggtgcttgcaacaagaagcagccgccggagtgccagtgcaatgacgtgtcggtcaacgggtgccatccggagtgcatgaactgcgtcaaggtcggtgcaggaattcgtcccggcatgggccatggccccgtcgtcacctaccgctgtgacgacgttctcacaaacttctgccagagcagctgcccggaagcgccggcgccataagccggtggccggtggtctcttctgacgtacggcatgggacgccaagtcgagtttgcttctctccagtttcgtcagagaaaagaaatagcttaatgaata

SEQ ID NO: 34912 - DNA, 334 bp, Zea mays
  Clone ID: LIB3060-023-Q1-K1-F7
cccaagacactgagctggtctgtttagttggaaagccatctgtacgtttttcgccgatcatggaggatgagaggaacacccagcagcaccagggcggtgagcaggcccaggaccaggagaacgaggtgaaggacaggggactcctggacagcctactcggcaggaacaagcacgacgaccaggagaagaagaaccagcaggcggaggaggagctggcgaccggcatggaaaaggtcacggtggccgagcccgaccacagggaggagggacacgaggccgccaagaagatggacagccttttggccaagctgaaccggaccagttccagttccag

SEQ ID NO: 34913 - DNA, 301 bp, Zea mays
  Clone ID: LIB3060-023-Q1-K1-F8
gcagcggataaggtccccctgcgccaacggtcaatgcatggaacctatcaaaccaaggcggcgattctccgatcccaaccagactcatggtggcgttcatggcgagcagcggggccatgaacgcgtcgagcaggccaaccttcgtcacccctcgtagcttctttaactggggcaaaagcgcgagagaaaccgagacgccgccgccgcagctgcagttctcctaccacgacgtcgagccaccgttccccatgtcgctcgtggcaaaaacacacctcagagaccgtgagctcaggtgctgcta

SEQ ID NO: 34914 - DNA, 447 bp, Zea mays
  Clone ID: LIB3060-023-Q1-K1-G1
ctccatgtcctcctccagacctccacgatccggcctcccccacctctcgccggccgaggacgatgcgccggcatcagagcgcgcgccccggagccgaaaagcggggggcgtcatgaagcccccggccggcgccagcggcaagggcggcgcggtggacccctctctgccgcggttcaggtgccaggagtgccgccgcgccctcgtcgtcgtcggggtcgagtcctacgccgacagactgcccgcacacgccgcgcccggtaatcatgcatcttctggtcaagggcatggtaatggttgcaggcagaatgaccacctttaaggtggggctatttaaccggaccaattttaagggccctagaattcttcaaggccaaccaggggcagaaccggacattgctgatccaagccattcaccagaaccattgaaggggcaaaatttagggcttc

SEQ ID NO: 34915 - DNA, 185 bp, Zea mays
  Clone ID: LIB3060-023-Q1-K1-D8
tcagcacatctcagcctttacctttctcacactctcttcactcagttcgaggaatcggtgcatttagcgaagcggtaggtagcatcactacgttcttccgccaagctagttagtgccaatggccactgctgtagcgatgctcgtggccctggccctagccctagctctgatcgtggctgctagcg

SEQ ID NO: 34916 - DNA, 452 bp, Zea mays
  unsure at all n locations
  Clone ID: LIB3060-023-Q1-K1-C10
gctagccttccctacagcaactgcttacatacaacacttccatcttcccgagctcgtattcgggcaattgccaattcaaataataatataacaccaatggtggttcccgtcatcgacttctccaagctggacggcgctgagagggccgaaaccctggcgcagatcgccaatggctgcgaggagtggggattcttccagctcgtgaaccacggcatcccgctggagctgctcgagcgcgtcaagaaggtgtgctccgactgctaccgnctccgggaggccgggttcaaggcgtcggagccggtgcgcacgctggaggcgctcgtcgacgcggaacggcgcggcgaggttgtggcgccggtggacgacctggactgggaagacatcttctacatccacgacggatgccagtggccgtccgacccgccggcgttcaaggagaccatgcgcgagta

SEQ ID NO: 34917 - DNA, 438 bp, Zea mays
  Clone ID: LIB3060-023-Q1-K1-C11
gacagaaatggaagaggaagaagaagagttgcagttggctaggcacatggtcaataggaggcgacgtgtacgcaatgagcgtcgtcatggtggttcgattccagggcgtgttaggattcatcgtgatcacatgagcggcgatgcaagaatccgagcggactactttggagccaacccggtgtacacggatgctcaatttcgtaggaggttccgcatgcgtcgccatgtctttgagcgccttgttgatgttgtgcaacaagtggatccttattttattcagcgtccaaattgtgcgggtgagattggtctttctgctctacagaaagttgttgctgctgttcgaatccttgcttacggtattccggctgatgccgttgacgaatacgtacgtattggggaatctactgctcatgaggcattgaaacacttttgcacggt

SEQ ID NO: 34918 - DNA, 381 bp, Zea mays
  Clone ID: LIB3060-023-Q1-K1-C12
ctagtgccaactgccaaccaccggcagccgtccgttttccgcaggcgcgaccttccggacagagccgccgcgtcgcgccgacgagcggtccttctgcctagtttctccgcccagcgagcggcgggttcctcggagattcccgctggccgcggggatccatttggtgagttgggagccggagctccgatttggcggtttccctttgggaggtcgtctgattgaccggcggcggcggtttgctttgtggatgcagtgactgctcgcgttgcgcctggatctggtttgggacggaggagtgaaacgcgacggtgatcgtgcgaggtggggacgccatcagtgctctgtctggggtcggtctgttctttggctgcagatctggaa

SEQ ID NO: 34919 - DNA, 355 bp, Zea mays
  Clone ID: LIB3060-023-Q1-K1-C2
cactgaatttatcctagaatctttggaacaaagtgatccacgatcattgatacaatatcttgcataccaagatttgtgtgtggcatctgagtgtaatttggaaccatggcgcagagctgctttctttgaggaatctggtgaaacttataaaagaatcgtgacaacttgtttgaagccacttgaggagtttacttcaaaaattgctgaagcccttgaaagattttctagtgataagccagaattgatgctacaacagtccaaactctgtagtgcatttgatgatttccagatatgcgcatggtgtgctcggacattgactgggttaactgcgtgctcacgccaagaagatcggtat

SEQ ID NO: 34920 - DNA, 404 bp, Zea mays
  Clone ID: LIB3060-023-Q1-K1-C4
agactggtaggttggtagctgttactgaaaaactaatagaaggcaggacggggaaaggagatggagctgaacagcatcccctatattgcgtcgtggtcttcctcctcgagctgcttctactacagctacagtcgctgcgcctgcagaggtacaagagatgggaagctggtaacaaaagcttctgcagctggtcgtaagcgtgctgctgattcagtatgttcacaactctctgagcagggaactgaagattccatttcaggtcctagatcttcctggcgtataaagaggagagaccttgcttctgccattttactcccttttctgattcctcgtgttaacatctctatcgcggctgagatatacgacgcatcaattattcgaagtggtgtgaagagtggtttaac

SEQ ID NO: 34921 - DNA, 378 bp, Zea mays
  unsure at all n locations
  Clone ID: LIB3060-023-Q1-K1-C5
accggaccgacgagcgacgaagcgcgcacaaagagaagaacctcggagctgagatggcacaaggcatggcgtcgatgacaggcctctcgcagggcgtcctgcccagcaggcgcgccgacagcagaaccaggacggccgtcgtcgtcgtcagggcgtccgcggagggcgacgccgttgcgcaagcgggccgtcgcgccgtgatcgggcttgtggccactggcatcgtcggcggcgccttgtcgcaagcggcgcgcgccgagaccgtcaagaccatcaagattggagccccgtcgtcgnccttcggtggactccccgggactctcaactctgaccaggcgagggacttcgaccttcccttgaaggagcggttctacctgc

SEQ ID NO: 34922 - DNA, 453 bp, Zea mays
  Clone ID: LIB3060-023-Q1-K1-C6
accgggccgacagcgacaacgcgcacatagagaagaacctcggagctgaatggcacaaggcatggcgtcgatgacaggcctctcgcagggcgtcctgcccagcaggcgcgccgacagcagaaccaggacggccgtcgtcgtcgtcagggcgtccgcggagggcgacgccgttgcgcaggcgggccgccgcgccgtgatcgggcttgtggccactggcatcgtcggcggcgccttgtcgcaggcggcgcgcgccgagaccgtcaagaccatcaagattggagccccgccgccgccctccggtggactccccgggactctcaactctgaccaggcgagggacttcgacctccccttgaaagagcggttctacctgcagccgctgccgccggcggaggcggcggcgagggtaaagacgtcggcgcaagacatcatcaaccttaagccgctcatcga

SEQ ID NO: 34923 - DNA, 262 bp, Zea mays
  Clone ID: LIB3060-023-Q1-K1-C7
gcaggtagtaccttggccaaaacgacttagctatcaagctcgaccgacgaccgaagctaagctaccaagctactagtagtcttcttggtcacgttgttgattgcagcggtcgagcacacacaagctagctagctagccgctagagctagggtcgtcggatagatcgacatggccggcagggacagggagccgctggtggttggtaggtgggcggcgacgtgctggaccccttcgtccggaccaccaacctcagggtcagcta

SEQ ID NO: 34924 - DNA, 463 bp, Zea mays
  Clone ID: LIB3060-023-Q1-K1-C8
cacaaccagaagccacccattggcgtacgcgaggcgatcggagcatcccgtcccaagaggagagactccggccggcgacgcgggggaaaatggggaagacgccggtgcggatgaaggcggtggtgtacgcgctgtcgcccttccagcagaaggtgatgccggggctgtggaaggacatcaccaccaagatccaccacaaggtcaccgagaactggatctccgccacgctcctcctcacccccgtcgtcggcacctaccaatacgccatgtggtacaaagagcaggagaagctttcccacagatactaaatgggatgtcctccaagttgctgcggcttgtcgcagttgaattttccatgatgggttgtataatctgtcaatgtcatttctttgctcagttttagttcaacccattttcacctttccatatgcatatacggtatctgtgcctggcaaacatattt

SEQ ID NO: 34925 - DNA, 250 bp, Zea mays
  unsure at all n locations
  Clone ID: LIB3060-023-Q1-K1-D10
cccggcancactcagcaccagcttcgctttatggccacccacgcagctctcgccgcctccggcatccccgacaacgccccactgcacagcatatcggccgcgtcatccatgcacggcgtgcagaggctggacttctccgacttctccaggctcaagcctgagtcgtgctccgtgagcgctgccgcgcgggaagcgtccttctccgacatccttggcgcgcagctcgtctccaatgccacacgagagaacg

SEQ ID NO: 34926 - DNA, 311 bp, Zea mays
  unsure at all n locations
  Clone ID: LIB3060-023-Q1-K1-D12
cgccatatgtcgccggaggccggaccaatcatccggtccgccgaccagctactcctcccgttggtcctgctggccgttgcctccgtcgctgccgccgccggctcgtgggagaatggatatgggagcatcctccgcctcccctcctcgtctccgcgccggttcccccgctccgcggccgtcgacctgatccacgcgctcaacctncaccccgccgacgcgtcccctcccctctccaccgccggcgtagagggcgccctcgcccccgcggggaccctcgtcgagaggcccatccgcatcgcgtccttcgcgaa

SEQ ID NO: 34927 - DNA, 450 bp, Zea mays
  unsure at all n locations
  Clone ID: LIB3060-023-Q1-K1-D2
aattcccggggttcaatccttggtgaagagttgtttgttctagggttgggtttttctgaggttgccaaagcacgcccaggcccagccaaggttggctgttgccacttctcagctgatggtaaactgctggctactggtggtcatgataaaaaggtcactttgtggtgtaaagattctctgaaccctaaatcttatctgaaagagcactcgtttcttatcactgatgttagaattagcccaagcatgtcacgccttgctacatncctctttgacaaaactgggccggtttgggatgccgaatattccgactattcactaacaactttcacgggccattcaacaacttgtatggcacttggttttcatcccaattaagagggtatgatatgctcctgggatagtgatggggaaattcccaacttgagccttaataatggtagctggttgaca

SEQ ID NO: 34928 - DNA, 85 bp, Zea mays
  Clone ID: LIB3060-023-Q1-K1-D3
caagttgttcaaggaatccagcgaccaggatatggagcacgctgaaaagctcatggagtaccaggacaaacgttgaagcaaggtg

SEQ ID NO: 34929 - DNA, 305 bp, Zea mays
  Clone ID: LIB3060-023-Q1-K1-D5
ctgaccatgccgccgatgccggcgtggccgcggcaggacgccatcgacctccacaaagcattcggagggttcggttgcgacagcacgacggtgaccaacatcctggcgcaccgcgacgcgacacagcgcgcgctgatccagcaggagtaccgggccgtgtttaaccaggacctggcccggcgcatcgcgtccgagctgagcggccaccacaagcgggcgatgctgctgtggatcctggacccggccacccgcgacgccaccatcctgaagcaggcgctcacgggcgacatcaccaacctgcgggc

SEQ ID NO: 34930 - DNA, 448 bp, Zea mays
  unsure at all n locations
  Clone ID: LIB3060-023-Q1-K1-D6
gcttcttctagctctagctaggctcgtctgctgcaagaaggtaacagtaacagcaggcatggaggggaaggaggaggacgtccgcctgggcgccaacaagttctcggagcgccagcccatcggcacggcggcgcagggcacggacgacaaggactacaaggagcccccgccggcgccgctcttcgagcccggngagctcaagtcctggtccttctaccgcgccggcatcgccgagttcgtcgccaccttcctcttcctctacatctccatcctcaccgtcatgggcgtctccaagtccacctncaagtgcgccaccgtcggcatccagggcatcgnctggtccttcggcgcatgatcttcgcccttcgctactgcaccgncgccatctccggcgggcacatcaacccggcggtgaccttcgggctgttcctggcgaggaagttgtccc

SEQ ID NO: 34931 - DNA, 454 bp, Zea mays
  Clone ID: LIB3060-023-Q1-K1-D7
gcaggcatcagcacatctcagccttcacccttctcacactctcttcactcagttcgagcatggggggcagcgagcgaagcggtaggtagcatcagtacgtgctgccgccaagctagttagtgccaatggcgagggctgtggcgatgctcgtggccctggccctggccctggctctgatcgtggctgcgagcgcagtcggcgcggcagcgcatcagtgcaacgctgctcagcttgctgcatgcgccccggcgatcatcagcggttctgcagccacggcttactgctgatataacctgcgcgctcacgaaccgtgcttttgccagttcgcgcgcaacccggcatatagcaactacgtcaacagccttaacgcccagcttacgcttacctgctgcggcatagccgtcccgagctgctatggctctagctcgtgccttgctgggtggatgaattaaaa

SEQ ID NO: 34932 - DNA, 453 bp, Zea mays
  Clone ID: LIB3060-023-Q1-K1-C1
aatctttgaggtcaaggccacagctggtgacacccatcttggtggtgaggactttgacaacaggatggtgaaccacttcgtccaggagttcaagaggaagaacaagaaggatatcactggcaaccccagggctctccggaagctgaagaccgcttgtgagagggcgaagaggactctgtcttccactgcccagaccacgattgagattgactcgctgtatgagggcatcgacttctactccaccatcacccgtgccaggtttgaggagctcaacatggacctgttcaagaagtgcatggagcctgttgagaagtgcctgagggatgccaagatggacaagagcaccgtccatgacgttgtacttgttggtggctccactaggatccccagggtgcagcaactgctccaggacttcttcaacggcaaggagctgtgcaagaacattaaccccga

SEQ ID NO: 34933 - DNA, 462 bp, Zea mays
  Clone ID: LIB3060-023-Q1-K1-A11
gtcgcgtggaagatcatcttcggcttcggcctcttcgaggccgtcctacagctgctgctccctgggaagcgcttcgaagggcccatctcgcctgccgggaacgtgccggtctacaaggcaaatggcttacaagcatatgcagtgaccttgataacttaccttggtttgtggtggttcggtatatttaaccctgcaatagtgtatgatcacttgggggagatatactctgctcttgtttttggaagctttgtattctgtatttttctctacataaagggccatgtatttccatcttcatctgactctggatcctctgggaatgtgataattgacttctactggggtatggagctgtaccctcggattggcaagtactttgatatcaaagtcttcaccaactgtcgtttcggtatgatgtcctgggctgttcttgccgtaacctattgcataaagcagtatgaa

SEQ ID NO: 34934 - DNA, 163 bp, Zea mays
  Clone ID: LIB3060-023-Q1-K1-A3
aattctcttatccacccacccatccacacttccccttcctatatataccatctaatcttttactttaacaacatactcctacacatctacgccaccgttcatactttacgaaagctcttccctacccacaaccaaaactaccctcttacttcaacctcacccc

SEQ ID NO: 34935 - DNA, 458 bp, Zea mays
  unsure at all n locations
  Clone ID: LIB3060-023-Q1-K1-A6
gctttccctgctcggctgctccctcctacagctcgcccctcaccctctcgactccctatcctagctctctcttgtcgccgctctgctcgttctccatggcgccgacgtggagctcgcccagccctcccagctcgatctccttcgagccgtaacggccccctagcgtgccttcccagccgctcagcaccgctccagctcgccgtggccaccgttgcacatggccatgtcaagctggccgtccctgctccttccatcatcgacctcacacagcgccgacctcggccatatcctcatctctgcatcgacgcgctctgaccctgctgtcgctggtgaaggtccacacgcgtcgtcgtttgcatcctggttttctccctgctcgatgcgcccacgtcatcgtcttcctgctcgtcccgtgacgccgctcatcagatctgcgcangggccctgcgcgacgtcac

SEQ ID NO: 34936 - DNA, 452 bp, Zea mays
  unsure at all n locations
  Clone ID: LIB3060-023-Q1-K1-A7
atttgcaaacttggaggaaaatggaggaaagagtggggcacacgccgcttcatcagacaggaagcatgtttcgctcccaaggacaaccacagttcattctaatccaatccctccaaatggaacctcccaggttcctcaaaagattcccacaggtagaccaggaagagtggttggtccagtaataccatttgagaacgcagctgcagttgatccatacagccaacgtaaggtctcaaggaatccagtacttnctccaaccacgtcgaacaatgtagcctatgcctaccacccgaaggtagaccacttaaaccgaaaacttccaccagaacctgaaaaaggaccgaatgcagtaccagccagaacagcggttcatggacgccaaggtagtatcacagatgtcccctgacttgaggtcttcctactacataccaaaaggtgtcccaaaggctgat

SEQ ID NO: 34937 - DNA, 363 bp, Zea mays
  Clone ID: LIB3060-023-Q1-K1-B1
cgcttccccttgctgtggatgccatcggggcgctcaccgggacaacatactcctcgacagcgacgccggggcgcttccttgaggaaagctcgtagctgcccccgcgcaaagctccggtctttcttggccctgacccctcctccccgccgccggcgccgcgtgagcacgccgcgcttggcttgatgctcgacttctgcgcgccccacgggcccgccaagctcccggttgcgtctgtcgctggggtgcgagtcgccggcaggtggttgtggcgatcggcggccgttggggcggtgcgccatggcgtcttcgcgcgggcctcatccttcggttcccggatcgggctcgattctcagaattttcaca

SEQ ID NO: 34938 - DNA, 447 bp, Zea mays
  Clone ID: LIB3060-023-Q1-K1-B12
cagtcagcaaaccaaaaccgctctcgagtctccatccattctttcggttaatccgaagttttcgggtttccagctctagctagccttagcctcgtccaagggacaaaggggccaccatgagcgtggtgatcctggacggctccacggtgcgcggcttcgtggcggacgaggcggccttcgcgcgcagcctggacgcgcggttcgccgcgctggacgccaacggcgacggcgtgctgtcccgcgccgagctccggcgcgcgctcgagtccttccgcctcctcgacggcggcggcttcgggtccgcccagccggcgccgctccccgccgaggtcgccgcgctctacgacgccgtcttcgagcagttcgacgccgaccacagcggcgccgtcgacccgcgcgagttccacgacgagatgcgccgcatcatgctcgccgtcgccgacgggc

SEQ ID NO: 34939 - DNA, 292 bp, Zea mays
  Clone ID: LIB3060-023-Q1-K1-B2
cctagcggtctccacatgtgagaaacgcctctctagtaattaagcagcatggcagagaagatgtggacgctaatcatcgtggttgaccttgattgccgcaagtgctaccacaagatccgcaagattctctgccaactgcaagaccatgagaggatccgcaccatctccttcgacgacaagagcaagacggtcaccatggtgggcccgttcgacccgcagcggctcgcgtgcaagctccgctgcaagggcggcaaggtggtgcgggacgtctacatcgtcgacgccaacgggc

SEQ ID NO: 34940 - DNA, 448 bp, Zea mays
  Clone ID: LIB3060-023-Q1-K1-B5
cctcggctcatctcaagagcgactagagagagagaggaagagaacaagcgataagctgatctggcacgcaagatgcgggctccaaggggcgcaggcggctgccgcggcggccaggagcatgtggaactgatccctggcatccccgacgacgtggccgtggactgcctggcgcgcgtcccccacgcctcccaccgcgcgatgcgccgggtctgccgcggctggcggagcgccgccgcggcgccggccttcgcgtcggcgcgcgccgcggcgggcgccaacgaggacctcgtgtacctcatgcagttcgggaacccggtccgcgacgacggggcccaaggagggcgacgacggccccggagcaccccggcgtacggcgtgccggtgtacaacgtgacaacggccgagtggcggcggtagcgcggcgcgccccccgtggtgccggtgttcg

SEQ ID NO: 34941 - DNA, 378 bp, Zea mays
  Clone ID: LIB3060-023-Q1-K1-B9
cctcgttcctgtcgcgcagccacgacctccacttcacatctcccccggcggcggcgcggtcaggtgaacaatggcggactccaaggccacctcggcggtcaccctccgcacccgcaagttcatgaccaaccgcctcctggcccgcaagcaattcgtgcttgaggtgatccaccccggccgcgccaacgtctccaaggcggagttgaaggagaggcttgccaaggcgtacgaggtgaaggacccaaacaccatctttgtcttcaagttccgcacccacttcggaggaggaaagtccactggtttcggcctcatctacgacaacctggaggctgccaagaagttcaagccgaaataccgcctaatcaggaatggccttgc

SEQ ID NO: 34942 - DNA, 384 bp, Zea mays
  Clone ID: LIB3060-023-Q1-K1-A1
ggagagtacgtggaggagcagccatggcttcatcggtggccgccgcggcgagcacatggctgggcacccgcctggcggacccggcgccacagaacgggcgcatcgtggcccggttcgggttcgggttgggcggcaaggcgaagcctgctccgaagaaggtggcgaagacatcgacctcctctgaccggccgctgtggttccccggcgccgtggcgcccgactacctggacggctcgctggtcggcgactccgggttcgacccgttcggtctcgggaagcccgtggagtacctgcagttcgagttggactcgcttgaccagaacctggccaagattgaggccggcggcatcatcggcacccggttcgagtcctccgaagtcaagt

SEQ ID NO: 34943 - DNA, 403 bp, Zea mays
  Clone ID: LIB3060-022-Q1-K1-F3
cccacttcggcctcggcagttccgcgtgccggccggagcctcgtctcgcttcgcatctcgcacgtcgcgccttcgccgctgcgattcctcagcagctcctcgaccgctccacccacccctgcgccggcgagatggagctcaagcccggcatgtcggcgctcgtcaccggcggcgcctccggcatcgggaaagcactttgtattgcttttgcaaggaggggtttatttgtgactgtcgttgatttctcagaggaaaatggaggagaagtggctacataagttcaaaaggaaattgccaaattcaacgagaatttaaaaatcccatctccataattggtaagtgggaaggtaggaatgccgattatcctgccggttggtttgagaagcctggaccggccttccat

SEQ ID NO: 34944 - DNA, 315 bp, Zea mays
  Clone ID: LIB3060-022-Q1-K1-F4
gctgagctgagctgagctcaccaccaccacacacgggagatagctatagctagcatagcaagcgagccagtcagcgacttagcagcagctagctagccatgctgccgtccttcgtgtcgccgacggcgagcgccgcggcctcggtgacgccttcgccgcggccgataccaggcagctacgggccaccggtgctgggcccgctacgggaccggctcgactacttctggttccagagccaggacgagttcttccggaagcgcgcggcggcacaccgcagcaccgtgttccgcaccaacattccggccacctttccct

SEQ ID NO: 34945 - DNA, 296 bp, Zea mays
  Clone ID: LIB3060-022-Q1-K1-F5
gccgtctcccttttgcgtgagcaaagaaagagagcgagaagcagtcgccatgtctggcatcatgcacaagatcgaggagaagctccacatggggggcgaccacaagaataaggaggaggagcaccacaagaaggccgaggagcaccacaagaaggaggagggggagcaccacaagaaggacggcggggagcacaaggaaggcatcgtggagaagatcaaggacaagatcaccggcgagcacggcgacaagtccggcgcccacaaggagaggaaggacaggaggaagaaggttaaga

SEQ ID NO: 34946 - DNA, 385 bp, Zea mays
  Clone ID: LIB3060-022-Q1-K1-F6
aataagacgacttgtttcattgattcttgaagagatcgagcttcttttgcaccacaaggtcgaggatgtcttgcaactgcggatcaagctgcggctgcggctcaagctgcaagtgcggcaagaagtaccctgacctggaggagacgagcaccgccgcgcaggccaccgtcgtcctcggcgtggccccggagaagaaggccgcgcccgagttcgtcgaggccgcggcggagtccggcgagggccgccacggctgcaacttcggtggccacttcaagtgccaaccctggaactggtgatcacatcgatcgaccaccattgatattaataataactatctaacttggggtggttggtggaccattattaaccaaggccaacctgcttg

SEQ ID NO: 34947 - DNA, 223 bp, Zea mays
  Clone ID: LIB3060-022-Q1-K1-F7
caagtgtgcagatgacaagccgtttgtcccatatccttgcatacgaggttccctcatgaaatggaatgtactgcatggtggaaagagttgttcactactcataactggtgaacattatccgcaacatgtatcctacccttcctctttcggacaattgtgcacatgacaagctcgtttgttctaccctaccaagtatcatacgagaacatagaaagcataatca

SEQ ID NO: 34948 - DNA, 353 bp, Zea mays
  unsure at all n locations
  Clone ID: LIB3060-022-Q1-K1-F8
gcgcgatggcagcggcgcaggaggaagcggcggcggcgccgccgagcacggagagcgatgctgccgagacggaggaggcaccaccaggcggcgcggagagcgatgctacggcgatggaagcggcggcggagtactcgtggctccagctccgcttcgaccgcccccctcgccggctctaccacttcgcccgccagttccgctccgccacttcctctggcagcaatagtagcggcgagaacttcctcaagggcgtaaagtggtccgccgacgggtcctncttccttaacaggctcgacgataactccctccggttggtttacttaccggaagaagcctacattgcggccgaaccc

SEQ ID NO: 34949 - DNA, 250 bp, Zea mays
  Clone ID: LIB3060-022-Q1-K1-G1
gtgcatgtgtccatgctgacctccatgactacaaggaagttaatggcaatgattcagacgctgagctctctgttgaggataacacacttgaaccaaatgtaaatttaaatgatactcccctaagtcgtttaatagaaaatggaaagaaaccatcaaatctggcgtccagtcatgaaactccattatcagtgggagaaattcttttgtctttggatgctggagttccattacctggtcgtgcagctgaata

SEQ ID NO: 34950 - DNA, 163 bp, Zea mays
  Clone ID: LIB3060-022-Q1-K1-G10
cccgttcttctatcttcctctttattcatttttgctccgaaacttgttttgttaggtgacctgttacattttcatctcgactcgtctcgactatactctcaccgtcaccacctacactctatactacctagctattaactacggccaaacaaacaactcgatc

SEQ ID NO: 34951 - DNA, 384 bp, Zea mays
  Clone ID: LIB3060-022-Q1-K1-G4
cccacgcgtccgctaccgaagcccttgtacccctcgccgccgctgctgctagggagcttccatgcgcgcgcgcctacaacgagagctagcagcagtagcggccgttatcttgtcgctccggatccgttcgtgtacccaagtcccagcctagatgccgcagatggaggggtccactgatcagatcgccgccggctggttcgctaaggagccggcttccgagcggcccgtgggcttgccgaggaccggctcttccagtcgccttaacgcgcaggcccccgaattcgtgccccgggggccggcggcaccggcaccggcgggtgggctggcggcttcggcggaagtgatccggatggtcgccgggccttccccggcggcgcgtggggg

SEQ ID NO: 34952 - DNA, 166 bp, Zea mays
  Clone ID: LIB3060-022-Q1-K1-G8
ctagcgccagcaccacccgcccaaactcccttagagagagagagagaggaggaggccgtcgccgccgctgttaccgtcggccgaggcgccaggatgttcgggtaccagaatggccttgacgtcgaggccgcgacatccagagccgacgccactgatggagcgcgcc

SEQ ID NO: 34953 - DNA, 458 bp, Zea mays
  Clone ID: LIB3060-022-Q1-K1-H11
ctcgctcgctagctagggtttccaccaatggcggcgcccaccacctcccgccgcggccccggcggcgcgcgcaacatggacgacgagaacctaaccttcgagacctccccgggggtcgaggtcgtcagcagcttcgaccagatgggcatcaaggacgacctcctccgcggcatctacggctacggtttcgagaagccctccgccatccagcagcgcgccgtgctccccatcatcaacggccgcgacgtcatcgcgcatgcccagtccggtaccggcaagacgtccatgatctccctcaccgtctgccagatcgtcgacaccgccgtgcgcgaggtgcaggctttgattctttcgcctactagggagcttgcttcccaaacagagagagttatgctggctattggggaccacctcaacgtccaagtgcacgcttgcattggtggaaagagtattggtga

SEQ ID NO: 34954 - DNA, 68 bp, Zea mays
  Clone ID: LIB3060-022-Q1-K1-H2
tcgacccacgcttacggcgtagactgtctccctcttcctgtcagtattagagttataataaagcaact

SEQ ID NO: 34955 - DNA, 402 bp, Zea mays
  Clone ID: LIB3060-022-Q1-K1-H4
cgtcgagcgggctgaggagctgcagcgccgtgggcgtgcccagcctgctggcgccgtcgtcccggtccggccgcctggcgccgttctgcgccaacgccaccacctctggccgcgtcaccatgtccgcggagtggatgcccggccagccacgccctgcccacctcgacggctcctctcccggggacttcggcttcgatccgctgggcctcgcgaccgtgccggagaacttcgagcggttcaaggagtcagaggtgtaccactgccgctgggccatgcttgccgtccccgggatcctggtgccggaagctcttggcctgggcaactgggtgaaagcgcaagaatgggcgggcgtccccggcgggcaagccacgtacctgggcgccccggtgccgtggggcacgc

SEQ ID NO: 34956 - DNA, 379 bp, Zea mays
  Clone ID: LIB3060-022-Q1-K1-H5
ccagtagtcgtcgcgtttgcagctaggcagatctgagttagccggcggatccgatccgtgcgcgtgcgcagtgtgtgtgtgtgtgtgtgtgtgtgtgtgtgtcggtggagagatggccacagcttacgctcccatggcgagccaggtgatgaagagcagcctcgtcgtgcactcgaggccgaggggcctgtcaggcgctgctgcgctcacgaggcggcccggccggttaaccgtcaaggccatccagcccgagaaggcaacgtaccaggtggtgcagccaatcaacggcgaccctttaatcggaagcttgaaaacgccggtaacttgaagccggttggtggcttggtacttttcaaactttcgggcttacggaacggcc

SEQ ID NO: 34957 - DNA, 465 bp, Zea mays
  Clone ID: LIB3060-022-Q1-K1-H6
gtctgcgagcaggcgcggcgggcacagttcttcgggtacaacctcaccttctggagccacctgcgcttcggcttgccgtcgacgatcatcatcacggcgatcggcctgctcatcgtcgccagttactgaaccccacacaagctagggtctcggcctcgcacaaacggcggggtgtgtagccagatggcaggcagaacgctgcagaaaacagcatgcagcactgcctgacatcgaaggagatgttgtactgattggcctttgtttgtacgttgtaacagtttttatgtcgttcgtgtaagtctgtacgtttcgcgcaaccgatgccggaaggcgccgggttgcccatctgctaaagcaaaatatgcgcaagactagtagatggcatggagtatagaaggccggcaccactgttctaggaaggcaaaaacttgctctagctagttcaggtaggagagccggcgaaaa

SEQ ID NO: 34958 - DNA, 468 bp, Zea mays
  Clone ID: LIB3060-022-Q1-K1-H8
agaaaccctagttcgaacgcgccgccgtcaccgtcgtcgctcgcgctctccgcccggatcggagcgagagtaggggcgtgtcggcggtgaaagcgactgcgtcagccatggcggacgaggagcattcggagaggagagaggaggcctccgagcttgcccccttcgacccgaccaagaagaagaaaaagaagaaggttgtcatccaagaaccttctgatgaagtggacaagcttgcaaaagagacagaaacactggcagtcgcagaacccggtggacttaacttcaatggaatggagaagaaaaagaagaagccggtggatcttgattcaactcttgatgagcttggagatggggaggacactcaagatgatcaagctgtagaggaacaaggggaaggcattgtgctgggaagtgtccctacatacccttgggagggaactgatcgggattattaatatgaagagctgc

SEQ ID NO: 34959 - DNA, 302 bp, Zea mays
  Clone ID: LIB3060-022-Q1-K1-H9
atagcctttcctctcactcgcccctctgcatttaccactttgccctcgtcggcggcgctgaccgcccgccgccgagtccggcgaaacaaccgcctgtagttccagagtagtacctcatggcggccatatcgtcacttcccttcgcggcgctgcgcggagccgccgagtggaggccttcgtcgacggcggcggccgtctccggcgccgtcgtgctcagcgcgaggtctcgccggggctcgcgctcggtggttcgattgtgtggcaacaccggtggagtcccaaccaatggtccaaaaaccaaa

SEQ ID NO: 34960 - DNA, 399 bp, Zea mays
  Clone ID: LIB3060-022-Q1-K1-F2
ccgccgtgattatggaaaagcttttcattggttttctaaggctgttgagaaaggcgagacacgagcattggaacttctgggtgagatctatgctagaggtgctggagtggaaaggaactatactgaagcatacaagtggttggcacttgctgcaaagcagcaacattactcagcttacaatggattgggttatctatatgttaaaggctatggggtggagaagaaaaacctgacaaaagcaaaggaactttttgaacttgcagccgagaataaggaagctgggggacattataaccttgggtgtgtgtatcttaagggtattggtgtgaaaagggatgtaattagagcctgccatcttttggttcatgcaattaatgcttggcaaccaaaagctattta

SEQ ID NO: 34961 - DNA, 252 bp, Zea mays
  unsure at all n locations
  Clone ID: LIB3060-022-Q1-K1-D3
gagagtgtgatcaccaacagctagtgctagtcccccttccttccatccatccatggcatgcgtgagcaccttccagagctgccccattgccagaagagcaaagatcaacaccaggtccaggggcagcagcagtagcgtggcgaaggggtcaccaccaccagccttccagttccagtgcagggcgtcgactttcgcggcggacaccagcctncggctcgagctggacgagaaccccgaggcgatcatctgggg

SEQ ID NO: 34962 - DNA, 402 bp, Zea mays
  unsure at all n locations
  Clone ID: LIB3060-022-Q1-K1-D5
ggcaagagctacgagagcgcggcggaggtccacaagcggttcaggatcttctccgagagtctcgagctcgtccgctccaccaatcggaaaggcctctcctaccgcctcggcatcaaccgcttcgcggacatgagctgggaggagttccgtgcgacccggctcggcgcagcccagaactgctccgccacgcttaccggcaaccaccggatgcgcgccgncgncgttgcgctgccggagacgaaagactggagggaggatgggattgtgagcccagtgaaaaaccagggccactgtggatcttcctgaaccttaacaactactgggccactggaggctgcttatcccaagccacctgccaggccaatttctttttttagccaccacttaatgaccgggggtttg

SEQ ID NO: 34963 - DNA, 399 bp, Zea mays
  Clone ID: LIB3060-022-Q1-K1-D7
atggtgcatggcttctgccgcttgcactgataccttttgtggggccctcactgtatgttctagtgcgcccatcactttcttccttgctggaagcatctgcttcagcatctgatgagttcaaaaaataattggtatctaactcagaactgatggagaatttggttgtgagcacatgacatgggtagagaaatggttatctggcaactgcatttgttagcccaaatgctatgtcaattgctgatttggaggaaatccacaatcttgcatgcccacctccctgtcaaaaatgaagggccccattaggatccggccaatgaggatttggcaggattaatatcaaccgggggccttaacaaatttggcaggggtaaaattaaggggaatccaacattttttaat

SEQ ID NO: 34964 - DNA, 305 bp, Zea mays
  Clone ID: LIB3060-022-Q1-K1-D9
gatcctcgtcgccgacgcatccacccgaaccctcctccgcgacctcgccgtcgccggagccttggccatgtcgatcttcgagtataatgggtccgccgtggtggcgatggtggggaagaactgtttcgcgatcgccagcgaccggcggctgggcgtgcagcttcagaccatcgcgacagactttcagcgggtgttcaagggccacgacaagctttacatcggcctctctgggcttgccactgacgcccagacgctttaccagccgttggtgttcaagcacaagctgtattaactgtcggaggaaa

SEQ ID NO: 34965 - DNA, 251 bp, Zea mays
  Clone ID: LIB3060-022-Q1-K1-E1
cttctgccgctttttccgattccccctgtggggccctcactttatgttctaggtcgcccatcaaatttttccttgctttaaacatcttctttatcatcttatgagttcaaaaaataattggtatctaacttaaaactgaatgagaatttggttgttagcacattacattggttgagaaaatgatatcttgctactgcattttttaacccaaatgctatttcaattccttattataatgaaattcacaattt

SEQ ID NO: 34966 - DNA, 291 bp, Zea mays
  Clone ID: LIB3060-022-Q1-K1-E11
ccctcgcgccgccgccgccgtgcccagcgctcgagctcctcgcctgccgcgagctcgcgccgcgacgccaccatgaagttcaacatcgcgaacccgtctaccgggtgccagaagaagctggaaatcgatgacgaccagaaactacgtgccttttatgaccgaaggatctcccaggaggtcagtggtgatgctctgggtgaggagtttaagggttatgtcttcaagatcatgggtggatgtgacaaacaaggcttcccaatgaaacaaggagttctgccttctggtccgtgt

SEQ ID NO: 34967 - DNA, 188 bp, Zea mays
  Clone ID: LIB3060-022-Q1-K1-E12
cagagagctagcatacatcgctagctcactttagcatatatattacataaatattggcatatatgaactaaactgaattgaggacgatatggcccgcttggtctcttccggaatcattggtaaggggcacaacatctttgacgatggcggattcggtgaagtccatgctgacccaataaagtcgagcg

SEQ ID NO: 34968 - DNA, 279 bp, Zea mays
  Clone ID: LIB3060-022-Q1-K1-E2
ctcctcttgcgattcgctcgctcgatcctagcttcccttccaagaagcgcagcgcccatggccgtgtcgacgcaagcctccgccgccacgcgccacctgctggccgccgcctgggcgccggcggcgaagccgcggcagctgagctcgcagctcgcgctgccgtcgtcgtcctcccgcgggccggccccgctccgcgcgtccaccgaggaggcggtggaggcgcccaaggggttcgtggccccgcagctggaccccagcacgccgtccccgatctttggc

SEQ ID NO: 34969 - DNA, 386 bp, Zea mays
  Clone ID: LIB3060-022-Q1-K1-E3
caccactctacgcaagcaatccttcggacttcggtgggggaaatggaggccgccgccgccgccgagacggggctcgcccagaaaccggttgtgctgtacccttcgccggggatgggccacctggtctccatgatcgagcttggcaagatcctcggcgcgcggggactgtccgtaataattgtcgtcgtcgagccttccttcaacacgggcgctacggcgcctttcctcgccggcgtttccggggccaacccgtccatttccttcaacggcttgcccaaagtcaagcgcttccggccggtaaggaccaaccccaagaagggcttaactttcaaggcaaccgggttttccaaccggaacttcgggaagttcttggcggcgggttccca

SEQ ID NO: 34970 - DNA, 418 bp, Zea mays
  Clone ID: LIB3060-022-Q1-K1-E4
atgggacttatgatgaactcggtcaaagtttatcttaggaattgatgcggtagtaggtgacatagcgaattttggccaaccgttctctatatgtggactacactcttccttatactgagtcaggggtacgcatgctggttccagttcgggaccagagacagaagactgcatggacattcctagaacctttaacagctgatctatggtttggaactggatccttcgttgtcttcacaggttttatagtttggtttatcgagcacaagacggaataagaattcaaaagaaccgcaggcagtcaaattggatcaagcttctaattcttcttcttaacacttggatttgctcataaggagaggattgtgaaccatttatcaagaattgcaatagttggttggctttttgtgggtctaatatt

SEQ ID NO: 34971 - DNA, 394 bp, Zea mays
  Clone ID: LIB3060-022-Q1-K1-E5
ctgctgcagaatatattattccatacgctaagttcctgaagagcctcaatcatccggtctgtagtggagcaaggatcaactttcagtgccataatgaagatgttagtgaaaggcgatctggagtggttgttcgcattagtgaaatagatcccatgaaatggcctggctcgaagtggagaagcctgctggtaagatgggaggacggtgctgaatgtaatggccaaaatagagtatctccatgggagatcgagatagctggtggttctgtctctgtttctaattctctttctgcatctagttctaaaggacccaagttgggtcctaagggaaatttgaacgttcaaccattgtgaaatggtggtactgactcattggaacctggaaggttaccaag

SEQ ID NO: 34972 - DNA, 361 bp, Zea mays
  Clone ID: LIB3060-022-Q1-K1-E6
agtctagcccatttccaactgatggaaagcatggatggtggagcactggtttctcagatggcgggtggattgcttctctagtggcttcggggttttcggttgtcccgattgcatctcagacatggaaggcttactttgggctaatgcgaagtgaaacaccaaaggatgatagcagacaagctgcttcaattttgctccctgacaaagatcagtccttgaagttggaaaaacaccatgggcgagcagaggctcttctgttaacagcctatgggaaaaggcttggtctggcctctgggaaggtcaacaaaaccttaatttgatggctattgtgattgccaattgacctgccctttttttgggg

SEQ ID NO: 34973 - DNA, 387 bp, Zea mays
  Clone ID: LIB3060-022-Q1-K1-E8
gagacattgctgctgccagcagatgaagatcgagacaagcttgcggatcctatgtaccggctggaacaccaggaagaggatcttcggaagaaaaaagaagctgagccagttttagttcgccttcagcgactctcggacagccggcactctgatgattatgccctgaacagagcactccgcgatcgtcttaggagccaaaaaaaagagagttgctgaagagaagaagtccgcgagaaagataggccttggtgttccggtcttggcttccttcggaaaaaaatccaacggaacgggttcaatggaagttggattggaatttgggaaaagccgaagggattagaaggcccgaattaaaggtggcttcatcttttcggagtcattaagctt

SEQ ID NO: 34974 - DNA, 434 bp, Zea mays
  unsure at all n locations
  Clone ID: LIB3060-022-Q1-K1-F1
cacgcacgcccagccgagctcctgcttccctctcccgcggtgcctggcttcctccaagcccgcgcccaagcacaaccacgccctggtccgcgctccagccctccccatcctcttcttgctatggtgcccagccgagctctatccccttcctgccatggccgacgcccctccctgctgcagctcgatgccctnccctgcagcaagcagtgccctcccctttctgcaccaagtgggtgcccccagcccttccttggttccaatggccggccccttttgctgttccaatggggacctttaaatcccttttggtttaactagtcctggtaaaaaccctgttaatttaaggtttaaggggggtgaatggggccaaattgaagtaaaaccctggaaaattaaggtgaaaaaaaaggtaaggtcaacccttcctaaggggt

SEQ ID NO: 34975 - DNA, 291 bp, Zea mays
  Clone ID: LIB3060-022-Q1-K1-F10
gtcctcgctgatgtcctgaacgcagctagcgaggaacttgagcaagagccaagaggcgcccgtgtgcggttctgccacgtgtcacgtaatcgacgtttccccgccttccgcggttctgccgtcgtgcgcgcgtcacgccgtcacctgaccctcatgacagcacgaatcccaaagcagaaggccaaaaccccgtcatcccagccccagggcccaggctcccggatcgtctaatcaatcccgcattccccattgcacgccgtctccgctagggttttactccgcagccacacc

SEQ ID NO: 34976 - DNA, 346 bp, Zea mays
  unsure at all n locations
  Clone ID: LIB3060-022-Q1-K1-F11
gtccgttctagaatctagacacggcaatgaagcccaggcctctcggttgcggttgcggttgcgtcccggcggcggtagggtgcgtcggctgggcatggaggccgactccgaggccgcgcggnggagggagggcagcaggggtgtcgcccaagtgctcgcactcggcggcggcggcgggagcggtacagtcggaggaccgccgccgcgaggtgctgtaccgcccggtggagctgcccgggacggggtacgggtcggagctggaagcgcggatcgagaaagtcatctacgcctgccgcttcatgaccttcttcggaaattgtggcttgctcctcggctctgtcccatg

SEQ ID NO: 34977 - DNA, 265 bp, Zea mays
  Clone ID: LIB3060-022-Q1-K1-F12
gtccctttcttcttcttcctcttgattgataggtgcgccgaagcttgttttgttgggtggcctgggtctctgtcgtctcgtctcgtctcgtcttccgcccggccgccaccacctgcaggctatactagctagctattaagtccggccaaccaagcagctcgatcaggtcggtcgacggcggggacagttcggagggaggaggcggccggagaccgaaggacgcctaccatcaactcgcggtcctggccgcgctgccaaaaaataa

SEQ ID NO: 34978 - DNA, 230 bp, Zea mays
  Clone ID: LIB3060-022-Q1-K1-D2
caggatagagagggagaggagcagaagagagcagaggtccagaggcgcagaaggcagtcgcgggcaggaggaagaggaagaagaagcggcagcgagcgaggatgccgtgcctgaacgtgtcgaccaacgtgaacctggagggggtggacaccttcgccatcctcgccgaagcctccaagtccgtcgccaacatcatcggcaagcccgaggcctacgtgatggttgttctc

SEQ ID NO: 34979 - DNA, 250 bp, Zea mays
  unsure at all n locations
  Clone ID: LIB3060-022-Q1-K1-B2
ccaaggtcttcccgtgcgcgctatcctgcgcacgcaccgtgacctgctcggcctaatcgtcccgtttaccgctccctcagctcgcccgagctcctgccctgctcgccgtgctaaccgtctatgtcgtcgccggacttgtctcctcgaccatcttggcgttgntatttcctgctgctccatgacatcgtcgagccattctcagttgctcgccgtcgaagctcccctgttggctgcgtcctgctcgcctttg

SEQ ID NO: 34980 - DNA, 273 bp, Zea mays
  Clone ID: LIB3060-022-Q1-K1-B3
cgaaaaggaaaacttgtgcctttatggctaccccaacgaaacatgggaagtaactttgccagcagaggaagttcctccagagatccctgaaccagctttgggtataaactttgctagggatggcatgaacgagaaggattggttggcgttagttgctgtccacagcgatgcctggttactagctgttgcattctactttgcagcccggtttgggtttgacaaagaggccaggcggcgactcttaacatgataaataacttgcccacaatattt

SEQ ID NO: 34981 - DNA, 220 bp, Zea mays
  Clone ID: LIB3060-022-Q1-K1-B6
ttcccgtgcgcgctatcctgcgctcgcacttttacctgctcggcctaatcgtcccggttaccgctccctcagctcgcccgagctcctgccctgctcgccgtgctaaccgtctatgtcgtcaccggacttgtctcctcgaccatcttggcgttgatatttcctgctgctccatgacatcgtccagccattctcagttgctcgccgtcaaagctcccctgtt

SEQ ID NO: 34982 - DNA, 405 bp, Zea mays
  Clone ID: LIB3060-022-Q1-K1-B7
gcaaggaatcccccgatggctcatcgcgttctcctcctcctctctctcgcgtcggccgccggggttgccgccgccgtcgacgcggaggacccgctgatccggcaggtggttcccggtggagatgacaacgatctggagctgaacgcggagtcccacttcctgagcttcgtgcagcggttcggcaagtcctacaaggacgccgacgagcacgcgtaccggctgtccgttttcagggccaacctgccccgcgcgcccgggcacaatctgctgaacccttcggggaaccacgggtcactaaagttttcgaacttaacccgggaaaattcccgcggaactaacttgggcttcggaagttccggcgcgcttttcttaaaaaactcggggagttcgcccaagaagcccccg

SEQ ID NO: 34983 - DNA, 452 bp, Zea mays
  Clone ID: LIB3060-022-Q1-K1-B8
ctgagattgttcgttcgcctagagctccaacccattctttcaagaagccgattggtgctaaaaggcctggaaataagactggtggacttggtgcacggaagcttacatcaaagccaaatgaaagcctctatgagcagaagcccgaggaaccagctcccgtcctgccatcatcggtgattgagagtactacaactaggagcaaatcacatactttccgatttgattaccttgaaaatgcaactgctcttaaaaatgggaatagcttaaaaaggaaccacctgaatggaccttttgcaaccccaatggcgtcaaacttctttgctgaatttgggattgacagtggatattagaaaaaatctacgttcaagtcattcaaagtgcagatcgaggaaagcacggaagccagacagaaattcttaaaagcgaaatcaatttcttcctctcagattttt

SEQ ID NO: 34984 - DNA, 453 bp, Zea mays
  Clone ID: LIB3060-022-Q1-K1-B9
ccggattctcggtactcatgccgtaaacctctaaaagaatggtaatttacatcggcagaggttgaggcttctgatcaagtgcctcttaacagggttgaaattgattcatcggtcctatgggaggagggcttatttattctctacaaaggcatcaatctcttgtacttgaagaaccaaatattaggagcagaagatgaaaacgccggtcactgaagtaattacaaggacccactggaatgcattctctatttcgaaaactgatgtctcaaagttcatcccgaatatcccagcatccactccgaaaatggccacaacaaatgttgcggtcgttagcagcaattcaaactggatcagctggttccgcacattgtccagctgaatgttgatgaagtcttcagtgtcatcgatgtactctttaagcgatgtcagcttgttcagagtgctgtcgataac

SEQ ID NO: 34985 - DNA, 226 bp, Zea mays
  unsure at all n locations
  Clone ID: LIB3060-022-Q1-K1-C1
atttcgacttgcgtactcaatcaaggcaactttctcgaccactcaaatgctgccgacaaccgcggccngtgttcgcgccgccgtcgaccacggccggcccctgcttctgcccgagcgagccgcacgccatgctcatcctggctatgacctacatgcggctgcgctagctgatgtcctgcactcgcacgtgcagtggtatacgagaggccgtcacgacggacccgct

SEQ ID NO: 34986 - DNA, 337 bp, Zea mays
  Clone ID: LIB3060-022-Q1-K1-C11
gtccttctcctaagcaaagccccctcgcttttggcgtatgcccccgctggcgcgcccatgattgccgccgattcctccgcccgttcagtccagcaacccttgctgctgcagtgctgcggctagttcggtggcggggaaggaggaggaggcgagatcttggagtggggcgaagcggagatgtcgttgccgtcgaacaaccggaggacgtgctcccggagcagctctgcgcggtccaagcacagcgcgcgggtggtggcacagacgcccgtggacgcgcagctgcacgccgagttcgagggctcccagcgccacttcgactactcctcgtcggtgggcg

SEQ ID NO: 34987 - DNA, 275 bp, Zea mays
  Clone ID: LIB3060-022-Q1-K1-C12
gccccgcacttccgcccgagggccgtgcggtccgctatccgggcgcaggcgtccgccgtcgaggcgcccgccacggccaaggcgaagaaggagtccaagaagcaggaggagggcgtcgtcaccaacctatacaagcccaaggagccgtacgtcggcaggtgccttctcaacaccaagatcaccggcgacgacgcgccggtggagacgtggcacatggtcttcagcaccgaaggcatgatcccgtacagagaaggccagtccatcggcgtcatcgt

SEQ ID NO: 34988 - DNA, 387 bp, Zea mays
  Clone ID: LIB3060-022-Q1-K1-C3
gcttatgatgacagtcgtcaccgtctttctttcaacaatcagtttcaagatcagggttcagctgatcgcgttgcagatccatacttctatatgcctcaacaaccttctctgacggttgaatcaggcacaaggacgcaaacagcgaacaatgacttgcgtttttggagtgagcggaattcgatgtatggtaatccaagtgaccaacagcagggtttcagctttggggcaaacacatcaagttgggtgaaccagccactttcccaggttggacaggcacgaatggtcaaggcggattccaccggtggtccatttggtttaaaggagacttgagaaagccatgggttcaaaatatttggtttccaaggtgattccacccattcattaact

SEQ ID NO: 34989 - DNA, 217 bp, Zea mays
  Clone ID: LIB3060-022-Q1-K1-C4
gctcagcatccagtcagtcagtcctcgatcttctatcctctactgcctgcatcgattccatctgcgatcgattccattccatgcatcgaagctgcatcagggccatgacgatggcagctacgacgactatgatctcagcatcagcgcatgcgtcgacgtcgcagctgccgacggagttccggttccacccgaccgacgaggagctcatcctgcacta

SEQ ID NO: 34990 - DNA, 394 bp, Zea mays
  unsure at all n locations
  Clone ID: LIB3060-022-Q1-K1-C5
ccgagagcgggtttagttagaggctacgggcggtcgggcgcggcggcggcggcggccatgagcggcgggagcgagagcactaccgccagcaggtggcccgagctggccacgctgcgcgccctggcgcgcgacgccgcggagcagctgcggctgccgcgggccggcacgtcggcgtcggcgtcggcgtcgtcgtcgccgtggcgcgggcgcgaggaccacctncacggccacggcaagacggccaaggtgatgcacctgctgctctggggacccaagtgaagcggcgagaggcccaccgaccggccgcggtgctcggtttgctctggccggcaatcggcccggaaggactggactggaccggacctattcacctatatactacgacctgcacatg

SEQ ID NO: 34991 - DNA, 225 bp, Zea mays
  Clone ID: LIB3060-022-Q1-K1-C6
cacgagcgagcaagtccctaatccccatttctaaatctctaaccctagcgtactgagcttggcgtggcggcggcagtgtcccgggctcccagcggcacagtcgtgcggcgcgagcgcagcctctgtgcctaggctgcgcctgcacgtcggccggcggcacgcggtggctaataggctggaggcactgcccgagcggctgcccaccagtggtccagctcccactat

SEQ ID NO: 34992 - DNA, 321 bp, Zea mays
  Clone ID: LIB3060-022-Q1-K1-C8
ctatgatgttgtaaaggctcacaactccaacagcaaaattattggttttcttggaggaaccgagggattatttgcacagaaaactattgaaatcactgatgaagctcttccatcctataaaaatcaaggtggttatgacatgcttggtcgtacaagggatcagatcaaaacaactgaaccggtaaagggcaccataaggtcatggtaagcattggaattggacccttctggtattaatggaagggttaaattcaacaacggttcctgttaacttggttaaacctttgcttaattgaaatggtcaaccaaaggtagtggtgg

SEQ ID NO: 34993 - DNA, 292 bp, Zea mays
  Clone ID: LIB3060-022-Q1-K1-D10
acagcaatccacacaagcacttcgacgtcgtacgggcgctgcacacagacacaccaagcgtcggcgccaatggcttactaccaggaggtggactactgctcggaggaggtgaggtcggtggccccggccggcttcggccgccacggaggcggcgtccagcagcacgtcgtcaaggagaagttcgaggaggtcgacacggtctcacgcgccggcgccaaccaccaccaccaccaccatggtcaccacggcggacacggcttcgtggtgcgcgagaccagggtcggaggggaca

SEQ ID NO: 34994 - DNA, 299 bp, Zea mays
  Clone ID: LIB3060-022-Q1-K1-D11
cccccatctcttcgactcctttctggagcagctagggttccgtcctcgatccgatccgccgagggcacaccacctttccccactccgatcgaatcgatggccgccgagggcgagaagaagatgataaccctcaaaagctccgatggcgaggagttcgaggtggaagaggcggtggcgatggagtcgcagaccatccgccacatgatcgaggatgactgcgccgacaacggcatccctcttcctaacgtcaactccaagatcctatccaaggtaatcgagtactgcaacatgcacgtaca

SEQ ID NO: 34995 - DNA, 233 bp, Zea mays
  Clone ID: LIB3060-022-Q1-K1-D12
gtgaaatggcagaaggagctctttccaggcatagagattgacactagccagcctccgattgttgtcaagactcagttgtacacactaactggtgtgccacctgaacgccaaaaaattatggtgaagggaggaatattgaaggacgatgcagattggtctactttgggagtgaaagatggccaaaagttgatgatgataggcacggctgatgagattgtgaaagctccggagaa

SEQ ID NO: 34996 - DNA, 255 bp, Zea mays
  Clone ID: LIB3060-021-Q1-K1-H12
cgctagtcagttataagtagctagggcatctggctgctggaaaatcaagcacgcatccaccaggcacacagctagctagcagatcgtttcgagtgaagatccaaagaggtagagagatggaaaggatgagttcgtcgctgcagtactgggtggaggagcacaagctctcaaccatcggagccgtgtgggcgacagcggtgggcgcgtctgtggcgtacagcccgcggcaggcgccggcgcaggcgaccggcatgc

SEQ ID NO: 34997 - DNA, 157 bp, Zea mays
  Clone ID: LIB3060-021-Q1-K1-H2
tccaacttctagggctagtcacgcttccttggggcatcgatggcatgcgtcagcaccttgcagagctgccccattgccagaacagcacagatcaacaccagacccatgggcagcaaaagcagcctggcgaaagggtcaccaccaccaaccttacagt

SEQ ID NO: 34998 - DNA, 367 bp, Zea mays
  unsure at all n locations
  Clone ID: LIB3060-021-Q1-K1-H6
ctgcaagctaaggagagtgtgatcaccaacatctagtgctagtcccccttccttccagccatcgatggcatgcgtcagcaccttccagagctgccccattgccagaagagcaaagatcaacaccaggtccaggggcagcagcagtagcgtggcgaaggggtcaccaccaccagccttccagttccagtgcagggcgtcgactttcgcggcggacaaccacctncggctcgagctggacgagaaccccgaagcgatcatctcgggggccttgcccgggaactgctcccttcttagctacgacgaccttcgggcctacctcgagtcgcaagagacggcggcccaagcagacgatcagcgcggcgtggcg

SEQ ID NO: 34999 - DNA, 151 bp, Zea mays
  Clone ID: LIB3060-022-Q1-K1-A1
aaacgctgtaatggaccatggcctaactcattgccaaccctcttgttatttacaagctccaaggccagatttctctagttttcatctcctatcatactaccattgcttaacctgacctgaacaaaattgaataccttatggcagtgttcaa

SEQ ID NO: 35000 - DNA, 415 bp, Zea mays
  Clone ID: LIB3060-022-Q1-K1-A11
ccatacatggacagctataacatcacaaacgcgctagatctcaaaaggggcacggaggatcaggatgggaagaccataaaacttcaaataacgtgttacacgcctgtttatgatcgtcttcacttataatcatttctctgctactaccgcggagctcatggaatcattactgtatatgacgtgacagaccaagaaagcttcaataatgtgaagcaatggttgaacgagatagaccgttatgcaagtgataatgttaacaagctccttgtagggaacaagagtgaccttactgccaacaaagttgtggcaactgagacagcaaaagcgttagctgatgagatgggcatcccaatcatggagacgagtgccaaaaacgccaacaacgtggagcaagccctcatggctatggctgcat

SEQ ID NO: 35001 - DNA, 245 bp, Zea mays
  unsure at all n locations
  Clone ID: LIB3060-022-Q1-K1-A12
cgacggccgccccgactggctggcgcaggacctcaaccagggccacgtcgacctctagtacctgctcatagccgccatggcggcggtcaacctagtctacttcgtcgcctgcgcgcgctggtacaggttcaagaacccggccgtcgccgacgtcgagcagctggagctggagttagagggaaaggccgcagcgcctnctgtctgaatactgaagagctattttcttttcttcctcctcatcaatc

SEQ ID NO: 35002 - DNA, 258 bp, Zea mays
  Clone ID: LIB3060-022-Q1-K1-A2
cccgcgtccctgctcctgcctcctatgggcctttgatccggggcttcgtggatcttgggaagaggaggtgcggtgggcgcctcggcggcgatctggcggggaggatatggccagcgggaaggagccgatcgaggtcaggtttcgtctcttcgacggcacggatatcgggcctacgaagtacgatccctccaccacggtctcctcgctcaaggagttcatcctcgctcggtggccgcaggataaggatatagctccaaa

SEQ ID NO: 35003 - DNA, 184 bp, Zea mays
  Clone ID: LIB3060-022-Q1-K1-A4
cccacacagaagcggcggcggcggagcaaacgcaggctaaggcgagggtgtgagggaaggagcggcagcggtggtgcacgtcaacttctaccgcaactatggtaagacgttcaagaaaccaaggcgtccttatgagaaggagcgtctcgatgctgaactgaagctggttggtgagtatgggctg

SEQ ID NO: 35004 - DNA, 336 bp, Zea mays
  Clone ID: LIB3060-022-Q1-K1-A5
ctcacagacgatcgcatcaaagctaccgtcaaggacatgatagcggctgcaactgaaacatcggcccaaacgctggaatggaccatggccgaactcattgccaacccgcgggtgatgagcaagctccaaggcgagatagcgcgagtcgtcagcgccgatcagacgaccatcgctgaaccggacctgaacaaaatggagtacctgagggcagtgttcaaagaggtgcttcggctccacccaccagcgccgctcctcgtcccgcacgaatcaacaacgcccgcagttgtgcagggctacgagatccccggcaaaacggctctctttgtcaacgtgtgg

SEQ ID NO: 35005 - DNA, 268 bp, Zea mays
  Clone ID: LIB3060-022-Q1-K1-A7
cggacgcgtgggcgacgtgcggcgtgcggtgcatcctgacggacgaggaggcggcgctggtcgggggacggaaccacagccacgcgacgcaggacctgtacgactccatcgcggcggggagcttcccggagtggacgctgtacgtgcaggtgatggacccggacacggaggagcagtacgacttcgacccgctggacgacaccaagacgtggccggaggacctgctgccgctccgccccgtggggaggctggtgctggacaggaacgt

SEQ ID NO: 35006 - DNA, 455 bp, Zea mays
  Clone ID: LIB3060-022-Q1-K1-B1
ggctttcaagcttcagaaatggtttcttctcagccatcctctctgactgcaatcctcgcacagggccccggccactgcccagtcaagatactcctcccaatggggcccccagatgtcgtctcctcagataatgttgagtacgatttctctgatgtttttggttccaccccggtccaaacaccaacaaacctttgtggttttggtccggagagtcctgcacctactgttgagtccaatgaagaattttacagtgatcctgttgtcatcatcaaccgatcccattctctggtcggtccaacatcacttgtcagtcgctccttgcaactaagcaagccttaatcttgaaaaaaccagggatccttcggacttggcaaaggcctttcaaaaaaaaaaggaagggacccaaggcaacttaatggttaagaatctggttatgcttttaccagggaatgggg

SEQ ID NO: 35007 - DNA, 458 bp, Zea mays
  Clone ID: LIB3060-021-Q1-K1-F5
ggaagatcatgtgcaagaaaatgctggtgcatgaagcttgaatggatgtgacaaaagaaaaaatgaagatgggacagtgattgaaagtgaaactgcgaaagatgatgccagaacatatggagttaatttgtcagaatcagatgctgcagttcgtattcagtctgcctacagagggtatgatgttcgaaaatggcaacctttggataaactctggaagatcaagcatgtgcatgaacagatgcaagttgtgaggaagcagattcaatgccttttagattcttgcagtaagccaacacaaaaagagcaagtggccataggtgaaactattatgaatttactcctgaagcttgacgcaatccagggcttgcatccaagtgtaagggaagctaggaagtctgttgctcgagaactgatttgcttgcaggagaagcttgatactttatgcaaagcagcatctg

SEQ ID NO: 35008 - DNA, 460 bp, Zea mays
  Clone ID: LIB3060-021-Q1-K1-F7
aaaacgccgcaggccagtctgcgagttggatggccttcttcttggccctcgtgtgcatcctcagcttgctagccatcgcctcctacgtccagtacactcgctggcaaaaggggaaaggccgcttcggcggccatgggaggtctgctcccttgaagctgcctcctggctccatgggctggccttaccttggcgagaccctccagctttactcccaggaccccagcttcttcttcgcttccaaacagaagaggtacggcgagatcttcaagacgcaccttctgggttgcccgtgcgtgatgctggcgagcccggaggcggcgcggttcgtgctggtgacgcatgcgcacctgttcaagccgacctacccgcggagcaaggagcgcatgatcgggccgtcggctctcttcttccaccagggcgactaccacctccgcctccgcaagctcgtccagggcgcgct

SEQ ID NO: 35009 - DNA, 381 bp, Zea mays
  Clone ID: LIB3060-021-Q1-K1-G1
ctcacaacccagtcgctcaaaaccctagagctctcgcctgctcgccttcgccgccggagcgagcgccccatcttcatccgtcaaccatggcgacccagatcagcaagaagaagaagttcgtcagcgacggtgttttctacgccgagctcaatgagatgctgacgcgggagctggcggaggatggctactctggcgtggaggtgcgcgtcacgccgatgcgcacggagatcatcatccgcgccacgcgcacgcagaacgtgctcggcgagaagggccgcaggatcagggagcttacctccgtcgtccagaagaggttcaacttccctgagaatggcgtcgagctttacgccgagaaggtcgtcaaccgtgggctctgtgcca

SEQ ID NO: 35010 - DNA, 444 bp, Zea mays
  Clone ID: LIB3060-021-Q1-K1-G11
agaagacgagtgtcaagtgaacctgaaacttgcggtgtcactggctggtagcctgagtgtgagggagtgatcgagctagctgagctccgatcctcgctagctaggataccgccataccacaagtcttcttcacaagtttaggagtgacagcaacaagagatcgatggcctctgccaccgtgctcaagtcctccttccttcccaagaagtccgaatggggcgccaccaggcaggccgtcgcgcccaggccgtccaccgtctccatggtcgtccgcgccttcgcctacgccgatgagctcgtgaagaccgcgaaaacgatcgcgtcgccggggcggggcatcctggcgatggacgagtcgaacgcgacgtgcgggaagcggctggcgtccatcgggctggagaacacggaggccaaccggcaggcgtaccgcacgctgctggtcac

SEQ ID NO: 35011 - DNA, 447 bp, Zea mays
  Clone ID: LIB3060-021-Q1-K1-G12
accgaaatccaaattgaaacagttgcaggcgattctgagctcgggttttgttccggggacggattcctgtgccggctgactggatgtcaagccctctcgaccgatttgctaggccatgctttgaagggtttgtacataacgatgaaaggaaagagagcagatctgatgcagacaactcataatgagataagaagactaagattgggtctttcaagaaaaaagcaattaatgcggggaacaaattcaagcattccttgaaaagggggagccaaaaaaagtaccaaaagggggatttccatcagggacataaggaacgtaaaggagcttcaagatgttgagacattgcgacattgcttaattgatgaggatttgctgaaaccacagcacgatgattatcacatgatgttaaggttcctaaaagcacggaaatttgaagttgagaaagct

SEQ ID NO: 35012 - DNA, 439 bp, Zea mays
  Clone ID: LIB3060-021-Q1-K1-G4
tccaaggagcctatcgctcgagcctaacagaggtcttatgaagcagattattctacaatctgattcaacacatctactgagaaagagaggtattgctgatacaattcgtaactgttgctttgaggctgatactcagcttctgagtttgctttctttagcagaatatctctggccagctctacttttgcctgtaaccggaaagaagatctatagtgaagaatacagatcaaatatgccactttagctatccagtgcactctctcatgaacgggaagttgttgaagattctgaaattcatcagcaagcattacaagctatttatatgatcgtattgcatgatggttgtcgaaggtccttttggtcaattaatggcccactaattctgcaagttggttatgaagatgaaaaggacccgaaagtgatggaagcatatgaactc

SEQ ID NO: 35013 - DNA, 363 bp, Zea mays
  Clone ID: LIB3060-021-Q1-K1-G5
tccaaattgaaacaatttcaagcttttctgagctcggcttttgttcctaagactgagtcctattccagctgacgggatgtcaagccctattgaccgatatactaggccatgctatgaagggtttatacataactatgaaaggaaagatagcaaatcttatgcagacaactcataaagagataataagactaagattagctctttcaagaaaaaagcaattaatgcgacgaacaaattaaggcattcattgagaaggagaagcaaaacaaataccgaaaggcgggattacatcaatgacataatggacattaaagagcttcaagatcttaaacattccgaaatgcttaattgatgaaaatttgc

SEQ ID NO: 35014 - DNA, 415 bp, Zea mays
  Clone ID: LIB3060-021-Q1-K1-G7
gtctggacgagcacgcgcatccgtcgcaagctcatgctcgttccgcactgcctcagggactcaggagaagctcacctaggcatgcggcataacagaagcgctcatcctcaggccggcatgcgtctaacgtgaagaactacgattctgctctgaaaggcattgaaggtcttcattctgatggctacgagagggttcagcactagagccgcaagaaattctacatgcactgtaaaaatgataatcaggtggtaagcatcgtgtttactgttcgggttttggatcatcacgacatgaaatgctagaacgaggatctgatcacggactgtgcacgtacacgtggtgctttaagcatgtgtaacaaacggtactatctgacgcgcttcatgcctagctatcataacatcgtgaaggtgta

SEQ ID NO: 35015 - DNA, 459 bp, Zea mays
  unsure at all n locations
  Clone ID: LIB3060-021-Q1-K1-G8
gcagcattctcccttccaaatgccgtcctccccgtggcctcccgctgccggagcgccgcctccgcagcagcgagcggcgcatggcacggtctccaccgtggcgcctgagcgtctacccgtcgagggttcccgatctgggccagcgaaggaggaggacacggctcggcttccgtctgccgactactactcagagctaaagaccctggagcatgccgagaaaaccaaaaaatatcagggtaagcttgcagcacggttgaaggccaaatatttttccaacaagacttttgaagaaggatatgtgtttgaagaaattgttatagaatcaaagaccgtccggctaagcaggtggccgtttacaaggttgtttgcagatccagcaagactttgccgaganaagagctctaatgagaagggcatttctncacctctggctggtgaagccatgtcagatgactaacc

SEQ ID NO: 35016 - DNA, 221 bp, Zea mays
  Clone ID: LIB3060-021-Q1-K1-G9
gcctgaccagctaggatcagcggaagcagcaatggtgatggcgtcgtcgagcgggctgaggagctgcagcgccgtgggcgtgcccagcctgctggctccgtcgtcccggtccggccgcctggcgccgttctgcgccaacgccaccacctctggccgcgtcaccatgtccgcggagtggatgcccggccagccacgccctgcccacctcgacggctcctctc

SEQ ID NO: 35017 - DNA, 369 bp, Zea mays
  Clone ID: LIB3060-021-Q1-K1-H1
cccccgtctcgtactgctcccgactaccaccttaaagataaaaaaacttcaaaggaggtttcgggcgcaagaccgcccatggcccggcccgcatgtgcatggcagtgagcttactggccaatgaggtgtcggacctgagcatcggctagccggccgtgaggtcgctcccgatctccgtcgtcgccggcgaccttgccgacgcgctcctgatggtggcccgctctggcgcaccatcctgcgtcgcggtgactggaccagcgcgcgccgtcttcggacgggtcggcctagcagacgtgctctgcttcctgtgcacctacccctaagcgctcgtgcgcacctgcgtcatgttctacaagccggtctacgtgc

SEQ ID NO: 35018 - DNA, 334 bp, Zea mays
  Clone ID: LIB3060-021-Q1-K1-F3
tagacgcgagctcgacgagctctgcctctgcccatggacactccgtgccctgctacctctgtctttcctggcgcgcgctggtcgttcctaccaatttccttggcctcgctcggtacttctctggtcgtgcttactcccgctatgtgctcaagcacgcccgccgtcatatcttcaccgtcctgcttcatagcgcgcccttccactttctgctcgctcgcgcacaggtcaaaaccccctggtggtcgcgcgttttcttacaaacagaccactaattccgcgagctcccttcctaacggtccctggctccagctcgggcggccctgttccccatggt

SEQ ID NO: 35019 - DNA, 444 bp, Zea mays
  Clone ID: LIB3060-021-Q1-K1-E10
gcgatgagcgcctctcgcgacgccagggcggagagctagccggccgggagcccacacgcagctggaagcaccagaccgatcgtgccggccgagcggcggcgcaggcgcaggcgcttacatgggagtagaggcgggcgggtgcgggcggagggcggtcgtcaccgggttctacgtctggggctgggagttcctcaccgccctccttctcttctcggccgccgtcgccgccgcagactcctactagcaagctaccaaccttctttctttcattcccttaggtagctcagccgtacacacaacaacacacaagtcatcagttactagctagttagtagcctatacaacacatacatacatacaaaggtgagtgaggttcgcgtgcaagcagagccaatcgtgccgatcgagctatatacatagccggcggcgagggatgggaagagc

SEQ ID NO: 35020 - DNA, 405 bp, Zea mays
  Clone ID: LIB3060-021-Q1-K1-E11
caagagcaaaccattgttggacgcgttcccttcctgcacgcaacctcatctcgtcctgcagatgctggatggccgtcctccttgataccttgcctcgcgagtgctctcggtgagctactttgttttgatttatcaggaaatccgtttgcttcatgttatgcaggctcagatctgattgctggattcggcatcttacgggcttgaatagagctaggactgggagaaaacaacaaacccgcgttggatcctgtatcggttagtccttgccttcaaggttcatgttgttttgttctggtggtcgagcatcgcatgttctgcttctggttccagatctggagaaatttctaagtcgtcgtcgtcgtcgtcgttcggttcggaacggatctgaggcgacgatggcttgaa

SEQ ID NO: 35021 - DNA, 405 bp, Zea mays
  Clone ID: LIB3060-021-Q1-K1-E2
cccaacagcgccactgtccagtgcgcgcgtcaagcttgcttagctagccgccatggccttcctggccgccgtctccgtgaagcccgtggccatcaaaggtctcgccggcagctccatctccggaaggaagctcgccgtcgccaggccgtcggcccgctccatccgcaggccccgcgcagccgccgtggtggccaagtacggcgacaagagcgtctactttgacctcgacgacatcggcaacaccaccggacagtgggacctctacggctctgacgcgccctcgccctacaacccgctacagagcaagttcttcgagacgttcgcggctccgttcaccaagagaggtctgctgctcaagttcctgctgctgggcggcggctcacttctggcctacgtcagcgcgtc

SEQ ID NO: 35022 - DNA, 449 bp, Zea mays
  Clone ID: LIB3060-021-Q1-K1-E3
ctgcctgaccagctaggatcagcggaagcagcaatggtgatggcgtcgtcgagcgggctgaggagctgcagcgccgtgggcgtgcccagcctgctggcgccgtcgtcccggtccggccgcctggcgccgttctgcgccaacgccaccacctctggccgcgtcaccatgtccgcggagtggatgcccggccagccacgccctgcccacctcgacggctcctctcccggggacttcggcttcgatccgctgggcctcgcgaccgtgccggagaacttcgagcggttcaaggagtcagaggtgtaccactgccgctgggccatgcttgccgtccccgggatcctggtgccggaagctctgggcctgggcaactgggtgaaggcgcatgagtgggcggccgtccccggcgggcaggccacgtacctgggcgccccggtgccgtggggcacgct

SEQ ID NO: 35023 - DNA, 456 bp, Zea mays
  Clone ID: LIB3060-021-Q1-K1-E5
ccggggacttcggcttcgatccgctgggcctcgcgaccgtgccggagaacttcgagcggttcagggagtcagaggtgtaccactgccgctgggccatgcttgccgtccccgggatcctggtgccggaagctctgggcctgggcaactgggtgaaggcgcaggagtgggcggccgtccccggcgggcaggccacgtacctgggcgccccggtgccgtggggcacgctgccgaccatcctggtgatcgagttcgtggccatcgccttcgccgagcaccagcgcaccatggagaaggaccccgagaagaagaagtaccccggcggcgccttcgacccgctcggcttctccaaggaccccgccaagttcgaggagtacaagctcaaggagatcaagaacggccgcctcgccatgctggccttcgtcggcttctgcgtccagcagtcggcgtaccccggca

SEQ ID NO: 35024 - DNA, 344 bp, Zea mays
  Clone ID: LIB3060-021-Q1-K1-E6
gaatccacgcatcgacccacttcttgcgccaatgacttccgctactatccattatacctttcaaccgtacctcagaacttctagcgcttcagttactcacacctgtaccactgccactcttccatgcttgcccaccccggcatccaggagcctgaagctctggcccttgtcaactccatgaaggcacatgactggacagtcgttcccggcggacaagccacgtacctatgcacacctgtgccgcgtatcactcttccgaccatactgctgatcgacttcgtgtccataaccttcccccagcaccaactcaccatggagaaagacccccataagaagaactaccc

SEQ ID NO: 35025 - DNA, 454 bp, Zea mays
  Clone ID: LIB3060-021-Q1-K1-E7
gagctgttttagcaacctgagatcccgggaggatccggcccaatccctaccggtgatttcgccgcacggtgatttcgctgagcacgagcactccctcgcacctgcgtgctcagtgaagcaccggagcttcctcgcgcacggctgcctcctcttcttcgcgcaagcaccggatcttcctcctcttctttatgcaaggcattagatctcccttctcttctcttctctggagagctttttctggagcttgggcgtgaggatcctgcaggccggtggcgtggagcgcgcgttccggcgcgccttgtcagccgagaaagtcgagctggtgaagtccctccactctacaccaccggcgggcccatagcacggcagcctcagcccccgcgcggtgagctaatctattgtcggcatggatgtagtcactccacttcagaaaagagtcagttgcatggctcct

SEQ ID NO: 35026 - DNA, 423 bp, Zea mays
  Clone ID: LIB3060-021-Q1-K1-E8
tttatcaacctgagattccaggtttatccttcccaatccctaccgttgagttctccgcactattattactctgagcacgatcactccctcgcacctgcatgctcagtgaatcaccggatcttcctctctcactgctgcctcctcttcttcgctcaagcacctgatcttcctcctcttctttatgcaaggcattagatctcccttctcttctcttctctggagaactttttctggagcttgtgcgtgaggatcctgcatgccgttggcgtgtagctcgcgttccaactctccttgtcaacctagaaagtcgagctggtgaagtccctccactctacaccaccggcggtcccatagcacggcagcctcatccccccctcggttagctaatctattgtccgcatggatgtagtcactccacttcat

SEQ ID NO: 35027 - DNA, 457 bp, Zea mays
  Clone ID: LIB3060-021-Q1-K1-F1
caacgctctatctctttcgccgagctcctcgttaccctatgagcgtgcttgaccgtcggcggcgaggtgatggcgatggaccctgacgcggtagcgaaggccttcgtggagcattactaccgaacgttcgacaccaaccgcgcggcgctggttgggctgtaccaggagacctccatgctcaccttcgagggccagaagttccagggcccctccgccattgcctgcaagctcggatctctccctttccaggcctgcgagcatcagatcgtcaccgtagactgccagccatcgggtccccagggaggcatgctcgtcttcgtctccggttccatacgcaccggccccgatgagcaccccatcaagttctcccaggcattccatttgctgccggccgattggtccttattcgtgcagaatgacatgttccgcctgaactatggctaaagacacccgatac

SEQ ID NO: 35028 - DNA, 414 bp, Zea mays
  Clone ID: LIB3060-021-Q1-K1-F10
gttgacaagaagtcagatttcaaactggttcatcaatgcccgtgtccggctgtggaagccaatgatcgaagacatgtacaaagaagagattggtgaggcggagctagactccaactcttcctccgacatcgggcagcgaaacaaggacaaagcaccatctcccgaagaaaatgaggacctgcagaccccaacaagccaggcttgccaaaccagccagctcggccagtctaaagccatcgttggtggagtgatgggctttagtggagtgctagccggcggcttccacaccgaggccaaccccgacgacagcttcatgagcctgatgctaaaggcccagagacctggtgaaaccgaaggcaccggtctactccacgatgccgtcgctcaccactcggacgacggcgcccggttcat

SEQ ID NO: 35029 - DNA, 440 bp, Zea mays
  Clone ID: LIB3060-021-Q1-K1-F11
acagcagctccgctcgtcgatcagctctcggctgaccactcatcgccagtgggtgcctgccgagcaggtctcgccgtcgccaccgccgcggtagagaggggagggagagggggaaaaaactggcccagatcgagaggtacagcacgaaaaagagaggcatgagagataggggaccggagggcggcgggccggggcccaagaccgaggggctcgtgcgcaggaagctgatgaagctcctgtcgctcgtccccttcggctgccgtgctggacccatcgacgactcgccgccgtccgtggaccacgccgccgccgcgaggaggcgccggaagaagaaggccaacatggccgtccagctgctgggggctgctgcaggtgcgccgcagcagtggcgcccctcgctcggcgacatctgcgaggagtacagcagcagcaccgacgcc

SEQ ID NO: 35030 - DNA, 445 bp, Zea mays
  Clone ID: LIB3060-021-Q1-K1-F12
atttatgaacaaggacttgtgcttcaacaacttaaatgttgtggggttcttgaggttgtccggatttcaagatctgggtatccaacaagaatgactcaccagaagtttgctcggcggtatggttttcttcttgaggatgttgcatctcaagatccactcagtgtttcagttgcaattcttcatcagttcaacattttacctgagatgtatcaagttggctacacaaagttgttcttccgaactggtcagattggcaaccttgaagatactcggaatcgtactctgcatggtattttaagggttcaaagctgtttcagggggcatcaagcccgtcatcatgcaagagaacgaacaagaggagttttgactcttcaatcattcattcgtggtgagaatgcacggcaaatttactcctctttgttgaggaaacatagagccgcagttg

SEQ ID NO: 35031 - DNA, 448 bp, Zea mays
  Clone ID: LIB3060-021-Q1-K1-D9
ctctaaggcatcaggggaggagctgaagaaatattcaggccaaactgatgcagagttatggatgataccaacatatgagaactcagcttggccaatcatggcaatttcattcgtatcactgcttgctatgtctgctatcctagttgcatgtttctttgcgaggagacaccagatcagacgggacagggcaagacttccccgagctcaggagtcccatggaatgagcagtcaattagttaaggcaataccaagccttattttcacaaaagtgcaagaagacaactgtacatcagcaacatgcgccatttgctgggaagactacagtgttggagaaaagataagagtgctaccttgtcgacacaagttccatgcggcttgtgtggacctatggctcacctcatggagaacattctgccctgtatgcaagcgggacgcaagtgctggaacg

SEQ ID NO: 35032 - DNA, 440 bp, Zea mays
  Clone ID: LIB3060-021-Q1-K1-C12
gccatgcccgtgcagtctactccatttttgttcccctctccggtggcggcctatcgggggtggggtcttcctcgcgtcgcctcccctcgctctcatccggtcatcagtttgaggtttcgacctatttcaccagagctgatgggactcatggatgggaacaaagatgaggccttgagatctgtcaagcttgcaaaatctgcatttgcatctggggataggcagcgcgcagaaaaattaattaaaattgctcaaagattggaccctggtcttccacttgatgatttgctgagcccagttgaaaaagttggcatcctgaatatttctacttgcaaagacaagactgaaagaagacaagctcttttatacccaaaaacaacataagaatctgttggtcctttaaatgttgataaggcttacactgaagagaatattaaagtggt

SEQ ID NO: 35033 - DNA, 196 bp, Zea mays
  Clone ID: LIB3060-021-Q1-K1-C3
gcagcgtctggacccccgtccgccgttgcctatcccgcttccttaggtccgaagccacttatcgccgctggggaaaattccaaccggccgcttgtccatgaagaaggtccgatccttgaaccccgcgatgtaaccgccggtccagcttcctgaccagcccctacgcccgtgatagcagcgccccccgcttcgcaag

SEQ ID NO: 35034 - DNA, 395 bp, Zea mays
  Clone ID: LIB3060-021-Q1-K1-C4
tcgccggtgtctattcctgctgcttcagctcgtaagcagctgtccgccgttgatgagaatcccaaccggccgcttgtcatggaggaagtccgcatctcgaatctcgacgaggaaccttccgctccagctcccgcaccagcccctacgcccgtgatagcagctcccttcgctgcgcatgccgcggcggttgaccatctcgccctctgctccactggtcggatcgggccgcatgcgcccgtcgatattcctactaataagatactgtcgctacccgatgcatctccagccaacgcgcccgtgttcgctcgccgggtgttttctgccgctgtgcccgccatggtgcctactaagaagactgctactgtcccctgcccatctttagccaaagcccccgt

SEQ ID NO: 35035 - DNA, 341 bp, Zea mays
  Clone ID: LIB3060-021-Q1-K1-C7
gtagggcaaggttgaggatgttgatgagaaggaagaaaaggacaagaagaagaagaagatcaaggaggtttctcatgagtggcaattggttaacaagcagaagcctatctggatgagaaagcctgacgagattaccaaagaagagtatgctgctttctacaagagcttgaccaactactgggaggagcatctcgccgttaagcacttctctgctgagggtcagcttgagttcaaggctgtcctgtttgtgccgaagagggccccctttgacctcttcgacaccaggaagaaactgaacaacatcaagctctatgttcgccgtgtcttcatcatggacaact

SEQ ID NO: 35036 - DNA, 451 bp, Zea mays
  Clone ID: LIB3060-021-Q1-K1-C9
ctttcgtcaactccacttctcttctccgcgtcacctcctcttcgccgccgccgacgctgcacggggcagccagccatggatgaggagtacgacgtgatcgtactaggcacggggctcaaggagtgcatcctcagcggtctcctctctgtagacggcctcaaggttttgcatatggacagaaatgactactatggaggagattccacctcactcaaccttaatcagctctggaagaggtttagaggggaagacaagcccccagcacatctaggtgcaagcagagactacaatgtggacatggtgccaaagtttatgatggcaaatgggacattggttcgaaccctcattcacaccgacgtgacaaagtacttgtcattcaaagctgttgatgggagctatgttttcagcaaagggaagatttacaaggtccctgccactgatatggaagctc

SEQ ID NO: 35037 - DNA, 405 bp, Zea mays
  Clone ID: LIB3060-021-Q1-K1-D10
cacgccgctcggaatcggagcttgcatccgaccgcgagcaagcggaccaaatcctccgccatggtctatcgcgtgcacgcatctggccgcctcgaccctcggcggcggcggcggcgacggcgacgacgacgatggggctggagatggaggcgatggcggggtcgatcggcgtgtcggtgcccgtgctccggttcctgctctgtttcgcggccaccatcccgactggcctcctgtggcgcgcggtgcccggcgccatggggcgccacctctacgcggggctcactggtgccacgctctcctacctctccttcggggccacctccaacctcctcttcgtcgtgcccatgacgctcggttaccttgccatgctcctgttccgccgacacgccgggctcatcaccttcc

SEQ ID NO: 35038 - DNA, 236 bp, Zea mays
  Clone ID: LIB3060-021-Q1-K1-D11
cacgcggctcggaatcggagcttgcatccgttcgcgagcaagcggtccaaatcctccgccatagtctatcgcgtgcactcatctggccgcctcgaccctcggcggcggcggcggcgacggcgacgacgactatggggctggagatggaggcgatggcggagtcgatcggcgtgtcggtgcccgtgctccggttcctgctctgtttcgcggccaccatcccgacaggccttctgtgg

SEQ ID NO: 35039 - DNA, 441 bp, Zea mays
  Clone ID: LIB3060-021-Q1-K1-D12
ctggagcactctcatagccaataaaaatacagagctgcagcgcctggttggcatttacaggaatattttaaacaatgcaggagtcactctgatcgaaggtcgtggaaagatagtcgatcctcatactgtcagtgtgaatggtaagctctacactgctaagcacatactagttagtgttggtggccgaccatcgatgccagatatccctggtatagagcatgtcatagattcggatgctgcgctggatttgccttcaaaacctgagaaaattgcaatagtgggaggtgggtatattgctttggagtttgctggctttttcaagggctaaaaaagtgaagtccatgtgtttattcgtcaaaggaaagttttaagaggatttgatgaagaggttagagattttgtcgctgaacaaatgtctttaaggggcatcacgtttcatac

SEQ ID NO: 35040 - DNA, 444 bp, Zea mays
  Clone ID: LIB3060-021-Q1-K1-D7
gttggcttctcctccccctccggttcgggttcgggttcgtgaggttctccggggttgggtttggtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaagaagcgatgcggaacgccatcgagggcatgaacggcaaggagctggacggccgcaacatcaccgtcaacgaggcccagtcccgcggcggccgtggaggcggctgcggcggcgggtacggtggtggccgtggaggctgcggctacggcggttgcgggcgccgtgatggcggcggctgctacggcggt

SEQ ID NO: 35041 - DNA, 444 bp, Zea mays
  Clone ID: LIB3060-021-Q1-K1-C11
gccatacccgtgcagtctactccatttttgttcccctctccggtggcggcctagcgggggtggggtcttcctcgcgtcgcctcccctcgctctcatccggtcatcagtttgaggtttcgacctatttcaccagagctgatgggactcatggatgggaacaaagatgaggccttgagatctgtcaagcttgcaaaatctgcatttgcatctggggataggcagcgcgcagaaaaattaattaaaattgctcaaagattggaccctggtcttccacttgatgattggctgaccccagttgaaaaggttggcttcctgaatatttctactggcaaggccaggactgaaggaggccaggctctttattccccaaaaccaccaaaggattctgtgggtccttaaaaggtggataaggcttacactgaggagatttttaaagtggtccag

SEQ ID NO: 35042 - DNA, 310 bp, Zea mays
  Clone ID: LIB3060-021-Q1-K1-A6
gagtccacgcatccgtccattcatctgttacgcggcccgtctcgacgcattttcctttctatctgagccaatttctctttccgggtgatgtcgaactccctaacgtggatcgtgaccaactatcgagcatatgctcctgttgctagcttggattctgacttataggcgttcaatcataatccggcacacggtagcttcgctccactgtcttttcaaccaagctcgatgaccaattgtgtgaatcaacagttcctctcttactatgttgaattactaatcgcgcacagtcatcaataaggtaaaactaacc

SEQ ID NO: 35043 - DNA, 442 bp, Zea mays
  Clone ID: LIB3060-021-Q1-K1-A7
ggtgtatcttcgcccccggcgaaggcgctatcctcccgaccacccggcggtgccggtactccggtaaggcaggttgccagaccccgcgaccccgatcccgatcggtcgctggcgaggcggcgtgacctaccccggctcatcctctcaagccagacggtctggctgctgtgcatccccgttttggcggctaccttacctctggcaaggcaatcccccctcacccctggcaagcacgggagaacatggagagtgcttcagatgtacaaatgcaacatcgtgctgaagattccgagactacaattgagatcaaaatcaagacattggattcccagacatacaatttgcgtgtgaataaatgtgtgccaattcctctgttgaaagagaaaattgctactgtaactggaatattgtctgaacagcaacgcttgatttgtcgtgggag

SEQ ID NO: 35044 - DNA, 356 bp, Zea mays
  Clone ID: LIB3060-021-Q1-K1-A8
ggaacgcacacaccgcccgtccccgatctccgatcccctcgtcgatccaaagatgcagatctggtcaagaccctcactggaaagactatcaccctcgaggtggagtcttctgacaccattgacaacgtcaaggccaagatccaggacaaggagggcattccctcggaccagcagcggctcatctttgctggcaagcagctcgaggacggtcgcacacttgccgactacaacatccagaaggagagcaccctccaccttgttctccgactcacgggaggcatgcagatcttcgtcaagaccctgactggaaagactatcaccctagaggtggagtcttctgacaccatcgacaacgt

SEQ ID NO: 35045 - DNA, 182 bp, Zea mays
  Clone ID: LIB3060-021-Q1-K1-A9
ccggccctgcgccttgctctcaggctcggctcgtggctcccactcccggagcgcagggggtcggttccgttccctgccggctttaaccccgaaaatccggccgacgctggacaaggtcgtaggctccagcaaggtggtgctgttcatgaagggcaccagggacttcccgaattgcggttttt

SEQ ID NO: 35046 - DNA, 447 bp, Zea mays
  unsure at all n locations
  Clone ID: LIB3060-021-Q1-K1-B10
agccaaccggctgcccggccatgtcgtcgccggctgcaggcacggcagcggagccgcgggtcggggaggactgcctcggcttcgtgcagctgctgagcgacggcacagtgaggcggtccacggactactccatgctccgtcccatcggccgcgtgccgtcggacacggacctgcccgtgcagtggaaggacgtggtgtacgaggacacgcgcggcctccggctccgcatgtaccggcccactggcgccgcagccggggagacgaagctgccggtgctggtgtacttccacggcggcggcttctgcctgctcagcttcgaggtggccagcttccatgccggcgcgctccggctcgccgccgagctcccggcgctcgtgctgtccgcggactaccgtctccccgcggcgctggacgacgccgagtccgncttcgcctggctccgcgccc

SEQ ID NO: 35047 - DNA, 403 bp, Zea mays
  Clone ID: LIB3060-021-Q1-K1-B11
gcctagctctatagctcgagtattgcttgctctccacaagaaacaaagcagagcaccaacaatggccgccgcctcctcgtcctcggtcctcctgctgctcctggccgccgccttggctggcatgagcgccaacgccgccaccttcaccatcaccaacaactgcgggttcaccgtgtggcccgcggccaccccggtgggcgggggcacgcagctgaacccgggcgggacgtggaccgtcaacgtgccggccggcaccagctccggccgcgtgtggggccggaccggctgctccttcaacggcaacagcgggagctgccagacgggccaatgccgctgctcgcttgcctgcacgctgtctgggcaaccggcggttacgcttgcccagttcaccatcggcggcagc

SEQ ID NO: 35048 - DNA, 450 bp, Zea mays
  Clone ID: LIB3060-021-Q1-K1-B2
gcgccggcggcgagtggccggtcatcgggcacgcgccgtggaacggctgcaacctcgcggacttgctgatgcccttcttgctcttgatcgtcggcatggccgttcccctggccctcaagaggatcccggaccgtggccgagccgtgaggagagtggtcgtaaggacgctgaagctgctcttctggggcatcctgttgcaaggcggttactcccacgctccggacgaactggcgtatggagtcgacatgaggcacgtgaggtggggcggaatcctccataggatcgctcttgcgtacctggtggttgcggttctagagatggtgacgaaagacggcgccaaggttcatcaggaccagccgccaggttcttcaggccgcttctcccgtgtattcagaatgtatctctcccagtggatcgtcgcgtgctgcattctggtggtctacctgtccc

SEQ ID NO: 35049 - DNA, 94 bp, Zea mays
  Clone ID: LIB3060-021-Q1-K1-B3
gctggcgttgtcctgccccttttaacaagtccttctccggttaagggttcctacggttttgtcggggggcggatgccgttgctgatgatgaata

SEQ ID NO: 35050 - DNA, 445 bp, Zea mays
  Clone ID: LIB3060-021-Q1-K1-B5
catgagttgtagggagggacttatgtcacctcaaacagaaactaaagcaagtgttgggtttaaggctggtgttaaggattataaattgacttactacaccccggagtacgaaaccaaggatactgatatcttggcagcattccgagtaactcctcagctcggggttccgcctgaagaagcaggagctgcagtagctgcggaatcttctactggtacatggacaactgtttggactgatggacttaccagtcttgatcgttacaaaggacgatgctatcacatcgagcccgttcctggggacccagatcaatatatctgttatgtagcttatccattagacctatttgaagagggttctgttactaacatgtttacttccattgtgggtaacgtatttggtttcaaagccttactcgctctacgtttggaggatctacgaattccc

SEQ ID NO: 35051 - DNA, 354 bp, Zea mays
  Clone ID: LIB3060-021-Q1-K1-B8
gtgacagccacctcagtctctgtctgtggaactctctctcgcgcgctgccatctcgcaggcggggagaggagatggacggggagcaggcggcgcggtgggcggcggcgcatgagggggttcccgtcggagcggaccttgtcgcggcggcgctgcggcagctgcgcttcctcgcggcggtggaccgctgccggtggctctactacgagggcccgctgctcgaccgggccatacgcaggtacaaagcatgctggcttccccttcttgacaagcacactaagggtgtggttgtagatggtccattggttgtccctcttgattgtgagtggatatggcactgccatcggcttaacccg

SEQ ID NO: 35052 - DNA, 347 bp, Zea mays
  unsure at all n locations
  Clone ID: LIB3060-021-Q1-K1-C1
ctttaagccacacgcacttgagctccaccgtcactaccaccagtaccacaccactccgcgctagcgtgacgacggttcagcggcacagaggtgcgacgtacgacgacgacgacgcatgcgccacacatggcatnccagctctccgccgacgtgccccggttccacggcctncggggctacgccgcgcccaggtccgcggtggcagcgctgccgttcgtgagggtgggcaggaagaggtcgtcgtcgcagggcatccgctgcgactacatcggctccgncaccaacctgatcatggtgacgacgacgacgctgattgctgttgcggggcggttcgggctggcgccgtc

SEQ ID NO: 35053 - DNA, 332 bp, Zea mays
  Clone ID: LIB3060-021-Q1-K1-A12
cgtttgtgccactcatggtgacatgtaccataacactagagacatcatcatgagggaggtccggtctggctcctcccgtgtgctcatcaccactgacctgcttgctcgtggtattgatgttcagcaggtgtccctggtcatcaactatgatcttcccacccagccagagaactacctgcatcgtattggtcgtagtggtcgttttggtaggaagggtgttgccatcaactttgtgacccgcgacgactaacgtatgctgtttgacattcagaagttctacaacgtgttgattgaggacctgactgccaatgttgctgaccttctgtgatcaa

SEQ ID NO: 35054 - DNA, 167 bp, Zea mays
  unsure at all n locations
  Clone ID: LIB3060-020-Q1-K1-F3
gnaccggngangncncccnccgcaccagngaggaaggaancgcngaggccaaggccgcagcgggggacacccancgngggggngaggacagngacaacaggangggcaaccacagcggccaggagnncaagaggaagaacaagaagganaacacnggcaaccccagg

SEQ ID NO: 35055 - DNA, 445 bp, Zea mays
  Clone ID: LIB3060-020-Q1-K1-F5
ctgcaagctaaggagagtgtgatcaccaacagctagtgctagtcccccttccttccatccatgcgtggcatgcgtcagcaccttccagagctgccccattgccagaagagcaaagatcaacaccaggtccaggggcagcagcagtagcgtggcgaaggggtcaccaccaccagccttccagttccagtgcagggcgtcgactttcgcggcggacaccagcctccggctcgagctggacgagaaccccgaggcgatcatctcgggggcgtggcccgggaactgctccctcctcagctacgacgacctccgcgcctacctcgagtcgcaagagacggcggcccaggcagacggtcagcagcgcggcgtggcgctcctgagcgagaccatgtccacacccgtgctggtggccacagcagaccagaccctggaagacgtcgagtgccac

SEQ ID NO: 35056 - DNA, 346 bp, Zea mays
  Clone ID: LIB3060-020-Q1-K1-F6
gcagagagcctcttgctgttagtgaactaatgcgacggataccgcgagggcggcgaactagggtgggcagcgatgatggcgacctcggacagcggcgtctacctcctgctcctactcgcccatccggcgccgccaccgcaccccgccaacggcgccagcagcctgtggcgcggcggtggcgccgcgctagctcctcatcctgctcgcttcgcggccaagaggaggacgctccggttggttaacgtcagcgtcagctgcagcgccgaggcgctgcgctccgacggcgcttgcgcggagccagcggtgccgcggtctgtgccggtgcgcgtcgcctacgagctgcaac

SEQ ID NO: 35057 - DNA, 423 bp, Zea mays
  unsure at all n locations
  Clone ID: LIB3060-020-Q1-K1-F8
accgtgaccgccgctttccgagctctcatggcggcgtccgcgtcctccctccttgccgcccccgcatcctcatcctgtggggccatctccccccagctccctcgtggagctccggccgctgcctccgtcgcttcgccgtcgcgtcactcctgctacctcctccgcgcttccccttcgaggcgccatcggagtcgcttcgtagccaacgccgctcccaccatgcagcctccggcggagtccagggtctccacggtagtcgatgtcgacctcggcgaccgtagctatccgatctacatcggcgcaggcctnctcgacgagccggacctgctgcagaggcagtcaaattatacattttttctttaactgttagactggagtggtcaacctgtgatccttatttatggtttctcaggcatgttcatg

SEQ ID NO: 35058 - DNA, 203 bp, Zea mays
  Clone ID: LIB3060-020-Q1-K1-G12
accatccattccaattcaaggtatcctaaatcatcaacatatgtctcgagaacacgaggacttataccttctgcggatcaatcatctatcatccaatcccctacaaaaaaaccattgccacatgttggctaattccacgactcactgatatttttcttacttgattgtcttcctgctatttataattaatcttcaacttacat

SEQ ID NO: 35059 - DNA, 191 bp, Zea mays
  Clone ID: LIB3060-020-Q1-K1-G3
aagaaaaatggcgcagctggaggagacgtacgcgtgctcgccggccacggaacgcggccgtgggatcctcctggccggggaccccaagacagacacgatcgcctactgcaccggccgtaacgttatcattcagcgtctagatgcgcctgttgacgcttgtgcctaccccgaccacgcctaccgcacgaccg

SEQ ID NO: 35060 - DNA, 288 bp, Zea mays
  unsure at all n locations
  Clone ID: LIB3060-020-Q1-K1-G4
cccaagcgngcgcccacacgcccgccccacctccacgcactcacccnctcacacggggaagcgggcactccagccgagcgcaaacgccgcaacgcacccgaacgctgcgagcgcacccagctcacaggcggccagcgcacctacctgatcggactctgcccgacgagcttgctggctatgcctcctcaagctcggttccatggccttcctcgccttcgggcagctggagctcacctgcgctctgcagctcgagcagatccctggtcgacaggccgcgcacttcagtga

SEQ ID NO: 35061 - DNA, 340 bp, Zea mays
  Clone ID: LIB3060-020-Q1-K1-G7
agctcatgctcatcctaggtggagctttgcgcgtgtgccatgtgttgctggtggtgctgctgcggctgcctggagtgcatccataacatcgtccctcccctcagcagccttcccttcctccgcttctccggcccagctctcccaggtggaggtggaggtggagcagcggcggcggtggtggcttctccacctgtagtctccatggcgtccatctcggtccccagcccggccccttccgcgaccgaagacgccgaaaacatcaggaaagcagtgcaagggatgggcacggacgagaaggcgctgatcgagatactgggccaccggacggcggcgcagcgcg

SEQ ID NO: 35062 - DNA, 460 bp, Zea mays
  Clone ID: LIB3060-020-Q1-K1-G8
aatcggtccatcccctgactatcactggctcactgcccttccacctccaggttccagcggccgtggtgaagaagcccaacggtgtcgccaaggccacggcgacctctgctgacgtggcagcccagccatccaaggagaatccgtccacccctgggttggtcaaggcctcgaagtttaagaggagaaaggtcaaggccaaccgtgcgaagcaggcagtcgctgcagcagctattgacgaggtcgcccctgtaggtgcaggcactggtgatggcgatgcatctgcatcagcggctttaccgcaaccatccgatgttgccgaggcattacctgtggtgcaaacgccaaagtcaaccacttttgctgaggcatcacctgtggcacagacgcagaagccagccactgatgctgaaagattggtgcctggacccaatccaaccactgctgtagcatcagcttcgtc

SEQ ID NO: 35063 - DNA, 200 bp, Zea mays
  Clone ID: LIB3060-020-Q1-K1-G9
ggacctttctcagaccgatttgatctcctacgtcatctgctcgttcaacttcgtcacgggtctcacgcccgacagcttcagcccctacatcatctacatggcgactgctccctcggacgtgctcgccgttgagctcctgcaacgctattgctgcatgcgccattctctgcctctattgcctctgttctagaggctttcct

SEQ ID NO: 35064 - DNA, 249 bp, Zea mays
  Clone ID: LIB3060-020-Q1-K1-H10
gtgagtgaacaccagccgtcttggcctgctcctcccctgctgcagccatggcgacctccgcggcgctctggaccgccgccaaccccacccagctctgccggtcccgcgctgcgctgggcaagccagtgaaggggcttggcctggggatggggcgggagcgcgcaagccagcggagcatcacgtgccaggcggcgagcagcatccccgccgaccgcgtccccgacatggagaagcggaagctgatgaacc

SEQ ID NO: 35065 - DNA, 329 bp, Zea mays
  Clone ID: LIB3060-020-Q1-K1-H12
atgctgcacatccagggactgttgtgatggcacgagttgattgtgcatcaaaggtgaacgtggatctttggacaaattctctgttgaccattatccttacctgttgtggggtccgccaacaaaattcaatttggttcagtggaaaccaaagcaagagaatagtgaattggaactaattgatgatggaagaacagcagatcggttactgaaatggataaataagaagatgggaagctcattcaatttagacgacaaaaagtatgagaatgaaagtatgcacccaaaaaatacttcagatcctgaacagattgttcgagcaatttatgacg

SEQ ID NO: 35066 - DNA, 196 bp, Zea mays
  unsure at all n locations
  Clone ID: LIB3060-020-Q1-K1-H4
aaccccgggccgacccacgcggccgaaccgggccaacactnncacgctcaggcgctcagctctagcaanggctgcctccaggatggcgatctcctacacggcgatggccggtacccccatcaaggcgggctccatcggcgagggccccatgagcatgcgcaagaccgagagcaagcccaacgtggcaccggccaga

SEQ ID NO: 35067 - DNA, 363 bp, Zea mays
  Clone ID: LIB3060-020-Q1-K1-H5
cacaatatttcatcgattccttccttgtcttctcacctctgacgattctgtttctgaaatctgggtcctgcaaaatggttccatggtcacggaattcgccatggtcagagtcagagagagagagagagagtcgtactggtcgtcacctgtcgaagattttcggtgtctcctgagccacagctgctgctgctgctggaaccatggagatggaggccgtggagtcgcacggaggcgccgggcgccggacgcccaagagggatcgcggcatctcctgtgcctgcgtcttcatcctggcgagtaactgcttccagttcatcggctactttgccgtgtcgacgaacccggtgaactacctcaaggacc

SEQ ID NO: 35068 - DNA, 387 bp, Zea mays
  Clone ID: LIB3060-020-Q1-K1-H6
ctcgtagagagaaggaaaaatatccccaaaccctagctcccgatctcgatggcgaaccctcgcgtcttcttcgacatgaccgtcggcggcgccccggcgggccggatcgtgatggagctgtacgccaacgaggtgcccaagaccgcggagaacttccgcgcgctgtgcacgggcgagaagggcgtgggcaagtccgggaagccgctccactacaagggctccaccttccaccgcgtcatccccgagttcatgtgccagggcggcgacttcacccgcggcaacggcaccggcggcgagtccatctacggcgagaagttccccgacgagaagttcgtgcgcaagcacaccgtccccggtgtgctctccatggccaacgccgggccccac

SEQ ID NO: 35069 - DNA, 250 bp, Zea mays
  Clone ID: LIB3060-020-Q1-K1-F12
cttctctccttttgctcggaacgcacacaccgaccgttcgcgatctccgatcccctcgtcgatggaaagaggcacatcttcgtcaagaccctcactggaaagactatcaccctcgaggtggagtcttctgacaccattgacaacgtcaaggccaagatccacgacaaggacggcatcctcccggaccagcaccggctcatctgtgctggcaagcagctacaggacggacgcacacttgccgactacaaca

SEQ ID NO: 35070 - DNA, 417 bp, Zea mays
  Clone ID: LIB3060-021-Q1-K1-A11
cgtttctgccactcatggtgacatggaccagaacactagagacatcatcatgagggagttccggtctggctcctcccgtgtgctcatcaccactgacctgcttgctcgtggtattgatgttcagcaggtgtccctggtcatcaactatgatcttcccacccagccagagaactacctgcatcgtattggtcgtagtggtcgttttggtaggaagggtgttgccatcaactttgtgacccgcgactactaacgtatgctgtttgacattcagaagttctacaacgtgttgattgaggagctgcctgccaatgttgctgaccttttgtgatcaatctgaagaaaaaacagaacaaaatagggtcgtgagggaacctggtaaggattggttttgtcgaaataccgtgggagagggggtga

SEQ ID NO: 35071 - DNA, 260 bp, Zea mays
  Clone ID: LIB3060-054-Q1-K1-G8
aagggttcagcccaatgcatctccgtgttaaccggcctccttatgaagacagtgatgccggtggtcgtcatgtggcagtgcaaggagcgccacttctaggtcaaggcctacatgtacttcgtaagataccgtagacgagattgtctaatcaccattgctgaagatcaagggttatcgttatcaataaaggtatctgcaaggatggtgatgatcataggtctaagactgctaaggatggacatgccataggccaatagctt

SEQ ID NO: 35072 - DNA, 387 bp, Zea mays
  Clone ID: LIB3060-054-Q1-K1-G9
gcaaaaaaaaacatcttcaccaggtgatgaaattaagggttcagaacaagcaaaaatcgaatcgattgcagagatcgaaacagtgggcgtcaaggagaatgtcattgctgatcataaggaaacaggtaacaacagtggcgtaagtatacatgcgcctctattagttgaatctggacaaaaggcatcacctggagttgaattgcgtggtattgaggttgatgctcatgttttggaacaagcaaagatggtttcagctctagaaccagactctactccagaagtttgtgctgacaagttagaaccttctggtgctgatgatgttggaatgattgttgtccaggaggctgcttctgttgatgatcacaatagagcacaaggtggtgaggc

SEQ ID NO: 35073 - DNA, 452 bp, Zea mays
  Clone ID: LIB3060-054-Q1-K1-H1
cgcccgcccgcgctatccactcgtctctccgtccgcatggccacttatctgaacgcaccgccggcagccaccacgacgactgcaagctgccgccatgccttctccggtggcagccttcgtctactccggccgagccgaccgacgctgcacgtgacgtgccaagccgccgtctcctcctcctcctcctcccagccgccgtcgtccccgtccaggaggtcagcctgcctcctcggcatcgcgtgcgccgtcctgctccgcccacgtgccgcctccgcggccgaaactgacgaagagccggccaacaacggctggtggctgaccgagttccccttgcccgtgcccaagatcgtcaacaaggagatcaacaacgcggagacgggcacgcgctccttcctcaagaacggcatctacatggcggacatcgggcccagcttcgcggcgcacgcgtaccg

SEQ ID NO: 35074 - DNA, 433 bp, Zea mays
  unsure at all n locations
  Clone ID: LIB3060-054-Q1-K1-H10
ggcccctttgcctccgctccaccgtcgcaggtcccttttgcctccgctcaaccgtctcagagtccttttacgtctcctccacagtctcagggcccattcgctgctggaccgtcgcctacgggcccttttgctgctacaccagcaccttttcgctctccgctgtcatcccttgcgcagccacaatctcccacgcaaggcgctttgcctacaccaccaacatatgcgaggccgctgtcacaaccactacaggcgcatgggtattaccctggtgcaccaccttcgaaccctcaatttccgatgtcaaggccagcatttcaacaacctgtgcagaatatgccaccttctccaatagggtcagctgccacatttggtaaccaggcagcttatcaaagtggcgggcctncagttggaggcacacttcagagtttagtgg

SEQ ID NO: 35075 - DNA, 402 bp, Zea mays
  Clone ID: LIB3060-054-Q1-K1-H11
caagggccttgtcccgctcgccggctccaacaacgagtcgtggtgccagggcctggacggcctggcgtcccgcgaggccgactactaccagcagggcgcgcggttcgccaagtggcgcaccgtcgtcagcatccctaacggcccctccgagctcgccgtcaaggaggccgcgtgggggctcgcacgctacgccgccatctcacaggacaacgggcttgtgccgatcgtggagccggagatcctgctggacggcgagcacggcatcgagcgcacgttcgaggtggcgcagaaggtgtggtccgaaaccttctacgccatggcggagaacaacgtcatgttcgagggcatcctgctgaagccgtccatggtgacgcccggcgcggaagccaaggacagggccac

SEQ ID NO: 35076 - DNA, 362 bp, Zea mays
  Clone ID: LIB3060-054-Q1-K1-H12
ctagggccttgtaccgctcgccggctcctacaacgagtcgaggtgccagggcctggacggactgacgtcacgcgaggccgactactaccagcagggctcgcggttcgccaagtggctcaccgccgtcagcatgcctaacggtccctacgagctcaccgtcaaggaagccgcgtggaggctcgaacgctactccggcatatcacaggacaacgggcttgttccgatcgtggagccggagatcctgctggactgcgagcacggcatcgaacgcacattcgaggtgtcgcacaaagtgtggtccgaaaccttctacgccatggccgtgaacaacgtgatgttccagggcatactgctgaagccgt

SEQ ID NO: 35077 - DNA, 387 bp, Zea mays
  Clone ID: LIB3060-054-Q1-K1-H2
agcccgcccgcgctatccactcttctcttcgtccgcatggccacttatctgaacgcagcgacggctgtcaccacgacgactgcgagctgccgccatgccttctccggtggcagccttcgtctactccggccgagccgaccgacgctgcacgtgacgtgccaagccgccgtctcctgatgcttctgctaccagccgccgtcatacccgtccaggaagtcagcctgcctgctcggcatcgcgtgcgcagtcctgctgcgcccacgtgccgtctactgcgccgaaactgactaagagccggccaacaacggctggcggctgaccgagttccccttgcccgtgcccaagatcgtcaacatggagatcaactacgcggagactggcacgcgc

SEQ ID NO: 35078 - DNA, 448 bp, Zea mays
  Clone ID: LIB3060-054-Q1-K1-H3
atgcacccccctatctattgtttacgtacgtgctgggccattaacggttcatggatcatgatggtgttcggcttttggccgcagttctgaggtacggtatcttggtgatcgacctcgaccctgacaccaagcattttcttaagcttgcctgaggttagcgataagctaggtagcagcactgatggatgcatgcattttgtacgtttcaatatggacagcagcacttccatgggtcaccacgtttatcgcagtagccgccattcttagcagggaagttgtactcttggcaaactttgccgcagtgaaatggcctgcagtattcacgatcctatggaaagcagaatggtggccgtaacctgcggacgacgccgtctgccaaaagaaacgtttgctcacccgttatatatatatagttgattagtacatacatatatatatatatatatat

SEQ ID NO: 35079 - DNA, 417 bp, Zea mays
  unsure at all n locations
  Clone ID: LIB3060-054-Q1-K1-H4
gcgaagaaggaagccggttagggtttccacctcctttcccctcctctccttcagcgtcgaccgctggccacaccctcgatatccttcccctcggacccggaggcgagcagcagcctccagcgcctgccacgcctgcccgtctcgttattggtcttcattcctgcaggaggattcgccatgtctgacatggagtccgtcgcagctcttatgaactcgacaagctccaagatacagcagcttcaggaggcatttgctgagcttgagagccagagcacggtttccatgaacctcaagtggaagcagcttgaagaccactttcgtggtcttgaacagtccctcaagataaagtttgacgagctaaaagagcatgagaaggagttccaggagactgtcgcanaatcagagcagattctggag

SEQ ID NO: 35080 - DNA, 382 bp, Zea mays
  Clone ID: LIB3060-054-Q1-K1-H6
cgacccacgcgtacgcgagaagacgagtgttaagtgaacctgttactttcggtgccactggctgcgtacctgagtgtgagcgagtgatcgagctagctgagctccgatcctggctagctaggatacgcggcatacctcaagtacctttcacaagtttacgagtgacagcaacaagagatcgatggcctctgccaccgtgctcaagtcctccttccttcccaagaagtccgaatggggcgccaccagtgcatgccgccgctcccaggccgaccaccgtctccatggtcgcacgcgcctgcgtctacgccgatgagctcgagaagaccgctaaaacgatcgcgtcgtcatcgcggggcattctggccatggacgagtcgaacgc

SEQ ID NO: 35081 - DNA, 435 bp, Zea mays
  Clone ID: LIB3060-054-Q1-K1-G7
ccatccgcacctctctccatctccctgctcctccgcctccttcttgatccagccaagccagggatcgccatgtcggactcggaggagcaccacttcgaatcgaaggccgacgccggagcgtccaagacctacccgcagcaggctggcaccgtccgtaagaacggcttcatcgtcatcaagaaccgaccctgcaaggttgtggaggtttctacctcaaagactggtaagcatggccatgccaaatgccactttgttgccatagacatattcaacgggaaaaagcttgaagatattgctgcttcatcacacaactgtgatattccgcatgtgaaccgtactgagtaccagctgatcgatatatcagaggatggatttgtgagccttcttacttcagatggcaacactaaggatgatcttagactcccaactgatgag

SEQ ID NO: 35082 - DNA, 427 bp, Zea mays
  unsure at all n locations
  Clone ID: LIB3060-054-Q1-K1-E9
ggacagggtcaccctggccggcgtgctccgcccggaggacgaggtggtggaccgcgctcttgcagatgcgcccgacacggagctcacccgcctcgccaagaactacttcagcagcacgaaccaagcgtcgctgctctgcctctcactccgtcgggcgctccgccgggcgcggtcgctgtacgggcccatcacggacctcctcgcgctcatcccgcagtcgccgcagctcgccacgccacactgcgactgtgcgttcgacgccttcctcctgttcgaccaaatgcccaatccgttcccggcgcccgcggccgggttccagtgcatgcaacgaagtttctctgggctcaaaaaccacctcgatcttcgtctactcagtgtccgacgcatgcgccgttggctccgctgtgccaagcgcggatcangtatc

SEQ ID NO: 35083 - DNA, 421 bp, Zea mays
  Clone ID: LIB3060-054-Q1-K1-F1
ccccgcccgcctccgcgccccgctcggctccgccgtgcagcagagggagggtgacacggactccgtgcaacggatccgcggaacggtggcgcttggcaggtcctcagagactgagactgcgacggtggcggtggggatggccgacctggtgaacctctggaggctggtggagggcgcggacggcggcccggcctggaccaagatgatggagaagtcgctgcccaccatgacctaccgggcgtggaggagggacgcccagaccgggccttcgcagtaccagagcagcagcatcttcgagaacgccagtccagaggaggtgagggacttcttcggggacgacgagttccggatgtccaacaggtgggacgacatgctcatctaccacatgaccctggaggagtgccggaccactgggacgatg

SEQ ID NO: 35084 - DNA, 413 bp, Zea mays
  unsure at all n locations
  Clone ID: LIB3060-054-Q1-K1-F11
gcaggctttgacggggtggcgaggatgaaggcgattatgatgaggaggacatcggaccactgctcagcttcgatgagatgtttcacctccacgcggcgtgcggcgtggcgcttccaggcgacatgatggaggcaaaccggtgccgaggatcccacagtcgtggacatcgccgggacgcagctgatgccgaaggaggaggcgctccagctttgcaccggctgtgtccacttctagacttccttgcctcgcctatcacctccaggaagtgatacccaccttggaagaatttggggatgaggatcccacgtcgcaacgttccatagtgcccctgcccccaccgatgtccacggccgtcgcgcccgggcatggcagtccgctcccacgcgatgcaagtccatccncaccgtcgcagc

SEQ ID NO: 35085 - DNA, 345 bp, Zea mays
  Clone ID: LIB3060-054-Q1-K1-F2
gtaaatttgagaccttgttattgatacttacgaagtttgttatattaatgcacagtaaattgaaactagattagaatttaaataattaagtgttataataaacgagatatttttttaataaaatattattacaaatataattaaaaattcatttatttgtaaaaatatcagaaacacaaattgattcatctattttctagagtctagtacataaacaaaactttttttaaagtgttgatcttttatgtcataataagtattggatgctgttctcgcactagaccaggtttgaaagttctacggattttatcgtgttactacatccttaatttcttactaggtgag

SEQ ID NO: 35086 - DNA, 440 bp, Zea mays
  Clone ID: LIB3060-054-Q1-K1-F3
cccacgcgtccggcaaacgcgccattgtctcgcactcgtagtcttgactcttgcgtgcttccctcgtcttctcggacgttccgttccatcgccatggcggaccagcttagcgaggagcagattgccgagttcaaggaagctttcagcctcttcgacaaggacggcgacggttgcatcacaaccaatgagctcggaaccgtgatgcggtctctcgggcataaccccaccgaggcggagctgcaggacatgatcgccgaggtggacagcaacggcagcggcaccatcgacgagcacgagttcctgggcctgatggctcgcaagatgagggacgcggagtctgatgaggagctcagggaggcgttccgcgtgttcgacaaggaccagaacggggtgatctacgtggacgagctccggcacgtgatgaccaacctcggtgagaa

SEQ ID NO: 35087 - DNA, 316 bp, Zea mays
  unsure at all n locations
  Clone ID: LIB3060-054-Q1-K1-F4
gtcccacccctcctgcatttcaaaatatgcgtatctccctgcgcttttcctagccctttgtcatccaaggaaacaataaacaaccggcgcttttacacccccgccaagaacaggagcaacaacaacaaggctcctcgcaacaatccattctcatccatggcgaagctcatgaacaagttggtcgattcgttcgagcacgacgagataccggacgtcggctgcgtgcgcgccgtgctggccgagctcgtactcaccttcctcttcgtcttcaccggcgtcttcgncgtcatggccgtcggatccgacgggaagcccg

SEQ ID NO: 35088 - DNA, 412 bp, Zea mays
  unsure at all n locations
  Clone ID: LIB3060-054-Q1-K1-F6
atctcacagacccaattcgcgagttctctctactctgccgacatggcgctctctgtggagaagacctgctctggacgggagtacaaggtcatggatctctagcaggctgactaaggccgactagagattgagctggccgaggtcgaaatgcccggcctcatggcgtgccgcgccgagttcggcccgtccaagcccttcgccggcgctaggatctcggggtctctccacatgaccatccagaccgtcgtcctcatcgagaccctcaccgcgctcggcgccgaggtccgctggtgctcctgcaacatctttttcacgcaggaccacgccgtcgtcgtcatcgcgcgcgactcggccgncgtgttcgcctgggaggtggagaccctcgaggagtactggtggtgcaccgagcgct

SEQ ID NO: 35089 - DNA, 431 bp, Zea mays
  Clone ID: LIB3060-054-Q1-K1-F9
attgcgactagtggcttacacgagtgggcactgacaaaagccgaggtcatagctgttctgtatgctggaattgtcgcatcttgcctgagctactcaatcatgacatgggcgaacaaagttcttggaccttctctggtcgccctctacaatccactgcaaccagccttttccaccgccctctcaactgttttccttggcgacccagtttacctcggaagcgttattgggggagtctccataattgctggtctctatctggtcatctgggctcgctacaatcaagggcagcgggcgcctacggatgcttgtttggaccctcttattattgtggataatccaagaatccccaagacacaagaaagtcccttcgtgtagatcctcaaaaaatgtgtcgattatccacacatttgtataggtggtctacagtatac

SEQ ID NO: 35090 - DNA, 370 bp, Zea mays
  unsure at all n locations
  Clone ID: LIB3060-054-Q1-K1-G2
aaccataccaaacacgcccatattaatacccgctcggcggtggttctgcaatcgaacgcaggccgcagtcgcgtgcggaactagagctccttcagagaagtgccgtgccagtgccaccgccggccgcatcatcgttccgtccccctgagtgttcagtaacttcttccgatccatattatggcttcaaagcagcagcagaaacagttcctggatgaagccatgatcaagcagccgacaccggaggaggaccgtgagggcgcatggccctcagtgctgacgatcatcggctttggattcctaaccttcaactcattcatggctgtgtacaggtcaaatggagatgttggatctatnctcttggggtcttctc

SEQ ID NO: 35091 - DNA, 249 bp, Zea mays
  Clone ID: LIB3060-054-Q1-K1-G3
gattcccggctcgactccactcgtctcgaactcatcgatctactcacatacttagtttctcacactacacgacttctaacatgggggagcctgctaagatctgagagtctagtgcattctcatacaagcgtcactacatcaggaccacttagtatcttataatagatggactattgtctgaatacatgctaatccatatacattactgccactgctcagcttgcacagcatatacctaaagtaatgctc

SEQ ID NO: 35092 - DNA, 416 bp, Zea mays
  Clone ID: LIB3060-054-Q1-K1-G4
aaagagcttacttacggtggctggggataaagctatttatcgtctcaagaccaggtttacaccaatctcaaaggcaaccgagctcatgcagcgaacactggttgggccatgctggcgctgattgatgcaggacaggcccagagagatcccgcgcctctacaccgagcagcaagggttttgataaacttgcagtcagaggacggagaatttccccagcaagagatcataggagtgttcaacaagaactgcatgatcagttactgccagtacaggaacaccttcccgatctgggctctgggagagtaccggtgccgagtcctgggagctggcaagctgtaatgacccggcctggccccgtcaactcgactgaaaaggcgtcttgtgtctcggtgttcttggtgttctatcttggcacg

SEQ ID NO: 35093 - DNA, 437 bp, Zea mays
  Clone ID: LIB3060-054-Q1-K1-G5
catttatgcttatggttttgagaagccatctgcaattcagcagagaggaattgttcccttctgcaagggtcttgatgtcattcagcaagcacaatctggtacaggaaagacagcaaccttctgttctgggatcttgcagcagctggactatggcctggttgaatgccaggccctggtccttgctcccacccgtgagcttgcacagcaaatcgagaaagtcatgctcgcgcttggtgattaccttggtgttaaggtccatgcatgtgtgggaggaacatccgtccgtgaggaccaaaggattcttggcagtggtgtgcatgttgttgttggtacacctggtcgtgtgtccgatatgctgcgcagacagtgcctccgccctgataacatcaagatgtttgctctagatgaagctgatgaaatgctttctcgtggtttca

SEQ ID NO: 35094 - DNA, 286 bp, Zea mays
  Clone ID: LIB3060-054-Q1-K1-G6
cgttaaccgcgctgctatcccccgctagccgccgcgctgctgcggctcgcctacctcctgcccagtccccgcgccccggcgccgaacgcgccgtctactctcgctccctccttttaccccgagcttaagctcgcgcgtacctgcctacctatccgtaagagaggaagaggggacaaggcccggtcggtcggtcggtcggtgggctctcggatctcgccgatgtctgcccgttcgttcgttgggatctcgcgccatggccgtcgtctcgccgtcctcggtccccgcg

SEQ ID NO: 35095 - DNA, 280 bp, Zea mays
  Clone ID: LIB3060-054-Q1-K1-E8
cgacccactcgtacgctggcgctaaactgctaccttgacatgtctactttcctaagccattgaccctgagccgggatcgtttccactggagcttgtgtacaatataccttcagtcctgaagcgtcacatacgtcgaatactcgcgcataacctattactctgaacaggccgcactccagtcatgtatcacaattctcacatgctcacagctcacttccatatttcagatctggatccaaccacttattacgctgacattctttatcgtcaactattgaaa

SEQ ID NO: 35096 - DNA, 352 bp, Zea mays
  Clone ID: LIB3060-020-Q1-K1-C8
ccctcgcctcctcacgtcacgcaccccatctcttctctccccctctcgtctcgtccagtcgtcgcgcctctgccccactctacccagctgccctgctctgcgtcgctcgccatggcgtcctccacggggagcttggagcacggggggttcacgttcacgccgccgcccttcatcacctccttcaccgagctgctctccggcgcacgggacatgctaggagccggcgccgatcaggagcggtcgtcgccgagggggctgttccaccgcggcgccaggggcgtgcccaagttcaagtcggcgcagcctcccagcctgcccatctcgccgcccgccatgtcgccttcctgctact

SEQ ID NO: 35097 - DNA, 397 bp, Zea mays
  unsure at all n locations
  Clone ID: LIB3060-020-Q1-K1-C9
agaaggatgattaccaaccttgtgatgtaacattggaaatttctacatcacactacgaccgcagacctagcaaagataagcatacttcaccaaaacaactgtctgaaaaatctccatcttcaggtgaccataggttttcaggtaggcttagtggtgggcgtagtcttgataataaaggagaaagaaagagccttacgaaatacagagatagagatggtgacatagcccaagagcgatcacatcatcaagatcgaatgccagctaaggttccattcagggagccaacaccgtcaaattcatccataagtagaggtggtcattttttgggcagttcaccaaataatcctttgccacctgcacggaacggtgacccttncttccagggtctacatgatga

SEQ ID NO: 35098 - DNA, 205 bp, Zea mays
  Clone ID: LIB3060-020-Q1-K1-D11
aactagacttcctagacagactagaccctatttagaattcgtaatatccacactaaactgatccgctcagggctgactcttactatcaacagaagtattgacaaaaatctgtatatccaactgatgatctacacactccaactccatctcgtcatcaagataaacctgcacataaaggtactgatatatttactgatttttacag

SEQ ID NO: 35099 - DNA, 190 bp, Zea mays
  Clone ID: LIB3060-020-Q1-K1-D2
atatcgttgtacctgcatctcgacctcaccggcgtccggcggtggtatcacgatggtggcgtggctgggccggcggatcggggtggctgcggcagctgccgcgttcatcgccctcgtggcgttcggatccgcctcatcctcgcccaagtccttcgtgaagtccatcggcttcgtccacgacgtcgtcatc

SEQ ID NO: 35100 - DNA, 315 bp, Zea mays
  Clone ID: LIB3060-020-Q1-K1-D3
gttctgtgtttcccgtcccatcgtgtgtgatcgcgtctgctggtctgccaagaggaggaaagggaggagagagatggcttgccctgcgcagtccatgctctccgccagcggctgcatcttcctgaggagcaagcctcaggcggcatcccaagtgcgagggggcatcatcggcggtggccgcagcagcaggccgttcctgctcacctgcaacgcttcctcttctccgtccccttcctcgccagcgccggcgcaggaagaccccgactgcaacgaggaggagtgcgccccggataaagaggtcgggagcctgagcgc

SEQ ID NO: 35101 - DNA, 326 bp, Zea mays
  Clone ID: LIB3060-020-Q1-K1-D5
gggagctctgcatcctgatccaccacccccatgcctgccttgctgcatccgtcgtcctcggtcgatgagagctgaggctcatgtagccgatgagtcctttttttttctttctcttcctgctgtttctccaagattcaagttggctggccgtgcttatccgtgcaggagctgaagcaggtttctgccctgttggtggtgatggtatctatcggtacccgtactttgcgtcgctttattcccatctttgctggtgaggtgctatgtcagtgttgttacactcgtttattttgttctcatattcttcggtttccttgttcgtaccggcg

SEQ ID NO: 35102 - DNA, 145 bp, Zea mays
  Clone ID: LIB3060-020-Q1-K1-D6
cgactgcgcacggcgccgcgccatgccgctttagaggttctgctccccggccagcaagaagagggattaagctggttgcaagtccggcttgcggatatctcgatctatcttctgtgatcttcgacttgcacattacatggagtgc

SEQ ID NO: 35103 - DNA, 241 bp, Zea mays
  Clone ID: LIB3060-020-Q1-K1-D8
cgccctctctctccttcctgccttctgcctgcggccggcccatgtccgtggcgcccgtgcgcgctcctccggccctgcgagctgcttctccagcgaaaaggctgctgcgccttgacgcaccaccgatccaccgccgcccaacccgagcgttctgtccggcagctaggtagcgagctgcgcggcggctgtgaccggaagcagggaggggaacagggcagcgaacgcccggcgattgccttgc

SEQ ID NO: 35104 - DNA, 362 bp, Zea mays
  Clone ID: LIB3060-020-Q1-K1-E1
ctcgcgaagtatcggcggcggcgagcgcggctggctagagcctcgttgctgaggaggggagagggcggctatgggcgatatgccgatgaggccggcgcgtccgggcccgccgatgcagcaccgtggtccgcccccgatggcgcgcctccgacccgaaccaatcgaccgcgagaagacctgtcctctgctgctcatggttttcacaagggttgctggtcaccaccaaaatgaagagtttgcagtgcgagggaaggaaccaaaggatgaagttcagatttacacatggaaggatgcgaccctgcgcgagctcactgaacttgtgaaagaagttgctcttccagcaggaaaaaggaatgcaaggc

SEQ ID NO: 35105 - DNA, 351 bp, Zea mays
  Clone ID: LIB3060-020-Q1-K1-E10
aattaacaagttcatgaacaccctgcggcagtaccagacccctttgcagcggtatatagctatgatgaaccttcaggaaacggacgagaggcttttctacaagcttttaattgataatgtggtggagctgcttccttttgtttacacaccaactgtaggtgaggcctgccagaagtatgggtccatctttggacgaccacagggtctgtatgtcagcctgaaggacaaggggaaggtcctagaagttctaaggaactggccacataggaacattcaagttatctgtgttactgatggtgaacgaatcttgggacttggagactttgggtgtcagggaatgggaaattctgt

SEQ ID NO: 35106 - DNA, 395 bp, Zea mays
  unsure at all n locations
  Clone ID: LIB3060-020-Q1-K1-E11
gtgatcaccaacagctagtgctagtcccccttccttccatccatccatggcatgcgtcagcacggtccagagctgccccattgccagaagagcaaagatcaacaccaggtccaggggcagcagcagtagcgtggcgaaggggtcaccaccaccagccttccagttccagtgcagggcgtcgactttcgcggcggacaccagcctccggctcgagctggacgagaaccccgaggcgatcatctcgggggcgtggcccgggaactgctccctcctcagctacgacgacctncgcgcctacctngagtcgcacgagacggcggcccaggcagacgatcagcgcggcgtggcgctcctgagcgagaccatgttcacacccgtgctggtggccacagcag

SEQ ID NO: 35107 - DNA, 188 bp, Zea mays
  unsure at all n locations
  Clone ID: LIB3060-020-Q1-K1-E3
cgnccggcgcgngcggcacggcctgtccaagatctaagagcgcacatacccatgcggggaagggacaccctctcctagatatgcagatatgcccgcacatggcgtttctgagtagcagccaacatatctaccatgtatagcagcttctcctagcaaatcatactagcacgccaggagactccatgcca

SEQ ID NO: 35108 - DNA, 230 bp, Zea mays
  Clone ID: LIB3060-020-Q1-K1-E4
caagcaactgcaaagcagcaagctctactcttcttctgtactgaacgtgtgactaggtaacaagaagcgtgaaccatggcggacgagtacggccgcagcggctacggcaggtccggcgccggcgacgactacgacagcggctacaacagcaagtccggcactgatgactacggccgtggcgaatgtggctacaacaagtcgggcggcgatgacgactactgccgcagcgg

SEQ ID NO: 35109 - DNA, 331 bp, Zea mays
  Clone ID: LIB3060-020-Q1-K1-E5
aagagaaccagtgtgctagtgctacagctactgcctagctacctaacctactacggcgcagctggcagcggcggccatgaccgacgggcgcgaggagagcaccagcagcaggtggccagagctggccgccctgcgcgcgctggcgcgcgacgcggcggcccgggccgggagggagacggcggggtggcgcgggcgggagcgggaggatcaccgtcacggtcacggcaagacggccaaagtcatgcacctgctgctctggggacccaaatgaggtgaagtgaagcgctgctgctgcagcacagcacctgcctatggctcgtggcccgcgcgc

SEQ ID NO: 35110 - DNA, 283 bp, Zea mays
  unsure at all n locations
  Clone ID: LIB3060-020-Q1-K1-E6
cccaggcgcccncggccgcggcgcgcgcncttcactccttaagtcagccgccgcctattgctcgggctcccgggcttcgcttttccgaccagccgaggccgacgcccttgctccaccgaaccaggcatcctgccgagccacgcgacgccgagcaccctgctctcgcgccctgtgcgcaagccgcgcgcactgccctgcacctgcgtctgcacgagctgcgtcgcccattcgcaccgagcgcgctgagtcgatgcgcgcagccgcgccttgctcatacgtgcac

SEQ ID NO: 35111 - DNA, 361 bp, Zea mays
  unsure at all n locations
  Clone ID: LIB3060-020-Q1-K1-E7
aaccgggccaacactnncacgctcaggcgctcagctctagcaanggcggccaccaccacggcgagcncctggacggcgatggccggtacccccatcaaggtgggctccttcggcgagggccgcatcaccatgcgcaagaccgtgggcaagcccaaggtggcggcgtccggcagcccctggtacggccccgaccgcgtcaagtacctcagccccttctccggcgagcccccgagctacctcaccggcgagttccccggcgactacggctgggacaccgacgggctgtcctgcgaccccgagaccttcgccaagaaccgcgagctggaagtgatccactcccggtggggcatgctcggcgcgc

SEQ ID NO: 35112 - DNA, 390 bp, Zea mays
  Clone ID: LIB3060-020-Q1-K1-E8
gggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggcggctacggtggtggccgtggaggcggcggctacggcggtggcgggcgccgtgatggcggcggcggctacggcggtggcggcggcggctacggtggcggcggtggctacggtggtggtggtggcggctacggcggtggcaaccgtggcggcggctacggcaactccgacgggaactggaggaactgagcggtggggcccgcgcggccaagttatcctgttcgctaccgggatg

SEQ ID NO: 35113 - DNA, 385 bp, Zea mays
  unsure at all n locations
  Clone ID: LIB3060-020-Q1-K1-E9
gcaccagcaatggaggcgagcggcagtcgtgtccggatggggagcccggtccccaagcgccggggangcgggggcgtggctactggcttcgggtctacggcgcagtcgctgaacgacgacattctccggtccgtcttctcccggctggacgaccacttcgacctcgcccgctgctccgccgtctgcggctcatggaataggataattgaaacagctcatctcatgagggatatgtattacaaaaggaacccacctgcatgaggttcaagctctaatatttcagtaaaaagttactttgagatgcttgccatggatgagcatgcatctgctttctctagaggacctgctgcagcttttcagtggactgggcacccaatgagggcta

SEQ ID NO: 35114 - DNA, 154 bp, Zea mays
  unsure at all n locations
  Clone ID: LIB3060-020-Q1-K1-F1
aagacgactngnnncancgagccttgaagatatcgagcttcttttgcaccacaagggcgaggatgtcttgcaactgcggatcaagctgcagctgcggctcaagctgcaagtgcggcaagaagtaccctgacctggaggagacgagcaccgtcgc

SEQ ID NO: 35115 - DNA, 253 bp, Zea mays
  Clone ID: LIB3060-020-Q1-K1-F10
caattctcggatcgacccatccgtccaggcgtgctatcctggcggtagcgctggatatggctagcgcggcaccggtgactatccaagaggcggccgtggatatggtggcaactacggaaacaatgctcgtggtggctatggtcgtggtgctgactatggactcgcatgtggggctgaaggcagttttgctgctggaggtagcgacagctttgggagcagtaactttgctgacagtgctattggtgaaaaccct

SEQ ID NO: 35116 - DNA, 190 bp, Zea mays
  Clone ID: LIB3060-019-Q1-K1-H4
cgactcgtcccacgcgagccatctgatctgacaaaccacatattccatgtttgccttgagaagcccccgaaggtgaggacttgtatcttttgactactgcagaatcttgaattggagcagcccaagaatatctaaaatctgcatttggtgcacgtctggccaagcttccttctgaaggtctacacgtttt

SEQ ID NO: 35117 - DNA, 318 bp, Zea mays
  Clone ID: LIB3060-019-Q1-K1-H6
aattcccgggccgaagaagaggagaagcgaagcaagcaggcttcgagaacaagactgcagggggagggggaggaccaagcgaaaggggagctagaggaagatgggcggcgcactgctgcttgcgctcctcctcgtctctgctgctgccgcccctcaggtacttggagttggcaatggagacaatcacatgagaatcatccaggaggacatcatcgagacagtcaacaaccatcccagtgctgggtggacagcctcacgtaatccttacttttcaaactataccattgcgcaatttaagcacatacttggagtgaaacc

SEQ ID NO: 35118 - DNA, 324 bp, Zea mays
  unsure at all n locations
  Clone ID: LIB3060-019-Q1-K1-H9
catcgatccgccattgctcaccgcacaagtgcacgctcacctcacacacgcagctaagtagctaacgccgtaggcgagaacaagaaaaggctcgacatggccgaggagaagaagcagggcctgcagctgctggacttctgggtgagcccattcgggcagcgctgccgcatcgcgctggacgagaagggcctggcctacgagtacctggagcaggacctggggaaaaagagcgagctgctcctncgcgccaacccggtgcacaagaagatccccgtgctgctgcacgacggccgtcccgtctgcgagtccctcgtcatcgtgcag

SEQ ID NO: 35119 - DNA, 356 bp, Zea mays
  Clone ID: LIB3060-020-Q1-K1-A11
cagatgtgcagacgattcttatttggacagttatatcatcacaattggggttgatttcaaaatgcgcacggtggatcaagatgggaagaccataaaacttcaaatttgggatactgctgggcaagagcgcttcatgacatttattagcttctactaccgttgagctcatggaatcattattgtatatgacgtgacagaccaagaaagcttcaataatgtgaagcaatggttgaacgagatagaccgttatgcaagtgataatgttaacaagctccttgttgggaacaagagtgaccttactgccaacaaagttgtggcaactgagacagcaaaggcgtttgctgatgagatgggca

SEQ ID NO: 35120 - DNA, 177 bp, Zea mays
  unsure at all n locations
  Clone ID: LIB3060-020-Q1-K1-A3
aaccccgggccgacccacgcgggcggaggaaagcngcagaagcaaacaaggacaacttggcagcnncagacggcaccaacggggcaactcacggaggcnangaagaaggcanngaagagagcagcaagaacagccangaaaacggcggacaggncnacacggacggcgcgaacanga

SEQ ID NO: 35121 - DNA, 373 bp, Zea mays
  unsure at all n locations
  Clone ID: LIB3060-020-Q1-K1-A6
gcggggcctnaccaccagggccagcccgngcaganggncgngcccggcaaccatcagggacaggcccnccgggcggcctaccaggccaacacgangcccgacacggccgngcccatcgacgggcaagaaacncacccngactcggngcaacnnaagccagggaaagcggagcaangngcaaggcaagagaaacnccacaagagncaggagacaggaacagaagnaaaggaaccagangaaaccgggngagcngaaancacggggcaacagacgctagcaataaacatgggaactcatccatattagccggatggaaagctatcaattcctgaattcatgttgaatgagccccaacactatctggcagagaaag

SEQ ID NO: 35122 - DNA, 266 bp, Zea mays
  unsure at all n locations
  Clone ID: LIB3060-020-Q1-K1-A7
ccctggcgnngngagaatncnnaaancangtttngnagggagggacccangncaccacaaacagaaactaaagcaagtgttggatttaaagctggtgttaaggattataaattgacttactacaccccggagtacgaaaccaaggatactgatatcttggcagcattccgagtaactcctaagctcggggttccgcctgatgaaccaggacctgcagtacctgcggaatcttctactgggccatggacaactgtttggactgatgg

SEQ ID NO: 35123 - DNA, 413 bp, Zea mays
  unsure at all n locations
  Clone ID: LIB3060-020-Q1-K1-A9
agaagacgagtgtcaagtgaacctgaaacttgcggtgtcactggctggtatagcctgagtgtgggtgagtgatcgagctagctgagctccgatcctcgctagctagctaggataccgccttaccacatgtcttcttcacaagtttaggagtgacagcaacaagagatctcgatggcctctgccaccgtgctcaagtcctccttccttcccaagaagtccgaatggggcgccaccaggcaggccgccgcgcccaggccgcccaccgtctccatggtcgtccgcgcctncgcctacgccgatgagctcgtgaagaccgcgaaaacgatcgcgtcgccggngcggngcatcctggcgatggacgagtcgaacgcgacgtgcgggaagcggctggcgttcatcgggctggagaacac

SEQ ID NO: 35124 - DNA, 380 bp, Zea mays
  unsure at all n locations
  Clone ID: LIB3060-020-Q1-K1-B1
aaccccgggccgacccacgcgtgcgagctgcgctactcgcccgncgccttgggctttattaagatcggaatcaacggctcggggacggagccgcaggctcgtggccagggtcgccctccagagcgaggatgtcgagctcgtcgccgtcaacgaccccttcatcaccacggactacatgacctacatgttcaagtccgacaccgtccacggcccctggaagcacagcgcctcaccactaaaggcctccaagacccttgtcttcggagacaagccgtgcaccggctttggcaatcaggaaccctgaggaaatcccatggagtgaggctggcgctgcctatgccggggagcccaccggcgtctccactgacaaggacaaggct

SEQ ID NO: 35125 - DNA, 297 bp, Zea mays
  unsure at all n locations
  Clone ID: LIB3060-020-Q1-K1-B12
cccccatttcgaagctcctcctcgcgattccaatccacgcacgccatctccgactccgcgtccggctcgcgcangacatatattcagtgatggaacacaaggaggccggctgccagcagccggagggcccaatcctatgcatcaataactgtggtttctttggaagcgctgccaccatgaacatgtgctccaagtgccacaaggagatgataatgaagcaggagcaggcccagttggctgcctnctccatcgatagcattgtcaatggcggtgataatgggaaaggacctgcaattg

SEQ ID NO: 35126 - DNA, 407 bp, Zea mays
  Clone ID: LIB3060-020-Q1-K1-B5
cacacagcaatccacacaagcacttcgacgttacacgggcgctgcacacagacacaccaagcgtgggcaccaatggcttactaccaggaggtggactactgctcggaggaggtgaggtcggtggccccggccggcttcggccgccacggcggcggcgtccagcagcacgtcgtcaaggagaagttcgaggaggtcgacacggtcgcacgcgccggcgccaaccaccaccaccaccatggtcaccacggcggccacggcttcgtggtgcgcgagaccagtgtcgaggaggacatcaacacctgcaccggcgaggtccacgagcgcagggagagcttcctcgccagggctaactgaacagcccgggcggccggcattcacgcccgttcgtgcctgcctgcgtgccttat

SEQ ID NO: 35127 - DNA, 342 bp, Zea mays
  Clone ID: LIB3060-020-Q1-K1-B9
ataccgccataccacaagtcttcttcacaagtttaggagtgacagcaacaagagatctcgatgggctctggcaccgtgctcaagtcctacttccttaccaagaagtccgaatggggcgccaccaggcaggccgccgcgcttagaccgtccaccgtctccatggtcgtccgcgcctacgactacgccgatgagctctttaagaccgcgaaaacgatcgcgtcttcttggcggagcattctggcgatggacgagttttacgcgacgtgcgggaagcggctggcgtacatcgggctggagaacacggaagccaaccggcaagcgtaccgcacgctgctggtcacg

SEQ ID NO: 35128 - DNA, 417 bp, Zea mays
  unsure at all n locations
  Clone ID: LIB3060-020-Q1-K1-C10
aattcccgggtggcgctgcaacgatgagcttggcgttcgtgccgaagagctccacagttcgtctggttccaaagttaccaagtattacatagaattgtggaagcaaattcctgcaaacgagccctaccgggtgatactaggccatgtaagggacaagctgtacaacacacgcgagcgtgctcgccatctgctggcatctggagtttctgaaatttcagcggaatcgtcatttaccagtatcgaagagttccttgagccacttgagctgtgctacaaatcactgtgtgactgcggcgacaaggccatcgcggacgggagcctnctggacctnctgcgccaggtgttcacgttcgggctctccctggtgaagctggacatccggcaggagtcggagcggaacaccgacgtgatcgacgc

SEQ ID NO: 35129 - DNA, 139 bp, Zea mays
  Clone ID: LIB3060-020-Q1-K1-C11
agcttgtgcttgctctggggggaaggagagttagagatcgagagagagagagagatctagtacgtaatcgagtacgtggtcctcgaacgaagatgttagcggcgttcagcggtcaagtggtggaagtacctacggagct

SEQ ID NO: 35130 - DNA, 329 bp, Zea mays
  Clone ID: LIB3060-019-Q1-K1-H12
gtcaaaaaggtcaatgttccaattcatgctttgatggctttgatgcgaagagtgctgttagttgatggatcattgcataacaagctgttcccttctacaacttcattgcatcaagagcttatttgttttgatcttccatcgttacattcaactttcttggatttgctgaatgcaactattaaaggcatgcgaagccaactcttacctcatggtgctagtatcatacggcttataacagagtacttcaaaatagcaaagctgcctactttgaagacaaaaacttatagcattttgcagctgttgctgacctccatgggtgttgggacgtc

SEQ ID NO: 35131 - DNA, 330 bp, Zea mays
  Clone ID: LIB3060-020-Q1-K1-C2
ctcgtggcgactactgggcgacctccccgcttccgccgctctacgccaggtgcccagatctggggcgggcccttcgccgaagagcagccaacaggtatgcgcaccccttctcttcctttcccgctgtgcgaagctgaggacccaaaccctagctgacactgttttggctatttgcgttcggatcggatctaatttcaggtgtataatgtagtattatgcttgctaacttgattgtcttgcaaaataaaaacatgggtccgctcatctcccctactgggttcgcatggcatatgtaggaattttagctatcttttagccgattgaatcaac

SEQ ID NO: 35132 - DNA, 261 bp, Zea mays
  Clone ID: LIB3060-020-Q1-K1-C4
gagccatcgacacgatcgcgagcgcaagcacgtacgttgtcggaagctcaagttaggagaagcgccattgcctgatcgatggcggcccaagctctcctctgcggccggcagctgctgggccgccccgtgcagtcggccgtctctaggtcgtcggcgaggaaggcgcccttcgtcgtcagggccagctccagccctgcagccaagcaaggtgccgacaggcagctgtggttcgcgttcaaacagttcctctcctaccttgat

SEQ ID NO: 35133 - DNA, 273 bp, Zea mays
  Clone ID: LIB3060-019-Q1-K1-F5
gagttgtacaggatcgtgtccctggggaaccatttgcaaggaagccatcaaaggatgctgagagggaaaagatattgagatcaatggagggtatgccgggagccccaagcatgaaaatgtactccagggacgatctgatgaaaaataactctggtactgaagacgacgacgaggaggatgatgaacatgaggatgacaacttcccaaagaacttggggaaagctttgaaaaacagggcctctcaaacgaaggatttgaaccagcaagtgttcc

SEQ ID NO: 35134 - DNA, 407 bp, Zea mays
  Clone ID: LIB3060-019-Q1-K1-F7
gcccagcaaaccactcccacccggtggctcgtcctcggacgccaagccactccgcgccccaatggggaagcgccgccgccgccgatcgaccggccgtcgacccatgctgcgctcggcgctcttccgctcagcccccgggctccgacggtctccggcgacggcccacttatccaccgacgacggcgccgtcgcagcgtggctcttcaacggccctgcctacgccccgtctagggtgcgcctcctcatcggcggggagttcgtcgagtcgcgcgccgacgagcacgtcgacgtcaccaaccccgcgacgcaggaggtggtgtcccggatcccgatcaccacggccgatgagttcaaagctgccgtccatgccgccaggacggccttccccggctggcggaacacgcccg

SEQ ID NO: 35135 - DNA, 262 bp, Zea mays
  Clone ID: LIB3060-019-Q1-K1-F8
atcgaccttcaagtctcgctacgtagcagtgcaataaaaaaagcagccgcaatggcgagcagcggcatggcgctctcctccacggccttcgccggcaaggccgtgaacgtgccgtcgtcgtccgccttcggcgaggcccgcgtgacgatgcgcaagacggcggcgaaggccaagccagcggcggcgtccgggagcccgtggtacggccccgaccgcgtgctgtacctgggcccactgtccggcgagccaccgagctacctga

SEQ ID NO: 35136 - DNA, 224 bp, Zea mays
  Clone ID: LIB3060-019-Q1-K1-G1
aactacccactcgacccacgcactccttacagccaaacaattcaccccgttaatacattctactacgacaatctactacctgcgccaagtagcgatactattacacacgactttaaccatacctagcctcaaatacaaactatcacatgatctataaattcacatactcatgcatcatgcatccacatatatcttatataccgaagtctataacacttaattac

SEQ ID NO: 35137 - DNA, 421 bp, Zea mays
  unsure at all n locations
  Clone ID: LIB3060-019-Q1-K1-G10
ggtggttcgaggttccgggcttcaacatgatgcactcgctgaacgcgtgggaggaggccgacggcgaggagctggtgctggtggcgcctaacgtcctgtccgtggagcacgcgctggagcgcatggagctcgtgcactcctgcgtcgagaaggtgcgcatgaacctgcgcacgggcgccgtgtcacgaaccccgctctcggcgggtaacctcgacttcggcgtgatccacccgggctaccttggccggcgcaaccggtacggatacctcggcatcggcgaccccatgccgaagatctccggagtggccaagctggacttggaccgcgccggcacgggcgactgcactggggcgcggcgcgacttcgggcccgggtgcttcgcgggggagccggtcttcgtncccgacgacgtggaggggga

SEQ ID NO: 35138 - DNA, 369 bp, Zea mays
  unsure at all n locations
  Clone ID: LIB3060-019-Q1-K1-G11
cccacgcgtccggaagtgtcggccacatcccacatgtgaactgcccactgccgcagtgcggcaggcgcggaccccaacctatgcagtacgcagtangcatcaagcgtcctgtgtggctgcatccaagtccaagcgccgtccggccaccagcacaggtaccgagccaccaaggtaggagccggccacggtgcagatcccaggctgccagccaccggcgtccagcactccggctgccagctaccggccacccgcagcgcaggccacactgacgggcagcagccgcacgacgctatggctgccgacgaacaccgacgggcaaaacccaaaatccaacccaagggtgggttcaagctactggaaggcaatgca

SEQ ID NO: 35139 - DNA, 452 bp, Zea mays
  Clone ID: LIB3060-019-Q1-K1-G12
atttttcccggcctccgctccggccagatcggctcgggtgaaccccagcccctaccgatccggatccgtccccatcgcctcgtgtgttttccgtcgagtattttagcgtgtgtgtccccccctcttcgcttcggttggtgcgtgcggctgtctcgggtagatctgtggtttggttcgccttgaaggcgcgcggcggcggtgtcgcggcttgtagcttgcgatttcacggtggagcttgtcggctgttggggtcggatttggagtttgtcatggcgtctaagcgcatcctcaaggagctgaaggacctgcagaaagacccccccacatcatgcagtgcaagtcctgctggtgaggacatgtttcattggcaagcaacaattatgggaccacctgacagtccctatgctggtggtgttttcttagtgaacattcatttgccgccagattacccc

SEQ ID NO: 35140 - DNA, 415 bp, Zea mays
  Clone ID: LIB3060-019-Q1-K1-G2
ctcttttccggcgacgaccgctgttcgagttgcggcgctctgttcagtgttcattgggcccttggccacgaccattatcctccagtagtaagtcaccatgtcttcgtccatgcaatcttcataccttcctgctaccactgagtccgtagccaaggctcaggaggccaaggacgcttctgagtccatctcaatcctctaccgcgtgcttgaggatccctcttcatctgcggatgccctgagagtaaaagagcttgccatcacgaatctaacaaactacctaacaaaagacaccagagctgaagacctaaggaaccttttgacccagttaaggcccttttttgcattgatccccagggcgaaaactgcaaaaattgtgcgtggcatcattgatgccgttgccaaggtgcctggaaca

SEQ ID NO: 35141 - DNA, 424 bp, Zea mays
  Clone ID: LIB3060-019-Q1-K1-G4
accaccttccggaccccaccactcccccgcgcgcgccgtgcgatcaccgccggccgccgccctgaccctggccgccttgaggaaaagcaaggccaacgccttctcctgctcctcctctccaccgaggtcgcgccgcgcgcttgccgtcacgatggccgcgtcgctgctcgtgctcgccgtggcgttcctggttggcgctggccacggcggcatcgatgggggtgcagcagctcacgtggaggtagagggctctgaggtgacctacgggagtgcgattaagctgttgcacgagaagacaaagcaccgtctgaactcacatgatgtgccgtacggctcaggcagcggtcagcagtctgtcaccggctttcctgaaggcgatgactcaaatagctactggatcataaagcctactccagatccatcg

SEQ ID NO: 35142 - DNA, 303 bp, Zea mays
  Clone ID: LIB3060-019-Q1-K1-G5
cttcaaccgaaggagttaccaagtatttcaatcctgcttttcctagcttcacaatgcgcaaaaagcgcacttaccctttcggatcccacaatagtccatctttctgtcatcattgcacctgctccagagtatcagccacctcctactgcctctgctccaccaatgagtggaaccagacttccagttcatgattgacacaacaactttgttcacaaaccccatgactttgtgaccactatccttcccaaggtttctctcctagccaaatacccttttttcaaggccaaaccttttattaaaaac

SEQ ID NO: 35143 - DNA, 436 bp, Zea mays
  unsure at all n locations
  Clone ID: LIB3060-019-Q1-K1-G6
cagatggatatatccgactggcaagatgatattcatgaaaacaaacatgaacaagaaggtattgaggctcgtgacagaagcaatgacttctgagacacatcggaattccctatcatttgctgaaaaggaaattaaggctgaactcctcgtgaatttgccagataccctacttctgaactggcttttccattgcttatcggactgctatactgtaataccagcccttgtgaagtactagattattggtactatntcataagaactgaaagcttctgcttgccaccatgaaaagggacaatatgtccatgcttgaaaagaatgatctatcagagaaatcagtcttggctctttgattcatctgtgatggatgactcttcggtatggtggtattggcagtcaagctctggcaagccaaagcaagcccatacacactact

SEQ ID NO: 35144 - DNA, 366 bp, Zea mays
  Clone ID: LIB3060-019-Q1-K1-G8
gcagcttctcccctcccccccctcgtctccgtacagagagggctcctcgctgccgtgtgccgggcttcactgtcccctctcgtctcctctcctctcccatggctcagcgcgacaagaaggtggaggagccgacggagctgcgcgcgccggagctcacgctgtgcgccaacagctgcggcttcccgggcaacccggccaccaacaacctctgccaggcctgctttctgggccgcacgggtttcttcttcggcttccgcttggcggcggcggccttcttcttcttggcttccgcggggcttcaattcgacgaccagcagcaaaatcccaagccctgtgccccggccgcgttcgggcccaccgaggaac

SEQ ID NO: 35145 - DNA, 404 bp, Zea mays
  Clone ID: LIB3060-019-Q1-K1-F4
cccaatcccatgcgcccctctgctctcacggtttgatttccctttcagttgggccggcatggccgcggtagcagctgtgcgcctgcaccccggcctcccccatcgccggccctgacactgggtaaacgtggtggctgaagctgctgctgaggattcgggatcttcttgctgccgccacgagctgcctgcgtgatattgacacggcgcgctcccctggctcctgggcatgacgaggggaggcggtggacaaggaggcaaggaggagccggggaaggtgatgggtccgctgttcccgcggctccacgtcaccgacgcaggcaaggccggcggcccgcggcctcggccaaggaccaggatggccctctacaaccagttaaccgtgccgtccaaccgtttaagttccc

SEQ ID NO: 35146 - DNA, 377 bp, Zea mays
  Clone ID: LIB3060-054-Q1-K1-D1
gggacttcggcttcgatccgctgggcctcgcgaccgtgccggagaacttcgagcggttcaaggagtcagaggtgtaccactgccgctgggccatgcttgccgtccccgggatcctggtgccggaagctctgggcctgggcaactgggtgaaggcgcatgagtgggcggccgtccccggcgggcaggccacgtacctgggcgccccggtgccgtggggcacgctgccgaccatcctggtgatcgagttcgtggccatcgtcttcgccgagcaccagcgcaccatggagaaggaccccgtgaagaagaagtaccccggcggcgccttcgacccgctcggcttctccaaggaccccgccaagttcgaggagtacaagctc

SEQ ID NO: 35147 - DNA, 430 bp, Zea mays
  Clone ID: LIB3060-054-Q1-K1-D10
cggtccaacactttcacgctcaggcgctcagctctagcaatggctgcctccaccatggcgatctcctccacggcgatggccggtacccccatcaaggtgggctccttcggcgagggccgcatcaccatgcgcaagaccgtgggcaagcccaaggtggcggcgtccggcagcccctggtacggccccgaccgcgtcaagtacctcggccccttctccggcgagcccccgagctacctcaccggcgagttccccggcgactacggctgggacaccgccgggctgtccgccgaccccgagaccttcgccaagaaccgcgagctggaggtgatccactcccgctgggccatgctcggcgcgctcggctgcgtcttccccgagctgctctcccgcaacggcgtcaagttcggcgaggccgtctggttcaaggccg

SEQ ID NO: 35148 - DNA, 398 bp, Zea mays
  Clone ID: LIB3060-054-Q1-K1-D11
cggggcaacactttcacgctctatcgcttagctctagcaacggctgcctccaccatggggatctcatgcactgcatatcggcggtaccgaccatcaaggtgggctccttcagtgagggccgtatcaccatgcgcaagaccgtgggcaagcccaaggtggcggcgtgcggcagtccctgttacagtcccgaccgcgtgaagtacctcgaaccattgtgcggcgagcccccgagctacctaaccagcgagttccccggcgactacagatgggacacctccggactgtcctcctaccccgagaccttagccaagaaccgcgagctggaagtgacccactgccgctgagccattctccgggcgctcagctgattcttcccctagctgatctcacgcaactgt

SEQ ID NO: 35149 - DNA, 448 bp, Zea mays
  unsure at all n locations
  Clone ID: LIB3060-054-Q1-K1-D3
cccgaacaataaacaacagcttcaccctcctcctccagtgcaggccgtcggcggctggcggcgtcatttctcctccttcctctggcctgccctgccctgccctgcccgcgcgataaccatctctcgcaactcctcttcgtactcctcgtctccaacgccggcaacaactacagagcttcagcttcccaagcgcgagacatgcgtgcggaaacacagacggcggagtagcgtagcgccacgatgggattgccaagctggtaggtagccaagaagacatgagatgggggcgtccttgggctccgccgccagcaaggaccggcagcaggagcacggcggcgaggctccgcgaccagatccctgcaagaagacgcggctctcgtccnctctctgcactatccacggtagccactgtcactcgaggctgatcccagggctcccggatgaggtc

SEQ ID NO: 35150 - DNA, 446 bp, Zea mays
  Clone ID: LIB3060-054-Q1-K1-D5
ctctgcttctgcggcgtcgcgagctccggctcagttttctgctctcccgccgcgccgtggtcgccgtcgaaattcctgacgcgcgtgcccagcgtcgtcgctctgctcgagttggtcctggtggccgttgtttggaaacagactcgaccgcacccagcgccgagcttcttcctgctcatgcccagtcgctctctctctgtttgccgcttgtccgtctccctggtgctcgccgcgcgcgctattccttttgcgcgcctggctagttctagctcgaaccaaaccgtctgcgcctgttcgcccctgctgcgcgcagtcgcgcagctcgcggagctctcttgccgtggccgtcgcgtccctggtcctagcctttagctcagtctctatgcgcgcgagctcgccggtgtgctgctagtctaactgggatctcgcccatggcgtcgatctgt

SEQ ID NO: 35151 - DNA, 431 bp, Zea mays
  Clone ID: LIB3060-054-Q1-K1-E10
gccggcggagccatggcgaccactctttcgttatcctctcccctcttcctcggagctccggccagaggcaagggttacacgagtagagttcgttgtcgggagcagcagcgacgaacgacaatagtatctatgcttggaaggaaatcaacggctagagcaactgttgtcccagaccccgactataggttaccaatcgctatacttgggattgctagtgcttttgcatatgccgacaatcttctcgctgctgcacctgtaggactgctggggcttcttcttttgttccagactacaagagtgaggttcgtctttgataacgaggccctggaggtgaaggttggagagcagctgcaggagtcaggtgaaaatgtattcgtcggcggcaagaaccgttggaagtactcaacgttcgtaaactgggagctgtggtg

SEQ ID NO: 35152 - DNA, 421 bp, Zea mays
  Clone ID: LIB3060-054-Q1-K1-E11
ggcagacgatcagcgcggcgtggcgctcctgagcgagaccatgtccacacccgtgctggtggccacagcagaccagaccctggaggacgtcgagtgccacttcgaggccgtgtcggggcttccggtcgtcgacagcggcctcagatgcgtcggggtgatcgtcaagaacgaccgggcaagagcctctcatgggtccaagacgaagatatcggaagtgatgacatctccagctatcacactatcgtctgacaaaaccgtgatggatgctgctgttctcatgctcaagaagaagatccacagattaccagttgtaaaccaggacgaaaaagtaataggtatagttacccgcgctgatgttcttcgcgtgttggaaggcatgttgaagatttaggagcgcagatacccatgctcggaagccaca

SEQ ID NO: 35153 - DNA, 176 bp, Zea mays
  Clone ID: LIB3060-054-Q1-K1-E3
tcgacgactgggccatcgaggactctttacgttgcgcactacacaggctttctgatcgcggtgaccaattgcaactctaagcggcttgcccttaacctggatgccctcacgaacatacgtctaaacttcataactgttggtacgctcacgagcatggttgacacatgtgagtactc

SEQ ID NO: 35154 - DNA, 432 bp, Zea mays
  Clone ID: LIB3060-054-Q1-K1-E5
gctgctcagctgcagcggcatgagcagctcggcgcggttgctggaagaggcgccgcccaaggaggagcacccacatcctgccgtgccggagctgccagaacctgagctgccgccgcaccctaccgacgtcgtgccgcctgagctgcccaaacccgagttaccaccgcacccggccgttgtccccgagctgccgaagcctgaggtgcctcatcaggtgccggagcagccgaagcccgagctgccaccgcacccgacagccgtccctgagctcccgaaacctgaggtgccgcacccagtgccggagctgcccaagcccgaggtgccaccgcacccgacagccgtccctgagctcccgaaacctgaggtgccgcatccagtgccggagctgcccaagcccgagctgacaccgcacccggcggccgtgcccgagct

SEQ ID NO: 35155 - DNA, 418 bp, Zea mays
  Clone ID: LIB3060-054-Q1-K1-E6
cacgaagtacggaaggctgccggaaggagctctcacctcacatccatctctgtcgcgcccgtcatcctcctcctcctcccctcctcaactgctatcggatttgcgctgcagtggagatcgacccgggctgggaatttctttcgttggtaaggaaccctaatttggtcggatgggattttcatcttcgacgaagcccgcgagattgatcgaccttagctgacgcgagggattggaaagcgaacgctcgggcgtagttaattttctaggaagattggggtttcagctcaaacccccatgctcgatgctgaggacgaccctggcgggagatgacgaggatcttcgtgcagcgcgggaccgccggctactcgtccagctccggccgctcgggctcgcaatcagcgcatcagcccgcagcagc

SEQ ID NO: 35156 - DNA, 414 bp, Zea mays
  Clone ID: LIB3060-054-Q1-K1-B4
cggacgcgtgggcggacgcgtgggcggacgcgtgggtgccgacgcggcgctcctcgccatcatcgtcgccttcctcctcccgctacgcctcgtctccctcggcctcagcctggcgtccgggcgtcacggtactagctccagacgcgtccgccgttcctgtgccgctttggccgtcgcagccgcgctcctcgcagtcatcttcgccctcccgcgtgaccacgtccgggagtgcgccgctccgatcgcttctgtctccagtgccggggatgatgacggcggtttccgcgaggagctgcggttggaggtcgagcagcttaagcagcagctggcgcggcttgaatctctttgggatagtaaatcgaaagctgtggatgataaacttgattctttagaggaggataatggccgtgtaat

SEQ ID NO: 35157 - DNA, 455 bp, Zea mays
  Clone ID: LIB3060-054-Q1-K1-B7
gcggagccgaaaatgtagtacagggaacctggtgttcttctatggcgtggcttcactctgcaggaatttgcaaaccagtgctttgggaacaagctggactatggtaaagggaggcagatgcccattcactatgggtcgaaccgtctgaactatttcacagtctcgtcacctatcgcaacacagctcccgcatgctgttggagctgcctactctctgaagatggacaagaaggacgcgtgtgccatcacatactttggggacggtgggacaagtgagggagacttccatgcagcgctcaacttcgcggctgttatggatgcaccggtgatcttcttctgccgcaacaatggctgggccatcagcactccgactactgaacaattcagaagtgatggagttgtcatccgtggccaggcttatgggatccgtggcatccgagtagatggcaatgatgc

SEQ ID NO: 35158 - DNA, 433 bp, Zea mays
  Clone ID: LIB3060-054-Q1-K1-B9
gcacctcttcttcctccctctcaccgtgctcctcagccgaggtggcgaggaccctccctgtacatcgtctcctccatgtcgacatcttccctcatctctccaacgtcgtccagccattgagcagctcatcggagcagcaacgctcgacactgagtagcccaccgtggagtcacctcatcagcgtctcctcgctcctcgtccgttcgtcgagctcggcaagcccctcctcagccgtgccgagtctccaagccggctgtcgacgctcgcctttgtttctgtgttactggtatccattcttgctcgccaatcgagcaccccacccaccgttccagttccgattccgctagttgtcgttcgcctcgccatcgtctcttgggaaagattataatgtctttggcttaattagttacttcatgtggaggtcttgaagctt

SEQ ID NO: 35159 - DNA, 201 bp, Zea mays
  Clone ID: LIB3060-054-Q1-K1-C10
gctgagctccggaggggctttgacatcatggatttagacgggggtatcggatgggaacctgctaacttgatgggtccggtacaaaacacgggagaaggccaatgctaaggccgcattggcacacccgtacttcaaccgtgaagggctccttggcctctccgtcatgcaaaacgtacggctgcaactgttccgcgcaaccca

SEQ ID NO: 35160 - DNA, 380 bp, Zea mays
  Clone ID: LIB3060-054-Q1-K1-C3
ggccttcccgacccaggcgacccgtacgccgtcatcccatctatctcgccttcacttccgactctccgtctccagcttaccggcgcggtcgctggatgtctacgcagtagatccatagaccctgatctcctcgaggtgattcccctcgtcgccagaggtatcctcgggcagcaatatccactggcgacgcagtcgccacagccgctacgttccctccttcaccgtcatcaccacggctaggtggaagcgctcggcgaggtagcggctccggggaaagacatggtgctgatcgagctggagcccgaggaggcgacgcgcccctcgctgccggtggcgtaagagcaagcggtcgccggcgacgccgcgcgcccctcgtcttc

SEQ ID NO: 35161 - DNA, 451 bp, Zea mays
  unsure at all n locations
  Clone ID: LIB3060-054-Q1-K1-C4
ggaactcatcatgaatccactaattgctgctgcttccgttattgctgctggattggccgtagggcttgcttctattgggcccggagttggtcaaggtactgctgcaggacaagctgtagaaggtattgcgagacagccagaagcagaaggtaaaataagaggtactttattgcttagtctagcttttatggaagctttaacaatttatggactggttgtggcactagcgcttttatttgcgaacccttttgtttaatcctaaaaaagaaaatgagtcctttagattagatacttttttctttttttagtacattggcatttgcttatgtaattctaagtatatcaatactttactttactcctatttattatattatttcttttttatattattccggaaattntgtatttatcgggacagacaataccctaggaaccccaagaagggctg

SEQ ID NO: 35162 - DNA, 421 bp, Zea mays
  unsure at all n locations
  Clone ID: LIB3060-054-Q1-K1-C6
cccacgcgtccggtccaaacgatacaggtatacgatacgccgctcgcctgaatcgagaccaccaccgctcccgctctgcctcacctcgccgactagagtttttgccgccgcggatctcgccgtccccgccatggatacgtcgggctcctccgcagccgccggcgacgccccgaccaccggggagcaccggatggggaccaccattgtcggggtctgctacgagggtggcgtcgtcctcggcgctgattccagaaccagcactggaatgtatgtagccaaccgtgcttcagacaagattacccaattgacagacaatgtgtacgtttgtcgctctggatctgctgctgatacacatgtcatttcggactatatacgttatttcctncaccaacacacaatccagcttggacaaccagctact

SEQ ID NO: 35163 - DNA, 401 bp, Zea mays
  unsure at all n locations
  Clone ID: LIB3060-054-Q1-K1-C7
gaatcccgtaatcccatctctctcgccttcactgccgcctctccgtctccagcttaccaccgccgccgctggatgtctacgcagtagatccatagaccctgatctcctcgaggtgattcccctcgtcgccagaggtatcctcgggcagcaatatccactggcgacgcagccgccacagccgctacgttccctccttcaccgncatcaccacggctaggtggaagcgctcggcgaggtagcggctcgggggaaagacatggtgctgatcgagctggagcccgaggaggcgacgcgcccctcgttgccggtggcggaggagcaggcggtcgccggggacgcggcgcgcccctcgtcttcagcggcgcccgaggaggaggaggcagccgctggaaggaaggcgt

SEQ ID NO: 35164 - DNA, 439 bp, Zea mays
  unsure at all n locations
  Clone ID: LIB3060-054-Q1-K1-B2
atgcaagaagacgtactcaatttctactctcttctatcagtctcctcactcctatctctcatgtctccttttcctcccaccgttcctgtcacccacgcagcacgccggagcagcagtagcagtcgagctcggcatcagctcccttgctgctcactttgcagcacctcgccagctccctggtaacactctgcacctgccgtcgaactctctcaggttcggtcatccctgctcccttccaaatcaacgcccctccactcgactctactactgtgtcgtgcgcgcgcttcctcctgcttccgtcgctgggtgcgtgctcatcttccgtcgcgtgccacctggtcgatagaatgagcagtttggtcgtccccatctcgccgtggttcgtcctcaccatgttttcagatgtgtttgggctgagatgccattcnaaatcgatgat

SEQ ID NO: 35165 - DNA, 410 bp, Zea mays
  Clone ID: LIB3060-053-Q1-K1-H7
gcaagatttgctcagatgatgtggagggtaaatttctttgccatgtcctgttgcatggtccttgacaatgactacatgttgtactatatcgctccgatgcataccctgttcactcttatggtgtatggatcactgtttgttctcaacaagtacaatgagatcccatcagtcatggccattaagatcgcaagctgcctcttgactgtcattctgatatgggaaattcctggtgtgtttggaattttctgggcaccatttacggttctggtagggtaccaaaacccaaaagcttctaagaagaacctaaccctggtacaccaatggcgctttcggttttgccctgatcggtacatatggatcattggaatgaattatgcttactttcaccccaacgtaagtgttctaaagag

SEQ ID NO: 35166 - DNA, 375 bp, Zea mays
  Clone ID: LIB3060-053-Q1-K1-H9
gcgacgctggcggaccgcccggcgctcgcgtcggtcaagttcctcgacgagagcgacaacaccatcacccgcgccagctacgggcccgtgtggcgcctgctgcgccgcaacctcgtcgccgagacgctgcacccgtcgcgggtgaagctcttcgcgccggcccgtgcatgggtgcgccgcgtgctcgtcgagaagctcggggaggccgggcccgacgccgtcccgccccgcgtagtggagacgttccagtacgcgatgttctgcctcctcgtgctcatgtgcttcggcgagcgccttgacgagcccgccgtgcgcgcgatcgcttctgcgcagcgggaggcactcatctaccgctccaagaacatgcaggtcttc

SEQ ID NO: 35167 - DNA, 442 bp, Zea mays
  Clone ID: LIB3060-054-Q1-K1-A1
gaggagcagcgcagccgcgatggaccgtttccagctcgtgctcctcggcctccccatcctcctcttctgctccgacgtcgttaccctcttcgcgcctctcccgccgccgggccccgggcccgacaggggcccccacgcttttcagcccggcgccgaatcctactccgccgccgacgcttccgcacatgtggagccacaggtggacggaactggctccggcaccaccgtcgacttcaagttctgcgcctcctgctcgtacaggggaactgcaatgaccatgaaacggatgctggaaacctcctttcctgggatccatgttgtcttggaaaattatcctgcgacgttccccaaacgcgctctcagtaaagctgtaccccttcttcagttcggcgcgatggcaacattaatggccggtgatcagatcttccccaggtttggaatg

SEQ ID NO: 35168 - DNA, 391 bp, Zea mays
  Clone ID: LIB3060-054-Q1-K1-A10
aaagcagaagcgctctccagaagtatggtagagagaggggggacgacgacagccgtgggggccgcggactgcatcgctcgacggtagctgacgtcactcggcccagtggaattttcaagctttggtggtggctcgtctgtctgatccgcgctctgctgcttattcttcgcccgccggactgtatgacaactataacagtacctacgtgatcacaggtctaggcatttgccctaccagtacagtacattggactagtaataactagtatgtatccagcaaaccgacacatggatccatactactagcactatagaaaccatgtttcttacccatactatcctcctgccagatgggaaatcccatgcggtcatccacaggcaatggactcatc

SEQ ID NO: 35169 - DNA, 311 bp, Zea mays
  Clone ID: LIB3060-054-Q1-K1-A11
cgggcacgacgccacgcgctacgaaagcactaacgctctcaagtattgcggtttatagatccaggacgacgacagccttcggggccatggactgcatcgatatcaaagtggtctccttactcgaaacgccgatcaccatgcgctaagaccgatggcaagaccaacggatccgagctctgatgccactgcttcggcccccgcactgtataacaactatgacagtacgtacgtgatcccaggagtaaccatacgtactagcaccacagctcataggactaggactaaccaggacttatccactaaaccgacac

SEQ ID NO: 35170 - DNA, 412 bp, Zea mays
  Clone ID: LIB3060-054-Q1-K1-A2
agctcaagtggtaccttgtcctcctgtgctacttcttcgctcccgtggttgcgttctgcaactcctacggaatgggcctcaccaacctgaaccttgccccgacctacggcaagatcgccctcttcgcgttggcctcgctcgtcggcagtgatggcggtggagtcatcgccggccttgcagcctgtggcatcgtaatgtccgttgcctgttccacagccgatctaatgcaggacttgaagagcgggtacctgaccctctcgtcgccgcggtcgatgttcactgcccagctgatcggcatcgcgctcgggtgcgtcatagctccgctcacgctgtggctcttctggacagccttcgacatcggcgaccctgacggggagtacaaggccccctttgccatcatgttccgggagat

SEQ ID NO: 35171 - DNA, 453 bp, Zea mays
  Clone ID: LIB3060-054-Q1-K1-A7
acgagatcctcggggtgcccaagtcggcgtcccaggacgatctcaagaaggcctaccgcaaggctgctatcaagaaccaccccgacaagggcggtgaccccgagaagttcaaggagctcgcacaagcctatgaggttttgagtgatccagagaaacgtgagatttatgatcagtatggtgaagatgcccttaaggaaggaatgggcggtggaggatcccatgttgatccatttgacatcttctcatcattttttggaccctcttttggaggaggtggtggaagcagcaggggaagaaggcaaaggaggggagaagatgtagttcacccacttaaagtttctctggaagatctttacaatggcacctcaaagaagctctctctttcgcgcaatgtcatctgctccaagtgcaagggcaaaggctcgaagtctggtgcctcaatgaggtgccctg

SEQ ID NO: 35172 - DNA, 377 bp, Zea mays
  Clone ID: LIB3060-054-Q1-K1-A8
ataaactgcggattctttctttctcttccattcttacgtttccatattaaagtgtagttgctttactgaaatttaatactattaatctaatatgcccattggcgttccaaaagtaccttaccggattcccggagatgaagaagcgacttgggttgacttatacaatgtcatgtatcgagaaaggacactcttttttaggtcaagagattcgttgcgagatcactaatcatattacaggtctgatggtatatctcagtatagaagatggaaatagcgatatcgcgctgtctataaactcccctggcgggtggctaatctcatgaatggccatttttgatacgatgcatacggtgacacctgatatatatacaatatgc

SEQ ID NO: 35173 - DNA, 381 bp, Zea mays
  Clone ID: LIB3060-054-Q1-K1-A9
aaaccagaagcgctcgcgagaagtaagggagagagaggggggacgacgacagccttgggacccgcggactgcatcgctcgccggtagctgacgtcactcggccccgtggaattttcaagctttggtggtggctcgtctgtctgatccgcgctctgctgctatgtcttcgcccgccgcactgtatcacaactataacagtacctacgtgttcacaggtctaggcattcgtcctaccagtacagtacattggactagtaataactagtatgtatccagcaaaccgacacatggatccatactactcgcactatggaaaccatgttccttacccatactatcctcctgccagatgggaaatcccatccggtcatccacaggcaa

SEQ ID NO: 35174 - DNA, 368 bp, Zea mays
  Clone ID: LIB3060-054-Q1-K1-B11
gcggctcttgttcctccctgtttaccgtctcctcagccgcagtggcgaggacgctcccggtacatcgtctcctggatgtcgacatctcacctcatctctacaacgcaggccagccattgagcacctcatcggaacagccacgctcgacactgagtagcccaccgtggactcacctcatcagcgtatgctcgctaatcaggcgttcgtcgagctcggcaagcccctactcagccatgccgagtctccaagccggctgtagacgctcgactttgtttgtgagctactggcatgcattcttgatcgccaatcgagcaccacacccaccgctccagctccgagtccggtagctgacgttcgcctcgccatcg

SEQ ID NO: 35175 - DNA, 370 bp, Zea mays
  Clone ID: LIB3060-054-Q1-K1-B12
ccccggccattcactcacccacctagctagtcatcactagtcacgttcgtccaccagagacaacaatggccatggagacgtgcttcagagcgtgggcgctgcacgcccccgctggcagcaaggacaggctcctcgtcggcaacctggtgctgccgtcgaagcgggcgctcgcgccgctgtccgtgggccgcgtcgccacgcgccggccgcggcacgtctgccagtccaagaacgcagtggacgaagttgtggtggcggacgagaagaactgggacgggttggtgatggcgtgcgagacgccggtgctggtggagttctgggcgccgtggtgcgggccgtgccggatgatcgcgccggtgatcgacgagct

SEQ ID NO: 35176 - DNA, 367 bp, Zea mays
  unsure at all n locations
  Clone ID: LIB3060-019-Q1-K1-D11
caataactggcaccgacatgcggaagagaatgaacaggatccgatccgtcctatataatccctggtctggcacctccgtctgcgtctccgtccgtatataagaagccagatttcgaattccctcctnctncgnctctcccgcagtccctctcctcctttccctcccccgtcgcgatcgctctgtgctccgnctacgtccgtcaaggcctgctcttgcgccgttccttctcgcccaatccgncaggggatggccacattcgagctctaccggaggtccaccattggcacctgcctcaccgagacgctggacgaagctcgtctcagcgggggccgtcagccccggaactcgccttccagtccatgactg

SEQ ID NO: 35177 - DNA, 448 bp, Zea mays
  Clone ID: LIB3060-019-Q1-K1-D12
ccaggcatggaaagtacatggcatgctgtttgatgtaccgtggcgacgttgttccaaaagatgtgaatgctgctgtccattcaatcaagaccaagatagcagtgcagtttgttgattggtgccctactggtttcaagtgtgggataaactacctaccaccaactgtagtccctgaaggggacctggtcaaggtgcatcgagcagtctgcatgatcagcaacatcacagtcgtggctgacgtcttctatcgtattgaccgcaagtctgatctcatgtatgccaaacgtgcattcgttcattgacatgtcagtgaatggatgtgaagaaggggagttctcagaggcatcggaggatcatgcatcactggagaacgattatgaggaagtcggacctgaagttgaagatgaggacgagtgaactgattattgagtcatcgatctggatgcat

SEQ ID NO: 35178 - DNA, 249 bp, Zea mays
  Clone ID: LIB3060-019-Q1-K1-D4
gcgtccgaggtagcgcatccgcacgcacaggtcctgctttatggcgcagtggagcagcgtggccgctagcgtggacctttagattgggcttgggccatgccgctgcggctcaccgccggcaccgttccgggcggcgatgccgcggcgcgggcgtgcgaggaggaacggctgcaaggtcgtcggctgcgcgtccgtcccgcaggagcaagccgagctgccgccgcttgccgtcgatggcaccgatgaaga

SEQ ID NO: 35179 - DNA, 147 bp, Zea mays
  unsure at all n locations
  Clone ID: LIB3060-019-Q1-K1-E1
ttccttggtcgagcacgcgtgcgcnacgcgtccgctgaaaagacctctcgtcatagatgagttatctgatgactcagatgacgaggggccgatggggttaatgagaaaggttgaggagaaaaaattgaaaggagttgatactccggt

SEQ ID NO: 35180 - DNA, 440 bp, Zea mays
  Clone ID: LIB3060-019-Q1-K1-E11
catattcattaacttaagcatactccttttttttatttaatgagttgatattaattaaatatcgttttggttagatttttgcaaaggtttcatttacgcctaatccatatcgagtagaccctgtcgttgtgagaattcttaattcatgagttgtagggagggacttatgtcaccacaaacagaaactaaagcaagtgttggatttaaagctggtgttaaggattataaattgacttactacaccccggagtacgaaaccaaggatactgatatcttggcagcattccgagtaactcctcagctcggggttccgcctgaagaagcaggagctgcagtagctgcggaatcttctactggtacatggacaactgtttggactgatggacttaccagtcttgatcgttacaaaggacgatgctatcacatcgagcccgttcctg

SEQ ID NO: 35181 - DNA, 445 bp, Zea mays
  Clone ID: LIB3060-019-Q1-K1-E12
cttaccaaaacagaggagcccgtcggccgtcgcaaaaaaaaaaaaaaaaacaaaacaagaccagcgcacgatggaatcgctgacgcttcgcgcttcgacggccgcctcgccgctgcagcgacgccggctgctccccggacggcagcgcgcgacgtacgtccgcgccacggcctccgccggcgagccggacctctccgtgcgcgtgaacgggctgcagatgcccaacccgttcgtgatcgggtcggggccaccgggcaccaactacaccgtcatgaagcgcgccttcgacgagggctggggcgccgtcatcgccaagactgtgtcattggatgctgaaaaagttatcaacgttactcctcgttatgcaaagcttcgggcagaaccaaatggggctgccatggggcgcatcattggctggcagaacattgaactcatcagggacagg

SEQ ID NO: 35182 - DNA, 403 bp, Zea mays
  Clone ID: LIB3060-019-Q1-K1-E2
aggtaccgcagccgcacgcacaggtcctgcggcatggcgcagtggagcagcgtgggcgcgagcgtggaccggtggattgggcttgggccatgccgctgcggctcaccgccggcaccgtcccgggcggcgatgccgcggcgcgggcgtgcgaggaggaacggcggcaaggtcgtcggctgcgcgtccgtcccgcgggagcaggccgagctgccgccgcttgccgtcgatggcaccgaggaagaaggcgtaggcggttgcggaccgtgcggaggcccggggtggttgctctgcaacttttgccagggcaggaagaccaccgccaagccggaaacgcggacccggttgtacggcggtgtcccaacttccaaggttgcggccttaatccggggccaaaaagccaggt

SEQ ID NO: 35183 - DNA, 256 bp, Zea mays
  unsure at all n locations
  Clone ID: LIB3060-019-Q1-K1-E3
accgactcgagccacgcgtcctctcatgccatgttccaccttcctttgtggctttaagtcggcgccgactttaagttggccatcgagaatgacgtcaagaacttccaggtcctcaaagagatgtacaacgagtggccattcttcaaggtcaccctggacctgctcgagatggttctcgccaaaggagaccccgacattgccggcttgtatgacgagctgcttgttgcggaagaactcaagcnctttgggaagcagc

SEQ ID NO: 35184 - DNA, 329 bp, Zea mays
  Clone ID: LIB3060-019-Q1-K1-E6
cggacgcgtggggttggcttctcctccccctccggttcgggttcgggttcgtgaggttctccggggttcggggtcgtgggtgggcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcagcttcgtcacctttctccacggaggaagcgatgcggaacgccatcgaaggcatgaacggcaaggaacttgacggccgcaaca

SEQ ID NO: 35185 - DNA, 250 bp, Zea mays
  Clone ID: LIB3060-019-Q1-K1-E9
ggagggttgatggagatcgctgccatctacgaggcgctcgacgacctggacgaggcgctgaaggttctgcagagggcgctgaagctgctggaggacgcgccggggcagtggagcaccgtcgctgggatcgaggcgcagatgggcgtgctgtactacatggtggggaggtacgcggagtcgaggagctcgttcgagagcgcggtcgcgaagctgagggccagcggcgagaggaaagtcggcgttttcggcg

SEQ ID NO: 35186 - DNA, 315 bp, Zea mays
  Clone ID: LIB3060-019-Q1-K1-F1
aactaccgactcgtgccactcgtcagctcagacgtatactcatcttaaccaaccgcttccagtcctatccccctctaacatggccatcgagcaccacctctggatctccctggtcctgatagacatgctcaaccatgtggccactcttcagggtcaccctactacctactgcatatacctcgtgctgaagtagaccccggcctactcggacaccatgacgagctgcttgtagcccaagaactgaaaccctttgggaaacttctgaatccccagactctggacacacagcaactactgctctacatcgctgaactc

SEQ ID NO: 35187 - DNA, 415 bp, Zea mays
  Clone ID: LIB3060-019-Q1-K1-F10
cgatctgtgtgcctggctgactgcaacctccgtgggatggaggctgagcggcagcagcaggaggagtgcgcgtgcagcgtggccgaggccgctgacacagttcgagcggttgcactacgcggtgctgctcgacgtcctcaatcgcatcggcgacgtcaaggcgctcagccgctgcgccctcgtatcgcgccgcttgcacgcgctcgtgccgctcgtcgactccgtcttcgtccgcgtctactgcgtcatacctgacgacccgccgtcctcgtcctcctgctcctacttctcctattgcgccgcaccatgcacctccgacgaggaggcgccagcctcaaccgcgcgcgggcgcagcgcgctagcgcacatcgcgcgcgtgctgctcagcggcatcggcaggcccatgcacgcgctc

SEQ ID NO: 35188 - DNA, 153 bp, Zea mays
  Clone ID: LIB3060-019-Q1-K1-F11
aaaaaagaatacctaaaatagactgaaaactacttagaatagaagcaaaagcggcaacaacaagaaggagtgggcgtacagcgtggccgaagccgatgaccagttcgagcggttgcactacgcggtgctgctcgacgtcctcaatcgcatcgg

SEQ ID NO: 35189 - DNA, 405 bp, Zea mays
  unsure at all n locations
  Clone ID: LIB3060-019-Q1-K1-F12
ctcgccgtactccctcacagaacccagtaaaatattgccagtcccgccgtcgagatggccccaggccgcctgctcgtcctcgccgtcgtcgccctcgcggccaccgccgtcgcggccaactccggcttcgcggactcgaacccgatccgccccgtcaccgaccgcgcggcctncgcgctcgagtccacggtcttcgccgcgctcggccgcacccgcgacgcgctccgcttcgcacgcttcgctgtgaggtacggcaagagctacgagagcgcggcggaggtccacaagcggttcaggatcttctccgagagtctccagctcgtccgctccaccaatcggaaaggcctctcctaccgcctcggcatcaaccgcttcgcggacatgagctgggaggagttccgtgcg

SEQ ID NO: 35190 - DNA, 385 bp, Zea mays
  unsure at all n locations
  Clone ID: LIB3060-019-Q1-K1-D10
agaatgcttaattcatgagttgtagggagggacttatgtcaccacaaacagaaactaaagcaagggttggatttaaagctggtgttaaggattataaattgacttactacaccccggagtacgaaaccaaggatactgatatcttggcagcattccgagtaactcctcagctcggggttccgcctgaagaagcaggagctgcagtagctgcggaatcttctactggtacatggacaactgtttggactgatggacttaccagtcttgatcgttacaaaggacgatgctatcacatcgagcccgttcctggggacccagatcaatatatctgctatgtagcttatccattagacctatntgaaagggggttctgttactaacatgt

SEQ ID NO: 35191 - DNA, 199 bp, Zea mays
  Clone ID: LIB3060-019-Q1-K1-B5
tgcatccctttacgtccgccacgctgcagcgcggcatgcaccctgcggtctctcccaagcccaagtcgcgcacgctcatggacgagatagcgatcgcagccacggaggagtaccactccttcgacttcaaggagccgcgcttcgtcgagatacttcacatcggctacaccgcagaccgagtaccgtaagatgaacatcg

SEQ ID NO: 35192 - DNA, 358 bp, Zea mays
  Clone ID: LIB3060-019-Q1-K1-B6
agaagagctattgtcaatcagcagagggtatttgctgttcaagtattcgagctgcataggttgagcaaagtgcagaagttgatcgctgcatctccacatgtacttattgagggggatccttgccttggcaaatccttggcggtgagcaagaaaaggctggctggagatgtggaaacacagcttgaatcagctaaaaacgatgatggcgtgcgaccaacgcagctagagcactcgaaagagaaaactgaaccaaaccaaccttaaccatttaaagacaaacaggccgaacctaatggtgactttcttgcctcaatccttaccctttccaccaccaaccagaaaacttgtgcctttcttg

SEQ ID NO: 35193 - DNA, 195 bp, Zea mays
  Clone ID: LIB3060-019-Q1-K1-C10
gcggatagagcagcgagccatcgacacgatcgcgagcgcaagcacgtacgttgtcggaagctcgggttagaagaagcaccagtgcctgatcgatggcgggcccaggctctcctttccggccgcaactgctgggcccgccccgtgcagtccggcgtctctaggtcgtccggcgacgaatgccccccttcgtcgtca

SEQ ID NO: 35194 - DNA, 224 bp, Zea mays
  Clone ID: LIB3060-019-Q1-K1-C11
ccggaccgacgagcgacgaagcgcgcagaaagagaagaacctcggagctgagatggcacaagcgatggcgtcgatgaccggcctctcgcagggcgtcctgcccagcaggcgcgccgacagcagaaccaggacggccgtcgtcatcgtcagggcgttcgcggagggcgacgccgttgcgcatgcgggccgtcgcgccgtgatcgggctggtggccactggcatcg

SEQ ID NO: 35195 - DNA, 327 bp, Zea mays
  Clone ID: LIB3060-019-Q1-K1-C12
caccaacctcaggacatcgaggagaagaggagtggccaatggcttcgtcggtggccgacgcggcgagcacattcctgggcacccgtctggcggacccggtgccagagaacgggcgcatcgtggcccggttcgggttcggcggctgaaagcccaatgctgccgtgccgaagaaggtggcgaagacgtcgatctcctctgaccggccgctgtggttacccggctccgtggcgcccgactacctcgacggctcgctggtcggcgactacgggttcgacccgttcgggctcgggaagcccgtggagtacctgcagttcgaactggactcgc

SEQ ID NO: 35196 - DNA, 333 bp, Zea mays
  Clone ID: LIB3060-019-Q1-K1-C2
actaggtctagatcgcaagggccttcctctttttcaccacatccttcttctgcaccgtgttccagcgaatttagaacacggcgctttattactacgaccgcataacaccaaactcgttattgacaaaactttcccacaccgccaaccatagcaccccatcaaccaggccctcatatacaacgacctcaacttcattaaaactaccaccctactcgcacttgcaactaacaatggtcttaccgtcatagataatacacgaacgctcgccctgggtaaccaggacaacccctgttaaaaagccgatgcccttaagaacttttttgccaggaccga

SEQ ID NO: 35197 - DNA, 405 bp, Zea mays
  Clone ID: LIB3060-019-Q1-K1-C4
ggaggaggggatttctcggggagcggagggtcggccaggacctgattgggctccagggcgcgagctttgagcgcagatttggtgcccgcgatctgccatggatttgatttaagatttagggagatcggtcgtgttcgcgtcgcgctgcgagattcgattttttatgtctgttttattcacgagattgcaagaacgggactgctaagcaagctaagatctcattttttttctggatcaatctcaaattaggatttaggaggaggaaataaagcaagaatagaaagttttttttttggggtgaaccctgatgcttgaaaggaaagtctaacttggttcgggctttttgctgaacttctgggagaccgaaacccaatgggcgtaccttgcccaccaagttcttggggg

SEQ ID NO: 35198 - DNA, 387 bp, Zea mays
  Clone ID: LIB3060-019-Q1-K1-C5
cttccgctcgaccgagaaaatcaaggatcttcgcacctaggagatcaagaacggacgcctggacatgctgggcatcatgctcgcttggttgcaagccgaatacaccgtctccggccccatcgacaaccttttcagccacactatcgaccctggccaacccaccattttccaggccttcacccccaaatcatgagctctgatgaacttggcagttcgaagagtgctaccacacatgcatgcattgttaagtttgatagccgatatggaactttttctttatgttagcggcagactactgggtagactgtcaacgatgatgatgaatatgatgaaatgttcgttgtgcgatgcatggtgtacttgtactatgttgcaactaatgtaaaa

SEQ ID NO: 35199 - DNA, 228 bp, Zea mays
  Clone ID: LIB3060-019-Q1-K1-C6
ggccagggaccaatcacagtcatcttctcccgttcacgtaacgtgcactagggtttatggtttagggcgacgcgccgccgtcctacgtccagcggccaggttttcttctggccctctgcgctgactacaacccaccacctccgggttaggttttggatttggagacatggcggaagtggtggacaagctcaaggactacgatatcaagaaggagggagaagcagagat

SEQ ID NO: 35200 - DNA, 420 bp, Zea mays
  Clone ID: LIB3060-019-Q1-K1-B11
gtcgatcgctgatcccaccggctgatagagttggcggccgtgggagtgagtcgtcagggatggcgtcggagcctgttgcgcggtcggtggctgaggatgtgggccgctggggcagcatgaagcagacgggggtgaccctgcggtacatgatggagttcggctcccggcccatccaagcgcaaccttgttctcttcgcgcaattgctgcacaaggggctccccattcggtttgggccgcctgccgctgaacctgaatcggttgcctttggccttttcaacaaggccggcattcttaaagttccggactggtacatggacttatttcgggacattaaattccttcctgaaatgaggagcctgaacgaccaactcgctttcacgcagatgatcaacatggtcaaagtgcggcatatcaatgtg

SEQ ID NO: 35201 - DNA, 429 bp, Zea mays
  Clone ID: LIB3060-019-Q1-K1-C9
cgctcctctccgtcgccggtggagctcatggcatcctccatggccgccgccgccaccgccaccgccctcgcgctgccgtccgggacgacgcagaggccgtctgcccagggccgcctcctcttcaccgccgcgcccgcccgctccctccgcctccgccccgccggccgccggtcggcccgctcctcgcctcgggccaccaaagctgtggtggcagcgttggctgatcctctcaagggcatgatatcaagagcttcggcgttccgcaagggcacacagtgcgagctcatcaagacccaatatcaactggcgcacatcttcgccggagatttgttgcgggccgagatcgctgctggctctgagaatgggaagcgggccaaggaattcatggagaaaggccagctcgtgcctgatgagattgtcgctaatatg

SEQ ID NO: 35202 - DNA, 449 bp, Zea mays
  Clone ID: LIB3060-019-Q1-K1-D1
agcaactagcaacacctcttctccttttacttcgcctcgcctcgcctcgccataacgacacgcgcatctccctacctcgatacgattcttcgtcttctcttccccgcgatcgcgccagcgcccccgaaaaaccctaactacctggagcctcgacggcacctgccgcaggcgacggcgagcgaccccaggcggtggtagacggcgcagcgggttgccccttgtggaggcggacggcacggcgcaggtccttgccttcccggctatgcgaattgcggtatgaagctcaagcggcgacgcgcggtagaagtgcctccaagtataaaatctttcatcaacagtgttaccactgttcctcttgaggatgtagaattgccgctgaaggattttgcatgggaatttgacaagggggattttcatcactggttggaccttttcaatcattttgattc

SEQ ID NO: 35203 - DNA, 444 bp, Zea mays
  Clone ID: LIB3060-018-Q1-K1-H5
atgggagggtctcatgacagcatggttacattggagaacagagtacgtggtcttgagagagttgttgagaaactgccccactgcatgtaggacttcatttgcaacctcatttgaaagttgatcaacaaccggtccagtttgctccatcaactttacaagtaattcagcatcaccagtcgaaagaagttcagcataagcagagtccatatcctcaagatgaacagcatccatcgcacgagtccaggcctcccaaagtgggcctctttcatccccttggttgtcatcattcaaagcttctccatccagttcaggaatagcaactcttgcagcggcccttgaatttccattatcttcaccagctactctaatagcttccagtgttgcttcatcttttgaggcccgccatgcacttcgggcagaaggaccctcaccgaacctaaaggg

SEQ ID NO: 35204 - DNA, 437 bp, Zea mays
  Clone ID: LIB3060-018-Q1-K1-H7
cgctcgaagctcctcccgaaccggccgtatcgccgccatggcagccgccgctcctgcaggctccgtgaaggaagtgctgccgtctcccctgacctccgcctccgagccccctccccttttcgatggcaccaccaggttgtacgtggcctatctttgcccgttcgcgcagcgcgcttggattgctagaaactacaagggtctgcaggacaagattaagatagttgccatcgatctcgctgacaggccagcgtggtacaaggagaaggtttatccagaaaacaaggtgccttctctagagcacgacaaccaggtgaaaggagagagcttggatttggttaagtacattgacagcaacttcgaaggtccatcgttgctccccgaggatcatgcaaaggcacagttcattgaggagctgctcggataccctgacgcattca

SEQ ID NO: 35205 - DNA, 373 bp, Zea mays
  unsure at all n locations
  Clone ID: LIB3060-018-Q1-K1-H8
tcgcctggaacaacgtgttcctcgtcccgagaagagtcgaggaaaaatctcgcattcgcaaaccaagcaaatggaggcatgagctccgccgcctncccgtctctcgccgatctcccccaaaccctagcctcgacctgaccgccagcgggcccgcaggccggagaaggagtcggaatcgcccccacccacccaccctctgccgcgggcggggagcgggcggcggacgagatgccgtcgcacggggatctggaccggcagatcgcgcagctgcgcgactgcaagtacctgcccgaggcggaggtcaaggtgctctgcgagcaggccaaggccatcctcatggaagaatggaacgtgcagcccgtgccgctgcccg

SEQ ID NO: 35206 - DNA, 280 bp, Zea mays
  Clone ID: LIB3060-019-Q1-K1-A1
caggccgcagtgatgaaactgtgtcaatgattgaagcatacctgcgagccaataaaatgtttgtggactacgatgagccttcaacagagagaatatactcatcttatcttgagctgaaccttgatgaggtggagcctagcatgtctggcccaaagaggcctcatgatcgtgtccctttgaaggaaatgaaatcagattggcatgcttgcctggacaacaaagttgggttcaagggttttgcagtgccaaaggagcagcacgataagggtgtcaaatttga

SEQ ID NO: 35207 - DNA, 307 bp, Zea mays
  Clone ID: LIB3060-019-Q1-K1-A10
gcgatccattccacacaaccaccactgctcttgccccagcccgccgcaggagttgccagatctggtccggtcacaggagctccgactccgagccctctccaatggcggttaaggtctacgtcgtgtactattccatgtatggacatgttggcaaactagctgaagagatccagaaaggtgcctcgtctgttgaaggtgttgaagctaaaacatggcaggtccctgaaaccctccctgaggaagtgcttggaaagatgggcgcaccccctaagcctgacgtgccagtcatcacgccgcaagaactcgc

SEQ ID NO: 35208 - DNA, 358 bp, Zea mays
  Clone ID: LIB3060-019-Q1-K1-A11
gtgacagttgtcatatgctcgtctcaaagatttagccatgcatgtgcaagtatgaactaatttgatctgggaaactgcgaatggattattaaatcagttataggtcggttgatggctcgtgctactcgtataaccgtagtaatcatagagctaatacgtgcaacaagaccccgacttgcgggaagggcgcatttattagataaaaagcttacccgggctcttcccggcgatccgatgattcatgattacttgaccgatcgcacggccttaatgccggcgacgcattattcaaatttctggcctatcaactttccatgggaagatatgggcctaccatggtggtgaccggtgacagaga

SEQ ID NO: 35209 - DNA, 299 bp, Zea mays
  Clone ID: LIB3060-019-Q1-K1-A3
cgaccgactcgaccgaaacagcctggatgcccgagctcggcttcgccttccaggtatatgtacctctgtgcaccagctaggtcatgggggtcctgctctaccatggacaggcccaactccgcgcgctcgccggatcccctgctaggcaccgactgccggacctcgtgctctcgtgatctcactactatgtgccgcatcgtcgtcagtgcctctggtgccttgcatggcgcgctgctcccttcaggctactcgcggtagccatctgctctgctcgaccactagactcttacatggtcatg

SEQ ID NO: 35210 - DNA, 154 bp, Zea mays
  unsure at all n locations
  Clone ID: LIB3060-019-Q1-K1-A5
ctttccgggacgaccgangcgagccacacgtccgcgatttgcgagctcggcttcgacctaccgctatctgtatgtcagtgcacgagctcgggactgctgggactgctctaccatggccgatgcccaacatcgtgcgctcgccggatcccctgct

SEQ ID NO: 35211 - DNA, 410 bp, Zea mays
  Clone ID: LIB3060-019-Q1-K1-A6
catatctccaagaaccaaaggtagctagctagccgcgactcgttggctagacgattcaagcagcggcgcaggatggtggcgccggtggtgattgcgtcggccgggctgggcatgctggccggcgtggcgatggccaaccggtccctcgggaacgggctcccggcggcctccaggtggaacgcgcgcccgcgctgcgccacgtgcggcggctctggccgcgtggagtgcatctgcaaccgctggtccgacggcgactccggctgccggacctgcgctgggtcggggaggatgccctgccgcagctgcggcggctccggcacgggccgaccgttccttgcgcggttcaccgtccagcaccagaagccgccgccgccgccgccaggctacaattgatcgatggtggatgatta

SEQ ID NO: 35212 - DNA, 378 bp, Zea mays
  Clone ID: LIB3060-019-Q1-K1-A7
gaaaagcatggatgccgaagccgccgccgtcgtcgagggccaggtgcggcactggaccgcggacgtcaacggcatttccctccacgtcgcagagcgcggcgccgtcgacgcgccggcggtcctcctcattcacggcttcccggagctctggctctcgtggcgccaccagatggccgcgctcgccgtccgcggcttccgcgcgctggcccccgacctccgtggctacggcgactcgtccgtgcccaccgaccccgccgactactccatcctccacatcgtcggcgacttggtcgcgctccttgaccacctccaactcacaaaggtgttcgtggttgggcacgactggggcgcgatggtggcgtggcacctctgcctgtt

SEQ ID NO: 35213 - DNA, 445 bp, Zea mays
  Clone ID: LIB3060-019-Q1-K1-B10
ctcccttccaattcgatgcctttgtagcgctgctgcctcgccgcgtcgtcgcgggtccccgatgtccgcttgctgctgcgcttccaacaccatggacggcgggggatccggcaatgcctccggcggcagcggcggcgcatcgacgtgctgctactacgcgctcctcggcatccgcaagaacgcctccgtcaccgacatacgcgccgcttaccggaggctcgcgatgaagtggcacccggaccggtgggccagcgaccccggcgcggccggcgaggccaatcagcggttccagcggatccaggaagcatactccgttctgtcggacaaggggaagaaagccatgtacgacgccgggctcttcgaccccctcgacgacgacgaccaggatttctccgacttcatgcatgagatgctggtgatgatggatagcgtgaaaaacgagaag

SEQ ID NO: 35214 - DNA, 383 bp, Zea mays
  unsure at all n locations
  Clone ID: LIB3060-053-Q1-K1-F7
ctcaccgatggcgagggttcgggacaggacggaggacttcaaagaggctgtccgagtcgccgcactctcccatggatacacggaggcccaattggccgcgctcatgtcttctttcatcatccggaagccgtcgcccaagtcaccgttcactaatgccgcaatcaagacgcttcagagcatcagggaactcgagaggttcatagtgaagcataggagggattatgtggatctgcatcgcactaccgagcaagagagggataacattgagcatgaagttggtgtttttgtaaaagcatgcaaggaacagattgatatcttaaagaacaggatccacanagaagagaagaatggaagtggaaagacatggcttggcactagggatg

SEQ ID NO: 35215 - DNA, 400 bp, Zea mays
  Clone ID: LIB3060-053-Q1-K1-F8
gtggggctagaaaagggaagcatgctgtgagagaagaatcacaccgggccgtgccgatgggtgtctacgagtagcagttgtatctcgctgacctcaccgcctgctgggcaccaaggaggagatgacttacccgaagcgggcagcatggcgggaagggtgcggatgcttggcctgcgtctacgcggggcctacgcggggcgtgcttgcggccggcggtgacggcggacggtgacagcagctgatcggccaagggcaggcacgttcactacgcatcagagacctgatatgtgaatgctagcaatcgggagctaggcgatcatcttcacacaaaacgccatggctaaaacggtgttgatgcatcaattgagaaggagacaccccaggtacttgagtttacctt

SEQ ID NO: 35216 - DNA, 413 bp, Zea mays
  Clone ID: LIB3060-053-Q1-K1-F9
ccgatcacggtaactgaatctgatgctttggatgccgtatagattgctcttcaggggggctcgtcggatgttactaccagggctatgtgtcttgtctctcttctgaagctttcttcccggtttccaccaacatcagagagaatacaagaaatagttgcgcaaaatacagggaatactgtgcttgaattgcagcaaagatctattgaattcagttccattatacaaagacatcagtcgataaaatcatctttgcttgaacgtatgcctgcattggatgaagcaaattatttggtgaagagagctgcttctacacaggctgctgtttcatctgtaaattctgcttctgcagtcacttctggatgcccacttaagcttgcaaatggcgtatcaaagccaccaccagcttctttagc

SEQ ID NO: 35217 - DNA, 313 bp, Zea mays
  Clone ID: LIB3060-053-Q1-K1-G10
gagcgctcgctcgatcctagctttcttccaagaagcgcacgcccatggccgggggaccaagcctcgcgcacgcgccactgctggccgcgctgggcgccggcggcgaaccgcggagctgagctcgcaactcaggctgacgtagtggcctgccgcgatccggcccacgtccgcgcgtgccaccgagaagcagctgaagcgcccaatgcgtttcgggtccccgcactggaccccagcacgccgtgcccgaccttcagcggcagaaccgacgggctgctacggaaggcgcatgaagaggagtgctacgtcatcacgt

SEQ ID NO: 35218 - DNA, 409 bp, Zea mays
  Clone ID: LIB3060-053-Q1-K1-G11
cgcttctcccgtcgtcttccccgctcctacgacctgcgtttgtcgatgctctctccatggcaccctctcctctcccccgttgcacctcctgccatggagctacggtcaccgctgaactcacataactgctcccttacctcctccattagaccaccgccaccgcgctccttggcgcgggcgccccccacgctttccgccaccgcagcggccgtctcgtcgctgtccgccacctcagcggccatctcgtcgccttcctgtccaaagaagaaggttctcgtgcccatcgccatgggtacggaggagatggaggcggtcatcatcgccggtgtccttcggcgggcttccgctgatgtgacgcttgcctctgtggaggacggcctcgaggtggaggcgtcctgcggctcccgca

SEQ ID NO: 35219 - DNA, 386 bp, Zea mays
  unsure at all n locations
  Clone ID: LIB3060-053-Q1-K1-G12
ggcgagcgcgtgccgttcctcttcaccgtcaagcagctcgtcgccaccggcaagcccgagagcttcggcgggcccttcctcgtgcccagctaccgggggttctccttacttgaccccaagggccgcggcggcttcaccggctacgacaacgccgttgcgctccccgccgggggcagaagtgacgaggaggagctccagaaggagaacatcaagaacgccgtcttctncaccgggaacatcacgttgagcgtcaccaagagcaacccggagaccggcgaggtcatcggcgtcttcgaaagcgtgcagncgtccgacaccgacctcgggccaatgcgccaaagatgtcaagatccagggggtctggtacgctcaactcgagtgattcg

SEQ ID NO: 35220 - DNA, 372 bp, Zea mays
  Clone ID: LIB3060-053-Q1-K1-G2
cgccgtcggccatgggtcaagcctggggtaatctccaagataggctccaagggcggcggtggaaggagcaccaggtgaggaagatcaccgacaaggtgttcgaccgcctcacggaggacgcccagaagcgcgacaaggaggccctcagattcgaggaggtctacatcgccgtcctctgcgtctacaatgacatcaacaagtacttgccggggccacaccacgaccccccgtccaaggagaagctcagggccatgatggaggagtacgacgtgaacctggacgggctcctggaccgcgaggagttcgcggagttcatccggaagctgaccgcggactcgctgtgctcgatcagcgtgaagctgctgatcacgc

SEQ ID NO: 35221 - DNA, 424 bp, Zea mays
  Clone ID: LIB3060-053-Q1-K1-G3
cccgcgtctcgccgcgtaggcgccacagaaactcgcacgccgctccccgccgtcctgcccgagtcgccgtcgccgccgaatccaatccatggctccgaccgcctcacccaccgcgctgcaccaccgcacgcccctcctactcccccgccgcaccgtcgccttgggtgccaccgtcaccgcgcgcgccgtcagggccgcttctctagccgtcagggcccagccggataccaccgctgcagccgtctgcacctgcgcgcctgagccgacgcccgagttcaagcctgcgccggggttcaaggcgcccgagcccaagaggttcgaggtcaagtccggccagctgggcagcgtcctcggcgcctcgctcgccatccccctacgcctcggcaccggcgtcttcgtcctcgggtactcgccatctgttgtt

SEQ ID NO: 35222 - DNA, 238 bp, Zea mays
  Clone ID: LIB3060-053-Q1-K1-G4
agctctcctgagaagcatatagcaccagcggaacacgggaacggcggaagcaaacaactagaaattccccagcccggttctttgcgtgcggttgatctcgtcggaagcccgggcgggggtccccaatccggcatcgaattccatggggggcaacggccggaattagatccggaacggccaactgggtcttcttggaaaagttggcccctgccaatctagcctgggtcttcgggttggt

SEQ ID NO: 35223 - DNA, 402 bp, Zea mays
  Clone ID: LIB3060-053-Q1-K1-G6
tcggttttgaattctcgactcaagcgtcccttccgtggttcattggtcatgccttgtttattttacaatatagctccaagcaccagggtggaattatcaccaagtgaggtagatcaccgactaagtgttcgaccagctcacggatgactcccagaagcgctacaaggagtccctgatattcgaggaggtctacatcatcgtcctctgcgtctacaatgacatcaacaattacttgcctgggccacaccactaccccctgtccaaggagaatctcatggccatgatgtaggagtactacgtgaacctagacggtctcctttaccagaaggagttcgccgagttcattcctaagctgaccgaagtctcgctttgctcgatcaacgagaagcttcttatcacgct

SEQ ID NO: 35224 - DNA, 245 bp, Zea mays
  Clone ID: LIB3060-053-Q1-K1-G8
aagtaaggaaggcctgaagacttcctttcacatctccagttactcccatacaggtaggtattcatagccactttcatcgaactaggacgatctcaccgacatgtaagcactaagcaacccaataggatcatcagaccctgcctgatgccaacgaacccaactacatcttcccttgcgacatcgtcgacattgtaaacttggcccgcatgcatacatacgcagcctcttacgagcgccaatggaca

SEQ ID NO: 35225 - DNA, 416 bp, Zea mays
  unsure at all n locations
  Clone ID: LIB3060-053-Q1-K1-G9
gattcgctcgctcgatcctagcttcccttccaagaagcgcagcgcccatggccatgtccacgcaagcctccgccgccacgcgccacctgctggccgccgcctgggcgccggcggcgaagccgcggcagctgagctcgcagctcgcgctgccgtcgtcgtcctcccgcgggccggccccgctccgcgcgttcaccgaggaggcggtggaggcgcccaaggggttcgtggccccgcagctggaccccagcacgccgtccccgatcttcggcggcagcacgggcgggctgctccgcaaggcgcatgtggaggagttctacgtcataacgtggacgtnccccaaggagcaggtgttcgagatgcccaccggcggcgccgncatcatgcgggagggccccaaccctttgaagctggcgcgc

SEQ ID NO: 35226 - DNA, 239 bp, Zea mays
  Clone ID: LIB3060-053-Q1-K1-H10
ggccagctctggtatcagggaaatctttttcttgcccttcaaccctgctgatacgaggactgctttgacgtacattgataccgatggcaactggcactgcttcagcaagggctctcctgaacagatctttgacctgtgccactgcaaggatgatctgaggcccatggtgcactctaccatgcgctagtataccaagcctggtagtccttcgcttactgctgccagaccggaattaccta

SEQ ID NO: 35227 - DNA, 378 bp, Zea mays
  Clone ID: LIB3060-053-Q1-K1-H11
cccacctcgacgcggcctcgctcctcgccccctcgccgccgctggcaaagccccacccgcgcagccgcttcctctgcctcatctcctccatgctcgccgtcctcggcgcctccctcgcgggtctcctcttattcgcgctccaccccgcgccgaacccggtcccgaactacgcgtcgctcttcctctacctcggatccaacgacaccgccgcctcgcacctacgagcgctcactctgcacccgcacgtcgcggggaccaaggcgaacgccctcaccggccggtacgtgttcgacgcgctctgcgcgctctgctttcccacccacattacgccttaatccggcctcctgtgctaacccgttcaacggttccttttccttt

SEQ ID NO: 35228 - DNA, 62 bp, Zea mays
  Clone ID: LIB3060-053-Q1-K1-H12
attccctgcgattcctctcccctcgccttctcgtctccccctaggggatcgtcggagaggaa

SEQ ID NO: 35229 - DNA, 397 bp, Zea mays
  Clone ID: LIB3060-053-Q1-K1-H2
acgctatgtacgtatgtgtagcagatggtttacatctacgtgttagaccaactccagcagcactccgcatgcggctccggatccctattttgcggagcctagctcactattcatcagtccagcaggctccgcatccggctccgtaaaacgcacggcctgtacctgcactccccatttccacgctttctctctcctctccgcagctctctgcgtgcgcgcgcggctgctcgcgggccccaggtgtcatagactgcatgcggagtgggatgtggagtgttgctggaaacggagactgatacggagaggagagagaaactgttggccgcgcgttttagggatacggagagggagtctgctggagttggtcttagagcccggagagctggagaagctagct

SEQ ID NO: 35230 - DNA, 313 bp, Zea mays
  Clone ID: LIB3060-053-Q1-K1-H3
aatttctaatgatggtgtcgatgcgactactgaacatcattctactgtagataattaccagacaagttaaaatggggctgaatgggttgagctattggtcagggagatgactaatgcttatgacatagataatgctcgggctaatgcgtccagagcgttctaggctttggcgatatcaatcgtatagcgttcaggatctgaatctacacataacctttatatggtaatcatgattctcaaagagctgctgactgttgaactgcgagagaacgctttactgaagcggtcggttgccattaaccatgagcttcta

SEQ ID NO: 35231 - DNA, 318 bp, Zea mays
  Clone ID: LIB3060-053-Q1-K1-D9
gcgaacattatcggattcatgtgttatttaagctgccctggatgggatacaaccgcgggaagcttggccggctatcattctcatcgtattcgcgccgtaccaagcaagaagcctgttgtgacgatggccttcctacattacttccaaggcaagacgtatgcacagacaacgaactcaaaagttcaagaattcagctcgcaatgagggactatgatcagtgtgacattaaaagatgcactggtcgtaaactttcaagatccgggcttgtgaacgagtcgagagtgaccatcgcgtttggaggagttgatctcagccctg

SEQ ID NO: 35232 - DNA, 414 bp, Zea mays
  Clone ID: LIB3060-053-Q1-K1-E11
cgttcctctcctgcctccagctctccacggtctctgacccgcacaactgaacccgcgatggcgcgccgcctcctcgtcgccctcctcgccgcgtcgctcctgctcccgctcgcccgcgcggactcctcctcgtccccgcccgacaccaccgcgtacgacgagctccgcctccggggcttcccgcgcggcctgctcccggccaacgtgcgggcctacacgctcgactccggctccggggacttcgccgtcgacctccgctccagctgccggatcgtgctgcccgcggggagctacctcgccgccttcagcgaccgcctcacgggccgcctcgacgaccgccgcatctcgggcctcgacggcatccgcgtcagggccttcttccgctggtggtccatcacggggatccgcgccgat

SEQ ID NO: 35233 - DNA, 398 bp, Zea mays
  unsure at all n locations
  Clone ID: LIB3060-053-Q1-K1-E12
cgggcctctcctgcctccagctctccactgtctctgacccgcacaactgaacccgcgggggcgcgccgcctcctcgtcgccctcctcgccgcgtcgctcctgctcccgctcgcccgcgcggactcctcctcgtccccgcccgacaccaccgcgtacgacgagctccgcctccggggcttcccgcgcggcctgctcccggccaacgtgcgggcctacacgctcgactccggctccggggacttcgccgtcgacctccgctccagctgccggatcgtgctgcccgcggggagctacctcgccgacttcagcgaccgnctcacgggccgtctcgacgaccgtcgcatctcgggcctcgacggcatccgcgtcaaggccttcttccgctggtggtccatcac

SEQ ID NO: 35234 - DNA, 419 bp, Zea mays
  Clone ID: LIB3060-053-Q1-K1-E4
ccgaatattgtcaagttcattggtgcgtgcaggaagccattggtttggtgtattgtgacggagtatgcgaagggtggatctctcaagaatttcttgagcaagaggcagaacaggtctgtcccgctgaagttggcagtcaagcaggcattggatgttgcacgtggcatggcctatgtccatggccttgggttcattcatagagatcttaagtcggacaacctcctgatttctggtgataagtccattaagattgctgactttggagtggctaggattgaagtcaagactgaggggatgacacctgaaactggaacataccgctggatggctccttgagaagtggcagttaagaagaggtggagcaatatgggacgaaggaagctttggtctcatttggttccatgaactagacccaacaa

SEQ ID NO: 35235 - DNA, 421 bp, Zea mays
  Clone ID: LIB3060-053-Q1-K1-E8
gtggctgactactgcgccatctactactccgacgacggcgcggtggcgagggacagcgagctgcaggggtggtggagcgaggtcaggaacgtggggcacggcgacctggcggacgctccgtggtggccggcgatggactgcgtctccgacctcgtggagacctgcgccaccgtcgtctggctgagctcggcgtaccacgcgtccatcagcttcgggcagtacgactacctgggcttcgtcccgaacgggccctccatcaccacgcggccggtgccgggcccggacgccggggcggaggtcacggagtcggacttcctggcgagcgtcacgccggtcaccgaggcgctcggcttcatgtccatcgcctcggggccgatggggctcaagggcacggaggtgtacctggggcagcgcccggaca

SEQ ID NO: 35236 - DNA, 176 bp, Zea mays
  Clone ID: LIB3060-053-Q1-K1-F1
tcgacggattcgcgctcgacacctcggcgctcctcgtctcgggcgcgagcgctgagggcacgcccaagatgctgacctacgacgagatccagagcaaaacgtacatggaggtgaaaggcacgggcacggcgaaccagtgcccgaccatcgacgggggcgtggaatcgttcccgttc

SEQ ID NO: 35237 - DNA, 354 bp, Zea mays
  Clone ID: LIB3060-053-Q1-K1-F10
gtgttcttgtatccctgctagtgttgtctctctcccacatccaccaagtctgctctgtgcagataatcaattgccagtgttgaccattctcacatttctttaccctaccttagccagaacattctacgtagttgctggcctatatgatacttgctccatattcatgtaatactttcctgaagttgaagaagatatctatcatagttgagttccattattcatagacatcagtcgatcaaatcatatatgcttgaacgtacgcctgccttggatgaatcaaattatttgattaatagagctgcttgtacactggctgctatttcatctgtaaattatgctcctgcactcacttat

SEQ ID NO: 35238 - DNA, 402 bp, Zea mays
  Clone ID: LIB3060-053-Q1-K1-F11
attctcaagtgatattttggtgtagagcttgaccaggttcagtgtttctttggacagtgcatgtgagccagcaaagtatatgtgcatgggagccacgttgagttgctcctgcagtgctgctgtgctggcatgccccaaaattcatgttcaccaagttgtggtcgagttccatatgcctacctacataatcagtgatgcctgcccatatatatacaaccctttggttgggctcagtgaaggtctcctccctgctcacgaattatttccaaagattactgtagggtgttgcgtcgcatgtgttcctgctaggatgaatcttctgcccagtctgtacatcgatctgcttaagctggtatgtgccaccccatgtgctggttaccacgcgtgcagttataccagctc

SEQ ID NO: 35239 - DNA, 330 bp, Zea mays
  Clone ID: LIB3060-053-Q1-K1-F12
cacagcaatccacacaagcacttcgacgtcacacgggcgctgcacacagacacaccaagcgtcggcaccaatggcttactaccaggaggtggactactgctcggaggaggtgaggtcggtggccccggccggcttcggccgccacggcggcggcgtccagcagcacgtcgtcaaggagaagttcgaggaggtcgacacggtcgcacgcgccggcgccaaccaccaccaccaccatggtcaccacggcggccacggcttcgtggtgcgcgagaccagggtcgaggaggacatcaacacctgcaccggcgaggtccacgagcgcatggagag

SEQ ID NO: 35240 - DNA, 209 bp, Zea mays
  Clone ID: LIB3060-053-Q1-K1-F4
tcccgctcgactccactctcctaccaccgtcactcatcacatcacagctactcgagagagagagagagagaaagatgggtggttcttacaccacctacacttccagcactttcactctatgtacaaccctaaccagatactcaaaataactctacagtctaaccctaacaactgacatggcttacaataccaaactcttatttttcaat

SEQ ID NO: 35241 - DNA, 56 bp, Zea mays
  Clone ID: LIB3060-053-Q1-K1-F5
ggcatcaccgtcgcgacgacgatggcagcctcgctccaagccgcggccaccctgat

SEQ ID NO: 35242 - DNA, 439 bp, Zea mays
  Clone ID: LIB3060-053-Q1-K1-C2
cccgtcccgactccactcgttcgacgagagaactcctctgatacgtagtttcactttcccaagctagccattccttctgtgtaggcgtctccagcccatcggcgcaccctaatatacctacatctattgctaacacctcagatctcaaacgctagccaggtaaaatgccaagatcaaatcaaatgttcacggcaaattctagaatgatggcggtatttagtgccttgacatcgaatccagagcagctgacattcgacgaaaccctcatatttgtcaagaaagtgaaggcccgcgattacatgctatacctgtcattgttcgacattctttgcataatggaactatcccagctcgatgcctaccgagagttacagctgctgtttggaaaccacccggatctgtgcgaagagctcgagaagttcatgccaccggtgcctac

SEQ ID NO: 35243 - DNA, 266 bp, Zea mays
  Clone ID: LIB3060-053-Q1-K1-C3
taaccataccttatcataacacaaagtagagtctcttcaaatactaataacaaatttgctcatcgtctcaaaatccaccagaattcattataccagtactctcacatctaaacttaaaatatatctacatctactatacatcgattaagagtcatggcctgcaccataccaatgtccacctacatcaactctagctcctattaatccgactaccagacacatccttaatacacaaaaatagcacgaagcatcttcagacatgtata

SEQ ID NO: 35244 - DNA, 365 bp, Zea mays
  Clone ID: LIB3060-053-Q1-K1-C4
caacgactcccggctccactgtcgctctcgctcccttccctcccacgcaatggtggcgcgatcgcctccgcctcgcgctgctgctctacgcgtgcctctgctccgcgtgggcgcgcccacgcctagagccgaccatccgcctgccgtccgagcgcgcggcggccgacgaaacggacgacgactccgtcgggacccggtgggccgtgctcatcgacagctccaacggctactacaactaccgacaccaggcagacatgtgacatgcatacaagaccatgaataacggcggacgtaaggactagatcacagaatggaactattacaactacatgcctaccaagagggacaaatgctaggtggaaacc

SEQ ID NO: 35245 - DNA, 390 bp, Zea mays
  Clone ID: LIB3060-053-Q1-K1-C5
cctcagcccactcctctcgtgtacgctagctcccagtcactggaaatccccgagcacggtcaccggcaccgacgagttgagccccgacgtggccatcccttctcagaacacaaagaagagtataatagaagaagaagaagaagttgttcctccaactgagaatcctcccgtggagaataacttttactttgacatctgtggtgaaaaagttgctattcctacgacacatggattgagagtcatggcgggcaccacaccagggtacacctacatcagcgcttggccattggaaaccgcccaggagacatcaccggggtacacggaaatcgttcgaggcatctcgaggcgtgtatgaggaccattggatacaaaattgctcaccggagttct

SEQ ID NO: 35246 - DNA, 420 bp, Zea mays
  Clone ID: LIB3060-053-Q1-K1-C6
cacaacaccactccaccgccgttcgaatattccaagcttgagattggaggaggggaggggaggggagccgagcgcagaaccctaattacctccatcgattgctaacagctcagatctcagaggcaggggaggtaaaatgccaagagcaaatgaaatgttcagggcagattctagaatgatggtggtttttggtgccttgacatcgaaaccagagcagctgacattcgaagaaaccctcagatttgtcaagaaagtgaaggcccgcgattacatgctatacctgtcattgttcgacattcttggcagaatggaactatcccagctcgatgcctaccgagagttacagctgctgtttggaaaccacccggatctgtgcgaagagctcgagaagttcaggccaccggtgcctacaaagcaggc

SEQ ID NO: 35247 - DNA, 417 bp, Zea mays
  Clone ID: LIB3060-053-Q1-K1-C8
gcgcacctgttcaagaacagctcgggctccaaggtcttgagctggagccagaggtttggcatcgcagttggcgtggccagggggctgtcttacttgcacgagaagtgccgggagtgcatcatacactgcgacatcaagccagagaacatcctccttgatgaggagatgggcgccaaggtcgcggacttcggcatggccaagcttgtcggccacgacttcagccgcgttctgaccaccatgcggggaacgatgggctatctggcgccagagtggctcgcgggcgcgccggtcaccgtcaaggccgacgtgtacagcttcggcctgctcctgttcgagctcatctcgggacgccggaacaacggctcctcggaggcagggtccaactccgctgtgtacttaccggtgcacgccgccgtc

SEQ ID NO: 35248 - DNA, 92 bp, Zea mays
  Clone ID: LIB3060-053-Q1-K1-C9
aggagaagtgcaaggaatcaggctgccttcatggtcaatggtcactcggtacagtgcgtcaggctctatggtgagatcaccataattggatt

SEQ ID NO: 35249 - DNA, 413 bp, Zea mays
  Clone ID: LIB3060-053-Q1-K1-D1
cgagaaatttactccttcggctgaagacctgccaggtgccttcgagcatatcgaaggtgaaattgatgactgaaagggaattaggcttacacctagttcctaattaattttggtggttgaattgcccaacacaaacaattggactaactaagtttgcccaagtttatagattacacaggtgtaaaaggttcacactcagccaataaaaagaccaagttttggattcaacaaaggagcatagtgggaaccgaaggccctctagtctgagagcaccggactgtccggtgtacaccggacagtgtccggtgcaccagaggactccagctccaactcgccaccttcgggaatttccagaggcgactccgctataattcaccggactgtccggtgtacaccggacagtgtccggtgcg

SEQ ID NO: 35250 - DNA, 438 bp, Zea mays
  Clone ID: LIB3060-053-Q1-K1-D11
actcggtcggaattcccggcgaagctttcgcaagctggccagctagctccctaccgactttattctcgaggagtgacggatcaggatgggaggggggacctcgagtgtggcggcgaagatggccttcttcccgccgacgccgccgtcgtactcgctggtggaggacgccggtgctggggtcaccactctcagcgtccagccgcaccgggagaacgtcgagttgctgcgctttcgcacccacacagggaacacgctggcggcgatgtacgttcgccacccggacgcctcgttcacagtgctctattcccacggcaacgtcctggacctgggccacctctaccagctcttcctgcatctagtcttcaacctccaggttaacatcctcgggtatgactattcaggaaatgggcaatcatcaagaaaggtatgatcaaatct

SEQ ID NO: 35251 - DNA, 269 bp, Zea mays
  Clone ID: LIB3060-053-Q1-K1-D12
ccggcgaagctctctcaagctgggcatctagctcattacctactttactcctacgagatacggatcaacatgggggggggtaccttaagtatatcggcgtcgattaccttcttcactccgactccaacctcgtacgctctaatgcatgacacatcacctccattgaaaaaactcagcacataacaggacctcaagaacttagtactgctcctcttcatcacccactttggtaacactcatgctaaaatatacgctcgccacacactctc

SEQ ID NO: 35252 - DNA, 357 bp, Zea mays
  Clone ID: LIB3060-053-Q1-K1-D2
cttgcaaaaccgtatttgcgatccacacctagcaggcgaggttagcactcttcctggggacatggatgactaggagcacgatgtgttcagacataagatttaagttgacggcgaggacgtattcatggatgccgacgactatgctacctaactgcacgaacttgtctatatgaaacacctgctcaaggatatggatgaggaggtcgacagactacgtgagatgcacgccaagggtgcctaggagataccaggtgtacattagtatgcaagcacatgtgtgtacagtgtagagatggaatctgggccagcatcattggaaatgttgtctatgcgtgcactttagaagatatgcagaag

SEQ ID NO: 35253 - DNA, 342 bp, Zea mays
  Clone ID: LIB3060-053-Q1-K1-D3
cttgcaaaaccgtatttgcgaaccactacttatcagccgacgttagcactcttgctggggccattgatgactaggagcacgaggtgttcagccataagatttccgttgactgcgaggacgtattcatggatgccggcgactatgccacctaactgcaggaacttgtctatatgaaacacctgctcaaggaaatggatgaggaggtatacggactccgtttgatgcacgccaagggtgcctaggggatacaaggtgtacattcaaatgcaagcacatgtactttcacatgtacaatggacagtgggccatgatccattggaaatgtggtctatgcctgcactt

SEQ ID NO: 35254 - DNA, 418 bp, Zea mays
  unsure at all n locations
  Clone ID: LIB3060-053-Q1-K1-D4
caacaagagatcgatggcctctgccaccgtgctcaagtcctccttccttcccaagaagtccgaatggggcgccaccaggcaggccgtcgcgcccaggccgcccaccgtctccatggtcgtccgcgcctccgcctacgccgatgagctcgtgaagaccgcgaaaacgatcgcgtcgccggggcggggcatcctggcgatggacgagtcgaacgcgacgtgcgggaagcggctggcgtccatcgggctggagaacacggaggccaaccggcaggcgtaccgcacgctgctggtcacggcgccgggcctgggccagtacatctccggcgccatcctcttcgaggagacgctgtaccagtccgncgtcgacggccgcaagatcgtggacatcctggcggagcagggcatcgtgccggggatc

SEQ ID NO: 35255 - DNA, 416 bp, Zea mays
  Clone ID: LIB3060-053-Q1-K1-D5
gcgcaacccaacccgccgttcctccgcctcctcccgcacagcaaaatggagacctgcgtcctccccaccacgctccccaccgcaaagcccctcccggcattccgaacccacgctgtagccgcatcgaaacttccccaacagcgccctcgccgctgcaccatacgcgcggccatcacccgtggccgcaaggaggagacggtgaccaccgtccgggagcagctggagggctgctacctcctggctggtatcaagtacgagggcctgacggtgaagcagctgcagggaatccgcgacgcgctcccagagacctgcagactgctggtggcgaagaacactctggtggggaaagccatcgagggcaccccctgggaagcgctcaagccgtgcatgaagggtatgaatgcctggctcttcgt

SEQ ID NO: 35256 - DNA, 343 bp, Zea mays
  Clone ID: LIB3060-053-Q1-K1-C12
tgatatcttttaatcacttgttgtacagtaccaagaaaattgattcgggggggcaattctatgacaagcttcttgtcaatcaacagaatgagaactacctgatattcgatgatcgatcacataatctaaaagacaactgtgtctacaatactatgaccccttctggacgaatctaacaggatgagatcaacctattgacagcattcacaatcattaccaagtctgcatggatcttcaccagtaagcttgtgacttcatttgaagaccattcgctctggcataattattgctgcaccaccgatagttacatcatgagcgatcagtatctcagtatctagtactg

SEQ ID NO: 35257 - DNA, 412 bp, Zea mays
  unsure at all n locations
  Clone ID: LIB3060-018-Q1-K1-G10
ggaacttaaaagaagctntggaggtcaagctgctaatctagtgaagtctgctggaaactctgctgcgactcttattgaactgattactcgacattttcctggtttccgggaccattcactctacaaggggcaccacgttttcctgtacaagagagcccagatctttgttgctgatttgtggggcgccttcaagggacaaaactatggcgagttccacgatatcaattccatcaccatatttgctgactacattgttccagcggtcctgagggagcttggagtacttaaatatggctcgaatctatcttgctccatcgactcgaacagtgagatagtgcctggaagcgacgaggaagtggagatacgcgcgtgctccatctatgcagtggagaagatgacggacctgatcagc

SEQ ID NO: 35258 - DNA, 369 bp, Zea mays
  Clone ID: LIB3060-018-Q1-K1-G11
gaataatctcggtgtcaccatcattacaggcactttcatccttcaaaacaatgccgtgcctcatgaccagcgaggcgctgcgaatggactgtccatgactgggatgtcctttttcaaggcacttgctccagcaggagcaggcattgtgttctcatgggcgcagaaacgccagcatgcgtttttcttcccaggtgaccagatggtattcttcctcctgaacgccgtcgagctggtcgggcttctcctcacgttcaagcccttcctggcagtaccagagcagtacgattcgagatagttagacgatctatctatctatacaagttctggaacgttcaagacgattcatcgtgtgcggctgtaccattgaag

SEQ ID NO: 35259 - DNA, 439 bp, Zea mays
  Clone ID: LIB3060-018-Q1-K1-G2
accgactcaaccccgacggaacgacaccaagtcaaggacctcgaaagggcaccaatattggccggcgtgaactccagcgtcgtcgggctcaagcccgccgcggcagtgccgcaggccgacgccggctcatcgtcggcgaagcgagtgcagctggccgcgcccgagggccgtcgcgccgctctgctcggcctggcggccgtcttcgccgtcacggccaccaccgggtcggccaaggccacgatcttcgatgagtacctcgagaagagcaaggccaacaaggagctgaacgacaagaagaggctggccaccagtggagccaactttgcgcgcgcctacaccgtggagttcggcagctgccagttcccctacaacttcactgggtgccaggacctcgccaagcagaagatagtccccttcatcagcgacgacctcgagattg

SEQ ID NO: 35260 - DNA, 444 bp, Zea mays
  Clone ID: LIB3060-018-Q1-K1-G3
accgaatctagcccgcacgacacgacatttagttgaggagctcgagagggcaccaatagtgggcggcgtgaactccagcgtcgtcgggctcaagcccgccggggcagtgccgcaggccgccgccgcctcatcgtcggcgaagcgggtgcagctggccgcgcccgagggccgtcgcgccgctctgctcggcctggcggccgtcttcgccgtcacggtcaccaccgggtcggccaaggccacgatcttcgatgagtacctcgagaagagcaaggccaacaaggagctgaacgacaagaagaggctggccaccagtggagccaactttgcgcgcgcctacaccgtggagttcggcagctgccagttcccctacaacttcactgggtgccaggacctcgccaagcagaagatagtccccttcatcagcgacgacctcgagattgagtg

SEQ ID NO: 35261 - DNA, 434 bp, Zea mays
  unsure at all n locations
  Clone ID: LIB3060-018-Q1-K1-G4
ggatccttgggcatctctgggaaaggtgtggtccaggcctgagtcaatctccttagcctccgcgtcggttttgttcagttcatcaagtgccattccattgtctggtactctggtgccacagcaaccatccttccacctcgccgtggtcagagcatctcgagaagtttgttacccagaacggagttgcgccaccgcagaccggagccgtgaacagcctctgtgttgaccgaacaactcacgctttctccggtcgattccttgtgagcaccaaagtttagaactcctaccagaaggagtgaagattcaagctgaagtggtgactgaagaggagtctactccagtggctgctgatcaagtggaggagccatctaactggggtttaatagagggatcgagtacctcttcactgcaacanaggtgatgaggagtattct

SEQ ID NO: 35262 - DNA, 443 bp, Zea mays
  unsure at all n locations
  Clone ID: LIB3060-018-Q1-K1-G6
agatgaggagggctggaccggagaagagtttgacagtcacgttgtgaaggagcgtgagggaaagcggcctattttaactggtgatctacaagtcacactaaaagaaggtgtgggaacaattggggagcttacattcacagataactctagctggataaggagtaggaaattcagacttggcttgaagattgcctcaggattttgtgagggtgttcgcattcgtgaggcaaaaacagaagcctttatggttaaggaccatagaggagaattgtacaagaagcactatccacctacactgaaagatgaggtctggaggttggaaaaaatagggaaggacgggtcattccataagaggctgaacaaatctggaatatctacagttgaggatttccttaggcttgtggttcgggatccacaganattacgcagtatacttggaagtg

SEQ ID NO: 35263 - DNA, 429 bp, Zea mays
  unsure at all n locations
  Clone ID: LIB3060-018-Q1-K1-G9
gataatccgtacgccgtccccttgcacagcaaacatccatggcgactgcccgcttgccctctcgctccctcctgtccccggctcagcaatcctatccacggcttcccgcctccgtccgcctctgcctctctcatcacgagcaacctcccaccggccccaagcggcaccgacgcgccgccacttctcatcctgccttttctgcagccgcgcggggtcgtgccaagaagattcccatcgcggacaccgatgagcccgccgccggagtccgcgtcaccgatcacggcatctcttaccgcctcgatggcgcgccatttgagtttcagtatagctacactgaggccccacgcgcacgccccgtagcgctccgtgaggccccgttcatgccgttcgggcccgaggccacgccacgcncgtggacgggaggaagcc

SEQ ID NO: 35264 - DNA, 448 bp, Zea mays
  Clone ID: LIB3060-018-Q1-K1-H1
gggtgagaggacccggacccgcgacaacaacctgcttgggaagttcgagctctccggcatcccaccggctcctcgtggtgtcccccagatcacggtctgcttcgacatcgacgccaacggcatcctgaacgtgtctgccgaggacaagacgacggggcagaagaacaagatcacaatcaccaacgacaagggccgtctgtccaaggaggagatcgagaagatggtgcaggacgcggagaagtacaagtcggaggacgaggagcacaagaagaaggtggagtccaagaactcgctggagaactacgcctacaacatgcgcaacacgatcaaggacgagaagatcgcgtcgaagctggctgccgacgacaagaagaagatcgaggacgccatcgacgcggccatcagctggctggacgccaaccagctcgccgaggcggacgagttcgat

SEQ ID NO: 35265 - DNA, 385 bp, Zea mays
  Clone ID: LIB3060-018-Q1-K1-H10
ttcccgggagaattctcaattcatgagtcgtacggagggacttatgtcacttcatacagaaactaaagcaagtgttggatggaaagctggtgtcaaggattataaattgacttactacaccccggagtacgaaaccaaggatactgatatcttggcagcattccgagtaactcctcagctcggggttccgcctgaagaagcaggatctgcagtagctgcggaatcttctactggtacatggacaactgtttggactgatggacttaccagtcttgatcgttacataggacgatgctatcacatcgagcccgttcctggggacccagatcaatatatctgatatgtagcttatccattatacctatttgaagagggttctgttact

SEQ ID NO: 35266 - DNA, 437 bp, Zea mays
  Clone ID: LIB3060-018-Q1-K1-H12
ggattccgggtcgcccagcgtccgaaaaaaaacaaactacaaaagaaaaaattaaaaaataaagaaaagagaatacaaaaatggaaacgggcccagacctccactggggtgaaacccttgcatactgagcaggctgcagcagggcatgtcaaaacgggctccgatttagaccgcattgtccgttgcattgccacactctttgcacgacatctactggatctggatacatcttattctacctccaccagaaggatcactccaaattcaaaagaaagggttaagaccatctctatgaccccaccttgaatatgaccgaatcactatgtgggttcgaactggtccttacacattgggacaacaggcaactcctcatcaaatcacaccgtggtgaagttgctaaacctgaccaatccaaggcgattaatgatgaagggatg

SEQ ID NO: 35267 - DNA, 447 bp, Zea mays
  Clone ID: LIB3060-018-Q1-K1-G1
gttgactaagacagatgagcttgtttttgttctagcagcaacaaatttaccatgggaattggatgcagcaatgctgcgtcggctggagaagcgtattcttgttccattgccagagccggatgctagacatgctatgtttgaagagctcctgccatatacacctggcacaatggagattccctatgatgttcttgtggagaaaactgaagggtattctggctctgatattcgcctggtatgcaaggaagcagcaatgcagcccctaagacgggtaatggcagttcttgaaggcaggaaagaagaggtccctgagggtgagttgcctgaagttggcccagtaactacagaagatattgaacttgctttgaggaatacaagaccgtctgcacatcttcatgcacatagatacgaaaagttcaaccaagattatggcagtcatgtacatgg

SEQ ID NO: 35268 - DNA, 83 bp, Zea mays
  unsure at all n locations
  Clone ID: LIB3060-018-Q1-K1-E12
ccccgaggagtcggaggatgagaagcgcgagcgtgtncgncgcgagctccagaagtatcgaaggagcaagcggataagaggga

SEQ ID NO: 35269 - DNA, 434 bp, Zea mays
  Clone ID: LIB3060-018-Q1-K1-E2
aaagatcatacacggtttacagggtatggtgggtggaaaggggcgagtttggcgcagacgctgctatagtaaccgtccctctcggggtactcaaggcaaacatcatcaagtttgagcctgagctaccgaaagagaagctctcggcaatcgccgaccttggcgtcggtatcgagaacaagatagctctcaagttcgacactgtgttttggcccgacgttgaagtgataggtagggtggccccgacgtcaaacgcctgtggctactttctcaaccttaacaaagccacaggaaacccggtcctggtgtgcatggtggccggaaggttcgcgtacgagatcgagaagctgtcggacgaagagtccgtgaacttcgtcatgtcccaactcaggaacatgctgccgcaggcaactgacccggttcagtatctggtctcg

SEQ ID NO: 35270 - DNA, 463 bp, Zea mays
  Clone ID: LIB3060-018-Q1-K1-E3
cggattcccggtcgaccacgcgttcggccataccttgagcttcaaagcattgaagccaagaaccctgcaactgcaacaagccctgacgcttaatacatcggccgggacttgatcggcagcagatcaaagattgccgccgacgaaggggagaaggcgaaaaaccgccgccgccggcaacaaaataacggtgttgcggggcttgacgttgcgcgggacatggggcggtggtacgagatcgcgtcgttcccgtgccttttccagacgtcggacggccgcgacacgcgcgccatctaccggctgctggaggacggcgccacggtgcacgtgctcaacgagacgtggagcaagggcaagcgcgactacatcgagggcacggtctacaaggccgaccccggcagcgacgaggccaagctcaaggtcaagttctacctgccgaccttcctccgcatcgtccccgtcgtcg

SEQ ID NO: 35271 - DNA, 443 bp, Zea mays
  unsure at all n locations
  Clone ID: LIB3060-018-Q1-K1-E4
gcctcctggccctggccctggcccggcttcctccgggggaccacttcctcaaccttggcttccatagcaggctagcagctgaccgaggtcaactcttccgccggcggaaagagagggagggagcggggaagagacgggagggtctccgcgcacctgccatcagccaccacccgatacccaggtcttgtcccgcgcagatctgctgctgcccttgagatctaaatcaaagcttccgctccggttgttgtcggttggtcggtacctgggcggcggcggcggcggcacgggaggacagcgaacatgtcgtcgagcacgatccggaaggccctgngcgcggtgaaggaccagaccagcatcagcctcgccaaggtcactagcaacatcgcgcccgatctggacgtgctcatcgtcaaggccaccagccacgacgacgagccggccga

SEQ ID NO: 35272 - DNA, 387 bp, Zea mays
  Clone ID: LIB3060-018-Q1-K1-E5
aggaggggcgcacttgactttcccctcctcctcctgcgagcaccttcctcgcctcgctctcatggcctcatcagagcctatagagtgccaggttgtggcgctgagggtgtcgattcactgccaaggatgcaagaagaaggtgaagaaggtgctccagaacatcagcggcgtgtaccgatgcgaaatcgatgcccggagcaacaaggtcgtggcgacggtctcgacggagctcgacccctacatgctggtcgccaagctgcgcaagtccggcaagcaggcggagctgtggccggagcagccggtgcagcagcaggagcagccggcaccagtaccaccagctgagagccaaaagcaggaggagcccaagaaccaaccagcctgcgagcc

SEQ ID NO: 35273 - DNA, 443 bp, Zea mays
  Clone ID: LIB3060-018-Q1-K1-E8
gggactgattatgggtctgtaagagtaggcacttacatgggccgcaagatgatcaagtgtgctgcatccaacctactttcagaattgttgctctcgtgtacgtctacgcaaccaggcgactcaagtcccgacgaatatgaaggacatggcgtcgacctcctgaaatctgaagcgtcaatggagtatctatgcaacttaccaccacataggtatgaagctgttttcgcgaaagaaattccggagacgatcactggcgatgcgtttttagagaagtatggagaccacaacgatgcggtaacagaagttgacccaaagcggtcttactgtgtcaaggctcctactagacatcccatatacgagaacttccgagtcgaggccttcaaagcgttgctaacagctgccaaaacagacgagcagctctcagcccttggagagctgatgtt

SEQ ID NO: 35274 - DNA, 439 bp, Zea mays
  unsure at all n locations
  Clone ID: LIB3060-018-Q1-K1-F2
gaggactgctcccgcgcggcgtggaagtcgtccaccctggagaagtcgaccggcctgctggaggcgcggctgtcggcgccgtgctacgccacgtacgacaacggcgaactggcctacttcgacaacgtggtgcgcggcaacctcagcaagggcgcgctccgaggcgtggagggcctctcccaggaggagctcttcgtctggctccccgtcaagggcatcctcgtccaggaccaggaacccggggtcatcctgttcgacatcgggttagcccacaagagcctgtcgaggtcgctcttcgaggacccgccggactgcaagccgtcggcctccggcgggatgagcgccgnctncgccgccaggagggagggcacgcaaggtgttactggactacggttgangcgagagatggcagcagcaggcagcgaccagagtcaggagc

SEQ ID NO: 35275 - DNA, 462 bp, Zea mays
  Clone ID: LIB3060-018-Q1-K1-F3
ccggattcccggtcgaccaagcgttcgggcgagaagagccgcccggcggttagtcattcgggaccccgaaaagggaaaggctaattgatggtccgtcaacggaactttccttccttatcttttacgacccggttaacttagcccggcccttctatagccccccttacggtcgccgaacgataagcacctttccggccgggtccgtcgccggatgagctccgcggcctattgcctccgacggccaggcctcgcgagcaacaggagacgttggtggatcacgagaggggtcgctttaaacgtggacccgttcctcgtagaggcgctcgacaacccttgccaacggctcatggttctacggatggaactggatatacgaaactttatgcagaaccctcagctgcaggagttcgaattccagaactttccgacttcttacctacgctgtgctgctcatcgtgttgc

SEQ ID NO: 35276 - DNA, 468 bp, Zea mays
  unsure at all n locations
  Clone ID: LIB3060-018-Q1-K1-F4
ggaatttcccgggntcgtacccacgcccgtccgttcgctcttccaccagcaggccacccgccggctgttccaaccctacagccgtggcctaccatcgttgcccccggaaggctcaaccttccttcccgggggcggcctccctcctcccaaccgtccgtacccccacttcttccccagccgacctctggccgccgccacccccgagccggcgagctcgggctccctccggccgcctccatcccttccccgaccggcgccttcctgctncccttgccggcgagcgcgggctcaagcgcgccccgactagccggctgctactgctcgacgccggatgggggagacgacgcgacgctcgctcgtggactggcgcccatgggacgaagctgcggactccctcgatcggccaccgtcgtgccctctctgggcgcgcccactactgcggtgcccgtccagctgccagggacgccc

SEQ ID NO: 35277 - DNA, 402 bp, Zea mays
  Clone ID: LIB3060-018-Q1-K1-F5
gtcaagttggaaaacaagaatggttcaacatcacacaagaaaaacggtttctcaagaccactcttgaaatgtgcagaagaggtcctactgaatggcgatgttgcaagtacatctgggaaatccattgcaagcttacaggtggaagcatctgatttggcaaacttccttaccatggatcggaatgggggttaccgaggttcacaaactcttctaagatctgtattatcagagaaacaagagctgtgcttctctgttgtctcattgctctggcagaagctcatagcttcttctgaaatgcagatgtctgcagaaagtacatcagctcaccaaggatggaagaaggttgttgatgcacttagcgatgtcgtttcagcctctccaaccatggcatcagctgctatc

SEQ ID NO: 35278 - DNA, 437 bp, Zea mays
  Clone ID: LIB3060-018-Q1-K1-F7
ccagtccactcgcagtcgcagctagtccggtccccggtccgacctatcccagtgacaccatctatcgtcggtcggggacgatgaggccggccgcgctcttcctcgccgcggtgctggccagcgtcgtcctcctcctcgccgccggccgcgccgcgggcgacttctcggccctggcgccgtgcgatgtgacgcagctgaccccctgcgcgagcgcgttcgcggggaaggcgtcgcccacggccgcctgctgcgccaagctcctgtcccacgggcccggctgcctgtgccggtacaaggacgacgccagcctgaagcgcctcgtcgacgccaggcacaagcgcagggtgttcaccgcgtgcaaggtgcccgtcccgagttgctagccgtactcctagtcctccaagctcatccgtcggccgtcggcgcaagcagccacg

SEQ ID NO: 35279 - DNA, 431 bp, Zea mays
  Clone ID: LIB3060-018-Q1-K1-F8
gaattggtagaacctagagtcgcctggacgcctaggcgtcgcctaggcgacgccataataaccttgcttttcagtcattggagtatattttggttcttgtgttttactgcatatctgatttttgttcccaatgcatcatacatatctaggttgcagctgttttgtgtggatataaaatgagacctgaatggtttgaataaataaaacaaagttaggagtccccgctgattgctttgcaatttataatgaaggaaatttatctatgcttaatgcattcaagttccaacaggatttggattttttttattttactttgctgtgtttctatttcatgaaggcagatctggtgcagcggtgaaagttgtctcgctgagtcaccatgcctctctgcatttgcaaaggaaaggtttgtctctggttattccttccca

SEQ ID NO: 35280 - DNA, 427 bp, Zea mays
  unsure at all n locations
  Clone ID: LIB3060-018-Q1-K1-F9
cgcccttcccgacgcgccgcccgaaaccctagctccaccgatctatctctctccagcccaggcagggggaggagatggcggcggcgccagcggcgggagggcagggaggcgggggtatggacgccgcgctcctcgacgacatcatccgccgcctgctcgaggtgcggaccgcgcgccccgggaagcaggtgcagctctccgagtcggagatccgccagctctgcaccgtctcccgcgagatcttcctcaaccaacccaaccttctcgagctcgaggcgcccatcaagatctgcggtgacatccatggtcaatacagtgatcttctaaggctttttgaatatggaggctttcctcctgaagccaattatctattcttaggtgattatgttgatcgaggcanacaaagtttggagactatatgccttct

SEQ ID NO: 35281 - DNA, 337 bp, Zea mays
  Clone ID: LIB3060-018-Q1-K1-E11
ccggattcccggtcgaccagctccgaccggcagcggcgctgcgcatggccacccagcagtttcgccgctccgatcccgccggcgcccggtgcacacaggcgccgcgtcgccagcacgcgtcagagctggacttgcgactttcggctagccgggtcggctcggagcgctgcggcggagcgtctttcgactctgggccagtcgtgcaagcacgggaaacgcggagggcccgagagcgaactgaggggacaacgttcgcgatcggcggacttctcgggctgacgcggaggactgcgatgactgtcgtcggaacgaagggagcgtagaacgctccactctc

SEQ ID NO: 35282 - DNA, 246 bp, Zea mays
  Clone ID: LIB3060-018-Q1-K1-C2
tcatatatatatatagaatcaatgttagagtagcttcctaccataagcggcatgtggacgacaagccgccgtacgccgccttggacgacaccatgaccaccatcactaataatatggtgaaggagcaactctcatactacaccttcagcttcatctatcttccatagcataactaccgtgtatggaatgccatgccctacgtcatatacaactatacttgctagaagctgttcaccatcgttacca

SEQ ID NO: 35283 - DNA, 451 bp, Zea mays
  unsure at all n locations
  Clone ID: LIB3060-018-Q1-K1-C4
gctctaccgtccggattcccggtcgaccaaccttccgccggaacgcctgacccaatcctttatttccggggcaacggccaatttggcttccggttgccgttcttttccgccgccgcccggatccccttactcccaaagcccttcaactatccactcccgcgtccccggagaagcggcgagatgtacggcatcctgacctcgccctgccctcgagccccgcttctgcgcgctctcccgagcccattcgcccgcgcattccccagaacactagccttccccgcgaggcccctancacgcggtctccgcctgaccccttcgcacgccgacgcggaggcatcggcggcagccacggcgttaggcgggcttctggcgtcgccgctctcgactctggaggccgccctgcggggcctcaagctcgcgccccttcgcgccctcgtggcggcggcgatgt

SEQ ID NO: 35284 - DNA, 432 bp, Zea mays
  Clone ID: LIB3060-018-Q1-K1-C5
gaaaaatgtaggcactttagtatatgggttgaccaatttttgggttttgagtttttggtgtgctgtttgccaggtatacaggcataggagaatgttttgttagtgaaagcaatagatttatcttcctgtgttaataagaagctgtccagtgtcattgtatcctcttaggttgtaatacaccaaaatatacccttctcttttgcttaaaatctgagcggagggagtcccgttcttgctattttctagtattagtaggctgttttttttttgtgtcgctaacttcttttctaatattttctgcagtgatgatcccattgtatcattatcagcacaagcacccacacaattccgttttcctgggtctgttcacgttgtgcttgagcttcagcatcggcgtggcttgtgctaacacccaagggaaaatcgttctgg

SEQ ID NO: 35285 - DNA, 373 bp, Zea mays
  Clone ID: LIB3060-018-Q1-K1-C6
gaaaaatgtaggcactttagtatatgggttgaccaatttttgggttttgagttgttggggtgctgtttgccaggtatacaggcataggagaatgttttgttagtgaaagcaatagatttatcttcctgtgttaataagaagctgtccagtgtcattgtatcctcttaggttgtaatacaccaaaatatacccttctcttttgcttaaaatctgagcggagggagtcccgttcttgctattttctagtattagtaggctgttttttttttgtgtcgctaacttcttttctaatattttctgcagtgatgatcccattgtatcattatcagcacaagcacccacacaattccgttttcctgggtctgttcacgtt

SEQ ID NO: 35286 - DNA, 427 bp, Zea mays
  unsure at all n locations
  Clone ID: LIB3060-018-Q1-K1-C7
gtgaaagtcaaggtatcatttactggcaagggagaaactcagtctatgaaacaattgtcaggcggacagaagacggtggtcgcactaacactgattttcgctatccaacgatgtgacccagctccattttatctgttcgacgagatcgatgctgctctggatccacaataccgaacagcagttggaaatatgatccgccgtctagctgacatggctgacactcagttcattgcgaccacattccggccagagattgctaaagtggctgataagatatatgccgtgagacacaagaatagggtgagcaacatcgacgtggtgtccaaggaggaggccctggacttcatcgagcgtgatcagacgtacaatgctagctgaggctgctgctgctgtgtattgattgatctgcangcagatgctaacgcag

SEQ ID NO: 35287 - DNA, 424 bp, Zea mays
  unsure at all n locations
  Clone ID: LIB3060-018-Q1-K1-C9
cggcctacgcgactgcttccctctctctcgagtctcgactctcgactgcgccgctacagcctgacgcgatggcctcgtcggcgacgagagaggttctcatgcttgaggcgcctccgccgtccgaccccgctgcggggccctggcgcgcggtgccggacgcggaggccattgacgcgctgccctacatcgacggcgactacggcgatgcggcggtgaagcgggaggtcgatcgcctcgtcgaggaggagatgcgccgagggaagcgcaagcctgcagacttcctccgggacctgccccctgttcccaccgccggattcgagaatcatcctatgcttgctaaagaatatgaacgtgttagggctggcaaacctccttttatgctagatatgtctcgctatggtttggagccacctncaatgaacaa

SEQ ID NO: 35288 - DNA, 399 bp, Zea mays
  Clone ID: LIB3060-018-Q1-K1-D1
cctccctctccgaaatcaaggtagcatacaccgctgcagtttctagagccctctctgccactcgtgatcccactagtcacgatgcctgccctcgctaagcccgcctcccgcaccgccaagcccgccgcggctccgaagccgaagcctgccgccgccaagccgaaggcggccaccgctggtgcctcccacccgccttacttcgagatgatcaaggaggctatcacggcgctaaaggagaggaccggctccagctcgcaagcgatcgccaagtatgtgggggacaagcacggcgcgtctctgccggccaacttcaagaagatgctttccatccagctccgtgggtccgcagccaagggcaagctcgtgaaggtcaaggcttcgtacaagctctcggacgcc

SEQ ID NO: 35289 - DNA, 397 bp, Zea mays
  Clone ID: LIB3060-018-Q1-K1-D2
cctgcctctccgaaatcaaggtagcatacaccgctgcagtttctagagccctctctggcgctggtgatcccactagtcacgatgcctgccctcgctaagcccgcctcccgcaccgccaagcccgccgcggctccgaagccgaagcctgccgccgccaagccgaaggcggccaccgctggtgcctcccacccgccttacttcgagatgatcaaggaggctatcacggcgctaaaggagaggaccggctccagctcgcaagctatcgccacgtatgtgggggacaagcacggcacgtgtctgacggccaacttcaagaagatgctgtccatccagctccgggggtccgcagccaaggtcaagcacgtgaaggtcaaggcttcgtacaagctctcggacg

SEQ ID NO: 35290 - DNA, 333 bp, Zea mays
  Clone ID: LIB3060-018-Q1-K1-D4
atcgtggcccggttcgggttcgggttgggcggcaaggcgaagcctgctccgaagaaggtggcgaagacatcgacctcctctgaccggccgctgtggttccccggcgccgtggcgcccgactacctggacggctcgctggtcggcgactacgggttcgacccgttcggtctcgggaagcccgtggagtacctgcagttcgagttggactcgctggaccagaacctggccaagaatgaggccggcggcatcatcggcacccggttcgagtcctccgaagtcaagtccaccccgttgcagccctacagcgaggtgttcggcctccagcggttccgc

SEQ ID NO: 35291 - DNA, 444 bp, Zea mays
  Clone ID: LIB3060-018-Q1-K1-D5
cgccggcgaggggtccttcgaggagcccgagggccgcgagaacctgcagcgcctgtggcagaagtaccgcgtcgacatcgccttcttcggccacgtacacaactacgagcggacctgccccatgtaccagagccagtgcatgaccagcgagaagacccactactccgggaccatgaacggcaccatcttcgtcgtcgccggcggcggcggctgccacctgtccagctacaccacggccatccccaagtggagcatctaccgcgactacgacttcggcttcgtcaagctcacggcgttcaaccactcgtcgctgctgttcgagtacaagaagagcagcgacagcaaggtctacgactccttcaccatcgacagggactaccgcgacgtgctcagatgcgtgcacgacagctgcttccccaccacgctagccacctagttaattaa

SEQ ID NO: 35292 - DNA, 440 bp, Zea mays
  Clone ID: LIB3060-018-Q1-K1-D8
agtccctgctatacagctctcgtcggggtcttctcccccttcggcccttcccccctccctgcgcgccatggaggcccaggagatcgccgctgcagcgcgccacttctgcgccatggttcgaatcgtcggtccggaccccaaggccgtgaagatgcgccgccacgcctttcattttcaccattcggggtcgaccacgctctcggcgtcggctctgctcctgccgcggggcgctttagcggagccgccgctacttctcgaccatatctgctcggcccacgggcacgcggcaggagacgtcgcgctcacggctgcttccctcgtcgagccgttcctggtcgcggagcagcgcaataactccggcgaggagcttcagccgaggttggttccggagacgcgtcttgatgcgtttggtgagtatgagtcggggaatgctcaagatg

SEQ ID NO: 35293 - DNA, 447 bp, Zea mays
  Clone ID: LIB3060-018-Q1-K1-E1
gcatgagcagctcctcacactctcttagaagctactcggtgtcaagttcagaggaggaaagccgatgtggagctgctgtggcctgcttagctcgaagagtaacaccagctggaacttctactagtgctgggacatcgaaagtgaccccctttccacccattgtgagtggtcaagttggcacggagggcactcctcgacttcaacgcagccgtgctgtgtccagggaccttgttagagattggaactttgacgaagtaattgtcgcaaattagggtaaccttcaacagttgtcagctgggctttgtgctctatttatcagggaggagattccttcatttgatatatatttcttttcatagtagacgtctggaagtccattactatatacttaatgacttagacgaggaaatgctcgagagggataatatctttcaagagcgatatctg

SEQ ID NO: 35294 - DNA, 404 bp, Zea mays
  Clone ID: LIB3060-018-Q1-K1-C12
cgcgagtgagtgaacaccagccgtattgtcccgactcctgacccctaccgatcctcgcctgctgcagccatggcgacctccgcggcgctctccaccgccgccaatcccacccagctctaccggtcccgcgcttcgctgggcaagccggtgaaggggcttggcctgagcatgggccgcgagcgcgcccagcggagcattgtgtgccaggcggcgagcagcatctccgccgaccgcgtccccgacatggagaagcggaagctgatgaacctcctcctcctcggcgccatctcgttgcccaccgtcggcatggtcgtcccctacggcgccttcttcgtccctgccggctccgggaacgccggcggcgggacctacgcgaaggacaagctgggcaacgacatcacggt

SEQ ID NO: 35295 - DNA, 410 bp, Zea mays
  Clone ID: LIB3060-053-Q1-K1-B1
ggagtccggagtcggacctcgactcggcacgcttccgcggctccgcgcccaggccaaggtgtgtcttccagtctccacgctccagagaccacatctctctctccatggcgacggccatctcgctcccgcgcgcgccgctgatcactccccgcgcgtgcaccccccgccggcttgtccacgtgtcggcggcgcgcgcctctcccccgcgcggaggagggcgcgtcggtcgccgctccccgacggtccccgctgtagcgggagcctcctcctccggcttggctccggacacaagcgtgccggcgtgggacgctctcggcggcgtctccgtcctcgccgcggggacaggcaacgctgtggcgctgacggacctgtgggactccgccgagggggtggccgtggttgcgctgctg

SEQ ID NO: 35296 - DNA, 411 bp, Zea mays
  Clone ID: LIB3060-053-Q1-K1-B10
attttattatggtgacaattcattgttgccgtgagccgtgagcgtgacattgttgtgcgccttccactgccagtaatggaagcaggcgccggggaagcagcagcaagcgcaccgcgcagactgaccctgccgtggaaggtgcggctcctgctcctctgcctcgatgtcgttgccggtctctcgatgcgtcgcgacggcaccatcaaccgctccatcttcaacctcttcgaccttcgtgccaccgccagcacgcgcccggacaggcagggcgtccggtccgccgacgtggacgtggacgtggacacgtcgagcggtctgtgggcgcgcgtgttctggccgtcgccggaggcgtccgcggccccgctccctgtcgtggtctacttccacggcggcgccttcacgctgctctct

SEQ ID NO: 35297 - DNA, 405 bp, Zea mays
  Clone ID: LIB3060-053-Q1-K1-B11
cgcttcgtgacttctctctcctctcgatcgattgcttgctccaccgaggcgggggaaagcgccgcccagatcgccgtaggcaagcggcgatcactccagctttgagcataagtttctgcacggaggctcgtgaagtcagtagtcgtatctggcagtggcagcacagcgcaccatggaatggctgagctggagaacggtgtgttgtttatcagtgctgtgcaccgtgctgttcttgcgcccggtcgagggcattcgctttgcgatcgatagagaagagtgcttctcgcataacgtggagtatgagggggatactgtccatgtatccttcgtcgtcatcaaggctgacaccccgtggcattacagcgaagaaggcgttgatcctgtggttaaggatcctaatggcgc

SEQ ID NO: 35298 - DNA, 412 bp, Zea mays
  Clone ID: LIB3060-053-Q1-K1-B12
caagtgcatatcatacacaatgggtggaggtggaaagattccgtatcccaaggaagtttggtcacccgccggtggttggtacgcccagccaggctattggaaggccaacactgcgatcatgggtgctttcgtgatcggtgtcgctgccgtcgcattcagcatcagcgccgaccgcgagtaccgtgaccggatgcctgaacctggccgattattgcctagccgatactggagcctacagattcgcgaacacgaaaagcagcaggccgcgcaaaactcctcatgaggagcaggtctacgagccggaaaaggacgaggggtggctttgcggcgtgacagagcagtttccttaatatgtgtcttctatcatttcatcattctctgtggctgtatgacaacgaaaagggcgtttttt

SEQ ID NO: 35299 - DNA, 390 bp, Zea mays
  Clone ID: LIB3060-053-Q1-K1-B2
gtcgacgatagtctcatacagactgagtaaaggttttaccaacactgtacagcacgctggtgcatttagtgaacatctggttggtgaaaagaggcccttatatgactcaagcggtcgatatgtgtaccaaattagccattcatctctacatgttctagctaagggcaaactcaatgaggaaaattttcaagatgcagaatcaactaatcagctggattctgatgctgctgtgccacatcatattagttgggatgctcctaagcctactctgccaactgattgtgaacacgatcctgtcgtaccatgttccgtctgctctgtggatgcgtcttacacggaaactattatcccgagcacacagattagagacattgctagtagtacagagag

SEQ ID NO: 35300 - DNA, 325 bp, Zea mays
  Clone ID: LIB3060-053-Q1-K1-B3
gtagaccacagtcttacctagagtgatctacgtgtttcaccaactatatccaacaagggggaggctccatcctacttcagggtggtcatacgaattcgttatattcacacaacagaatatgacaccagttgaccaagataactctaagaagatgctaatgcccactctaatctgatgagtctgagagggagatcattcatcatcagcaagatgatgatgcaccagtgcactacagatgattcgtggtcgatcttaagtgctcactgtgatataggcctgcacactaatctctatcacaatgcaagctctaagcggcgtactcgtg

SEQ ID NO: 35301 - DNA, 446 bp, Zea mays
  Clone ID: LIB3060-053-Q1-K1-B4
ccggcccgactccacgcattcgtgcgatgatcatctctcatccactgttttttttagattcaactgagctcatcattagggcgcgctcccttgacgcggcgcgggcaacaagcatggcgaatattgccgagcagctcaagatcaagttctttggactcctcggacgcatcaccacctgtgctcgcgcctgcgccacccacaaggatgccgctggtgcgacagatgccaagtcatcagagggatcccagcctgttgagatcaggtcaaggggaggtgctcctaccgctgctggaggggccaagggtcacatcaacagtgacaccatctagaggatagggagaggagaagagaagagatcgaatacaatagaagaagctcacccatagttaccacgtttgaaagaactgacgctgtaaatcacagttactcgttgcttgagcgtgtgt

SEQ ID NO: 35302 - DNA, 406 bp, Zea mays
  Clone ID: LIB3060-053-Q1-K1-B5
aaaatcgaaatcgatccgatctccgcttgcgctgaagcctgatctccaccgggttcgcagcaggggcgcaggacctcgatcacgaggaggcaggggagcagcatccacaaccacaagccatggcggggagggccaacatccccactaacaactccgacctcatcgcaatcatcgtcgacgaggacaccgtcactggcttcttgatggccggcgttggcaatgttgatctgcgcaagaaaaccaactacctcctcgacgacaacaagacgacagttaaacaaatcgaggatgcgctcaaagaatttactacgaaggaagatattgctattgtgctcatcaggcaatatattgtcaacatgataaggtttctggtggatagctacgacaagcccgtacctgctattct

SEQ ID NO: 35303 - DNA, 419 bp, Zea mays
  Clone ID: LIB3060-053-Q1-K1-B6
ctgctcagtacgcatccgctcccactactagattcaggtgagctcatcattagtgccccggcccttggtgcggtgcggccaacggccatggcgaagcttgccgtgcagctcaagagcaagttctttggcctggtcagacgcatcatcagctgtggccgctcctgcgccacccacaaggatgccgctggtgcgacagatgccaaatcatcagtgggatcccagcctgtcgagatcaggtcaaggggaggtgctcctcccagtgatggacgagccaagggtcacatcaacagtgacaccatctagaggatagggagaggagaagagaagagatcgaatagaagagaataagctcaccgatagttaccatgtttgaaagaactgacgctgtgaatcacagtcgtagttgcttgagtgtgtgt

SEQ ID NO: 35304 - DNA, 411 bp, Zea mays
  Clone ID: LIB3060-053-Q1-K1-B8
aacagacgacggaagctcctcctcctcctgcatgagagagatctagcatagcataggctcctttctgctggcgggatctacttttgattcgtaacttataacagaagatgaggaggcacagcaccttgtcaaatgatgaactctcagaagctgcagctgcccgttcaggatctgatgagtctgatagggagatcattcatcatcagcaaggtgatgatgcaccagtgcactgcagctgcttcgtcgtcgccttcacctgctcctgatgctagaggcctgcaagttgctgcccatcccagtcccagcaagaggcggcgtcctcgtggcctcgttgccgcggacggcagtgacgacgacgaatgcgcttcagatggtggtgagtccgagtcgtagtcgtctggcgggaaagac

SEQ ID NO: 35305 - DNA, 387 bp, Zea mays
  unsure at all n locations
  Clone ID: LIB3060-053-Q1-K1-B9
ggaattgccgagcgagcgagcttgcgccgtgcgcgatggagggtgacgagaagtcggcgggcggggcccctgcttactggggcctgggcgcgcggtcctgcgacgcgtgcggcgccgaggcggcgcgcctctactgccgcgcggacgcggcgttcctgtgcgccgggtgcgatgcgcgggcgcacggcgccgggtcgcgccacgcgcgggtctggctctgcgaggtctgcgagcacgcgccggcggcggtcacgtgccgcgcggacgctgccgcgctctgcgcctactgcgacgccgacatccactcggcgaacccgatcgcgcgccgncacgagcgcctncacgtggcacccttcttcggcgcgctggccgacgcgcccaagccct

SEQ ID NO: 35306 - DNA, 308 bp, Zea mays
  Clone ID: LIB3060-053-Q1-K1-C1
acgagagaactcgtcagatatttatgagcgcagccgcgggttaacctttccttctcggtgccgtgctcctggtcgtgcgcgcgttcgcaatcgcagcgctggggttgagccgcgagtggataaaccctagccggtggtgtagctgggttggtggctttgatgccggcgactgcccgcttgtaccccgaatggagtgaggtgacgaatgctgtcatgggctctaactatgccacgattggattataggatagtagctggcagctaccagtttcctagaaccaatttgtggatagcgagaggcgtgactg

SEQ ID NO: 35307 - DNA, 414 bp, Zea mays
  Clone ID: LIB3060-053-Q1-K1-C10
cagcaaagttatcaaggaatgaacaatcaacctcaaggagatctgatacaacagatccttcacactttggatcatctcaaagtgaacctatggaagaggaccatgtgactggacttccttttgccatgattgatgaaatcgctgatggttctcctgcttctgtggatggtttgcaacttggagatgagattgtaaagtttgggaatgtggaagctggtgatcagttgcaggaaaggctcatgtctgaagctctttccaatgaggacagtcaagtatctttagtcatcattcgccagggatcagtggtgaatttaacaattacaccaaggaagtggcatggaagaggacttctggggtgccatttccgaatgctatgaagagcccatcgttcttcatcaggatcgttggtctatc

SEQ ID NO: 35308 - DNA, 413 bp, Zea mays
  Clone ID: LIB3060-053-Q1-K1-C11
agcaactgaaatcttttaagcacttgttgcatcgcaacaagaaaattgatttcatcgagcagttcaatgagaagctccttgtcaagcaagagaatgaaaacttccagatatttgatgtgcggagttctgagctaattgaagtcagtgtctccaagtttatgaccccttcagcattcatttttctgtatgagaacaacctcttcttgacattccgaaacagaacagtcgctgtatgggacttcagaggagagcttgtgacttcatttgaagaccatttgctctggcataatgattgtagcaccaacaatatttacatcacgagtgaccaggatctcattatctcgtactgcaaatccgaggcagtggctgaggatggtacagttgttccagttggatccatcaacataagtgag

SEQ ID NO: 35309 - DNA, 414 bp, Zea mays
  Clone ID: LIB3060-053-Q1-K1-A8
gccctaatcatcgccgccaaccggcatctgagccggctgcacccggtgtaccgcctgctgcacccgcacttccgctacaccatggagatcaacgcgctggccagggaggcgctcatcaacgccgacggcatcatcgaggagtccttctggccgggcaagtacgccgtcgagctcagctccgtggcgtacggcgcgacgtggcagttcgacacggaggcgctgcccaacgacctcatcaagcgcgggctggccgtgcgcggggaggacggggagctggagctcaccatcaaggactacccctacgcccacgactgtctcctggtctgggactccatcaggcagtgggcgttcgagtacgtcaacgtctactacaagtacgacgaggccgtggccgtcgaccccgagctgagggcg

SEQ ID NO: 35310 - DNA, 378 bp, Zea mays
  unsure at all n locations
  Clone ID: LIB3060-052-Q1-K1-H1
gtgagctccgcgtacggctccggccatcactcctctggttgtgtctctccagcatcacgactccatcccttcatgctcgtatctggagctcgctcggcctacagctcgcttgtaccccggccgccgtgttgttcctgttcgtcttcagcgccggtcgagcatcgccgcttgggaatggcgcacggccatcccgtctcgacctcctccagctcctccatcccttggtccttggcgctcgccaagggcctctccttcatcttttgtcgcgtctcaactcccatggccgcctctacgcacgagctcgccggacgccgcagcatatgctccctgctcggcctncccggcgtgctgctccctcgccttggcgcccctgcgagc

SEQ ID NO: 35311 - DNA, 383 bp, Zea mays
  unsure at all n locations
  Clone ID: LIB3060-052-Q1-K1-H10
cagcagcttctgcttgctctggggggaaggagagagagagagcgagagagagagagagatctagtagagaggctagtaggtggtcctcgaacgaagatgttggcggtgttcagcgggcaggtggtggaggtgccggcggagctggtggcggcgggcagccggacgccgtcgcccaagacgaaggcgtcgcagctcgtggggcgcttcctggccgcgtccgagccggccgtgtccgtgcagctcggcgaccacggccacctcgcctactcccacaccaaccaggcgctcctccgncccaggtcgttcgcggccaaggacgaggtgttctgcctgttcgaaggggtgctggacaacctgggtcggctgaaccagcagcacgggct

SEQ ID NO: 35312 - DNA, 399 bp, Zea mays
  Clone ID: LIB3060-052-Q1-K1-H11
cggacgcgtgggatgatgatgggtgtttgaacctctgagacttgtatatttgagaaccttatgtcttgaaccaatcctacaccaccctgcgagaaatgagagttcactttgtttagacactaggaattgttttgggtgacatcatttttcttctttgaacttttcaaggttattgcttgtatagatagcaaacgatgacatgtacgttttctttcctttttcagattttcttttgtgacattattaactattatgtactaatgccggatgttgaattagaattagaattttatttgtacttatgttctcaagcttacctgccaggtcttgattctgacaccattcatggttctgaacatgttgacatctcttactgtaacatttgatacgcatgctttt

SEQ ID NO: 35313 - DNA, 349 bp, Zea mays
  Clone ID: LIB3060-052-Q1-K1-H12
cccgagaccgacaagtgcaaggtggactaaacatgtggccacggttctttccacgacggaacgtacagcacgggcgctagggttctttgcatagagaataatatacagattattcgcccaaagagacgtatgttatatatatatgagttgcatgcagtcaccgaactgggacagggttccgatttacatttactgatgagagtctcgtagtgtaatcctggggagagtatttgttgcatcaatcatgactgccgattggtatctcggtttaccagcatggaagcattatctgatttgggcatacaagtataaacgcaactagcgatcttggaaaaagagaaaccgaatt

SEQ ID NO: 35314 - DNA, 384 bp, Zea mays
  unsure at all n locations
  Clone ID: LIB3060-052-Q1-K1-H2
gtgagctccgcgtacggctccggccattactcctctggttgtgtctctccagcatcgcgactccatcccttcatgctcgtatctggagctcgctcggcctacagctcgcttgtaccccggccgccgtgttgttcctgttcgtcttcagcgccggtcgagcatcgccgcttgggaatggcgcacggccatcccgtctcgacctcctccagctcctccatcccttgatccttggcgctcgccaagggcctctccttcatcttttgtcgcgtctcaactcccatggccgcctctacgcacgagctcgccggacgccgcagcatatgctccctgctcggcctncccggcgtgctgctccctcgacttggcgcccctgcgagctccttc

SEQ ID NO: 35315 - DNA, 410 bp, Zea mays
  Clone ID: LIB3060-052-Q1-K1-H3
acgccgtcgagcttagctccgtggcgtacggcgcgacgtggcagttcgacacggaggcgctgcccaacgacctcgtcaagcgcgggctggccgtgcgcggcgaggacggggagctggagctcaccatcaaggactacccctacgcccacgacgggctcctggtctgggactccatcaagcagtgggcgtccgagtacgtcaacgtctactacaagtacgacgaggccgtggccgccgaccccgagctgagggcgttctgggacgaggtgcgcaacgtggggcacggcgactagaaggacgagccgtggtggcccgtgctggacacccgcgacagcctgttggagacgctgaccaccatcatgtgggtcacctgcgggcaccactcggccgtcaacttctggcagtaccac

SEQ ID NO: 35316 - DNA, 235 bp, Zea mays
  Clone ID: LIB3060-053-Q1-K1-A11
ggattcccgctcgaccacgcgtccggacggtgctctaatccgtcatacttggtggttgtgaggtcgaaagcggggagggaatataagatgctggtacaagctgtgggacgacgtggggccatacctcgcccggagacgggcctgagaagcttcgcagtgccaccaccgcccgtccactcgcatcaacaaagactcggacggggcagctacatgcggcgcagtccatgcctctacc

SEQ ID NO: 35317 - DNA, 284 bp, Zea mays
  Clone ID: LIB3060-053-Q1-K1-A12
ggcacaacgacaacgcgaagatccaggacaaagagggcatccccccagaccaacatcgtctgatcttcgctggcaagcagctggaggatggccgcaccctagcagactacaacatccagaaggagagcactctccacctggtgctccgcctccgcggtggtcagtaagccatgggtcatttaaactgctgctgtacctgggtatctgcgtcgtctgatgccctctggtgtacctctatatggatgtcctcgtctaataaacatctgcggtttgtgtgtcatgaa

SEQ ID NO: 35318 - DNA, 393 bp, Zea mays
  unsure at all n locations
  Clone ID: LIB3060-053-Q1-K1-A2
cccgttgtccctctcccgtcatttcatcttctcttctagtcgtttcatctttcccggcagctttggcttcagtcatcggcttcgcaagttcgcatcgaatccgtcgtcttttgcactgtcaccttcatcgttgctccagttgttcgtcccattccctccatggacgcgatgtgactagaggacggcgcgaccgtacaactttgtttcgattcgtcggcgccacagctttctccatgcttgtaatgtagtgcacctgctgaagaaggggaaaaacgagagagagagagaaaagggaaaaaacgagagagaaatcgctccagtagcgcgcccggagaaggtacctngctcgtctcgggcgctcggctgttccgcttgttctcttcttccgtctct

SEQ ID NO: 35319 - DNA, 422 bp, Zea mays
  Clone ID: LIB3060-053-Q1-K1-A4
atttgtttgtggaaatttaaatgtgcatgaatctggctactgtaggcttacacaacagtgcagtctgtttctgttaaggaacgcaggaaggaactatcagagaccaacgatcgttgggtggtgttgtggctgtgcctcttcagtgctgtgccccatcctcgtcggcggccgatgccgtgtgagccgggtaccttcacatgatgtcagcccaggtgctctgcccgtccgtcacttccttcaccaccgaggccacctcgtccacatgcacgcggatctggtccttgctgtcacgatcgcgcaccgtcacgctcgtggtgtgatcaaccgtgatcgccagggggacaccaatctcgtccgtccttgcgtaccgttttcctattgtattacctgttatgtcgatgatatgtgaaatcccagctgct

SEQ ID NO: 35320 - DNA, 379 bp, Zea mays
  Clone ID: LIB3060-053-Q1-K1-A5
agtattattattattattattattcggctcctgctcatcagctgcagcagtcgtgctccggaccggagaagtcgaaatggaggagaggctgttcgccacggagaagcacggtggccgggcgctctacaggctccacgccgtcacggtgttcctggggatatgcctggtgctctgctacagggcgacgcacgtcccggctgccggctccggcggcagggcggcgtggctggggatgctcgcggcggagctctggttcggcttctactgggtcatcacgcagtccgtgcgctggtgccccatccgtcgtcgcaccttccacgacaggctcgccgtcaggttcggagagcggctcccatgcgtggacatcttcgtgtgcaca

SEQ ID NO: 35321 - DNA, 381 bp, Zea mays
  Clone ID: LIB3060-052-Q1-K1-G9
gagctgcgcttgtccggagacggagccgactgaacatggccggagatccgggggacgcgccggaggtgggaggcggcggcatacgctccgtgctcaccacggcctcgctcgtcgctccctccggggacgaggttcagtttcgggagatcgacggcaagatcatcggcctctacttcgcggcaaactggtatccgaaatgcgaggctttcaccccggtgctggccgcggcctacgagcagctcaaggagcgcggcgccggcttcgaggtcgtgctggtgtcgtgcgacgaggaccggccgtcgttcgagcggttccacggaaccatgccgtggccagcggtgcctttcggcgacctcagctgcaagaagcgcctcatcgaga

SEQ ID NO: 35322 - DNA, 300 bp, Zea mays
  Clone ID: LIB3060-053-Q1-K1-A6
agcattatgatcattattattattcggctcctgcttatcagctgcagcactcgtgcttctgaccggagaagtcgaaatggaggataggctgatcggcacggagaagcacggaggccgagcgctctacaggctccacgccgtcacggtgttcctggggatatgcctggtgctctgctacaaggcagacgcacgtccctgctgtcggatacggcggcagggcggcgtggctgatgatgctcgcggcagagctctggttcggcttctactgtgtcatcacgcagtccgtgcgctagtgcccca

SEQ ID NO: 35323 - DNA, 338 bp, Zea mays
  unsure at all n locations
  Clone ID: LIB3060-053-Q1-K1-A7
gaaatacccaattcctcagggtgaaatacatcatgtcatgaaccctgatccttatcgggggactttcgggtctgatgctgcagcttatgctaaggaagtcgaagaacacataacttatggaagttcaggaagggttgcaggcttcattgcagaaacattccaaggtgtgggaggtgctgttgaactagctcctggatacctaaagttagcttatgacattgtgcgcaaggctggtggcgtttgtattgctgatgaagtccatagtggttttggccgtactggcagtcattactggngattccagacacaaggtgtcattcctgacatagtcaccatgg

SEQ ID NO: 35324 - DNA, 341 bp, Zea mays
  unsure at all n locations
  Clone ID: LIB3060-052-Q1-K1-F4
cgtcgggttccatggcggcgccgtcttctaaacccccgacaccacgcgggcgctgccaccacccgcccaacgccacccgccgcctccacgtcgccacccgctgcttccccgacccaccaccaccacccgcctccatgccgccgaccccgagtccgaaccctgtgctgtcccttctctccgcggtgcccgactgggccgacgccatccaggagcgccgcgtccgcgaccgccgcccgctctacgaccacgccacctggcggcaccaccgcagctcccgccgncacctgcgccacctnctcacctcgctgtcctcccgcgccatcctctccctggcgcccccg

SEQ ID NO: 35325 - DNA, 356 bp, Zea mays
  Clone ID: LIB3060-052-Q1-K1-F5
agggcaaaagccaaaaggcatcaccgccgcgacgacgatggcagcctcgctccaagccgcggccaccctgatgcagccggccaagatcggcggccgggcgccctttgcctcgctgccgtcccgcccgtcgtcgcaactcgcctgcagggcgttcggcgtcgacgccggcgccgccaggatcacgtgctccctgcaggacgtcgccagcaggtgcgtcgacgccgcgaagctcgccggcttcgcgctcgccaccttggcgcttctcgtcttgggcgccagcgccgaaggcacgcccaagaagctgacctacgacgagatccagagcaaaacgtacatggaggtgaaaggcacgggca

SEQ ID NO: 35326 - DNA, 398 bp, Zea mays
  unsure at all n locations
  Clone ID: LIB3060-052-Q1-K1-F7
cacatcccagtcatccgtcacaagctagatgccgcgctctgaccgtatgaccaggcttgtcccccagcagctgctcgtggtggtcgtcggagcagcagccatcaccgtcgcaacggcatcggcggcgcacgtggactccttcagctacccgaccttcgacgccaccacgacgcaggacctcgtggcggcaacaaacacctccatcctgacgtcggcctccctcctcttcggccacgacgccgacttcaacttcaaccgcaccgagggcttcatcctgctctcgcgcaccgtcgacgtctggcgcgccggccccggcggcgggccggcgcgcgaggcctncttcaacaccagcttcgcgctgagcggcgccgcgcccgtcgcgtacgtcgtactccgcg

SEQ ID NO: 35327 - DNA, 336 bp, Zea mays
  Clone ID: LIB3060-052-Q1-K1-F8
cgcataccagtcattcggcactagctatatgccgcgctatgaccgcatgacgaggcgggtcccaaagcaactgctcgtggtgaccgtcggagcagctgctatcaccatcgaacaggaataggcggctcaatgtcgactacttcagcgtacccaaccctgtgactgcccttctctccaggacgtccgactgggacgacaccattcatgagcacctcgtccgtgatcgtcgtccgctataacaccaagttacatgtcgacaccaccgaaggtttcatcgtgatctggggcacctgctaacctcggtgtgctctcgcgccatactatccctggggcccc

SEQ ID NO: 35328 - DNA, 170 bp, Zea mays
  Clone ID: LIB3060-052-Q1-K1-F9
ggctgggggctacagcacacctgaatctggactagattactcgacaattacacgctccaactcagcttacggtcgtagactgatgacacataaccatcacacggcatccatccgaactaaccaccctgttaacctgatccctgcgctacctagataacctaagacgcgac

SEQ ID NO: 35329 - DNA, 390 bp, Zea mays
  Clone ID: LIB3060-052-Q1-K1-G1
cccgcagcaggggagactgggagatacagagaggagagggagggtttcctcaaagagacccaaacccaagcagagaacactagcgttccctcaccagggcgtccatcccagcagccatggcgatggcgtacaagatggcgacggaggggatgaacgtgaaggaggagtgccagcgctggttcatggagatgaagtggaagaaggtgcaccgcttcgtggtgtacaagatcgacgagcggtcgcgcgccgtgctggtggacaaggtgggcggccccggggaagggtacgaggagctcgtggccgcgctgcccggcgacgactgccgctacgccgtcttcgacttcgacttcgtcaccgtcgacaactgccagaagagcaagatcttcttca

SEQ ID NO: 35330 - DNA, 415 bp, Zea mays
  Clone ID: LIB3060-052-Q1-K1-G11
cgcagatcgcgcagcacgtccagaagatgaccggcgccaagaacgtccgcctcaagacgcagctcgacccggcgctcatcggcggcttcaccgtgcagtacggccgcgacggctgcaacttgatcgacatgagcgtccggaagcagatcgaggagatcgcgtccgagttcgagttgcccgccgtcccgctcgaagtctgaggccggcttgaggcgtccattctcgccctcgaagctatagctgcggctactgtctcaaggaaccaagcgggaatgttggcactgtacccttcagtcagacctgcggatcaacggcggtggctccaaatctccaatactactacatatgaacggacactatttttgtgcgtatctgttgacgggaacctgtgtagttctttctcctatttttccct

SEQ ID NO: 35331 - DNA, 404 bp, Zea mays
  Clone ID: LIB3060-052-Q1-K1-G12
cccgagaccgactagtgcaaggtgtacttagcatgacgccacggttctttccacgacgggacgtacagcacgggcgcgagggttctttccatagagaataatatacagattattcgcccaaagagacgtatgtcatatatatatgagtcgtatgcagtcaccgaactggtacaggtttccgctttccatttcctgttgggagtcttgtagtgtaatcctggggtgtgtatttgtctcatcaatcatgcctgccgattgggatctcgtttcaccagcatggcatcattatctgattagggtatacaagtataaacgcatcgagcgatcttgtaaaaagagaaaccgagttgcagagggttaagggtttctctccaagatacatatcttggatagaaaatttcatc

SEQ ID NO: 35332 - DNA, 431 bp, Zea mays
  Clone ID: LIB3060-052-Q1-K1-G2
cctccccagagattaatggggaaaaggagaaagaaactgaagttgcagagaagagatggaaagtacttgtgtggaagactgctgtttatcttatcactctcggtatgctcattgcacttctaatgggactgaacatgtcctggactgcaatcactgcagctcttgttcttctggcactcgattttacggacgcacaagcttgtcttgagaaggtgtcatattcactgctgatctttttctgcgggatgtttatcactgttgatggcttcaacaaaacgggcataccgaacacactatgggagttagtggaaccatattcacgaatcgatagtgcgaaaggtgttgcacttcttgccgtggtgattcttatcctttcaaacgtggcctctaatgttcctacagtcctattgctcggtacaagagtggctgca

SEQ ID NO: 35333 - DNA, 383 bp, Zea mays
  unsure at all n locations
  Clone ID: LIB3060-052-Q1-K1-G3
cttgggcgtacgcggacacagccccgatccgaatcgtcctcctcgcgagcctcgtcgatcccccactcccctcccctcgcttcaagatgcagatctttgtgaagaccctcaccggcaagactatcaccctcgaggtggagtcttctgacaccattgacaatgtcaaggctaagatccaggacaaggagggcatncctcctgaccagcagcggcttatcttcgccggcaagcagcttgaggacggccgcacacttgctgactacaacatccagaaggagtcaacccttcatttggtgctgcgccttaagggaggcatgcagatctttgtcaagaccttgactggcaagacaatcacccttgaggtggagtcttcagacaccatt

SEQ ID NO: 35334 - DNA, 194 bp, Zea mays
  Clone ID: LIB3060-052-Q1-K1-G4
cggacgcgtggggaagaaaatgatccatgtaaattctcttgttcgtaatacggctatagcaataattctgtgtcaactttgctcgtgctgttctcggtgtgtttagatttttatagtatgtgtacttgttatagaatttctgtagagcagcttgtttgtgtagtctaatgttttataataatcatactagcagt

SEQ ID NO: 35335 - DNA, 401 bp, Zea mays
  Clone ID: LIB3060-052-Q1-K1-G5
agaaaatgggattgctgtatatactattttggaggtatatagagtttcagatatggagcttgtgagagtgcttgctagtgccgaagatgaagtcaatgttgcatgctttcatcctttaccaggacgtggacttgtttatgggactaaggaagggaagctcaggatccttcaacacaatggcgcagacatgataaacatggggtcgggttgcttcattgacgaaaatatggctgagatccagaggtatgcattggaatgctgaataagcttgaccacatcatgtgaattttaggcttacttccatgaaagacttctgtgcaggcttcatctgtgtgatccgttcaagggaaaacattagatgcatctgcaactacattagaacagataattctcaatgggct

SEQ ID NO: 35336 - DNA, 423 bp, Zea mays
  unsure at all n locations
  Clone ID: LIB3060-052-Q1-K1-G6
gtcacacacctcacagagctgcagcagcatcagctgccacctcctgcctctcctccttccttcctgcctgcataggttgttgctacacgtatatattctgaagaagagatcgagatgaccagcgtgtggaagaccaaggttctgcctggcctcaacaagatctttgacaaggatggcaagaaggctgcagctgcaggcttcttgaagtccttcaacaaggaggagattgacaaggagattgaggacaagaagacagagctggagcccaaggtcgtggaggcctacgaagcatctcctcctgaggtcaaggctctgttcaaggataagaagccagtcaaggtcagcaagaagaactcggctgcagtcaccaagttcctcgatgagctggctaagattgacttccctggagccaangtggtgagc

SEQ ID NO: 35337 - DNA, 394 bp, Zea mays
  Clone ID: LIB3060-052-Q1-K1-G7
aggaaacgggacacatagatatactattttgaagggacatatagtgtcacatgtgcagctttgctagatgcttgctatggcctacaatgaagtcaatgtgaacatgatatatccattaccaggatgtggactacgcatatgggactaaggactgaaagcgaatgatacttgaacacaatggagcgtacatgataaacatggcgtgaaggttgatacattgaaggaaatatggttgagaaccagaggcatgcataggaatgctgaacaagctggaccacatgatctacaatagcaggcttacttacatgaaagacttgtatgcaggctacaagtgtgtgatccgtacaaggaaaaacattagagccatctccaagtaccttagagcacataattc

SEQ ID NO: 35338 - DNA, 394 bp, Zea mays
  Clone ID: LIB3060-052-Q1-K1-G8
cccacgcgtccgagtgggtgcgccaagccgctctcggtgccgctgcaggcatgggctcgcccgccgtctcccgccggtcgccgtctccccccctcgttctgcgcccctgacacctccccagctctcacccgcgccgtcgagagcccaggccagtctcagtctgacgacgccccgccaccacgctcgggtgaggccgcctcgtccctggcgccgcgcgcgagctcgcatctcgaccgatggtcccggtcgcgggcgctgcggtcgggccaccggccggcgctgaaccgcgcggctctctcctcggcctcggtctcggcgccgccggtgatcaagtcgccgcggcccgaggacgctgccgtggcggcggaagatggcgaggacgacgacgtgtgcc

SEQ ID NO: 35339 - DNA, 368 bp, Zea mays
  Clone ID: LIB3060-052-Q1-K1-F3
gtgcggacgcacagactcgatgccgcttgcttctaccgtggccctgttcgcctgaccggtgcgaggacgcctgccagggcgctctcggcagtctttgattccacgcatgaagagccccgcgcggtgcgcgccgcacggatatggcggcagcctcatggctgaacggcgctcaggcgatccgaacatcatagaagacagaagcgacacataacaaccggacagggccacaaggaggtctctatctgggataaccacccaaattacaactcaagatgcaaacattattgatcaatacggatcacctggtctgctaaatgtttttatggaaagaaagcaacggccaagttcttggagatggatgccaatgc

SEQ ID NO: 35340 - DNA, 296 bp, Zea mays
  Clone ID: LIB3060-018-Q1-K1-A7
cacgcaggtggcgacgtcgtgcggggagcggatgcaccagattgtggccgaggaggcgacagctgccgcaggctcgtcggtttcggacgaggcggcgcggtggaggggtgtcatggagaagagctacgcgaggatggacgccgaggccgacgcttctagtgatactgcctgaccagtgcgcatctgccactacgagatgccagatgcaaagctcaaacacacgggctccactgctgtcgacgccgttgcagtgcctagccgtctggtcggctgcaaatgcggcgactgcgctgcgg

SEQ ID NO: 35341 - DNA, 364 bp, Zea mays
  unsure at all n locations
  Clone ID: LIB3060-018-Q1-K1-A8
gccattccacgctctcgcggctcgtgtgccagcggtgaccagcgctcgtgctcgtccagtccaccaggcgctgctgttccggcaagccagccagcagcagccgccgccgccgccgtctcggagctcgagctcctagtcccccggggccgaggcgccggcgccatggaccagctccggcccgagccggccgcgggcgcgcacgagatcgagaagacggcggcgccggacgtggagtcggagcccgcggcggcggtgccggagccggagcgcgtgccgncgtggcgcgagcaggtcaccgcgcgcgggatggtggcggcgctgctcatcggcttcgtctacacggtgatcgtcatgaagctgagcc

SEQ ID NO: 35342 - DNA, 412 bp, Zea mays
  Clone ID: LIB3060-018-Q1-K1-A9
gctggcttctcctccccctcttatcaagtcctcctcgggttagggttccttagggttgtgtggaggggcgatggcggcggctgatgtggagtaccgttgcttcgtcggcggacttgcctgggccaccagcaacgagtcgctggagaatgccttcgcctcctacggcgagatcctcgactccaaggtcatcaccgaccgggagacggggaggtcccgcggcttcggcttcgttaccttctcctccgagaactccatgctcgacgctatcgagaacatgaacggcaaggagctcgacggccgtaacatcaccgttaaccaggcccagtcccgtggcggcggcggcggcggcggcggcggtggctacggcggcggtcgcggcggcggcggctatggtggcgggcgccgtgacggc

SEQ ID NO: 35343 - DNA, 423 bp, Zea mays
  unsure at all n locations
  Clone ID: LIB3060-018-Q1-K1-B1
ggccgtggacgccgctcgcttcgccgtcgcccactacaacaaggaccaaggcgccgctttggaagttactaaggtgctcaaaaccaaacggcaggtggtgaccgggaccctgcatgacctgatactggaggcagctgatgctggaaaaaagagtgtgtacagagcanaggtttgggtgaagccgtgggaagatttcaagtctgtcgtcgagtttcgccttgttggagactctgaatctgaacccgagccttctgttgcttctgatgttagctctgggcaagcaattgccaaactctctcttgaagcagatattgtacaagaagaggctcgcctgcacaccattgagaatgatgggctttcccgcgatttcacatcatcatcttaggattccaggcaaggatggaaagcgtaaaggtttaaatg

SEQ ID NO: 35344 - DNA, 265 bp, Zea mays
  Clone ID: LIB3060-018-Q1-K1-B10
ctggcccagcatctactcctgtagctttactttttcgtcaaaatgaaaagaaacactgctctgtaactggttgacagtaccactcatagcataatgggtatactgctgattacggtggacctagactgatttcgatgtagagccaatatcaccaacgtccttgactgtctcatagaggagttctgcatcgagaaagtggagttcgatgacatgaacgataataacgtggtgattgtgcttggaaagttcgacgtctagaatctct

SEQ ID NO: 35345 - DNA, 400 bp, Zea mays
  Clone ID: LIB3060-018-Q1-K1-B11
ggtacactctgatccgaacaatggacgcgacgcaactgaaccgatcgatggacgccacgccgacgcggctcttccttggcgcgctcctcctcctcgtccccgccgcgctcctcctcctgctccgcgcgcggggcaggcgccgtctccccccgggcccgccgtccctgccgctgctcggcagcgtggtgtggctcaccaactcgcccgccgagatcgagcccctgctgcggcgcctcttcgagcgttacggccccgtcgtggcgctccgcgtcggggcgcgcttgtccgtcttcgtcgcggaccgccgcatcgcgcacgaggcgctcgttgaccgcggcgcgacgctggcggaccgcccggcgctcgcgtcggtcaagttcctcgacgagagcgacaacac

SEQ ID NO: 35346 - DNA, 265 bp, Zea mays
  unsure at all n locations
  Clone ID: LIB3060-018-Q1-K1-B12
cacagccaccgtcgccatggccgtctcagccgtcctctcgtctccgtgaaagccctggagggcgacatggtcacggacgcccncggcatcgccttaccgtccgtcttcggggcaccgtatccgccggacgtgggtccgttcacccacaagctgctgtcctgcaacaagcgccaagcctacgcaagtctccggcgggcttggcaaccagacgtcgggccaatcctggggtaccggcccggcctgggtccggattccccgggttccc

SEQ ID NO: 35347 - DNA, 441 bp, Zea mays
  unsure at all n locations
  Clone ID: LIB3060-018-Q1-K1-B2
gtcactcaacacagcacaggcagctcgtgagagagagagagagaaagatgtcgtggttggggcaccaccaccacaaccagccggctcccccggcgtcgggccccaaccaggtgttcaagatcttctgccgcgccaacgagaactactgcctggccgtccgcgacggcgccgtcgtgctggccccggtcaaccccaaggacgaccaccagcactggtacaaggacatgcgcttcagcacccgggtcaaggacgaggaaggcatgccggcgttcgcgctcgtcaacaaggccacggggctcgccatcaagcactccctcggccagtcccacccggtcaagctcgcgcctttcaacccggaccaggaggacgcgtcggtgctgtggacggagagcaaggacgtgggcaagggcttncgctgcatccgcatggtcaacaacaccc

SEQ ID NO: 35348 - DNA, 397 bp, Zea mays
  unsure at all n locations
  Clone ID: LIB3060-018-Q1-K1-B3
cggccgacttcgctcaaccggcagcccgtcacaaggaaatattggccgattttgccgcggcgggggggcctgcaccattattccggtccctccccttgccacggtttccgactcctatactatctactcttggccggagagcccatctggtcgacggtccgctatgtctctgcgncaagcgccgcgcctgagccgacatgggctcaagctcattcttcaactgacgaaatcataacgtcactgatgctgacgttcagctttacatccgatgaacattcttctagttccagaacgctatatagatggaaaagggtattgctcacagtaagtggcgaagctcttgccgcgaatcacacagaacacatcgacccagagattacaatggctattgcacgag

SEQ ID NO: 35349 - DNA, 405 bp, Zea mays
  Clone ID: LIB3060-018-Q1-K1-B6
gtttattggcccattataaaattgtacaaagcttctccaaatatgccaattgatccattacaattgtttcataactactgtttatggattttgggactgcagaactgatggattctaacagatgtaacagacctacagtagggatgctaggccaaggagttaaaatatatccacatgttagaatatttcgtaactgtagtaacttcaacattatatagattaatcatgaacttttagttgtattaaacaaataagctctgtatgttcattgttgtagaactaagtttattgtgaatttgtgaacacatatatttgttcatgaaactgcattggatttggactaacaaagtttgtgtatgtgatatgtttttagtctggatctgcccttggtcaagattcaaatat

SEQ ID NO: 35350 - DNA, 434 bp, Zea mays
  Clone ID: LIB3060-018-Q1-K1-B7
cacagagagaggacaactcctcacaactctcccttccctcctgtaggggccaaaagggttagagagtaagagaagtagttcattcccttgcccaacacaagaaaacaagctctcctcatcaccctaatccaagcaactgcttgtgtgttgggaaattcttgtgacccctgttatattattatccgtgtagctactagcttcattcccccctttgtacccatcaaatggctggcatgtctctgcaacacccctgggcgtttgctttcggtctactaggtaacgtcatctcattcatgaccttcctggccccgataccgacgttctaccgcatctacaagagcaagtcgacggaaggcttccagtcggttccctacgtggttgcgctgttcagcgccatgctgtggatcttctacgcactgatcaagtccaacgag

SEQ ID NO: 35351 - DNA, 434 bp, Zea mays
  Clone ID: LIB3060-018-Q1-K1-B8
agcgtaacaagtgtccttcctccgtcttcctcctctgccgactgccctcatccactccactcccaagtccccaccacccccaaccccgtctctccactgcggcgcaggcttcgcttcggctccgctcggctcgagcagaagaaaatgcaacgggcagtgcagaccgtcaggtcacacggcaatgttcttaaatatgctgttctacaacacatcagcgctcccaagccagcaatgcttcctgctgccttttctcgtttcatgtcagtttcatctgctcgcctagaggatcgtggatttgaaactgccactgtagcagatgtcttgaagtctaaagggaagagtgctgatggatcttggctctggtgcaccacagacgatagcgtctatgacgctgtcaaatctatgactcagcacaacgtgggagctttggtggt

SEQ ID NO: 35352 - DNA, 395 bp, Zea mays
  Clone ID: LIB3060-018-Q1-K1-B9
ccacgggtccgggccactgcattatatccttcctggttctctgtacacctatatcgctctagtccgtgggcatcgtcctaagccacgtgctaaggctttcgttggactctttcacgacgacgagcacccatcatttctgtacaaatggctgatggtgaggacatccagcctcttgtctgcgacaatggcactggaatggtcaaggctggtttagctggctatgatgcaccaagggcgggtttccctaacattgttggccgttctcgccacactggtgtcatggtaaggatgggacagaaggacgcatatgttggcgatgaggcacagtccaagaaaagtattcttacgctcaagtacccgattgagcacggtattgtgagcaactgggatgacat

SEQ ID NO: 35353 - DNA, 426 bp, Zea mays
  unsure at all n locations
  Clone ID: LIB3060-018-Q1-K1-C1
ctcttcttctcctcctctttcttctcgaaccatcatcatatatatatatagaatcaatatggaaggagcggccgaccataagcggcaggtggacgacaagccgccgtacgccgccgtggacgacaccatgaccaccaccacgaagaagatggtggaggagcagctctcagacgacgccggcggcggcggcgagctgccagagcagaactaccgtggatggaaggccatgccctacgtcatagggaacgagacgtgcgagaagctgggcaccatcggcaccacggccaacctgctggtgtacctcaccaccgtgtacggcatgtcgggcgccagcgccgncaccctgctcagcctctggtcgggcaccgtcaacctggcgccgctcctgggcgccttcctcagcgacacctacatgggccgctacgc

SEQ ID NO: 35354 - DNA, 425 bp, Zea mays
  Clone ID: LIB3060-018-Q1-K1-C11
ggctcacgaggtacggcacctcgccgtggcccgcggctgtttccgaggcaagcggactcaccggcgtcctgcgcacgcgaggcgagcagcggctccgtcgacctgcgagccaatccgtctttatttctccaccccaatatccaaacataagataaaaatctatccaacactcatttcccacgccactcccccactccctctccaccctgcttccgttttcggccggcgatggcgacgaccgccgccgcatccacgtcgctccggccgctgtcaccgtccccacctcgcatcgcgagtttgccccgtcggtggtgttggggaatcccggtgcagtcctccgggcggagcgcattccatgctgaacggcggaggcggagcactttattatgcgctgctgataaagctcctgaagaatccctcaagaa

SEQ ID NO: 35355 - DNA, 409 bp, Zea mays
  Clone ID: LIB3060-017-Q1-K1-H3
gagggtcaaacatgcactactattgccatgaagatccactcacggctgcatgcaatccgagattgtcaatgatgcatacatgctggctatctgtatacaggcacttggactacaatctttcacatgacatgaacgccttccataaactggtcattgacgatcaacagctgctacgtacatcaagttcaacacctagatggctaagctggcctttaacctatgaacatctgctgtttacgatacgagatctacgttctttgtagcaaatgacaatgctagtccattgacagaatgtgctgtatactggtctaccgcttccagcataactaccattcggaaaccgccactctttgagtatgctgacagttccatgacaaatacttgtcgcacaagctttgtcttacactct

SEQ ID NO: 35356 - DNA, 395 bp, Zea mays
  Clone ID: LIB3060-017-Q1-K1-H4
cagtccgatcgtgagctcagctcagctccgctagtcctctccccgcacgcaccaccagcaccagcagtccagcaccatgggcggcgccctgatcgtcgcgctcctcctcgcgaccgtgcccctctccttgggcggcggcgcgcacccgggctactccgacgccgacgagagcgcgtgcacggtggacgcgggcgcggagctgctgcggcggctggaggagcgcgggcccggcgggcgcagcatcatcgacatcacgcacgcggtcgtgccggacctgccggcgttcgccacgggggcggtcgcggggcccatgctgcgcctcagggagtccatggcggacgggtccgagtacaacctgtcggagctgcggatggagtgccacaccggcacgcacg

SEQ ID NO: 35357 - DNA, 429 bp, Zea mays
  Clone ID: LIB3060-017-Q1-K1-H5
accttcaagtctcgctacgtagcagtgcaataaaaaaagcagccgcaatggcgagcagcaccatggccctctcctccacggccttcgccggcaaggccgtgaacgtgccgtcgtcgtccgccttcggcgaggcccgcgtgacgatgcgcaagacggcggggaaggccaagccggcggcggcgtccgggagcccgtggtacggccccgaccgcgtgctgtacctgggcccactgtccggcgagccgccgagctacctgacgggcgagttcccgggcgactacggctgggacaccgcggggctgtcggcggacccggagacgttcgccaagaaccgggagctggaggtgatccactcccgctgggccatgctgggcgcgctcggctgcgtcttcccggagctgctcgcccgcaacggcgtcaagttcggcg

SEQ ID NO: 35358 - DNA, 372 bp, Zea mays
  Clone ID: LIB3060-017-Q1-K1-H6
atctaaacggagctctaagcgtctcggcaaagaggagcgcaaccgcactggggatgaggacagtaaggctcttgtccatggccatcccaacccaggacgcgaacaaggcggaggagatccaattggggtacacgcgtgcaacgatgatccatagatccaataacgatatgcaggcctctgcgtcccggatcgctcgtggcggacaggacggtgtgctacacgtcggcagactgccatgtgagcctccgagctaacggatgggcgagacacggctatactaaggctggcactcaggctgactgacgccgcagcgtgcaacattcggcaggaactgagagttagacgtcatccattcctgctggtccatgctaa

SEQ ID NO: 35359 - DNA, 392 bp, Zea mays
  Clone ID: LIB3060-017-Q1-K1-H8
aaaaaaaaaaaaaaaaaaaaaaaaaaaaaaaaaaaaaaaaaaaaaaaaaaaaaagaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggccgttttaagggacccaagttaacttccccgggcttgcaacgtaaaagcttttttaaggggaccccaaaattaaattaaggggccgggttttaaaaacgtcggaacgggaaaaacccgggggttcccaaattaaatcgctttgaaaaaaatccccttttgcaaagtggggttaatagcaaaaaggcccgaacgaatggcctttccaaaaatttgccaaccctaaagggaaaagggaaccccc

SEQ ID NO: 35360 - DNA, 420 bp, Zea mays
  Clone ID: LIB3060-017-Q1-K1-H9
gctgattcctttccagctcgcaccgcggttgaacagcgtttcgttgtttcctccccaacttccaacacgcctcgatctagatccactcttcccccttctccttccggtcctccccccgagactattcatataggcgggtaggcgtccgaggcctcgtttgttctcggcttcttgtctccaagggtgctactccgtccgcgcttggtctgctctcgtccttccggaggccgcggcgcaacatggcgaagatcaagccgaaggccttgctcgcgcaaagcaaggtgaagaaggtccccggccaaatcagcgtggccacgatcgtcacctacatgatcctcggcgtcctggtcgtgtcctccgtttacgctgcctacaggtactgctgggcagtcacaggagcagcggatgcagtgggcgccc

SEQ ID NO: 35361 - DNA, 429 bp, Zea mays
  Clone ID: LIB3060-018-Q1-K1-A1
gccatggccaccgccgccgcgtctagcctcctcaagtcctccttcgcgggctcccggctcccggccgccacgcggaccacaccggcgtccctcgtggtggccaccggcccgcgcggcgccggcgcggggcccatctgcgcgtccatgtccatgtcctcctccaacccgccctacgacctgacgtccttccggttcagccccatcaaggagtccatcgtgtcccgcgagatgacccgtcgctacatgacggacatgatcacctacgccgacaccgacgtcgtcatcgtgggcgccggctccgcggggctgtcctgcgcgtacgagctctccaaggaccccgccgtgagcatcgccatcgtggagcagtcggtgtcgccgggcggcggcgcgtggctgggcgggcagctgttctcggccatggtggtgcgc

SEQ ID NO: 35362 - DNA, 424 bp, Zea mays
  unsure at all n locations
  Clone ID: LIB3060-018-Q1-K1-A10
gagccctctcttccattccagccttcccaggccagctgcaactactggctcatcaccagaaaccagaacgtacgccggcaacccatctccctgaaatggccgctgtggagccccggcagttcgggcgtctggagccgggctcctcgccagtgcgcgtggccacgaacggcgccaaggcgtaccctcctccggcaagccacctcccgcggcgcgctgactcccctgtccgcggctgcagcttccctcccctcgtctccccgccgcgcaggctggacgacgcgtcggacgacgaggacgaggagcaggaggactggcgagagctgtacggctcgcacctgcagctggaggtggagcccgcggtgcaggacgcgcgcgacgaatgcaccgnggacgcgtggatcgagcggaacccgtgcctggtgag

SEQ ID NO: 35363 - DNA, 338 bp, Zea mays
  Clone ID: LIB3060-018-Q1-K1-A12
gccgtcaagcccaccaagttcacaaaggacatggacgccgagaaggaactcaccaagttcatcaaccagtgcaacgaaataaaagctgcgaatcttgctagcaaagagggcggtgacctcaacatagtgaaggcggatggtgaggaatctaaatcaaagaaataggaagccagaaactgaaaacgagtgtgtgaaacgtgatgcgtggtaaactgttaatgcgatgtattctgctgaagaaaattcagttccgtatggctgggtagatgaacatgtttagcgcaaagtgacggtgtaactgcaaccggggtaatggcttgcaagttttgttctgtgcc

SEQ ID NO: 35364 - DNA, 422 bp, Zea mays
  unsure at all n locations
  Clone ID: LIB3060-018-Q1-K1-A4
ncagccaggcggtttggtcctgccagcattggccccaggcagttgggccccaaaagagcaactgcaaccgaccaagggccaatggcccgaaccgcggcgccggccgcgggctacggagaggacggagtgtaccgctccccgcgcccggccgtgcgcatcgagtccgacacaggcctctccctcaacgacctcctcttccgccgcgccgacgtgtgcccctccgctctcgcgctggtcgactccgncaccggccaatccctcaccttcgccgcctttcgctccgccgtcctcaccacggccgtcgccctctcctcgcgcgcgggcgtccggcgcggcgacgtcgtcctcttcttcgcccccaactgcttcctctaccccgtctgcttcttcgccgtcaccgncctcggcgccgtcgctaccac

SEQ ID NO: 35365 - DNA, 444 bp, Zea mays
  unsure at all n locations
  Clone ID: LIB3060-018-Q1-K1-A5
caagccatcgccccgatggacaccgccgcctcatgccgcctcctctcgccggcctccgcctctccgcccccctgtccgaagcagctacccaagcggcgaccgaccttcgcggcctcgcagcagcagtcgcccagctccagcgccaagttcaggctcctctgcctcctccatgacaagtccgcgtcgccaacgacgtcggtgcagatgcagagctcacagtcacagttgcagaggctggcgacggtgttgcagtgcggagccgtctgggcagctgttgaggcgccggcggcgctggcggtgaccggcgaggaggacatcgacctgctagggatcctgccgccgctcgcggtgttcgccttcttctacttcctcgtcgctcctccggtgatcatgaactggatgaggctgangtggtacaagcgcgaattcgtggagacgtacctg

SEQ ID NO: 35366 - DNA, 435 bp, Zea mays
  Clone ID: LIB3060-017-Q1-K1-H2
gaaggtaaaagatgcaagattattggaggaagatcttgtcagggctgcatgcaagcttgagttgtcaatgatgcaaacatgcaagctaactgcagacaggcactcgcaaaacaatcttacacatgacatgaaggcaattcagaaacaggttattgatgatcaaaagcttttacgtgataaggttcaacacctgagtggcgatgctggccttgagcggatgaactctgctctttccgatacgagatcaaagttctttgaagcaaaggagaatgggagtccattgacagcacctgttgcaaatgtgtctacccctttgagcatcaattcgtctgggaaagcaccactttctgaggttcctgaaagttccaggacaaatgttgttgggacaagctctgtagtccgttctttgttcagtgcttcttcatcatcagtcag

SEQ ID NO: 35367 - DNA, 421 bp, Zea mays
  Clone ID: LIB3060-017-Q1-K1-F9
cggacgcgtggttagggggggagcgcatgtgcctgaagtaagcctaatcctaaccgccgccgtcatgacggcgcccaagctcaagctcctagctcttcctactctgctggtcctcatcctcctcctcctcctctccgccgcccggcggcgcgtccttctggagacgctcctcctccgcgccccggtcctcccgggcgacctcctcccgctcctgccctggcccgtggcgcagccgctgctccgccgcctcgcgctgcggggccccgccgacctgctcccggctttcgtcggggccgcgcgcgcgccggggtccgacgacgcctacccggtcgccgagtggaagggcgcctgcttctacgagaacagggcgtgggtggagttccgcaacgggaccggcggtgggctcggaggcggcgtagtc

SEQ ID NO: 35368 - DNA, 421 bp, Zea mays
  Clone ID: LIB3060-017-Q1-K1-G10
gaaaaacttgaatcattctatttaccaatgtattcaccatcggttggtgaagtggaggccatactaaagcaagttgggttgttcaacatgaatcatgtaaaagtattccagacaaattgggatccctacgatgacttggaaagtgatgttgtgcataacagtattaggagcggtgaaaatgttgctaagtgcctacgagcagttatgcagccgctagtcgcaagccaatttggagaacccattctcgataagttattcaaagagtacgctcgccgtgttgccaaacaccttgagaatgagaaaaccaagcatgctattattgtcctatccatcgagaaagcaattcacctgtgaagtgtattgtttctcactatctcgcttggcatgctactatttgtgtagaaaactttgtatgtatgtt

SEQ ID NO: 35369 - DNA, 424 bp, Zea mays
  Clone ID: LIB3060-017-Q1-K1-G11
aatcggctctaccagaagaaattctctggcccgaggtgggaggcgttggccaagaaaggtgccatgaaacagaggttgttgtgggcgttcaccggtgtcaagaacccagcttatcccgacactctttacatcgactgtctcattggacctgacactgtcaacacgatgcccgaccaagctttgcaggcattcatagaccacggcactgtttcgaggacagttgatgcgaatgtgtacgaggcggaaggtgtatacagcgccttggacaatcttggcattgactggcgcgaggtcagaaagcagcttgagctggaaggtgtggactccttcatgaagagctttgacagcctactcgtgagcctgcaggagatggtcaacatcctcaagacggcatctgtgtaaaactgagaagattgtgtaccgg

SEQ ID NO: 35370 - DNA, 379 bp, Zea mays
  unsure at all n locations
  Clone ID: LIB3060-017-Q1-K1-G12
aatcggctctaccagaagaaattctctggcccgaggtgggaggcgttggccgagaagggtgccatgaaacagaggttgttgtgggcgtccaccggtgtcaagaacccagcttatcccgacactctctacatcgacagcctcattggacctgacacggtcaacactatgcccgtacaagctttgcatgcattcatagaccacggcactgtttcgaggacagttgatgctaatgtgtacgaggcggaaggtgtatacagcgccttggagaagcttggcattgactgnggcgaggtcggaaagcaacttgagctggaaggtgtggactccttcaagaagagctttgacagcctactcgtgagcctgcatgagaagggcaaca

SEQ ID NO: 35371 - DNA, 416 bp, Zea mays
  Clone ID: LIB3060-017-Q1-K1-G3
cggattcccggcttcggatcaccttgcagcagcacgtggttcaagaaagtgaaacttgacgcactgaacatgtccagatgctggggagagctcaagtatttgatggacacaatagctgggaattccaaaaactgcatctcgtcacagcctcgcagattggatgcgtgattcacacggctggtttggcattgtttgaacacatgagaaggaagggctgttccatacggttggaagacgacatgttgcgttgtgtactatgtatttagacgaagactgttcttttttacgctgaaaaataaattgcatcttccgtctttctttgtgatgagctccttttctctatcctttttcttttctagaaaaaaaaagagtgagacactatacgtgtttgttacctgcaaggtttatgctacttt

SEQ ID NO: 35372 - DNA, 250 bp, Zea mays
  Clone ID: LIB3060-017-Q1-K1-G4
gtatgcttgattcacactgctgatttggcattgtttgaacacattataacgaatggtctttccatactcttagcaagactatatgttgctttatgtactatctatttacactaacactgttcttttttacgcttaaaaataaattgcatcttcctactttctttgtgtatgactcctcttctctatcctatttcttttctacaaaaaaaaatagttatacactatacctattagttacctgcaagtttta

SEQ ID NO: 35373 - DNA, 408 bp, Zea mays
  Clone ID: LIB3060-017-Q1-K1-G6
gttgcatggagcgaggctgaacctatgaagctggcagggatccatggacggggggaactggacaagcctacgtgtccacgacagcgaccctaccgtctgctatccaggccagttcgcctcttggcccatcgttggcccggcggtccttctgcccttgcgattcttcagggtcgccctgacaggccctgccgtcggctgtacgtggaacctgtgcatttgcttcctcgagctctacggctacttacattagatcttcttcttactcttcttcttaataaaaaatatagatgccggagtttttgtgcaaacacaagtaatattacctgcgatgccacaattgctggtcattgcacatcatgaaacatgtattcacagttgaaaaagaaagttgttagaacgataggccta

SEQ ID NO: 35374 - DNA, 411 bp, Zea mays
  Clone ID: LIB3060-017-Q1-K1-G7
cggacgcgtggccaggaagagattacaatgcaccgtgtgcaacaatctcttccgtgtggacgacgaacatcggaggcacttcaagcagcatgagatcacaatgtcaccgtctccaagaatctccccctgccttctagatcccaacctgttgcatcatgtccacttttcaggttctgcacgactggacgctgaggctagagcactgtcctgtttataaactaatatccagaacagcgccacagctggctactgctatggtcatgcacgctgcactgtctggttcattgataatgtagagttgatctgtcacttcagtatgacgccaccttgatagcccgatgtcgaattacctgactatatgtatcatccttgtagtctgcaagaatcatgacgttattactaaagcactta

SEQ ID NO: 35375 - DNA, 402 bp, Zea mays
  Clone ID: LIB3060-017-Q1-K1-G9
aattactgcatttcttaacttattttttctctttctattttgcttttttttttattttatatggtatccatcgctttgaaaccatcaaatttgatctccttccatatttcacaagctgcggctagttcaacactccatttgcaagctgctttgataatttcattaccttcacgagcaaaaatcgcgcccttcgttacaagcttgtacacaggcttctaaagccacacgattagctgctgcaccaggtgcatttccccaaggatgtcctaaagttcctccaccaaattgtaatacggaatcatctccaaagatttcggtcagagctggcatatgccaaacatgaatacccccataagccaccggtataacacctgtcatggatactcagtcctgagtgaaaaa

SEQ ID NO: 35376 - DNA, 443 bp, Zea mays
  Clone ID: LIB3060-017-Q1-K1-H1
atcgtgcaagccctcgctgctcgccccttctcgcccacgtcgtgcccccgtcgatccatcgtttgtgttcccccttactccctgcgccttcctctcaccctctatcgcctaaaaaccctagtccgtgcccagccactaccgtcgactgcgcgtggtcgctggccgcgtgcgtcgacccaactgatggcacgacctccctcaccttcgtcgctaacctgatccatggaaggcgaaagatcccctgattacccctctccttccaccttgctcggctccaccctgcctcgactggccgctctactgcaccgtcgtcaccgtcacaaccaccatgcggaggcggatccacgtcgtctaggtcgacgtcccgttgctggagactaggcgcaggcccatcaactaacacgccaccgtcctcgcaccgcatgaggtgctcacgatgcggg

SEQ ID NO: 35377 - DNA, 423 bp, Zea mays
  Clone ID: LIB3060-017-Q1-K1-H11
ggccggcaagtaccagatgaagaagctgtgcctggagccgacgtccttcaccgtcaaggcggagggcatcgccaagaacgccccgcccgagttccagaagaccaagctcatgacccgcctcacgtacacgctggacgagatcgagggcccgctcgaggtcggctccgacggcacgctcaagttcgaggagaaggacggcatcgactacgccgccgtcaccgtgcagctcccggggggcgagcgcgtgccgttcctcttcaccgtcaagcagctcgtcgccaccggcaagcccgagagcttcggcggtcccttcctcgtgcccagctaccgtggctcctccttcctcgaccccaatggccgcggcggctccaccggctacgacaacgccgtcgcggctcccggcaggggcagatgtgacgagga

SEQ ID NO: 35378 - DNA, 433 bp, Zea mays
  Clone ID: LIB3060-017-Q1-K1-F8
cggacgcgtggttagggggggagcgcaagtgcctgaagtaagcctaatcctaaccgccgccgtcatgacggcgcccaagctcaagctcctagctcttcctactctgctggtcctcatcctcctcctcctcctctccgccgcccggcggcgcgtccttctggagacgctcctcctccgcgccccggtcctcccgggcgacctcctcccgctcctgccctggcccgtggcgcagccgctgctccgccgcctcgcgctgcggggccccgccgacctgctcccggctttcgtcggggccgcgcgcgcgccggggtccgacgacgcctacccggtcgccgagtggaagggcgcctgcttctacgagaacagggcgtgggtggagttccgcaacgggaccggcggtgggctcggaggcggcgtagtccatgtggagaca

SEQ ID NO: 35379 - DNA, 361 bp, Zea mays
  Clone ID: LIB3060-052-Q1-K1-D9
ccgggccgacccactcgtccgcacgcgccagagtgcactaccccatcaggttcacattcaccaccggccgcaccctccaccagcttcggatccttccaattgatgctactctcccgacagcatgcacgcttcctactaatccgcctcgccttcctctgccagccgagaacgccccgaagagtcacggcccacacgccagccgctaaagacctgccgtacaccgacgccgccgacactactgggacgtccactcgaaacgcggagactaaccccaagtacaacaactaccacaacgcgaccctcacgacgtaaatgctgcatcaccagctgaccggcccgatcgacaacgagatgaccatca

SEQ ID NO: 35380 - DNA, 368 bp, Zea mays
  Clone ID: LIB3060-052-Q1-K1-E1
caaaaatgaatggcacaggccatcgatagattgattcatccactgatgacgatacatgcgtctgtgcttagtttacatcgaccgcttacagcaggcagccattgacattgattgatgagcacacatcgatcatgagcatacgccggctggtgcaactactacacgcctacgatctgaacaagtagagtacagagaagaccacactgttcactcgacggacggacgaacgaatggatggatctgatggtagtacacatgtacggcgttgctcagtcagttagttgccggggacgaagttcgtggcgtatgcccaggcgttgttggcgacggggtcggcgacgtggtcgaagaggttctcgatggggccc

SEQ ID NO: 35381 - DNA, 411 bp, Zea mays
  Clone ID: LIB3060-052-Q1-K1-E11
cccacgcgtccgctacttcccatacccatactttgtgtccttgatccatctagtagtgggtgtcgtatactgcctcatcagctggagtgtcggtctccccaagcgagcgcctatcaatggcacgctcctcaagcttctctttccagtcgccctgtgccatggtattggtcacatcactagcaatgtgtccttcgctgctgttgcagtctcatttgctcacactatcaaagctctggagcccttcttcagcgcagcggctactcagtttatccttggacagcaagttcccttctctctgtggctttctcttgcccctgtggtcattggtgtttcaatggcatcccttactgagctttcattcaactggactggcttcatcaatgccatgatatcaaacatctcattcactta

SEQ ID NO: 35382 - DNA, 422 bp, Zea mays
  unsure at all n locations
  Clone ID: LIB3060-052-Q1-K1-E12
ctcaggcgcaaggagagtgggtcgtctgccgcgtcttccagaagggcggctacaggccgaggaggaggcagcgagaagcgtcgccgccgccgtccgctagcagcagctgcgtcacggatgcgtcgagctcggacctggacgaggtcagcagctagcttagctagctagctagcagaaccgaccgtacgtgccggctggccacaacatgcagtcaagaacgtacgtacgtatatgtataccgccaccagctcgtcgcgcgcgcagctgtgctgtgcatgccgtacgtgtgcggtcggcctcgacctcgatctcgaagagaggatgtgatcaagctgagttacggataacggggaacaacccattcacacgcacttttactccgagccaacattatttggtggtaactagnttttcttttcttt

SEQ ID NO: 35383 - DNA, 206 bp, Zea mays
  Clone ID: LIB3060-052-Q1-K1-E4
ccatactatagattgcttaattcgctggttactatacatgcctgggcgcttagtttacatcgaccgcttacagcagccagccatatacattgattgatgagcacacatcgatcatgaacatactccggctgctgcaactactacacgcctacgatctataacaagctaagtacataaaagaccactctgaccactccacgtacaga

SEQ ID NO: 35384 - DNA, 430 bp, Zea mays
  Clone ID: LIB3060-052-Q1-K1-E5
ggacgcgagtgagtgaacaccagccgtattgtcccgaccccgaccgatcctcgcctgctgcagccatggcgacctccgcggcgctctccaccgccgccaatcccacccagctctaccggtcccgcgctttgctgggcaagccggtgaaggggcttggcctgagcatgggccgcgagcgcgcccagcggagcattgtgtgccaggcggcgagcagcatctccgccgaccgcgtccccgacatggagaagcggaagctgatgaacctcctcctcctcggcgccatctcgttgcccaccgtcggcatggtcgtcccctacggcgccttcttcgtccctgccggctccgggaacgccggcggcgggacctacgcgaaggacaagctgggcaacgacatcacggtggaggcgtggctcaacacgcacggtcccaa

SEQ ID NO: 35385 - DNA, 427 bp, Zea mays
  unsure at all n locations
  Clone ID: LIB3060-052-Q1-K1-E6
ggacgcgagtgagtgaacacctttcgttgtcccgacccgaccgatcctcgctgctgcaccatggcgacctccgcggcgctctccaccgcgcaatcccacccagctctnaccggtccctgcgctttgctgggcaagccggtgaaggggcttgcctgagcatgggccgcgagcgcgcccagcggacattgtgtgccaggcggcgagcagcatctccgccgaccgcgtccccgacatggagaagcggagctgatgaacctctctcctcggcgccatctcgttgcccaccgcggcatggtacgcccctcggcgccttcttcgccctgccggctccggaacgccggcggcgggacctacgcgaaggacaagctgggcaacgacatcacggtggaagcgtggctcaacacgcacggtcccaacgaccgtacgc

SEQ ID NO: 35386 - DNA, 314 bp, Zea mays
  Clone ID: LIB3060-052-Q1-K1-E9
catcttcctcgatctccctagctcgctctccaatctcccatttctctctctctctctcgtcttcggcatccatccatccatcccgtcgtcgtgatagatggcggcaggccaaccgtccgtggagatgacgacgcaccaggggccgccagctgccacctattctccggccagggatggcggcggcggcggcggaagaacccccaaggagaagaaaaagccgcggggatcgacaaccggctttccaatcagggcgacccggaacgccaagggggggtactccgccttcaccaacgtaccggccatggccggggccg

SEQ ID NO: 35387 - DNA, 436 bp, Zea mays
  Clone ID: LIB3060-052-Q1-K1-F11
catggcggcggaggggaagaggaagggcgtcccggcgctagggtggtggctgatgctagtcggctccctccgcctcgcctccgtctggttcggcttcttcgacatctgggcgctccgcgtcgccgtcttctcgcagacggagatgactgatgttcatggccgtacatttggtgtctggactcttttgacctgcaccctgtgcttcctttgcgcactgaacctggaaaataggcctttgtacctggccaccttcctatcattcatctacgctcttggtcatttcctcacggaatacttgatataccacaccatgcctgcagcaaatctgagcacagttggcttctttgcaggaacgtcgataatatggatgcttctgcagtggaattctcatgggaacccccggggttcctatgctgggaagcagtcatgactgatg

SEQ ID NO: 35388 - DNA, 405 bp, Zea mays
  Clone ID: LIB3060-052-Q1-K1-F12
aagaagacgagtgtcaagtgaacctgaaacttgcggtgtcactggctggtagcctgagtgtgagtgagtgatcgagctagctgagctccgatcctcgctagctaggataccgccataccacaagtcttcttcacaagtttaggagtgacagcaacaagagatcgatggcctctgccaccgtgctcaagtcctccttccttcccaagaagtccgaatggggcgccaccaggcaggccgtcgcgcccaggccgtccaccgtctccatggtcgtccgcgcctccgcctacgccgatgagctcgtgaagaccgcgaaaacgatcgcgtcgccggggcggggcatcctggcgatggacgagtcgaacgcgacgtgcgggaagcggctggcgtccatcgggctggagaaca

SEQ ID NO: 35389 - DNA, 421 bp, Zea mays
  unsure at all n locations
  Clone ID: LIB3060-052-Q1-K1-F2
gcccggccgcacagactcgatgccgcgcggtgctacggtggccctcttcgccggtccatcgaggaggcctgccgtggtgctctcggcggtctttgattccacgcaggaagagccccgggcggtgcgcgcggcgcggatttggcggcggcctcatggcatgaacggggctcaggcgatccgaacatcatagaagaaagaagcgacacataacaaccggacagggccacaaggaggtctctctctgggataaccacccaaattacaactcaagaagcaaacattattgatcaatacggatcacctcgtctgctagatgtttttatggaaagaaagcaacggccaagttcttggagatggatgccaatgcttccggttntgctgtcggagcgaatcatgaggaaggaaggaaacgcatggattg

SEQ ID NO: 35390 - DNA, 439 bp, Zea mays
  Clone ID: LIB3060-052-Q1-K1-D8
cccacgcgtccgaacgtgctcgatcttcatctcgaccgtcgctcaccgggaagctacgctacgacgaagcatggcgtccgtcaccgcccgcgccccggtcgcggccctgcgcccgtcggcgtctctcaagtcgtcgtcgtcgtcggcggcggccttccttggccactctagccgcctcggccgcactgctaccgcgtcgccgacgaggcgcagcctaaaggcggaggccaagggcgagtggctcccgggccttccctcccccgcctacctcgacggcagcctgccgggtgacaatggcttcgacccgttgggcctggcggaggacccggagaacctgaggtggtacgtgcaggcggagctggtgaacgggcggtgggcgatgctgggcgtggccgggatgctgatcccggaggtgctgaccaaggtcgggctgatcaac

SEQ ID NO: 35391 - DNA, 363 bp, Zea mays
  Clone ID: LIB3060-052-Q1-K1-C2
ctgtggatcagaaactccatccgggacatcgtttaccaggtccggcggcgaagcgagagggtggcatccaagaaagtgtgcgtggtcggcgctggcgtgtcggggctggcgtgtgcccgcgagctgctccgcgagggccacgacgtgacggtcatggagcagagcggcggcgtcggcgggcaatgactgtactacccgagggcggacggcggcgacccaactcgcgctgccggcgcgcacagcagcatgtacacgtgcgtgcggctcatcagccctagggagctcacgggcttctccgacttccccttcttacccagagactacggtaccggccactgccggcggtacccagggcacgctgag

SEQ ID NO: 35392 - DNA, 367 bp, Zea mays
  Clone ID: LIB3060-052-Q1-K1-C3
gcgctactttgttcaaaatggtgttgttacggatgagtgtgatccatacttcgacccggtcggttgcaagcatcctggatgcgaacctgcttatcctacaccaaagtgtgaaaggaattgcaggggccaaaaccaagttggccagaaaagaaagcttttaaccttggtgcctaccgaataaattcagatccacacgtgattatggcggaggtgttccaaaatgggcctctggaagatgcttttacactttacgaggatttcgcacactacaaatctggagtgtacaagcacattaccgggggcattatgggtggccatgccgtcaagttgattggatggggaaccaccgatgctggagaagattact

SEQ ID NO: 35393 - DNA, 395 bp, Zea mays
  Clone ID: LIB3060-052-Q1-K1-C4
gcccgcccgaacgggtggctgcggcgcatgcaatcgccttatccccccggcccgccggcccgcggccacaagcgcaagcagtgaacacggcgcctcctcgctcgcgcggccacgcccccgtcgtcgtcttctcccggcaggtactacagcgcataaatacgcagcaccggcgcccggctcggttcccgtctggccacccatccgatcccacccggcagcggcgctgcgcaatggccacccacgcagctctcgccggcttccgcatccccgccggcgcccggctgcacagcagggcgccggcgtcgttcaggcacggcgtgcagaggctggacttcgccgacttctccgggctcatgccggagtcgtgctccgtgagcgctgccgcgcgggaggcg

SEQ ID NO: 35394 - DNA, 369 bp, Zea mays
  Clone ID: LIB3060-052-Q1-K1-C5
ctcgatcgccaataatggagtttccgtaccagcaccaccaccacggccatcgccgggacgacaacgaagacgaccgcaaaggcccgcctacaccggtgtacggcggctacggccagccaccgccacccgacccgtacggccacgcgcacgtcgacccggatccgtacggtcgaccttcggcccagtccgcgtacggtggggccggggacgcctacggccacagcggccaaggctacgcgccccggtcggcctacggcgccgagtacggttacggcaacgtcgtccacgtcgcgcacgaggtcggccacgagaggccttactacggcggttgctgcggcggtcttggtggcccctacggaggcggtggct

SEQ ID NO: 35395 - DNA, 432 bp, Zea mays
  Clone ID: LIB3060-052-Q1-K1-C6
aggtacgcaaggcacagcccaagaccaccgcaccgcacctgcacaccgacagggatggcggcaaccgcgcacctcaccggtgtcctcggcgtgtcgtcgccggctctcgctccgtcccactgcagctgcagcggcgccaagaagcacagctgctctctgcgtcaggggcggcagcagaggaggcgcctccgcgtcgcccgcgccgtcgaggtggacgcgccttccgccggcgcaccggagcctgaggaggccgaggagccgtccgtcgacttcgctttcgtcagcccgccgctgctgccggacgggacgccggacgtgcactaccggacggcgcgcggcgggcagaagctcacggacatcatgctcgacagctacatcgacctctacgggccctacgataaggttcttctcaactggctcaggggcggcgtg

SEQ ID NO: 35396 - DNA, 412 bp, Zea mays
  Clone ID: LIB3060-052-Q1-K1-C9
ggcacggcacggacggcacgaccgagctccagtctgcccccgcccccatccgcacgtccgccttgatccggcaaatggcgtcgccggcgcggcggctcctgcagaccaactccgtgcagtacccgacgctccccgcggccgacccgccgagcccgctggccgtcgactccgacgtggtggtcatcctcgccgcgctcctatgcgcgctcatctgcgtcgtggggctggcctccgtggcccggtgcgcgcgctcccgcgccgcgcccgccgtcgccaggagggggctcaggaagaaggcgctcagggcgctgccgagcctcgcgtacgaggacgccgtggcggcccgggccgcggacggggcggcggaggtcctggcggagtgcgccatctgcctctcggagttcgcgccacg

SEQ ID NO: 35397 - DNA, 411 bp, Zea mays
  unsure at all n locations
  Clone ID: LIB3060-052-Q1-K1-D1
ccgaccccctccgtttgccaacgactcccggctccactgtcgctcccgctcccttccctcccacgcaagacaatggtggccgatcgcctccgcctcgcgctgctgctctccgcgtgcctctgctccgcgtgggcgcgcccacgcctcgagccgaccatccgcctgccgtccgagcgcgcggcggccgacgacgccgtcgggacccggtgggccgtgctcatcgtcggctccaacggctactacaactaccgncaccaggcggacatctgccatgcataccacatcatgaagaagggcggacttaaggacgagaacatcggtgtcttcatgtacgatgacatcgcgcatagcccggaaaatccgaggcctggtgtcatcataaatcatccccagggtggcgacgtctatgct

SEQ ID NO: 35398 - DNA, 355 bp, Zea mays
  Clone ID: LIB3060-052-Q1-K1-D10
ccgatccgcatctccgatccgcatctccgcttagtatatacatggggattggtagcgagcgattgattacactgggtgaccatcatcatcagtaactaataattactttagattagaagcaaagggaagcgaagcaagaatcgatcgagtcgagaagatggtgcagttcggcaagtggctgaggaggcagatcgagcggagcctcccggagtggcaggaccagttcctgcgctacaaggagctgaagcggtgcgtcaaggcccgctccggcggctgcccgccgttgcccgcggaggaggccgagttcgtggccgagatcgacgcggagaccgagaagatcaacgccttcttcctc

SEQ ID NO: 35399 - DNA, 439 bp, Zea mays
  unsure at all n locations
  Clone ID: LIB3060-052-Q1-K1-D12
gccaaatcttgcagtggtgtgagggattcatgtgtattgcaagccaaagctcctctcccgctgccactaagttggcactgtccagagctgtgtgcgctgtcttcctgtgtttgtgatgaccacagccaccaaattcaccacaccatagctagaacattctagggagttgctggcccgtatgaagcttgttccgtaatcatctcacaacgcgaagaagaagtggaagtcactgaagagaagacaccaccaccctcggattctcgggcaggaaactgcttctactttgatatttgtggatccgagcctgactcacctactaacaaaggtgaagaagcgacaaatttttgttgcttttgctccaaggtggtatcaaatgaagaaaaacaagagtgaagatgcnggaggacgtggtcctccatataagatctttttggtttaa

SEQ ID NO: 35400 - DNA, 383 bp, Zea mays
  Clone ID: LIB3060-052-Q1-K1-D3
cgcgccgtcgtcgccgtcgcccgcaagcggcgctccggactcgcccttcggcgcagcgacgacgcccaggggagagggctggaagaagctgcgccggaaaggcaggatggccgacggcgccgacgcccccggcacgccgaggagccccactgtgtacgactgggtggtgatcagttcgctggaccgctgaagcagccggccgggccaagacgaggacacagcacaaggatggaggaagccagccaccatcagcagcagctagcggactgaaggaggatcggaacagagaggcccccccggccatgcgacctgcttaacagagcttctggtcacggttctgttatactacgcgttaacggtgtatgtatatacgtcatcttcct

SEQ ID NO: 35401 - DNA, 431 bp, Zea mays
  Clone ID: LIB3060-052-Q1-K1-D4
caactccgacgagaaccgccactcctcgaaatctcgaaggattttctgcggcgaaccccttcgtgacgtgacccaatgggagaggcctcgccgtcgatcgccaaggacgtcaccgagttgatcgggaacacgccgctggtgtacctcaacaaggtgaccgatgggtgcgtcggccgcgtcgccgccaagctcgagtccatggagccctgctccagcgtcaaggataggattggctacagcatgatcactgacgcagaggagaaagggctgattactccaggcgtgagtgttctgattgaaccaactagcggcaacacaggcattggactggcctttatggctgctgccaagggctacaaacttacactcacaatgcctgcctgcatgagcatggagaggaggatcatatttgaggcttttggtgctgaact

SEQ ID NO: 35402 - DNA, 440 bp, Zea mays
  Clone ID: LIB3060-052-Q1-K1-D6
gttggacgcgttcccctcctgcacgcaacctcatctcgtcctccagatccaggatggccgttctccttgagaccttgcctacccgagtgctctcggtgagctactttgtttcgatctatcaggaaatccgtttgcttcatgttgtgcaggctcatatctgattgctggattcggcaaacccgcgttggatcctgtatcggttagtccttgcctgcaaggttcttgctgttttgttttggtggtcgagcatcgcatgttctgcttctggatccagatctggagaaatcgcgaagtcgtcgtcgttcggttcggagcggatctgaagcgacgatagatggaggcggcgggatctctcggtctgcagtcctgctccacctcgatggatgatgtctctgcgctgataattattggatcaatgtcgataattattagtagatcta

SEQ ID NO: 35403 - DNA, 390 bp, Zea mays
  Clone ID: LIB3060-052-Q1-K1-D7
ggctccgtggcttttgcctgtcctgtggcagcgaatcggagagcggaggggaggggaaagcgcagcaacgccggctagcgagcgggccgttcgaggatcgcaatgtgagcacgagcagggacacacaagatgcttcatcctagctgggtcggtgtctcggcacacgtctcggagtattggtctgtgataatcgccactgttgttttcgcatttggtggcgcggtgacaatttactatacagtcaatcagttgaacaagaacatcagcttgagcctgataagggctatcaaggccagggccaagaggtacaagaaatcgaaggacaaggtgcccgctgcatcccacatctggaggaaagaagttgtctcccgcaacaaaggcctgaaatgc

SEQ ID NO: 35404 - DNA, 342 bp, Zea mays
  Clone ID: LIB3060-052-Q1-K1-C12
cgttcccgttcaaggccggcaagtaccatatgaagaagctgtgcctggagccgacgtccttcaccgtcaaggcggagggcatcgccaagaacgccccgcccgagttccagaagaccaagctcatgacccgtctcacgtacacgctggacgagatcgagggcccgctcgaggtcggctccgacggcacgctcaagttcgaggagaaggacggcatcgactacgccgccgtcaccgtgcagctcccggcgggcgagcgcgtgccgttcctcttcaccgtcaagcagctcgtcgccaccggcaagcccgagagcttcggcgggcccttactcgtgcccagctacc

SEQ ID NO: 35405 - DNA, 293 bp, Zea mays
  Clone ID: LIB3060-052-Q1-K1-A3
caaaaaagtagtaataaattaaaataataattcccgcctaaactatctgatagtttggccagtttaataaccgaccataagcaaccattgggggcccctggataaactgatactttgtattgtatttacaacaaaataatacgcttgataagcatctatgtaattttactcggtaaatctggcttgatttgctgtttggcatctgtcgagcttaacattatttttaatccaaaggatgccaaacgtgtggtgaatgaacggtaaaaactatcagatagttgaggcgggaattt

SEQ ID NO: 35406 - DNA, 437 bp, Zea mays
  Clone ID: LIB3060-052-Q1-K1-A6
caaacatagaagcaggatcaactgcgtgtgagcctcagccaaaaaaagtaaaaaataataataatgtttgtgcttcaatttctgaattctgataaaaaatatatcgactagtgcatatagaagtactcactcagtcctaaaataaaattagttttatcttttagttgatttatacataattaatgtatttgttttacgtacatgtctagatttattatcgtctatttgaacatagaaataaaaatcgaaagctaaaacgactaatattttgggataatattttgggacgggtgaagtatcaaatatttactgcaagatttgagtttgggaggaggcgtcgatgagaaaccgtccaaagtggaatagattttactataatctgacagtcaacttaattcatttcttcgagggcatctgcacgttagaaattgatgtta

SEQ ID NO: 35407 - DNA, 419 bp, Zea mays
  Clone ID: LIB3060-052-Q1-K1-A8
cgctgcttcaagaaaccaccgagagcctaaccgcacaggcaggagagagagcagggagccagggacagtagcgtggggccggggagcaacgatggaggggaaggaggaggacgtgcgcctgggcgccaacaagttctcggagcgtcagcccatcggcacggcggcgcagggcgccggcgccggggacgacgacaaggactacaaggagcccccgccggcgccgctgttcgagcccggggagctcaagtcctggtccttctaccgcgcgggcatcgccgagttcgtcgccaccttcctcttcctctacatcaccgtcctcaccgtcatgggcgtctccaagtccaccttcaagtgcgccaccgtcggcatccagggcatcgcctggtccttcggagggatgatcttcgcgctcgtctact

SEQ ID NO: 35408 - DNA, 405 bp, Zea mays
  unsure at all n locations
  Clone ID: LIB3060-052-Q1-K1-A9
gcgataaaatccgccgcggccgcctccactccacctcgacgctcgcttctccaaatccccgcttcgccttgcgagggggcggaggggaggtggtagtggtagggtatacaggagtgctctgcccatggagaaggcggggcaacaacgccatgttatcggcggcggcggcaagaaggcgcccgcgctggggctgcagaagcagaactcgtggtcgccggacatcgagcgcgacgaggcgtgggagcgccggcgcaggggcatgcgccgcgggggcacggcgctgcgccgcgcccgcagcgtcacggacgacgacctcgacgagctccgcggctgcatcgacctgngcttcggcttcgagccggcgcacgccgccgcgtgcgcgtgcgcctgcgcctgcgccgggag

SEQ ID NO: 35409 - DNA, 337 bp, Zea mays
  Clone ID: LIB3060-052-Q1-K1-B1
gttatgcccccgtcatttctcgagatatgtgtggcagatttgcctgcgacgtttattttcatcggacctgagtcttctcggggttagcagctacctttgtatgttgtggctccctgtgcgagcgtgctgtgtcgtatcacctggtttgtgagattagttgttgtcaaacttgcttggtttgattggttgtgcgtttaagagctgatagttatatacatatattgctttgctataccgccgctatatctatgtagcccttgatgtatgtatctggattctgaaatgcaagaatgaaccttgagcagccctttgtgttgccgatattttgtggtgccgt

SEQ ID NO: 35410 - DNA, 330 bp, Zea mays
  Clone ID: LIB3060-052-Q1-K1-B12
cccactcgtccgcacgaggtggagctcttacacctggccgcagattttgaccataatgtgatttatattaatagctgcatgtgtctagagagcaaagcaaaggaaattaaagtgcggtgtccctttttcaatttttttacatgtgaaagactgtggatgccgctgcattgtacagatagttgactcgttcgccagatgaaaaatgtataacaagagtcgtaggttcaagatagggagaagatgaaaccgtgatgattcatcattgttaaaaagatggactgtctgttggaaaaataaagctgattaataaccgcaataatgtcggtccgc

SEQ ID NO: 35411 - DNA, 412 bp, Zea mays
  Clone ID: LIB3060-052-Q1-K1-B3
aagacaccgccctctccttcgctagcggaaccgccctcccctcgccggggtaggggtttcggaggtagacgcccgccatggacgcgttccggaaacagctggacgtgctcatgggcgccaaccgcaacggcgacgtcgaggaggtgagccgcaactactacgaccgcgacgtctgccgcctcttcctcgccggtctctgcccacacgacctctttcagctcacgaaaatggatctcggtccttgttctaagattcattctcttcaactgcggaaagattatgaagaagcgaaagcaaaaggaacagaaaattttgatagagaactcgaggatatgatagaaaggctcattgtggagtgtgacagggaaaatcagagggccctaaacggcttgcagatgatgatgccaatgct

SEQ ID NO: 35412 - DNA, 143 bp, Zea mays
  Clone ID: LIB3060-052-Q1-K1-B7
gtctcggaggtgggagcgagcgatcatcggcgtcgccgggtggatccaaagcgcgcgacgcgagaaaatgcaaggcggatccagcggcatcgtgtatggtggcctcaagtaccaggcgcggtgtatcgccgacatacgcgcgg

SEQ ID NO: 35413 - DNA, 342 bp, Zea mays
  Clone ID: LIB3060-052-Q1-K1-B8
gtgtcggaggtgggagcgagcgtatcatttgcgtcgccgggtggatccaaagggcgcgactcgagaaaatgcatggcggatccagcggcatggtgtatggtggcctcaagtaccaaacgcggtgtatcgccgacatacgcgcggacgccggctcgaccaccttcctcgccggcacccttagcctcaaggacgagaacgaagtgcacctgatccggttgtctacggcggatagcgaactggactgccactgcctctgtctaccaaaccaacgagattgtggaccttaaatgatgcccgttcgatcacagggtcatctccacagtgtacacttcttgcgagggc

SEQ ID NO: 35414 - DNA, 256 bp, Zea mays
  Clone ID: LIB3060-052-Q1-K1-C1
cttggatcagaaacgccatccgggacaccgtgaccaggtccggcggcgaagcgagatggtgtcatccaagaaagtgtgcgtggtcggcgctggcgtgtcggggctggcgtgtgcccgcgagctgctccgcgagggccacgacgtgacggtcatggagcaaagcggcggcgtcggcgggcagtggctgtacgacccgagggcggacggcggcgacccactcggcgctggcggcgcgcacagcagcatgtacgccttc

SEQ ID NO: 35415 - DNA, 346 bp, Zea mays
  Clone ID: LIB3060-052-Q1-K1-C10
cttgctctgatagcttgctccaggacgtacgtacgtacgtagatcgatccatcgatcgctagctagctgacgaccatggcgtccctctcctctgccgccatcaccgccccttccttcacggccgcgcccgctcgcgcagtggtcagcaggaggtccttcaccgtgcgtgcctctctccgcaaggccactgccaccgtcgtcgtggccgttgccgccagcgtcctgcttgccggcggcggcgccatggcccaggaggtgctgctgggcgcaggcgacggcgggctcgtcttcgagcccagccagttcaccgtcaaggccggcgacaccatcaccttcaagaacaacg

SEQ ID NO: 35416 - DNA, 344 bp, Zea mays
  Clone ID: LIB3060-052-Q1-K1-A2
ctggtctgcctccctaaaaaaaactgctcggtttctggtcctgctccgacgcgccgggatcaggtgtgatatcttagccgtgctcggttgctccgactggtcttaggcaaagagggctcgcatgctcgcctggtccagatggttgaagcacatgggccccgactggtcgggcctttaccagcacgagggcaacttcctggcgcagcagcggctcgccgtaatctccacgttgaccggcgaccagacgttgttcagctaagaccgcaccgtcttggcggtggccaatggagagatggacaaccaccttaacgttctgaagcagttcactttcacacacaacttca

SEQ ID NO: 35417 - DNA, 420 bp, Zea mays
  Clone ID: LIB3060-052-Q1-K1-C11
cccgttcctgcatcgcggcggagatgggcgccttcaccacgccgctcgcgtcggcggcggcgctgcttctgctgctgctcgcgccgctcgccgcggcggcggacagcatgtcgatcgtctcctacggcgagcggagcgaggaggaggcgcggcggatgtacgccgagtggatggcggcgcacggccggacctacaacgccgtcggcgaggaggagcgcaggttcgaggtgttcagggacaacctccgctacgtcgacgcccacaacgccgtcgtcgacgcgggcgttcactccttccgcctcgggctcaaccgcttcgccgacctcaccaacgacgagtaccgcgccacctacctcggcgtcaggagcaggccgcagagggagaggaggctcggtgacaggtacctggccggcgacaacg

SEQ ID NO: 35418 - DNA, 439 bp, Zea mays
  unsure at all n locations
  Clone ID: LIB3060-017-Q1-K1-E4
gcgaatggccgatgtgcttgacccggcctccgacgcgccgcgcgcgcgccgtccgccgccacctcccccggatagcccggaggaccgctcgccgcagctgcccccgcctccacccgggggcccccccggcggcgagccggaagcggagtcgctctccgccgccgccgccgccgcctccgctgggttcgtcccggccccaaaggtatcgggaccaccgcagcggcggagggcggggcgggagcagccccagcccgccgccgtaccggggcagccgccgccactcgccgtccaggagatccccgtcgccgccattcaagcggtcgcggagggacgacgggtacgaccgccgcgggggccgcgggagcccgccgcgttacgggtacgatgataggaggcgaggttatgaccatgagcgangtggcggcagaagtgggtatga

SEQ ID NO: 35419 - DNA, 434 bp, Zea mays
  Clone ID: LIB3060-017-Q1-K1-E5
agaaaaacggagattacttgcccccttttcgcttcaccatcgtacgaaaccctagccgcgcctcgccgacggcactccggatcggtcggtgccatgtccaaggccagggtctacgccgacgtcaacgtgctgcgccccaaggagtactgggattactaggcgctcaccgctcaatggggagagcaggacgactatgaagttgtcaggaaggtcgggagaggaaaatacagtgaagtatttgacggtattaatgttaacaataatgagaaatgcatcattaagatcctcaagcctgtgaataaaaagacgatcagccgagaaattagaattgttcagaatctttgtggaggccataacattgtgaagctgctcgatatcgacagagatcagcattcgaaaacgcccagctagatcttcgaatatgttgacaacac

SEQ ID NO: 35420 - DNA, 438 bp, Zea mays
  Clone ID: LIB3060-017-Q1-K1-E6
gcttcgacaccaaatccgccgccgcgctctccaaatgcatgatcatgggggcctcggcgtcatcggtttggtacaacctccaggtgtcgcacccgaccaaggaggcgcccgtcatcgactacaagctcgcgttgctcttccagcccatgcttatgctcggcataaccatcggcgtagagctcagcgtcatcttcccatactggctaatcactgtcctcattataatcctcttcgtaggcacctcgtcgagatccttctacaagggaattctgatgtggagggaggagaccaggattctgacggagacacgcgggcgagaagagcaatccaagtctacctgcgctgcaagtgatgtggtcattgatcccagttatggggagcccctcctgactcaacctcagcccaagaagtctgcatgggagactttcatgttcaatc

SEQ ID NO: 35421 - DNA, 432 bp, Zea mays
  Clone ID: LIB3060-017-Q1-K1-E7
ccagcacctgcctctcctttgcttgcgcagatctagcgatggcggcgggcggtgagttggcgtggggggaggagcccgtggcgcggcgccggcctaagaccaagatcgtctgcacgctcggcccggcgtcgcgatccgtcgagatgatctcgcgcctgctgcgcgccgggatgtgcgtcgcgcgcttcaacttctcccatggctcccacgagtaccaccaggagacgctcgacaacctgcacgccgccatggagctcaccgggatcctctgcgccgttatgctcgacaccaagggtccagagattagaactggatttttgaaagatgggaagcctattcaattgataaaaggccaagaaatcacaatttctacagactatagcattcagggtgatgagaaaatgatatcaatgagctacaagaagcttgctg

SEQ ID NO: 35422 - DNA, 428 bp, Zea mays
  Clone ID: LIB3060-017-Q1-K1-E8
gcgaagtcttcgtcggagcaggacgaagagcgagcagcaagatgtcgtggcaggcgtacgtcgatgaccacctgctgtgctacatctaaggccagcacctaatctcctgcgccatagtctgccactactgctgtgtgtgggcacagtccgagaacttccgcgagctatagcctgacgaggttgctgggatgataaaggactttgatgaacctggaactgttgcaccaactggtctttgtgttggaggtacgaagtacatggtgatccaaggtgaactctggagttgtcatccgaggaaagaacggcactggaggcattactatcaagaaaactggcatgtccttgattatcggtatctatgatgagccaatgacttcagggcaatgcactatgccggtggagaggctcggcgattacctgatcgaaca

SEQ ID NO: 35423 - DNA, 424 bp, Zea mays
  Clone ID: LIB3060-017-Q1-K1-F11
cacacagcaatccacacaagcacttcgacgtcacacgggcgctgcacacagacacaccgaagcgtcggcaccaatggcttactaccaggaggtggactactgctcggaggaggtgaggtcggtggccccggccggcttcggccgccacggcggcggcgtccagcagcacgtcgtcaaggagaagttcgaggaggtcgacacggtcgcacgcgccggcgccaaccaccaccaccaccatggtcaccacggcggccacggcttcgtggtgcgcgagaccagggtcgaggaggacatcaacacctgcaccggcgaggtccacgagcgcatggagagcttcctcgccagggctaactgagcagcccgggcggccggcatccacgcccgttcgtgcctgcctgcgtgccttatgtatgtctgtgattgt

SEQ ID NO: 35424 - DNA, 395 bp, Zea mays
  Clone ID: LIB3060-017-Q1-K1-F2
cgcacgcgtacgggcggcgcacggacggacctacaacgccgtcggcgaggaggagcggcggtaccaggtgttccgggacaacctacgttacatggacgcgcacaacgccgtcgtcgacgcgggcgtgcactccttccgcctcggcctcaaccgcttcgccgacctgaccaacgacgagtaccgcgccacctacctaggcgccaggaccaggccgcagagggagaggaagctcggcgccaggtaccacgccgtcgacaacgaggacctgccggagtccgtcgactggagggccaagggcgccgtcgccgaggtcaaggaccagggcagctgcgggagctgttgggctttctcaacaatagcagctgtggaaggcatcaaccagattgttacaggcg

SEQ ID NO: 35425 - DNA, 428 bp, Zea mays
  Clone ID: LIB3060-017-Q1-K1-F5
ggccactattattattttaccatcacctacccgctgccttcctccttcttttccctttcccatcgtcgaatcctcgccccttctcccgtcggctgttgcttttgcttcgaattcccgatttgcttgccggaaccctagcgacgccgtggtgacgcgacgccgacgcgtatggagatctccttcgaggcgtgggagggcgtgcagcggcatggtcaggacctcgcggaccgcctcgcgcagggtttcacgggcctgctccaggtgccgccgcagttcccgtggccgccgtcgccgcacaagcggatgcccttcgacatcgacctccccgtcgtccccttcggcgccggcggccccctcggcgtcccggtgaaggacttccccttcctcgccgcggccgtctcctcggtcatcgacatcggcggcaggct

SEQ ID NO: 35426 - DNA, 415 bp, Zea mays
  Clone ID: LIB3060-017-Q1-K1-F6
gaaggaccgagtgctcatgccccagtatcttcagggtctgacagaatcagcggtgtgttatcaacagatgcatctgaacctgatcatttgtctgagtgcataccatcacaggatacatccatgatttcacagcttgacagcaggaaagctcatctgagtgctctgcaacaggaaagggttgagaaagtaaaccaaggtccggaagatatctctgcaaatattgggccagtggaaaaggaacatgttcatggggatctgactttgcaatctgctagtgccgtactctctattagctgcaatggttctaatcaaggaactaaatctgaaaccaatcttcaaccatggactgctacagatgataggatggcttttggagagcagaatgcggaaaagtctcacttagaactcattggta

SEQ ID NO: 35427 - DNA, 431 bp, Zea mays
  unsure at all n locations
  Clone ID: LIB3060-017-Q1-K1-F7
ctcccgtcgtcctcgaaaccctaggccagaccacagctgaagccgagcggagttctggtcgccgcccatcgaatccagcttctccaagtccaaggcaccgtcgcgacccccatcgtccgcacgacctggatctgacgcgcctccccctgccgtcgccgccctccgcctcgtaccttctcgcggcgaccgccgtgctcggactcctcggcggccttctactctacatgcttgcccggaagcggggggtcgacgccggcgaggtccaggacttgcacaacaaggccccccgcgccgtcgccaccgtcccagtccaggactaggactagcaccaggaggaggctgcggaaatggccggcagggcgcccgagatcgatgaggacctncacaggcgacagctcgccgtctactgacgcgagactatgaagcgcctt

SEQ ID NO: 35428 - DNA, 439 bp, Zea mays
  unsure at all n locations
  Clone ID: LIB3060-017-Q1-K1-E2
gccggcgtacatggtcatctcttcgccgcctaaagcggggccccggttcgaattcctcgtcaaaagcgtgccgggagctaccgcggggcggctctgcgccctccgagacggggatgttgtggagctcggcgccgtcacggggaaggggttccccctcgacaggataaatccgcccgacgtcgcgcagaccgtgctcatcttcgcggcggggacggggatcagtgcgattcgatcacttattgagttcggtttcgctgccaaagaaagagctgatgtgaggctttattatggtgatacaagtctgaaatctatgtcataccaggaaaggcttagtaactgggagtcaactggaattaaaataataccagtcttatcacaaccagatgacagctggaaaggtgaacgaggatatgttcaggatgctntcttcagaaacaag

SEQ ID NO: 35429 - DNA, 415 bp, Zea mays
  Clone ID: LIB3060-017-Q1-K1-C9
ggagagtacgtggaggagcagccatggcttcatcggtggccgccgcggcgagcacattcctgggcacccgcctggcggacccggcgccacagaacgggcgcatcgtggcccggttcgggttcgggttgggcggcaaggcgaagcctgctccgaagaaggtggcgaagacatcgacctcctctgaccggccgctgtggttccccggcgccgtggcgcccgactacctggacggctcgctggtcggcgactacgggttcgacccgttcggtctcgggaagcccgtggagtacctgcagttcgagttggactcgctggaccagaacctggccaagaatgaggccggcggcatcatcggcacccggttcgagtcctccgaagtcaagtccaccccgttgcagccctacagcgaggtgtt

SEQ ID NO: 35430 - DNA, 328 bp, Zea mays
  Clone ID: LIB3060-017-Q1-K1-D1
ggcagtcaggcgcatgctgcgcgcggctccgcagcaccccttacctttcgccgattgcaccggccgtgccttcctccaccaccagccgcggcacacccgcggaaccgtcgctcgagctcgcgcctgaaccccccaaactctgccaaatttcgccaaatccagccggtcggaccccgcaacacatcgccaaaaccaaccgggccggccgacacaagccgcagcccgtggcgatggacctggcgtcgagcgaccttgcggcgctgggcgcggcggagctggtccgcgtctcggcgtcgatcccgcgcgcggctccccgcaccttcgcgct

SEQ ID NO: 35431 - DNA, 355 bp, Zea mays
  Clone ID: LIB3060-017-Q1-K1-D10
ggcaaaagccaaaaggcatcaccgccgcgacgacgatggcagcctcgctccaagccgcggccaccctgatgcagccggccaagatcggcggccgggcgccctttgcctcgctgccgtcccgcccgtcgtcgcaactcgcctgcagggcgttcggcgtcgactccggcgccgcctggatcacgtgctgcctgcatgacgtcgccagcaggtgcgtcgacgccgcgaagctcgccggcttcgcgctcgccacctcggcgctcctggtgtcgtgcgccagcgcggaaggcacgcgcaagaggctgacctacgacgagatccatagcaagacgtacatggaggggaagggcacgggcac

SEQ ID NO: 35432 - DNA, 421 bp, Zea mays
  Clone ID: LIB3060-017-Q1-K1-D11
ccccgctgccccatccggccatcccacagcgaatctcccaaaccccggctccctcgattcccaatcccacccctgccacgaagagatcagatgacggcgagctgctgctgatcgagtgcagtggaatcggaggcgatgcgggctagccggccggcggtgcaccctgtggagcggcccctccgccgccggccgcggcggcggaggggccggaggcccaggtggagggtgccgcgcacccgcgcggggtgcggatgaaggatccgcctggggcaccagggacacctgcggggcttggtctacgccttgcgcaggccttcttcgcagccgctgcgctcgccgtcatggcgtccaccaacgacttcccgtccgtctctgccttcagctaccttgtcgcagcagccattttgcagtgcttgtggag

SEQ ID NO: 35433 - DNA, 425 bp, Zea mays
  Clone ID: LIB3060-017-Q1-K1-D12
cccaaccaagcccgcacgacacgacaccaagtcgaggagctcgagagggcaccaataatggccggcgtgaactccagcgtagtagggctcaagcccgccgcgtcagtgccgtaggccgccgccgactcatcggcggcgaagcgtatgcagctggccgcgcccgatggccagcgcgccgctctgctcggcctggcggccgtcttcgccgtcacggccaccaccgggtcggccaaggccacgatcttcgatgagtacctcgagaagagcaaggccaacaaggagctgaacgacaagaagaggctggccaccagtggagccaactttgcgcgcgcctacaccgtggagttcggcagctgccagttcccctacaacttcactgggtgccaggacctcgccaagcagatgaaagtccccttcatcagcga

SEQ ID NO: 35434 - DNA, 433 bp, Zea mays
  unsure at all n locations
  Clone ID: LIB3060-017-Q1-K1-D5
caaatccacggtttaataacgaaccgtgttaacttaccataacaacaactcaattcctatcgaattccttcctatcgaattcctatagtaaaattcctataggatagaacgtacacagggtgtacacattatatatgaatgaaacatattcattaacttaagcatactcctttttttatttaatgagttgatattaattaaatatctttttttttagatttttgcaaaggtttcatttacgcctaatccatatcgagtagaccctgtcgttgtgagaattcttaattcatgagttgtagggagggacttatgtcaccacaaacagaaactaaagcaagtgttggatttaaagctggtgttaaggattataaattgacttactacaccccggagtacgaaaccaaagatactgatatctnggcagcattccgag

SEQ ID NO: 35435 - DNA, 415 bp, Zea mays
  Clone ID: LIB3060-017-Q1-K1-D7
cggatccacggtttaataacgatccgttttaacttaccataacaacaactcagtttcgatcgaattccttcctatcgaatccctatagtaaaattcctataggatagaacgtacacagggtgtacacattatatatgaatgaaacatattcattaacttaagcatactcctttatttatttaatgagctgatattaattaaatatctttctttttagattcttgcaaaggtttcatttactcctaatccatatctagtagaccctgtcgttgtgagaattcttaattcatgacttgtaaggagggacttatgtcaccacaaacagaaactaaatgaagttgtctggatttaaagctagtgttaacgattattaattgacttactaccaccctgaatacgaaaccaatgatactga

SEQ ID NO: 35436 - DNA, 432 bp, Zea mays
  Clone ID: LIB3060-017-Q1-K1-D8
cctccggcggcggcgacgtccctctcgtcgactacctcaacacccagtactatgggagcgtcggcatcggcacaccgccgcagaacttcaccgtcatcttcgacaccggcagctccaacctctgggtcccctcctccagatgctacttctcgattgcctgctacctgcaccacagatacaagtcggccaagtctagcacgtacaaggcggacggcgagacctgcaagatcacctacggctccggctcgatcgccgggttcttcagcgacgacgacgtgctggtcggggacctgaccgtcaaaaaccagaagttcatcgagacaacgcgcgaaagcagcgtaacgttcataatcggcaagttcgacggcatcctcggtctcggataccccgagatctccgtcggcaaggctcctccgatctggcagagcatgc

SEQ ID NO: 35437 - DNA, 408 bp, Zea mays
  Clone ID: LIB3060-017-Q1-K1-D9
cccacgcgtccgaacaccagccgccgtcatgtcgaagcgaggtaggggaggttcggctgggaacaagttccgcatgtcactgggtctaccggtggcggccacggtgaactgcgcggacaacacgggcgccaagaacctctacatcatctccgtcaagggcatcaagggccgcctcaaccgcctcccgtccgcctgtgtcggcgacatggtcatggccaccgtaaagaagggaaagcccgacctcaggaagaaagtgatgcccgccgtcatcgtccgccagcgcaagccgtggcgtcgcaaggacggtgtctacatgtacttcgaagataatgctggagtgattgtgaatcccaagggtgagatgaaaggttctgcaatcactggacctatcggcaaggagtgtgctga

SEQ ID NO: 35438 - DNA, 83 bp, Zea mays
  Clone ID: LIB3060-017-Q1-K1-E10
gccgaaacaagttactaggcccttggaaccagcaacagaagctgtctcgtcttatcatggagacctgccagcaacatggcggc

SEQ ID NO: 35439 - DNA, 415 bp, Zea mays
  Clone ID: LIB3060-017-Q1-K1-E11
agcttgcaacgccttacgcctccacactcaacagtcatggtcgtcatgggcaaggagcagcaacaacacgaggaggaggaggtgcaagggaaggtcgtccaagaagaagtgcaagtcgttcaagagacggtggtgccggtgccgtcggaggaggacaaggaggccgaggcggcgctggtgcacaagatctccagcctggccgccgtcatcgcgaagctgccatccctgagcccgtcgccggaggtgaacgcgctcttcaccgagctcgtgacggcgtgcatcccgcgcagcagcgtggacgtggagcggctgggcccggagctgcaggagatgcgcggcgggctgatccgcctctgcgccgacgcggaggcgctgctggaggcactactccgacctgctggcctccttcgacaac

SEQ ID NO: 35440 - DNA, 399 bp, Zea mays
  Clone ID: LIB3060-017-Q1-K1-E12
ggacactcctcctcagaactctcccttccctcttgtaggggccaaaagggtcagagatctaggaagaagagaactagtccccaagcctaacaagaaagcaagctcttctgcaactgttggcattcgccttaatttgtatccatatcccaatggcaggcctatctctgcaacacccctgggcattcactttcggcctcctaggcaacgtcatctccttcatgaccttcctggccccgataccgacgttctaccgcatctacaagagcaagtcgacggagggcttccagtcggttccgtacgtggtggccctgttcagcgccatgctgtggatcttctacgcgctgatcaagtccaacgagacgttcctcatcaccatcaacgcggccggctgcgtgatcg

SEQ ID NO: 35441 - DNA, 433 bp, Zea mays
  Clone ID: LIB3060-017-Q1-K1-C7
gccgcaccccgatccactagagctatggagttcgacgaatacgagtacctggagaaggcggtggagccggctcccccgccggccaatggttccggctccggcgagaaggaccgcggctcgcgtcgccgcgagggcgacgagggccgcatatcgaagcgctcccgctcgggggaggaccgcgagcggggccggcaccgcagcgttcgggagcaccgggatcgggataaggatgacgggaaggagaaggagaggagccgcgatagccgcgggaaggacagagacagggaagggagagaacgggagaaggagaggggggacaggcaccggcccagagagagggaggtggaacgggagcggaggagcctgagccgttcggagcggcgccgtatcgaggaagaggagatggtgagggagctggagatggagcgcgagc

SEQ ID NO: 35442 - DNA, 295 bp, Zea mays
  Clone ID: LIB3060-017-Q1-K1-B12
gccacatcctcccctccttcctccttgggttcccagcccgtgcgcccgcctgtcgcagtcgcaccgcagccgccggccatggcctgcctcaccgacctcgtcaacctcaacctctcggacaccacagagaagatcatcgccgagtacatatggatcggtggatctggcatggatctaaggaccaaagccagaaccctcccggccccggtgaccgatcccagcaagctgcccaagtggaactacaacggttccagcaccggcaaggcccccggcaaggacagcaaggcaatcctgt

SEQ ID NO: 35443 - DNA, 317 bp, Zea mays
  unsure at all n locations
  Clone ID: LIB3060-017-Q1-K1-B2
gttcgagcggctcagcaaagaagccaccgtgcccagcgacaccgtcgcattcgccaacgttgagggagcggcccccgccccggatgttgcatgggtctccgacctcatcaactgagggaactcgtggaactaccagctcagaagttcgggggggggggggggggngggcgggagcgacgaacgctaatgcggcgacttcttaactcgctagctcttacacagttatgtacctgatccttgtacagatgttgctgatgtgtgaatagaatcgtaagcacgtcaaagggagccaagggctgaaaagggacacctacctt

SEQ ID NO: 35444 - DNA, 442 bp, Zea mays
  Clone ID: LIB3060-017-Q1-K1-B6
gtgtccttcctccgtcttcctcctctgccgactgccctcatccactccactcccaagtgcccaccacccccaaccccgtctctccactgcggcgcaggcttcgcttcggctccgctcggctcgagcagaagaaaatgcaacgggcagtgcagaccgtcaggtcacacggcaatgttcttaaatatgctgttctacaacacatcagcgctcccaagccagcaatgcttcctgctgccttttctcgtttcatgtcagtttcatctgctcgcctagaggatcgtggatttgaaactgccactgtagcagatgtcttgaagtctaaagggaagagtgctgatggatcttggctctggtgcaccacagaggatagcgtctatgacgctgtcaaatctatgactcagcacaacgtgggagctttggtggttgtcaaacctggacagaa

SEQ ID NO: 35445 - DNA, 438 bp, Zea mays
  Clone ID: LIB3060-017-Q1-K1-B8
gtccttggaatgcctacgtatccatatctctatggtgatgacctcgtagatgtcctgaagaagaagcatgctgccgggacctacaaaagcctggtcttttaccttgaagcatgcgaatctgggagcatctttgagggcctcctgccgaatgacatcaatgtgtatgcgaccaccgcgtcaaatgcagaggagagtagctgggggacgtactgccctggcgagttcccgagccctccaccggagtatgacacttgcttgggagacctgtatagtgttgcttggatggaagacagtgatttccacaatctgcgaactgaatctctcaagcagcaatacaacttggtcaaggataggacagcggttcaggatacattcagctatggctcccatgtgatgcaatatggttcattggagttgaatgttaagcatctgttttcg

SEQ ID NO: 35446 - DNA, 420 bp, Zea mays
  Clone ID: LIB3060-017-Q1-K1-B9
gtccactgcattttatccttcctggtgctctgtccacctctctcgctctgggccgccgccgccgccctaagccacgtgctgaggctttcgttggtctcttcgccggcgacgagcacccaacaattccggaaaaaagggctgagggtaaggacatccagcctcttgtctgcgacaatggcactggaatggtcaaggctggttttgctggcgatgatgcaccaagggcggttttccctagcattgttggccgtcctcgccacactggtgtcatggtagggatgggacagaaggacgcatatgttggcgatgaggcacagtccaagagaggtattcttacgctcaagtacccgattgagcacggtattgtgagcaactgggatgacatggagaaaatctggcatcatactttctacaacgagc

SEQ ID NO: 35447 - DNA, 428 bp, Zea mays
  Clone ID: LIB3060-017-Q1-K1-C1
ggttgctgatggctgacattgtgaaaatggggccggcctcagggaaagacttctatgagacctgtggtcacagctgacagaggttatgctggacagtacccatctttgccaagcacaaaccagaatctgaaacaatctggaagcatggttcccccaacagagcttgacaaggggttacaacctgcccaagattcggttcaggttaaggatcatgatcattctactgctgacagcaagctcccatatggtactgactggtctccacaagatggcccgacatttgcgaaccaatcttcccttcctgagccatctggtgatccgtccttgtatgaggcatcgtttcagtcatctacattggttactgatgtagttaattcacatgaaaattcacacttggatgaaaacgacacctttgcaatgggaccagc

SEQ ID NO: 35448 - DNA, 420 bp, Zea mays
  Clone ID: LIB3060-017-Q1-K1-C11
cacttgctctccctccaacaagctaattaaggccggtcgtcatccctcttctagctcgttttattatccatggcggaggagaagcaccaccaccaccacctgttccaccataagaaggacgaggagcaggaggagcagctcgccggcggcgggtacggcgagtccgccgagtacacggaggccacggtgacggaggtggtgtccacgggcgagaacgagtacgacgagtacaaggaggagaagcagcataagcacaagcagcacctcggcgaggccggcgccatcgccgccggcgccttcgcactctacgagaagcacgaggcatagaaggacccggagcacgcgcaccgtcacaagatcgaggaggaggtcgcggctgcggcggccgtcggctccggcggcttcgccttccacgagcac

SEQ ID NO: 35449 - DNA, 421 bp, Zea mays
  Clone ID: LIB3060-017-Q1-K1-C12
gacctccgccaccatgccagtctggccatgtgttggccgtcggctccctggaaccagcgccccagccaccaacctccgctcacttcgacgacggaccgtgccgctggtccatccatggccgtgagtccacctccgccgagctgctagtctctagctcctccgaccattctgctcgcccgacaacttgtcacaactgggtctgctccatcggctcctcgtccggctttaacatcaccgtggccagcagccacttcaaattcgtgagcgcccaacgccgccccctggttcactccctccgtacgcacatcgcccttgtccccggtccatgtagcgtgtctctacgctctgcgtcctcgccgtcattatttttggagttcgtcgtaacgcgctgccgatggtctgcgtatagcgggagatcttc

SEQ ID NO: 35450 - DNA, 424 bp, Zea mays
  unsure at all n locations
  Clone ID: LIB3060-017-Q1-K1-C4
gccagccgccgagcgctcgagccgggtgcccggcgcccgtgtgacccgtgaccggctgaccgaccgcagtccgcgtcctgcgttcacgcgtgtacgcgccgcggtggcgttgtccgccccctgtccgcccctgacagacgcgaccagctcaccacgccgctatggcgcactggcgcggttcaagtgtccagccgtcgtccgccaagttgcccggagcaccgtcgcgcgccgcagtccgcagacaaggacataaggtgtctgacagtctgagcacgcggatctgagcagagcagctgtctgagcgcgctgctaaccatgcggtcacgccgctgtatgagcgcacctacgcgcagatctgagcagacaagacaccggtcatcctnctgaacggcatacccgaacgtcaccgcggttcgcctcggcc

SEQ ID NO: 35451 - DNA, 440 bp, Zea mays
  Clone ID: LIB3060-017-Q1-K1-C6
gtcttcacactcctcgccatcacataaaaccagtgcaagcagaagcagcgcaatggcgagcagcaccatggccctctcctccacagccttcgccggcaaggcagtgaacgtgccgtcgtctctcttcggcgaggcccgcgtgacgatgcgcaagacggcggcgaaggcaaagccggcggcgagctccggcagcccgtggtacggccccgaccgcgtgctctacctgggcccgctgtccggcgcgcccccgagctacctgacgggcgagttcccgggcgactacggctgggacaccgcggggctgtcggcggacccggagacgttcgccaagaaccgggagctggaggtcatccactcccgctgggccatgctgggcgcgttgggctgcgtgttcccggagctgctcgcccgcaacggcgtcaagttcggcgaggccgtgt

SEQ ID NO: 35452 - DNA, 296 bp, Zea mays
  unsure at all n locations
  Clone ID: LIB3060-051-Q1-K1-G6
agaaaagaaggacgaaaagaagccggcgccggccaaaacggagtacaagtttgtgccctacccgtacccgctgccgaaccccgcgatgtgcccgagctggccgtggcagtgcccgcctcagcagcagtgccagtgctgccagaagcctccgcctccgccgcccaagtcgccgccgaagccgccgccgtgcacctgttcgagccacgccgnctgtgtctgcggcaagacaccgccggcggtctggccaccgatgccgncgncggtctggccgcccccgtggggcacctgcaacgtcg

SEQ ID NO: 35453 - DNA, 378 bp, Zea mays
  Clone ID: LIB3060-051-Q1-K1-G8
gcgtgcgtgcgcatcactcgcggactcgcctcgtgcgcttccatttccactccgacccggccggcgacccgccccccggtccccggagcgaccgaggcctcgctcaccgacatgtgggccctcaacaacgccaaggccggcggaccctgcctcacgccgcggcacccagcgccgccttcccttgcgtcgccgtcgacggcatcggctgggcggaggttctggaggcgcagccccgtgtgggcgcccctggtggcggtgcgcgcgtcggggggcacgaagaaggacggctccgtcggtggcgaagccagcggcgaggaagccgatagcaaggcgtcgtctgccgggcatgatgatgcatctaccccaacagggggatcc

SEQ ID NO: 35454 - DNA, 415 bp, Zea mays
  Clone ID: LIB3060-051-Q1-K1-G9
cgccgatcacacattggacttgcactggtgcttgctcataattactagttcatcagcaaacaacaaacaatggcaccgaggctagcgtgcctcctagctctggccatggcagccatcgtcgtggcgccgtgcacggcccagaactcgccgcaggactacgtggacccgcacaacgcggcgcgcgccgacgtgggcgtcgggccggtgtcctgggacgacaccgtggccgcgtacgcgcagagctacgcggcgcagcgccagggcgactgcaagctgatccactccggcgggccctacggcgagaacctcttctggggctccgccggcgccgactggtcggcgtccgacgccgtgggctcctgggtgtccgagaagcagtactacgaccacgacaccaacagctgcgcggaggggc

SEQ ID NO: 35455 - DNA, 347 bp, Zea mays
  unsure at all n locations
  Clone ID: LIB3060-051-Q1-K1-H12
cccgcgtccgatccaggtctggtatcagggaaatccatcgcttgctccncatccctgatcgtcagaggggaattttaaagaacaccgattcctacggcaactagaagccatggagcacaaggacgctggaagccaagcccgcaccggacccatgctatgcatgaataactgccgatgcttcaatcgctcagcgaccatgaacatgagctccaagtgccacaaggagatgataacgaaccaggatcacgccaagctggctgcctcctctatcgacagcctcgtgaacggcatcgactccgtcatggagccggttgttgctggcagcaacacggtagtaactgttgccc

SEQ ID NO: 35456 - DNA, 386 bp, Zea mays
  Clone ID: LIB3060-051-Q1-K1-H2
cacgcgtccgaagtaatcgtcacagtggtagatttgcgctgttacacatcactgcactgcacaggcgcagatccacatgggctccatcgttgccgacgccgatcgccggccacacgccgtgtgcgtgccgttcccagcgcagggccacgtgacgccgatgctgaagctagccaaggttctccacagccgaggcttccacatcaccttcgtcaactcggagttcaaccaccgccgcttgctccgctcccgcggcgccagcgcgcttgacggcctcccggacttacgcttcgtcgccatcccggagggtctgcccccgtgcgacgccgacgccacccaggacgtgccgtcgctctgccgcgccaccatggagaactgcctcccgcatt

SEQ ID NO: 35457 - DNA, 417 bp, Zea mays
  Clone ID: LIB3060-051-Q1-K1-H3
caccagccgagttcgcagcggcactccatgtccagcagtctcttcggctcttcgttgggggtgcgtggacaccggaaattacctcggggattgcgttcctgatctaaacccggcatgaagtgctgctcacagcgtttgctgctactgctcctgctgctgctggcatcgtcgtcggtactgtccgtcgaggttgccgcgcagcagacttgccctgccgacctcgacagccaatgcgacggtggtgcgcctgatgactgggagggggaatagttccccggcgttccgaaaatcacgtctgaaggtgcaacaagcaagaaccctgttgcttataagtggtataacactgaggaaggcattctcggaaagaagatgaaggactggatgcgcttcagtgctgcgttctggcacacgttccgt

SEQ ID NO: 35458 - DNA, 432 bp, Zea mays
  Clone ID: LIB3060-051-Q1-K1-H6
ctgcactccagcactgaacacttgattgattcagtaggtagctagctagctgaagcacaatggatcctaccaagttccgtccgtccagtagccacgacacgacggtgacgacgacgaacgctggcgctcctgtgtggaacgacaacgaggcgctgactgtggggcctcgcggtcgcatcctgctggaggactaccacctgatcgagaaggtggcgcacttcgcgcgggagcgcatcccggagcgcgtggtgcacgcgcgcggggacttcgccaagggcttcttcgagtgcgcccacgacgtgacgtcgctgacgtgcgccgacttgctgcgcgcgctcggcgtgcggacgcccgtgatcgtgcgcttcttgacggggatccacgagcggaggtccacggagacgatccgcgacccgcgcggattcgccgtga

SEQ ID NO: 35459 - DNA, 422 bp, Zea mays
  unsure at all n locations
  Clone ID: LIB3060-051-Q1-K1-H7
cttagaacggggagacgtctaactgatttagtaaaagtgggcagcatcgtgatgccaacttacccccctgccatggttttattggtcctctgcttgtttctcgttttccttgggagtcagcttctctgttttatgtggtcgcacacggccttatttgtagtattacaccacagaagctggctgacccccactgacggagaggtgattgatgcaagcattgtgtatgatccttggacaagggaatcgcgggggtttggttttgtcaccatggctgctactaaggaggcagatcactgcatcaaatatctggattgttctgtgttgcaagtactctacacagaacattttattgttttgtcttcaccaccgagaatccgagatcgcctcccatagcctncacatccataaggtcctgcttgact

SEQ ID NO: 35460 - DNA, 412 bp, Zea mays
  Clone ID: LIB3060-051-Q1-K1-H9
gttctcatgatccatattgttatggatatatttgagatcatgatttctatgattaattatcttttatatgtcatcatcataatgttaatttatggaattaaaatgatatggaaaatgcctataattttaacacaccaaaaacctaatgttaggcatttttctgtcagtggttttgctgctgtgctaaagcctgatccatttgatggtaaaaacttcttgatttggaaagctaaaatggtattgtggcttactgtaatgtcttgttttcatgccgctgagggcaagcctgtcaacttacctcctgaggatgaggctaagtttaaggctgaagacaacctctttcgaggagcagtaattagcgcacttgatacaaaattccagaaaagctatatcatccttcctacagggaaag

SEQ ID NO: 35461 - DNA, 421 bp, Zea mays
  Clone ID: LIB3060-052-Q1-K1-A1
ctcgtctccctcccaaaaaaaaactgctcggttgctgctcctgctccgccgcgccggcatcatgtgtggcatcttagccgtgctcggttgctccgactggtctcaggcaaagagggctcgcatcctcgcctgctccagaaggttgaagcacaggggccccgactggtcgggcctctaccagcacgagggcaacttcctggcgcagcagcggctcgccgtcgtctccccgctgtccggcgaccagccgctgttcaacgaggaccgcaccgtcgtggtggtggccaatggagagatctacaaccacaagaacgttcggaagcagttcaccggcacacacaacttcagcacgggcagtgactgccaggtcatcattcccctgtacgagaagtacggcgagaacttcgtgggacatgctgacggg

SEQ ID NO: 35462 - DNA, 355 bp, Zea mays
  Clone ID: LIB3060-052-Q1-K1-A10
gcggcgcattccatcttgatcggctgcatctacctctaagactcgttatccagataaccggttggctttaacaaatggcagacgagacttggaaaaatgagagtatactggagtgctacactcataaataatgcgggtcaccaactccatgttatctgaactttccacaggaattccccctatctatagctgccgatgccgtactcgtggtctatcggacattgagagcgactaggcgtacaagctccactactagtgcatacaccgcgatggcacagtctaatcagagcccgaatcgtacttagcgactaactcttagagctcaggggttgaatctacctgcgcttatggttct

SEQ ID NO: 35463 - DNA, 386 bp, Zea mays
  Clone ID: LIB3060-052-Q1-K1-A11
ccacgcgggcgaagccagaatcgctctcgagatttaatgtagagagacgggggacgacgacagcgtttgggcccgctaactgcatcgctcgacggtagctgacgtcactcatacccgtggaattttcaagcttagatggtggctcatctgcctgatccgagctctgctgctttttcttaggccgccgcactgtatcacaactatcacagcacctacgtgttcacaagtctacgcatttagactaccaatacactacattggactatgcacaactaggacgcatccatcaaaccggcacatggatccatactactcgaactatagaaaccacgtgccttacccatactatgctcctgccagatggcaaatcccatccgggcatgcac

SEQ ID NO: 35464 - DNA, 437 bp, Zea mays
  Clone ID: LIB3060-051-Q1-K1-G4
cacagcgatccacacaagcacttcgacgtcgtacgggcgctgcacacagacacaccgagcgttggcaccaatggcttactaccaggaggtggactactgctcggaggaggtgaggtcggtggacccggacggcttcggccgccacggaggcggcgttcagcagcacgtcgtcaaggagaagttcgaggaggtcgacacggtctgacacgccggctccaaccaccaccagcaccaccatggtgaccacggcggccacggcttcgtggtgcgcgagaccagggtcgaggaggacatcaacacctgcaccggcgaggtccactagcgcatggagagcttcctcgccagggctaactgagccgcccggtggtcggcatgcactcccgttcgagcctgactgcgtgccttatgtatgtctgccggtgactggttgtgcaagg

SEQ ID NO: 35465 - DNA, 387 bp, Zea mays
  Clone ID: LIB3060-052-Q1-K1-A12
ctctgtttccttgctgtgcactacacattccaaccataacttctcttgttctcgttctcgtccctgcgtgaaccgcggaccaagaagaagcgggcgttggggactttgggatttgaaagcctacatattattatttctctaattcaggagtggtctgtgctgggagggaagggatctgtggggctgcagccccatccgggctgagggttgaaggatccggccctttggtgtgctcccccaatcgggttattatttctctaattcgggcgtggtttgtgccgggagggaaggaatccgtggggctacagccccatccgggctgagggttgaaggaaccggccctttggtgcgctccccccaatcgaggaaaaaggggcatcggatgct

SEQ ID NO: 35466 - DNA, 419 bp, Zea mays
  unsure at all n locations
  Clone ID: LIB3060-051-Q1-K1-F12
ccgatcacggtaactggatccggtgccttgggttccggataaattggccttcaaccgtacttcgcgggtggttcttcccggggcttggggcctggcccttttttgaaaccttctttcccggttccaaccaccttcagagaggattaaaagaattagtgccccaaattaaagggaatactgggctggaatggcagcaaagatctattgaattcagttccattatacatagacatcagtcgataaaatcatctttggcttgaacgtatgcctgcattggatgaagcaaattatttggtgaagagagctgcttctacacaggctgcagtttcatctgcaaattctgctcctgcagtcacttctggaggcccacttaagcttgcaaatggcgtatcanagccaccaccagctcctttagctga

SEQ ID NO: 35467 - DNA, 323 bp, Zea mays
  unsure at all n locations
  Clone ID: LIB3060-051-Q1-K1-F2
cactacactacaccacacccacccgactacgatcacacacgcagaagatcgagttcggtcgatcgtgaccgtgacgcaggaagctataagctagccaagacaggaataataatggcggcgtcgacggtggcgagcctctctgtcccggtgacgacgacgaccttcgcggcggcggcggcagcgggcggcgccgacgtgctgatcgtcgtcccgaggagggcgggcgctgggcgcgtctggttccccgcggcggcgcgccgcggcggcggcagcgggcggttggtcgccgtgcggtccagcgggccggccacgccgncggagat

SEQ ID NO: 35468 - DNA, 392 bp, Zea mays
  unsure at all n locations
  Clone ID: LIB3060-051-Q1-K1-F4
cccacgcgtccgcaccgattagcttgcttgccctagcagatcgaagccgtagccctagccgaggagcgcccatggccgctgcgatcgtggcctgaggcggcggggctcttcccatggggtgaggggatggaccctagcctgaaggaggaggtgatgaaggcggtggaggaggcgaggtccgcggcggcgccgcggtgccgggtggtgcggatcatcgtgcacgacgaggacgccaccgactcgtcttccagcgacgacgagggagaggaggcggnggagcgcgccgcggcgcacccggccgcggcgccggcggggagcgtgaagcgcagccgcgtgctgctccagtccgctgggtgcggggcggaggaggacggcgagggggccaggttcac

SEQ ID NO: 35469 - DNA, 423 bp, Zea mays
  unsure at all n locations
  Clone ID: LIB3060-051-Q1-K1-F5
agctcgtcccgaactcgaacaagacagtcaaggcgtcgatgctggacgaggtgatcgactacctgaagcagctgcaggcgcaggtgcagctgatgagccggatgggaagcatgatgatgcccatggcgatgccgcagctccagatgtcgatgatggcccagatggcacagatggcgcagatggcgcagatggcccagatgaacatgggctccctcggccagccgggctacgcaggcctcacgccgcccatgatgcacccgccccccttcgtccccgtgtcctgggacaccaccgncaccgtcaccaccttcctcgccccgcaggccggcagcggcacggtgccagcggacgccttctacgccttcctagcttgccaagcgcagcagaacgggcagcagcaaccgggtagcatggaggcgtaca

SEQ ID NO: 35470 - DNA, 76 bp, Zea mays
  Clone ID: LIB3060-051-Q1-K1-F6
agcttgagcacgcctcacgttggttagttcagctcacaaggcggtccgccacgtggcggaggacctgcggtatgag

SEQ ID NO: 35471 - DNA, 405 bp, Zea mays
  Clone ID: LIB3060-051-Q1-K1-F7
cgagtctccatccattctctccgctcatccgcagctctctagtctccagctctagctagccttagcctcgtccaagggacgaaggggccaccatgagcgtggtgatcctggacggctccacggtgcgcggcttcgtggcggacgaggcggccttcgcgcgcagcctggacgcgcgcttcgccgcgctggacgccaacggcgacggcgtgctgtcccgcgccgagctccggcgcgcgctcgagtccttccgtctgctcgacggcggcggcttcgggtccgtccagccggcgccgctccccgccgaggtcgccgcgctctacgacgccgtcttcgagcagttcgacgccgaccacagcggcgccgtcgaccgcgccgagttccacgacgagatgcgccgcatcatgc

SEQ ID NO: 35472 - DNA, 405 bp, Zea mays
  Clone ID: LIB3060-051-Q1-K1-F9
ctggttccagcactctcacgctccaccgatccttctggaagagttgatcagtgggcagaaactgtggaagaaaagcttcaacgtctgcactcgcatgaggcctatgaaatgatcgagaatcacctcaccctcatcctggggcagcgtcaaggtgacgccactatcgcagccataagtaagctccgtgttggccaggtctatgctgcatctgtgatgtacggttatttcctgaagagagttgaccagaggttccagctcgagaagacaatgaagggcctcccttggggatcagaagaggaagacagcgctttgaatcaagttatgatgaccgacttgatgccttcagctcagacttctagctctcatccagagatgggctcgtggaccgcgcctgccttcagcaca

SEQ ID NO: 35473 - DNA, 386 bp, Zea mays
  Clone ID: LIB3060-051-Q1-K1-G10
gtctcaccctccctccctcacacaaataataaggaaaggtcccgcccttttcctccgacatccacaaggggggaggggaaaacacgtacattcacccggcggcaataatggcctcggttccggctccggcgacgacgaccgccgccgtcatcctatgcctatgcgtcgtcctctcctgtgccgcggctgacgacccgaacctccccgactacgtcatccagggccgcgtgtactgcgacacctgccgcgccgggttcgtgaccaacgtcaccgagtacatcgcgggcgccaaggtgaggctggagtgcaagcacttcggcaccggcaagctcgagcgcgccatcgacggggtcaccgacgcgaccggcacctacacgatcgagctc

SEQ ID NO: 35474 - DNA, 393 bp, Zea mays
  Clone ID: LIB3060-051-Q1-K1-G12
cacaaaccctgctaacgatgccacacgttcattggagaccacctggtggcattattgttaaaggcctgtaattaacgccaaccttaccctggcttactttgggcaaaagtcccggaattggccgaccggttaacttgaaaaaaggaacttgaggagtgcttgaatgatggccacaggtctatgtggcagcagtgttgagctcattggaagcctttctttgctctgaggacggtccaggggttctgaaagccgtccgtgcagctggtgagcctctcgtcgatgattggagctgtctcaagtccacggttcgtacttttgaggcgcaatgtgggtcgttggcgcagtatgggatgaagcacatgcggtccttcgcaaacatctgcaacgctggca

SEQ ID NO: 35475 - DNA, 429 bp, Zea mays
  Clone ID: LIB3060-051-Q1-K1-E8
gcgccttcctgcccctatctagctagctttcccgatcctgcatcgcggcggagaggggcgcctacaccacgccgctcgcgtcggcggcggcgctgcttctgctgctgctcgcgccgctcgccgcggcggcggacagcatgtcgatcgtctcctacggcgagcggagcgaggaggaggcgcggcggatgtacgccgagtggatggcggcgcacggccggacctacaacgccgtcggcgaggaggagcgcaggttcgaggtgttcagggacaacctccgctacgtcgacgcccacaacgccgtcgtcgacgcgggcgtacactccttacggctcgggctcaaccgcttcgccgacctcaccaacgacgagtaccgcgccacctacctcggcgtcaggagcaggccgcagagggagaggaggctcggtgaca

SEQ ID NO: 35476 - DNA, 294 bp, Zea mays
  Clone ID: LIB3060-051-Q1-K1-G3
agaaattcgtgtctcttgtccaatccttgcaatccagcagcaggtaaacgtgagttgtttaagtacggaagagataggtcctgttcagccagatgattacaagcattcgcagggcttgttagatttgaggttcttagtctaaaatcacattgaatagggagatgaacacatgtgatgctgattatgtgttatctacatttgtctctatggctgtaagatggccatatatttcctcgaaagtgatcttgattgatcatttgtgctatgtattattataatgacatgggtcatgta

SEQ ID NO: 35477 - DNA, 407 bp, Zea mays
  Clone ID: LIB3060-051-Q1-K1-D3
cctgagttcctcaccggcgaggcgagctcggaaaaaatcgcatggccttgcagcacgcaggtccagctagctctacgctgaccaccggccgtcatggcaggagcgccgcagccgtcctccgtcggccaccggcgggttctaggagccgtttgagggcgcacgcgcagaaacccgacgccggatcccgtggcgcgggagccgagaccgcgacgtcgtcctcatcctcccgctcggagaacgccgtcctcaaggccgcctggtacggctccgagctcctcggcatcgccgcgtcgcttctccggcccgcgccgtcgtcgcctcaggagggggatgctggcggtggcggtgacgcagagggcgaagcggcggcggtggcgggggccctggacctggaccacgcgggagtg

SEQ ID NO: 35478 - DNA, 423 bp, Zea mays
  Clone ID: LIB3060-051-Q1-K1-D4
gcggatagagcagcagaggcagcgacacgatcgcgagcgcacgcacgtaagcacgtggtcggaagctcaagttagaagaagcaccagtgcctgatcgatggcggcccaggctctcctctccggccggcagctgctgggccgccccgtgcagtcggccgtctctaggtcgtcggcgaggaaggcgcccttcgtcgtcagggccagctgcagccctccagccaagcaaggtgccgacaggcagctgtggttcgcgtgcaagcagtccctctcctacctcgatggcacgctgcccggcgactatggcttcgacccgctgggcctctcggacccggagggcaccgggggcttcatcgagcccaagtggctggcctacggcgaggtgatcaacggccgatacgccatgctgggcgcggtgggcgccat

SEQ ID NO: 35479 - DNA, 368 bp, Zea mays
  Clone ID: LIB3060-051-Q1-K1-D5
cagcacggcagtgctccgttacctcctcgtggttcgccccggttgtctactcctggagctcccccggcgcgacaccggccgagctctctagcgcacggcggccggagaagacgaggagggggggacgatctcatacatcggaccggcgtgcctgtgtcgtctgctgatcgcgttgttctctttactctttctgtccctcctttagttgaacacttcaatcagtatattaagatttctgattgggcggcggatcgccatgggattcggaatgcggaataataacaacggggcgagctgctcgtcgtggcgcctggacccggcggcgccgctgctgccgagccacggcagcagcgggggccgctagggtg

SEQ ID NO: 35480 - DNA, 324 bp, Zea mays
  Clone ID: LIB3060-051-Q1-K1-D6
ggcaccaacccagctcggcgccatcgtcgacccttaccccgtttgcctgagagcgatggtgacggagctgaccgcggcgcaactgctcgcgtacaagggcaccgacccgtacaagcccatctacatcttcttatggagcaaggtctacgacgtgacctgcggccgtggcttctacggccccggcggcgcctacgccgtcttctcgtgccgcgaggccagccgtgcactaagcaagatgatcaaggacgaggtcgacgtgtcctgtgatatgtccgagctcacacaacaggagctggtcgttctcgtcgactgggagaccaagtt

SEQ ID NO: 35481 - DNA, 419 bp, Zea mays
  Clone ID: LIB3060-051-Q1-K1-D7
cctgaactgatccttgggttcaacgccttcttgcctaagggctatgcgatcaagctagaagaagagaagaaacctgtcgattttgtggaagctatcaatttcgtgaacaagataaagaatcggtttcagcatgatgaacaagtttacaaggcattcttggacatcctcaacatgtaccgcaaggataataagtctatccaagatgtttaccatgaggttgctatgctgttcaaagaccataaagatttgcttgaagagttccagcacttcctgcctgatacttcagtggctccacaagcagtggcctcaaagggtggtttggttaagcgggaggacaggagctctttagtgcctcctgcaaataagatccttcacaatgataagagggacagagtttacctgtcacatgctgaccgtga

SEQ ID NO: 35482 - DNA, 423 bp, Zea mays
  Clone ID: LIB3060-051-Q1-K1-D8
cctgaactgatccttgggttcaacgctttattgcctaagggctatgcgatcaggctgggagaagagaataaacgtggcgattttgcgcaagctatcaatttcctgaacatgatatccaatcggcttcagcatgatgaacaagttcacaaggcattcttggacattctgaacatgtaccgcacggataataagtgtatccaagacgtttaccatgacgatgctatgctgttcaaagaccataaagatctgcttgaacagttccagcacttactgcctgatactccagtgggtccacaagcagttgtctcaatgggtggtttggttcaacaggaggacacgagcgttatagagcctcctgcagctaagctccttcacagtgataacaaggacatagtttacctgtcacatgctgaccgcgatttt

SEQ ID NO: 35483 - DNA, 395 bp, Zea mays
  Clone ID: LIB3060-051-Q1-K1-D9
ggcacaggcagcagctaacatccctcactctcggtacctgacctgaccacgagagcaacatgggcggaggacacgacatgcacgggcagcactacggccacaacggcggcgtgaagggcttcgtgtccaacctcgtccacggcggcggcggccatggccatggaagcggctacggccatggccatggaaacggctacggccatgggaatggcggctacggcggcggccacgggtaccctcctcccgccgccgccggcgcgtaccctcatccgcacggcgcgtaccctcacccgcacggcggccacgggtaccctcctcccgccacctaccccgcgcactcggcgcactacgggcacacggggtcgtaccacaccagccacaacagctacggcggc

SEQ ID NO: 35484 - DNA, 410 bp, Zea mays
  Clone ID: LIB3060-051-Q1-K1-E1
cagattatgatttctgtgcacatttctttctaacacactggctattccatcagggtgggttactagaaccaaccatgggattttaccgacccaatgcctttcctccactacttaacaaatttgactcaacatgctcaacaagttcacaacgcattatttaacattctttatatgcaccgctcgcatacttaacctatccactaattgtatcctaagtctcctatactattgaaacaccattcttaattgcttcaaaacttccaatgattgatgcctgatacttcagtgtctccacaatcatcaacctctactggttctttggttacacgctaagacactagatctttaacgccttctgcaaataacatactttacaatgatccgacgcacatattctacctgtcacattc

SEQ ID NO: 35485 - DNA, 410 bp, Zea mays
  unsure at all n locations
  Clone ID: LIB3060-051-Q1-K1-E10
ggaaaagatcggctacagacaggagaggctctgtctccgccaggcggcggccaccaggtcacccctggcagctaccctccgcggcaagacttctacgagcaccctcgccccccatggccggctcagcttcagccacaccacgtcgctgcagacggcgcccgggcaccgcgggctccgagcagggtgggcggtgcgcgtgctcccgctgacggaggagaacgtggagaaggtgctggacgaggtgcggccgagcctgatggcggacggcggcaacgtggcgctgcacgagatcgacggcctcgtcgtcgtgctcaagctgcagggcgcgtgcggctcctgccccagctccaccatgacgctcaagatgggcatcgagacgcgcctncgcgacaagatccccgacatcctcg

SEQ ID NO: 35486 - DNA, 398 bp, Zea mays
  Clone ID: LIB3060-051-Q1-K1-E3
gtcaaagatataatttcagatctaaaagatggccaggcttccttagtttgtgatggtgtggggtttcatgtaagatgtgcatgtcatatactaaatttagttgctagagatgggctggctgtaattttctaaacaattgacacgatcaaagttctcgtactagctgagaatgtatcaccattgcagtggaaggaacttatgaagggtgctaacgagtcagaactagatacatggaggggcatctcactagatggttaccctgatggagttcaactgatttaatgctggacgatgccttgtactacaaggatgcttttgcagagcttaagtattcacatcgtgatatgtatgtcgaaactgatcgatcttcagattagtgggacatggcacttgaaatc

SEQ ID NO: 35487 - DNA, 186 bp, Zea mays
  Clone ID: LIB3060-051-Q1-K1-E4
cactcattcgttgtacgatataatttcacaactaatatattttcacccttccttcatttctaatgggggtggtttttatgccacatcggcatgatatatactaaatctcacttgctacactaatcctccccttaacttcgtaatcaacagactaaataacagctcttacaccatctgatactagat

SEQ ID NO: 35488 - DNA, 415 bp, Zea mays
  unsure at all n locations
  Clone ID: LIB3060-051-Q1-K1-E5
cggattagttgtactgtacattgttcctgcgaagacactgggtcgtccgggtcaatcggcagcttgaaccagccatggcggcgcaccggccgaacgccgcggcgccgctgctcgccaagctcgacgccaccgccacgccgccggcgaagcgcaacaagtaccccttcttctgcgccgtgctcgcatccatgacctccgtgctcatgggctacaacgtcgcggtgacgagcggcgcgcagatcttcatggcggaggacctcgggatgagcgacgcgcagatcgaggtgctctcgggggtcatcaacatatactcgctcgtcggcgcgctgctggcaggctggacctccgaccgtctcggccggcgcctcaccatcgtcctcgccaacgccttcttnctcgtcggcccgctcgccat

SEQ ID NO: 35489 - DNA, 429 bp, Zea mays
  Clone ID: LIB3060-051-Q1-K1-E6
gagaaggaatgcacagttgacaatgcctagagctccgaatctggcagtcttgctgcactgcgcatgctattatcgcgcgaactgctcagatcaactctgcttctttggtttgttttctatgcaaattcctttgcttattacgggttagtattgctgacatcgcagttgagtgatgcaaataaaagttgtgcatctggtgtgtcttttggtctgcgccatatggaaatcaatctttacaaagacactttcatcactagtttagcagaaatcccacgtttatttttgtctgctgatcttgttgattggtttggtcgaaaagcttcgatgtggtctatgatgttcgcatgctgtgctttccttggaccacttgtacttcaacagactgagttgttgactactattcttctatttggtgcccgtgcatgtgcc

SEQ ID NO: 35490 - DNA, 409 bp, Zea mays
  Clone ID: LIB3060-051-Q1-K1-D2
ctctcaccctctctaatattgttcacgtgggcccacttccaattattagtagatgaagaatggataggaggtgaaaagtaggtatagaaaatgatattttatggttgtagtggggtataggggaaggatttagggggaaacgctgtacagagtggagatataggggggaagagaacgctgacgtggcacgtgagtgggatatagggagagaaatttaggggtaaccgctgaagacagtctaaaggctcatctgtgtgtattctgtcatgtcatgtcatgtcatgtgtgttggtatatgatggcttggtcgtcgtaatgtaatgtgtggacaataaatatgcggggttgcacctcaacgtaacttactagtacttgctattgcgatatatatgtactttattataataat

SEQ ID NO: 35491 - DNA, 394 bp, Zea mays
  Clone ID: LIB3060-016-Q1-K1-H6
ctcgttccaggcctgacgtccgtctgcaactcgactactatactaccgccgcgctctgctgctgcgccatccgggtcagctgaactgagcatcatatcatggagggaggagccggtcccaagccatcggacaagagggtggccctcgtcacgggcgggaaccggggcatggggttcgagatatgccggcagctggcgttcagcggactcaccgtagagctaaccgcacggagcgagactcggcgcgcctaggcggcacgcgagcttcacgggttcggcctggctgacgacttgtgagaccagctggacgtaacggagcccagcagcgctgatcatatggctgatttcgataggaccaagttcgggaagctcaatgtgctggtcaacaacgcggt

SEQ ID NO: 35492 - DNA, 430 bp, Zea mays
  Clone ID: LIB3060-016-Q1-K1-H7
gaaaactccgcaggccagtctgcgagttggatggccttcttcttggccctcgtgtgcatcctcatcttgctagccatcgcctcctacgtccagtacactcgctggcaaaaggggaaaggccgcttcggcggccatgggaggtctgctcccttgaagctgcctcctggctccatgggctggccttaccttggcgagaccctccagctttactcccaggaccccagcttcttcttcgcttccaaacagaagaggtacggcgagatcttcaagacgcaccttctgggttgcccgtgcgtgatgctggcgagcccggaggcggcgcggttcgtgctggtgacgcaggcgcacctgttcaagccgacctacccgcggagcaaggagcgcatgatcgggccgtcggctctcttcttccaccagggcgactaccacc

SEQ ID NO: 35493 - DNA, 407 bp, Zea mays
  Clone ID: LIB3060-017-Q1-K1-A12
cttcaagtctcgctacgtagcagtgcaataaaaaaagcagccgcaatggcgagcagcaccatggccctctcctccacggccttcgccggcaaggccgtgaacgtgccgtcgtcgtccgccttcggcgaggcccgcgtgacgatgcgcaagacggcggcgaaggccaagccagcggcggcgtccgggagcccgtggtacggccccgaccgcgtgctgtacctgggcccactgtccggcgagccaccgagctacctgacgggcgagttcccgggcgactacggctgggacaccgcggggctgtcggcggacccggagacgttcgccaagaaccgggagctggaggtgatccactcccgctgggccatgctgggcgcgctcggctgcgtcttccccgagctgctcgcccg

SEQ ID NO: 35494 - DNA, 309 bp, Zea mays
  Clone ID: LIB3060-017-Q1-K1-A2
ctgataccgagcgccagttgccagcacttagagtaggagtagggatcgaagagtgagggaaactgaaacacgaggaggagtcatggcgaccccggatgaccgcggcagctggttgctgtacctgtccctagccgccaaatgcgcctgcgaccagccttaccgtctcgcgggcttcctggccgtctgcgccgtggccttcgtcgtgacctgcctcctgcactggtgcttcccgtgaggcccggcgtgcgggaagtggtggtggacgcggcagctcattgccggtggctgatctacagcgtcactggctgc

SEQ ID NO: 35495 - DNA, 434 bp, Zea mays
  Clone ID: LIB3060-017-Q1-K1-A4
gaaggaagcgacatacgagaaggggaaaatagtcgatagcgaatatggtgacaaattggctggatagacctgctcaggtgaaattacatttgaggcaccagatgagaggacagacattaaagcagatgctgactcaccagctggtgagaccaaagaatgtgaaattacagtagaggcaccatatgagaaaatagcagacaaaggtattgttgaaccaataatcagggagataactgaagatcaaactgcatctggagaaccagatgaagaagctacaacaactgaggaaacggtataggatgttaaggtgctagatgataagtctacagcagatgggaaacctgtatagaatgccacagtcgcgacaaatgaggattcaacaacagttgagaatactctgaaggatgcaatggttgcgccaccaggtacaaata

SEQ ID NO: 35496 - DNA, 428 bp, Zea mays
  Clone ID: LIB3060-017-Q1-K1-A5
cacctctctccatctccctgctcctccgcctccttcttgatccagccaagccagggatcgccatgtcggactcggaggagcaccacttcgaatcgaaggccgacgccggagcgtccaagacctacccgcagcaggctggcaccgtccgtaagaacggcttcatcgtcatcaagaaccgcccctgcaaggttgtggaggtttctacctcaaagactggtaagcatggccatgccaaatgccactttgttgccatagacatattcaacgggaaaaagcttgaagatattgttccttcatcacacaactgtgatattccgcatgtgaaccgtactgagtaccagctgattgatatatcagaggatggatttgtgagccttcttacttcagatggcaacactaaggatgatcttagactcccaactgatgag

SEQ ID NO: 35497 - DNA, 439 bp, Zea mays
  Clone ID: LIB3060-017-Q1-K1-A6
ggccactatggtccttcgcactattcttttgcgcgggctgtacttcccctggggatcagcctcggcgtgccttatatgggggcgagctgaggagcaaagcggacaacaagaggctttcgatcgatctccctacctatctctctctctctgctatcccttccactgcttacctacccactagcttttagtagaaagaggagggccgggacgtggtgacaaggctaggctagcttggggccggcggagatcgatcgtcgacgtcgacggccatgacatggtgcaacagcttcaacgacgtgcgtgccgtggaggacaacctggccaccgccgacgtcgccaagaaacagcatctgcaggcctgcttccacgtcaacctcatcaggacctgcccctcctgcggacaccgtgcgcagtatgacgaacagcgatcggatcgtcc

SEQ ID NO: 35498 - DNA, 290 bp, Zea mays
  Clone ID: LIB3060-017-Q1-K1-A7
gtccactatggatcttcgtgctattctttcgcgcgggatgtccttccactggggatcagcccacgcggtgccttatatagaggcaatctgaagagcaaagcggccaacaagaggctatcaaccgatctccctacatatctctctctctttggtatcccttcctctgcttaactacccgctaactcttagtagaaagaggatgtacctgacatactgacaaggctaggctagcttgtggccgtctgagatcgatcagatgtgacgactgacatgacatggtgcaacagctt

SEQ ID NO: 35499 - DNA, 412 bp, Zea mays
  Clone ID: LIB3060-017-Q1-K1-A9
cggggtaccacaccactccgcgctagctgaggacggtacagcggcacagaggtgcgacgtacgacgacgacgacgcaggcgccacacatggcatcccagctctccgccgccgtgccccggttccacggtctacggggctacgccgcgcccaggtccgcggtggcagcgctgccgtccgtgagggtgggcaggaagaggtcgtcgtcgcacggcatccgctgcgactacatcggctccgccaccaacctgatcatggtgacgacgacgacgctgatgctgttcgcggggcggttcgggctggcgccgtcggcgaaccgcaaggcgacggcggggcctgaagctggaggcgcgcgactccggcctgcaaacgggtgaccccgccgggttcaccctcgccgacacgctggcctgc

SEQ ID NO: 35500 - DNA, 409 bp, Zea mays
  Clone ID: LIB3060-017-Q1-K1-B10
ggttattggaggatgcgtcagtggcagagatgagttagtttccaaagttcgtatttaccaccatgtagttggtggtgttctaaacccgaatgctgcgtaccttatccttcgaggtatgaagacactgcatctccgtgtgcaatgtcagaacgacactgctcttcggatggcccagtttttagaggagcatccaaagattgctcgtgtctactatcctggcttgccaagtcaccctgaacatcacattgccaagagtcaaatgactggctttggcggtgttgttagttttgaggttgctggagactttgatgctacgaggaaattcattgattctgctaaaataccctatcatgcgccttctttaggaggctgtgagagcataattgatcagcctgccatcatgtcctac

SEQ ID NO: 35501 - DNA, 404 bp, Zea mays
  unsure at all n locations
  Clone ID: LIB3060-016-Q1-K1-G10
ccatcctgcacgctcctccgcctgattcccagcgcgtcgcacttcaagagattcgatcgggttcgccggttcgcgcccgccgccatggcgacttcctcaggaccaaaggaggcgccagcgaataaccctgggctccagaccgaggtcgaccccgccaccaaaggctacttcttgcaacaaacgatgttacgtgtgaaggacccaaaagtgagccttgacttctactcacgtgtgatgggcatgtcgttgctgaaaaggttggattttgaagagatgaaattcagtttgtattttctaggttacgaggatgtgaccttagcccctgatgatcatatcaagcggactgaatggacttttaggcaaaaagctactcttgagctcacccacaactggngcacggaaaa

SEQ ID NO: 35502 - DNA, 367 bp, Zea mays
  Clone ID: LIB3060-016-Q1-K1-G11
gggacacgcgcaccgctccggccatgtcctggaggcagcagtgaaccggacagaggaagagatagagagaagtagagaacgcccgccacggcgccgtcaacgccacacccggccgaaccgaaaccgagactgcatcctacttcgcggcgcgccgagatgagcggcatgagcctcttccatcgtctgcctcctgtcgcggaggctgaggaccgctactacgtgtatgcagcacacccggacccacagcggcagggcgtgctgacgctcttcgtcgcggagctccgcgacgacgtgaagcgccgatagattcacatcctattataccaccagcacgtcttccatcactgtctactcgattacacaggac

SEQ ID NO: 35503 - DNA, 439 bp, Zea mays
  Clone ID: LIB3060-016-Q1-K1-G12
cggacgcgtgggttcttgcactcgagttcttcagttcttaggaatagtcagacggaacaactcgagtttgccatggtggtgatctggaaccggggtgtgctgccccctctttgattccctgattggtctcgctccagttcgacgcgggatttggacgggacgggcggaagttgggagagcagagcggccggcatgtttgggtccagggtccaggatgaggtggagatgcagaggaggcctaacaacaggatctttcccgacgagagacaaaatcaatctaagtcattgtatcaaactacacgggctgacagatttggcgcaaatagaatagatctgaagaatcctgagaagcttaaggtgttaaatgaaagcaacaaaccctggcaccagcgtattctagaccctggaagtaatattgtactgagatggaacagggtgt

SEQ ID NO: 35504 - DNA, 322 bp, Zea mays
  Clone ID: LIB3060-016-Q1-K1-G2
cgcgcgtacgtactctcctgccgcacgccttccatctaccactttccagccatggccttatctaacatctgccgttcactggtcgaacatatgcttggacacatgacatagagcgtcgccctctgcactgacacccatctatccgaccgtcatggaactcagctgattgcgtacctgaatgcatggtagctgttaggccccagatagttgtcgcgctcatacagtacctatgacgtgcatctagctcggccctatctcggaaacttgcgccacacccggatggtcatgactggcactagcatcccacacatcaatgccatct

SEQ ID NO: 35505 - DNA, 405 bp, Zea mays
  Clone ID: LIB3060-016-Q1-K1-G4
ccgagctcgatggtccgtcatgcagtcttacaacctcctgaagtggcacaagaaagctcatagagccgcagtcaaggcgctggaagacgggcacagtctcagcgttgtgatcagaaggatagaagaagccatcgcttctgacagcaaataaatatgaccgttgatcctttacatgtgttcttgtcaaccaagctttgttggcagcttccacaggacgcggaagaaggagaactttcttaattcgcgcgaagggttagtgtgtgttggaacatgagtggcgcttttcaaagaaagaaaggcagaagatccttggagctggagggaatagcggagaccacgaccagggcgtctgatggacggactagatcgagtgatacatccgttggagattttaaagaagtcaaa

SEQ ID NO: 35506 - DNA, 227 bp, Zea mays
  Clone ID: LIB3060-016-Q1-K1-G5
atggaatcatgtggtcttttgcatctggagtcaatgtgaacaagcagattgtcgtattgtctttctcgtaataaatttgtcgatgttgagcccttaggctgttgttggtacattggtacttcgtcgatgcttgaattgggaccctttgtccgttttcctagactctgatgctgtatgcaactgaaacaagtaaatctatgatcttaaggctgcagtatgttcttgtt

SEQ ID NO: 35507 - DNA, 332 bp, Zea mays
  Clone ID: LIB3060-016-Q1-K1-G6
aggagcatgtgtctatacttggggtacgctgttcataatttggtatatatgcgattctgttattgggtactatttgtcatacataccataattaaaatggcagtgatgggctttcaaaagaaaggacttaccatgccgaccctatacatggacgccgaccatgagaaggtaacctgatgaactgataaccaaataggcgaccgttataggagctccaaggatagggtccctacattcatagctgatgattggcccacaagggcttgtaaatccatttcaatgcctgtggctgtcaaggagcttgactgtaaaaaacattcttgaaccgaact

SEQ ID NO: 35508 - DNA, 423 bp, Zea mays
  Clone ID: LIB3060-016-Q1-K1-G7
ggcgtgtgcgaggcgccagcagccgattgctacgccggccgctcgccgtcagcatccggcgacggggacacggtgaaacggtcgctcgtccggacatggcgacggcatccgactagatccagcccgtcgatctatagtcaccatatgagctaccaaagctggttcggactgcggtccgcatcaagagcttgaccaagtaccatgtcgcctgcaagcaacaaacttctgatctacaaagtctcttgatgtggcctcaagccggtgtgctctctccagggcaccgcatcgtagcagcatctggcaagctcggagagcatcaccagaacaacgataagccgtttgacaagtgcaaggttaaggataacattgtaagcctgaaagccaaaggacctgagcagtacgaatctgaactgaatgaaaagc

SEQ ID NO: 35509 - DNA, 216 bp, Zea mays
  Clone ID: LIB3060-016-Q1-K1-H1
ccagttgtaggttttgcttgcttcgcccggcggtaaagctgagcgcggcgagagccggagaccgaagaagcgccgcgcgcccggtcatggagatcggacagtaccccgcgagcggctgcttcaaggagcaccagaagatctaccaggagtggttcgcgctcgcggacgcagatggggatggccgcatcacgggccccgatgcgatcaagttttttg

SEQ ID NO: 35510 - DNA, 337 bp, Zea mays
  Clone ID: LIB3060-016-Q1-K1-H10
gagaaggggaaacaattccagtggccaatagtttggatgccagcaggatatgatgcacgaaaccaaaaggctaaagatatgaatgacacagaagagaccccaaaatccccaaagatttctgaagtgtctcctcaatcacccaagatcattcctctgacttggtttgggaatggtcatcatcatgatcagaaatcggctgccagaaatggttctggaaaccacaacaacggatcaacagtggataaccaacctgggggttcttaccattaagacatcatgattcttgaagggaaccctaaaattacatcaacttgtcccaaaaaccttcccctttgga

SEQ ID NO: 35511 - DNA, 395 bp, Zea mays
  Clone ID: LIB3060-016-Q1-K1-H11
gtcctgtccacacttgatgcaggtttctccgggtgcactttcgcttccagtgccgccagcgccggtgctgggactggaaccgggacggcgggcagcagcaccttcagccccagcgcgggcaccggcttcaacggcaccgggaacgggatgggcggcagcactactaccggcctgggacccacgggcaacgcctttgacgccgacgccgccgtcgcgccgggcctgctccccagcgccgcgtccctcggcctcgcactcgccgtcctctccttcctaacctagccctgccgcgccattaacggcagcctcccctcgtcttatgtctggtcgtgttcagtaccatacctctctgaacatgagccagctgctgctgctacttggctggctccatggcg

SEQ ID NO: 35512 - DNA, 375 bp, Zea mays
  Clone ID: LIB3060-016-Q1-K1-H12
aacaagggcctcctgtctgctctcacttcctcagtcctcgtccgtctctgctccgatccctcctctctctacctagctagctagccagccttcctgtagcgcggcagatatggctgcctccaccacggcggcggcggcggcgtcgctgctgctgctgctgctcgtgtcgctcgccgcggcggcggacatgtcgatcgtgtcctacggggagcgcagcgacgaggaggcgcggcggatgtacgcggagtggatggcggcgcacggccggacctacaacgccgtcggcgaggaggagcggcggtaccaggtgttccgggacaacctgcgctacatcgacgcgcacaacgccggcgccgacgcgggcgtgcactcctt

SEQ ID NO: 35513 - DNA, 431 bp, Zea mays
  unsure at all n locations
  Clone ID: LIB3060-016-Q1-K1-H2
gacggatgcatccacgcgtgcgattcacaatgcttatgccttactgtaaattactcggaccagcttgtgactaccggaggtctatctccttagctgacgagaacacgctgctctatacgcgtctgctggcgaggtaatccgtaagaagctgtcgctttccctactagctgttagatccaattctacaacttcaatgcaatgcaagctccatccttcaccgctcagggaccagagagacacagagacgtcctgtaaggccgggcctgctctacacactggtgaccaaggaatggcattactctgaactagagacacgtntcttgattaacacgacaggaccaaggccagcagacggaacgatttaagctgcgatactagagctgacacagaatgcgctagatcttgtctctgctgatcagactggtcacttc

SEQ ID NO: 35514 - DNA, 305 bp, Zea mays
  Clone ID: LIB3060-016-Q1-K1-H3
tctgcgatcagcgctactgtgtctcgtactgctgaaggtcagtcatagcgacatcggaggacgcttcggtggtacctgactggatgttgcatgtgaacatcttaggcaactggtacggtcgggcgctgctgccagaaccgaacgtgaaggtgtgctgccgagccaaccgaagctacgccatagatctgacacgacagtaatgggttgctggcgcacggaaactcgcaagactagtaccagcactggatcaacgacatacgctggagcacgtgcataagcgaccatgaacgttaagcgacgatcgc

SEQ ID NO: 35515 - DNA, 334 bp, Zea mays
  Clone ID: LIB3060-016-Q1-K1-H4
acggacgcatccactcgttccatgcctgacgttcgttttcaactcgattactatactaccgtcgcgcactggatgagctcaagacgaatccactaaacggtgcagcatacgatgtaggtactagacgggccgaaggcattggttaaaagggtccccatcttgatcaacggactcctgagcgtcaagctgtagaaggtattgcaagacatgcacagccgaaaggtcaaagaacaggcccttcattgctaaacctagctctcatgggaggtttaacaagctatacgactggctgcggcactaacgcttgtatttgcgaacccttttgtttaatcct

SEQ ID NO: 35516 - DNA, 366 bp, Zea mays
  Clone ID: LIB3060-016-Q1-K1-G1
catacctgccgtccgacacgcccaaggggctggaggacctgaggaagaaggacctgcaggcgctgcgcggcgacgggcacggcgagcgcaaggtgttcgagcgcgtctacgactacgacgtgtacaacgacctgggcgacccggacaagaacccggcccaccagcggcccgtgctgggcggcaacaagcagtacccatacccgcgccgctgccgcaccggccgccccaggaccaagaaggaccccgagacggagatgcgcgagggccacaactacgtgccccgcgacgagcagttctcggaggtgaagcagctcacgttcggggccaccacgctgcgctccggcctgcacgcgctgctgccggcgc

SEQ ID NO: 35517 - DNA, 429 bp, Zea mays
  Clone ID: LIB3060-016-Q1-K1-E5
ggcacgtttgaggttgccaacatggggcacagcgtagctagcagcctcctgagcacaagctactccgacagtgaacagagcgccctgaaggcagctgacaagatcactgcgctgccggggcaaccggacggcggcgtcgacttcgaccagtacgccgggtacgtgactgtcgacgagaagaatggccgggcactcttctactacttggtggaggcaccacaggatgcctcggcaaagccgctcctcctgtggcttaacggagggcccggatgctcgtcgcttggctacggagcaatgcaagagctcggtccgttccgcgtaaacagcgacaacaaaacgctgagcagaaacaaggcggcttggaataacgtggctaatgtgatcttcttggagtcgccggcgggtgttggattctcctactccaacaca

SEQ ID NO: 35518 - DNA, 422 bp, Zea mays
  Clone ID: LIB3060-016-Q1-K1-E6
caactttttccacccgccggaacactggtaaccctcacgccggcgcagccgcagccgaggcgccgtgaacaacctccggaagcgcatgatctcccttctcctccgggcacctggatcaccatacgtcccttgcccccacttcttcccgctcttctatccccaccgcctcctctccgccatcaaatgcgtcgctacaaaaccattcgccgtcgaggactacctcgtcgccacatgcggcctcacccaagcacaggccctcaaggcgtcgaagcatgtctcccatctgaaggatccctcgaaagccgacgcggtcgtcgccttcctctccaatctcggcctgtccagcgccgagatcaccgacgtcgtgaccagggaccccaaagtcctctgctccgacgtggagagatccctcaccgctcgcg

SEQ ID NO: 35519 - DNA, 432 bp, Zea mays
  Clone ID: LIB3060-016-Q1-K1-E8
gtgaagcttatctgcgttacctgacgaattagggtcctcttccccagatctggtggggaagaacgctacctcacgtcccggatcccatctggcggccaaggggagttacacgctagccggcggtcggccagccgccgccaaccgcctcagccccaacagtcgcaccgccgccgccgaggcaaactcgaagccacccccgccgccgcagccacagccgcgccgagcttgagccgtcgttgctccgctgaatcgcccccatcgtctctcctgaagagagaggacatttattgagacagcatgcctaagataaagacaagtcgtgtcaagtatcctgaaggatgggagcttattgaaccaaccatccgtgagttggatgccaaaatgagagaagctgaaaatgatccacatgatggaaagagaaagtgtgaagct

SEQ ID NO: 35520 - DNA, 397 bp, Zea mays
  unsure at all n locations
  Clone ID: LIB3060-016-Q1-K1-E9
accaactcgagtcatcgagttccacagctctcgcgtcgcgcgcagccaatccctctcgctccggcctacacagcccacaactcccttctccatctctctctctctctctcgcccgtgtcgccccctgtttgtgtacaaccccatggcgacccacgccggcgagaacggcagcgggcacgagaacggcggcgggcacgcggagtggcggttcgcgcgggcggcgaaggagggcgcgctggccgttgcgggggacaagatgagcatccgggcggtgcggttcaagatcagcgcgagcctggacgcgcgcgacccgcggcccgtgctgccgctggcgcacggggacccctcggtgttcccggccttccgcaccgncgncgaggccgaggacgccgtggcc

SEQ ID NO: 35521 - DNA, 361 bp, Zea mays
  Clone ID: LIB3060-016-Q1-K1-F11
gtgaacctgaaacttgcggtgtcactggctggtatagcctgagtgtgagtgagtgatcgagctagctgagctccgatcctcgctagctagctaggataccgccataccacaagtcttcttcacaagtttaggagtgacagcaacaagagatctcgatggcctctgccaccgtgctcaagtcctccttccttcccaagaagtgcgaatggggcgccaccaggcaggtcgccgcgcccaggccgcccaccgtctgcatggtcgtacgcgcctccgactacgccgatgagctcgtgaagaccgcgaaaacgatcgcgtcgccggagcggtgcattctggcgatggacgagtcgaacgcgacgtg

SEQ ID NO: 35522 - DNA, 399 bp, Zea mays
  Clone ID: LIB3060-016-Q1-K1-F12
agccaccatcgaccttcaagtctcgctacgtagcagtgcaataaaaaaagcagcgcgcaatggcgagcagcaccatggccctctcctccacggtcttcgccggcaaggccgtgaacgtgccgtcgtcgtccgccttcggcgaggcccgcgtgacgatgcgcaagacggcggcgaaggccaagccagcggcggcgtccgggagcccgtggtacggccccgaccgcgtgctgtacctgggcccactgtccggcgagccaccgagctacctgacgggcgagttcccgggcgactacggctgggacaccgcggggctgtcggcggacccggagacgttcgccaagaaccgggagctggaggtgatccactcccgctgggccatgctgggcgcgctcggatgcg

SEQ ID NO: 35523 - DNA, 433 bp, Zea mays
  Clone ID: LIB3060-016-Q1-K1-F2
gtgaagcttatctgcgttacctgacgaattagggtcctcttccccagatctggtggggaagaaggctacctcacgtcccggatcccatctggcggccaaggggagttacacgctagccggcggtcggccagccgccgccaaccgcctcagccccaacagtcgcaccgccgccgccgaggcaaactcgaagccacccccgccgccgcagccacagccgcgccgagcttgagccgtcgttgctccgctgaatcgcccccatcgtctctcctgaagagagaggacatttattgagacagcatgcctaagataaagacaagtcgtgtcaagtatcctgaaggatgggagcttattgaaccaaccatccgtgagttggatgccaaaatgagagaagctgaaaatgatccacatgatggaaagagaaagtgtgaagctc

SEQ ID NO: 35524 - DNA, 422 bp, Zea mays
  Clone ID: LIB3060-016-Q1-K1-F5
cggacgcgtgggagaaagctgcggccttttctgctactcctgcctgccagcggcctgcctgcctgcctactagtgcggcgtggaggtggagcagtgggcgctacagcctccatcagctagctgccttgccgtgtcctcctcttcctcctgtcggtggcgatctctgcggaaacccgagcttcgtccaagccgggcagtagtgcgcgccgcctgggcgtaattatggattcttttgagggctctgatcatataactcaaagaaaggttgttcctgcaaaacatattgcattggttgatggaaagaatgagcctgctgtagaggggttgcctaatggttggctgaaagaatgcaggcctagaaagaaccgatatggatccagagtcaagagtgacacgttctatattgatccaatcaatggata

SEQ ID NO: 35525 - DNA, 433 bp, Zea mays
  Clone ID: LIB3060-016-Q1-K1-F6
cacagcacatcgatcgacgacgatatcgggaagcaatatggggttggccttgtcgcggctggaggagattaggacgcagtaccgcatggcagcggaagacggcgaggctgacagtccggcaccggcgccagtgccgtcgaccggtgctgctgctgcttccggcggcggcactgaaaagaagaagcaggcggacgactcgtcgtcgtcgtcaaagacgacagaatgggttcctcataagttctctgagatcgtcggtcaaagacgacctgatgaggatatgttccgagggatctaccttccacgatcggatcagcagccgaaaacaaagaagtactgggtagatgggagaaatgccaactgcttcatgctgttccctaaaggattcagcatcacctggggttcggacgaaaggtactggagttggcgcaagctc

SEQ ID NO: 35526 - DNA, 422 bp, Zea mays
  Clone ID: LIB3060-016-Q1-K1-F7
gaattcagagggccgcacacgttccctgccgctgcctctacccctctccgggctctcgctccccgggtccaccgtctctacaccgccgccgctcacaccccaattcctctcgccccattgccggccgtctacctccgtcctctcgcctcgctcgctgcaggttcaatcgccgccgccatttctgcagtttttaattcccacgtcctgttccggcccggccgtgcactccaaattcttccaacaaggccagcccacgccacccggccgggatcccagaaaagttgcgctcggacttcgcgcgttacgtctcccacccagcccttctatcccgtgatttcagaggcgcccctgtaccgaaagcctagctcccaatcttccttggattcgtcttttttttggatcttggggactgcactgcacac

SEQ ID NO: 35527 - DNA, 434 bp, Zea mays
  Clone ID: LIB3060-016-Q1-K1-F9
cggacgcgtgggcggccatggaagacacgccgcaccctggttccagctcgcgatactccctgcacgccggagtcgcccagctcggccacctacctccctatgcgcgacctcctctagctccctgtttctccagagtgtcttcctctgttggctcgccggcttcctgctccctgctcacccagcgcacgcttctccttgtgtgccgtgcctgcgtgctgctcgccctagctcccagccatggcgtcggccaaagctcctgcgcgttatgtgcccagctcccttttccgcgtatgcgcgcttagctcgctttcctgcgcgcccagcgttctgctcccgctcgtccctgcgcgccaagctccttgcgcggtccttccttgagctcggtcctgcgcttttcctttctctgtgctcgtgctcgccgtgccgtgagtcac

SEQ ID NO: 35528 - DNA, 381 bp, Zea mays
  Clone ID: LIB3060-016-Q1-K1-E4
gagctgcttagatccgtcgcatcactgtttaccctcatgccggcgcaatctcatccggggcaccgtgaacaaccttcggaagcgcatgatctcccttatactgcgggcacctgtatcaccatacgtgccttgcccccacttcttgccgctcttctatccgcaccgcctcctctgcgccatcaaatgcgtcgctacaaaaccattcgccgtcgaggactacctagtctgcacatgcggtcttacccaagcacaggcccttaaggcgtccaagcatgactcccatctgaaggatacctcgtaagccgactcggtcgtcgtcttgctatgcaatctcagcctgtccagctcctagatcaccgacttcgtgaccagggtccccaa

SEQ ID NO: 35529 - DNA, 418 bp, Zea mays
  Clone ID: LIB3060-051-Q1-K1-B6
gctggccccaatcgttacctcaccgccccattgatggtcgggaagaaggatccgaacgacccatcgatcgagtcaagcaccaccaccacaaccaccacttctataagcatgggcgaccaaagcgttgcgagtatagactcggatgggctgacgcctagcgccgtcttctcgcagatcatgaaccccaaggggcggtgaggtaaagctggccccaatcgttaccttgcaggtgtaatttattcattcagaatatttcatttctttaatgttctctcaagttaaggcttaagaaccagaagtgtgaggattgtttcgtactagatattctgccttgccttgtactacttgcttcaccgagtattgtaatgactatacatctgttggcttgtattgtaccgctgctattgacccagccagt

SEQ ID NO: 35530 - DNA, 355 bp, Zea mays
  unsure at all n locations
  Clone ID: LIB3060-051-Q1-K1-C10
cgacgctgggcgacctgggctcgggggcgccggcgacgagccgagctggacgcctgctccgggatcgacaggggaaagggaaggtgaccagccggatcgctaggagctgcagctcgatccggcgggcccatggggggacacctggtgtccatgctccggtggccgccgaacctgggcctgcccatnctggccgtgctgctccccgcgccggccgctcacctccgggtccaggtccaggattggcggcagtggcagtggcagcggtcgcgggccgagcagctggacgcgaacgcgcggcggttgacccagctcgtgcggaacgtttccgtcctggtggacgccgctctgtggggcg

SEQ ID NO: 35531 - DNA, 388 bp, Zea mays
  unsure at all n locations
  Clone ID: LIB3060-051-Q1-K1-C11
cgcttgcttttctcaagtcacagggccggcccagcccaaaatccttttcaccgctacgacctgcgtgctccggcgatgcaacggatttcggctacgacttctgcgctcctgctacaccggcggcttcgacttcctctccaccaccttctgctccctacgcggcctggcagtatcccatggcggttggaccacccgaccgtcgatgcagcctgcggtgcgaaccgcggcgccggtcgaactcaccatgtggccgccgcggaggggttactcccagttcgcgagcgggttcaccccgctgaagccgaagccgctgcgatccatgctcgacatcgaacgcgccaagggcctcttccccgaccacctngtcgccgcatgggatgactatcat

SEQ ID NO: 35532 - DNA, 399 bp, Zea mays
  unsure at all n locations
  Clone ID: LIB3060-051-Q1-K1-C12
ctggaaccgtccctcgttcgtaatctttccgcttcggttcgcaatttctggtcaaggtgggggccaattgggaccaacggcaaacttggcagagaaaggagaaaaggccggaagccggccgggatcggaaaatgggcccgaaaaaccccgggagggaccagaaggaggaggagaaggagtggtggctgaaggatggaggcttgaaggaaagcccgggccgaacttcaggatgcgtgattcgacagagacgatgacacgatgaggacggacggcgacgcgtcggttcgncgcgctccttccagtcccataagtggccgcagagctacagggaaacaactgatacttacacaatcgctgcatcaccgagctttgggtacttgggcccttctacaagcaaat

SEQ ID NO: 35533 - DNA, 422 bp, Zea mays
  Clone ID: LIB3060-051-Q1-K1-C2
gaagcaaaaagggagacatctttagggtcaatatcatccaatgtttctgatgccagaagtaatatgattggagagattgagaacagatcaacattcctcttagctgtaaaagctgatgtggagacacaaggagaatttgttgaatctctagcaaatgaggtccgagcagcaagcttcataaatattgacgacgttgctgcatttgtaaattggttggatgaggagttgtctttcttggttgatgagagagcagtgctaaaacattttgattggccagagagcaaaacagatgcaataagagaagcagcttttgagtaccaggatctgataaagttacagaacagggtttcatcctttactgatgatccacaacttgcatgtgaagaggctctcaagaagatgtattctttgcttgaaaaagt

SEQ ID NO: 35534 - DNA, 420 bp, Zea mays
  Clone ID: LIB3060-051-Q1-K1-C3
cacgcgctcaccgtgctgcctccaccatcgatggctctccctcccggcgcaggggcggtggcgccggcgacgcccttcgccgcgaatccgtgccgtctccggcgggcgtctggtcctcctgccgccgcccttcggctcgggccgctcttctggccatgggaaaaggtgaaaatcggtcccctttctgtttcccccatgggttttggaacatgggcatggggaaaccagctactttggggctatcaagaaagcatggacaacgaacttcaggattgcttcaatctggctctaaggaatggcataaacctttttgacactgctgactcttacggaactggaaggctgaacggacagagcgaacggctactcggtaaattcatccttgagtttgaagggaggattaaatctccagatgatgtg

SEQ ID NO: 35535 - DNA, 390 bp, Zea mays
  Clone ID: LIB3060-051-Q1-K1-C4
cgcgagtgagtgaacaccagccgtatattcctgaccccgaccgatcctcgcctgctggaggcatggcgacctccgcggcgctctccaccgccgccaatcccacccagctctaccggtcccgcgctttgctgggcaagccggtgaaggggcttggcctgagcatgggccgcgagcgcgcccagcggagcattgtgtgccaggctgcgagcagcatctccgccgaccgcgtccccgacatggagaagcggaagctgatgaacctcctgctcctcggcgccatctcggtgcctaccgtcggcatggtacgaccctacggctccttcttcgttcctgcctgctacgggaacgccggcggtgggacccacgcgaaggacaagctgggctacgaca

SEQ ID NO: 35536 - DNA, 420 bp, Zea mays
  unsure at all n locations
  Clone ID: LIB3060-051-Q1-K1-C5
aactccgggtcaccattttttgatgagtagagggggctccccgtctcggccctcctgccggttgaggccagcagagtgatgagtgaacggagtcatgcttgtgagattaggctttgtcgttgtagcctccgtcgcagctttaactcttcagagagctaacagtggggccaggcacagcaaagactatgtccaagcaaggaaaaggaaggataaggctaacaattctgaacatggggagaaagaagaagagaaggaagaggttaaaacaatcagcggcataatcaactcagcccgctcgctagacgatgacgacgatgatatgctttccgagatcgaaagcctnctatcaggagacattgacatccctataccaagcgatcgcttcgacgttaatggacggtcacggtacaacaacgctta

SEQ ID NO: 35537 - DNA, 415 bp, Zea mays
  Clone ID: LIB3060-051-Q1-K1-C6
gcttgaacatccaactgatccaaccaccgacccgggcgagcaagccatctccgtttgcttgccagtcccgcgagcaccattcaccacaccagcgcagccgccatggccgacgtcgagaaggccacccccgtggccgcaccggccgagggcgcgggcggcgacgtggccgccgggagaaccggcgcggtggccgccctgctgcggcggtggcggacccaggacctgctggaccggtcggggtccgcgctgcgcgccgcggcgtgggcgttctccctgctggcgttcctcgtcatggcctgcaacgagcatggggactggaggcagttcgaccgctacgaggagtacaggtacatcgttgccatcggcctgctggccttcgtctacacgacgctgcagctcctccggcacggcgtcc

SEQ ID NO: 35538 - DNA, 226 bp, Zea mays
  Clone ID: LIB3060-051-Q1-K1-C7
ccaaaagtacggtagaaaatgatattttatcgttgtagtcgagtatacgggaaggatctctggggaaacactgtacagagtcgacatctaagacggaagagaacgctgacctggcacgtgagtcggacatatggagagaaatctaagcgtaacccctcaataccgtctaaaggctcatctgtgtgcattctgccatgtcatgtcctgacatgtcgccctatatatg

SEQ ID NO: 35539 - DNA, 364 bp, Zea mays
  Clone ID: LIB3060-051-Q1-K1-C8
gccaaaaggcatcaccgccgcgacgactatggcagcctcgctccaagccgcggccacggtgatgcagccggccaagatcggcggccgggcgccctttgcctcgctgccgtcccgcccgtcgtcgcaactcgcctgcagggcgttcggcgtcgacgccggcgccgccaggatcacgtgctccctgcaagacgtcgccagcaggtgcgtcgacgccgggaagctcgccggcttcgcgctcggcacctcggcgctcctcgtctcgggcgcgagcgcggaaggcacgcccaagaggctgacctacgacgagatccagagcaaaacgtacatggaagtgaagggcacgggcacggcgaaccagtgcccg

SEQ ID NO: 35540 - DNA, 393 bp, Zea mays
  unsure at all n locations
  Clone ID: LIB3060-051-Q1-K1-C9
gcgatggctgggcagaaccagcggctcaacgtcgtgccgacggtgacgatgctcggcgtcatgaaggctcggctcgtcggcgcgacccgcggccacgcgctgctgaagaagaagtccgacgcgctgacggtccagttccgcgccatcctcaagaagatcgtcgccgccaaggagtcgatgggcgagacgatgcgcgcctnctccttctccctcgccgaggccaagtacgtcgctggcgacggcgtccgccacgtcatcctccagtccgtccgcgcggcatccgtccgcgtccgctcccaccaggagaacgtggccggggtcaagctccccaagttcacccacttcgtcgaccccgccgcggcctccgggggccccttcaacgcgtncccgagc

SEQ ID NO: 35541 - DNA, 514 bp, Zea mays
  unsure at all n locations
  Clone ID: LIB3060-051-Q1-K1-D1
attcccgggctcgactccacgccgtctcgctgctcacgctctctctaatattcgttcaacgttggctccacnnttccaattattagtcagatgacaaaatgtggataggagggtgaaaagtagcgtattagaaaatgggatattttnnatggttgtanngtggggtatttaggggaagggggatttagggggtaaaccgcctgtnnacagagtggcagatatttaggggggaagaagaacccgctgacgtgtgcacgtnngagtgggatattagggagaagaaatcttaggggtaaccccgcttaagaccagtctaaaaggctcatnnctgtgtgtatatctgtcanntgtcatgtcnnatgtcatgtgtgtctggtattatgnaatggcttgcgtcgtcgtaaatgtaatggtcgtggaccaatataatattgcgggtgttgcacctttcaacgtaaccttactaagtaccttgctatttgcgatataatatgtacctttagttataataatt

SEQ ID NO: 35542 - DNA, 302 bp, Zea mays
  Clone ID: LIB3060-051-Q1-K1-D10
cccaagtgtttgggttgagaagaagaattgtacttccgtgcagcgtacaccccgtctgcgatgaaatgttgacactagtatcatgaacatatccccagtctgggctaactatgggacggctaattggtcacatgctatggaagacgactgggatttatctacaagtgatgctgatggactaagcttagatgcatgtatcaacctagtgccaggatatacgatgctcaccaagtggtcgttaattaacaacactaacttactgtcattccaggttgcaattctgatctgttgcggatcgtgct

SEQ ID NO: 35543 - DNA, 265 bp, Zea mays
  Clone ID: LIB3060-051-Q1-K1-D11
gatatcatcttcctggtgagacagaagaagattctgcgactagacttgccaccaatttagagaatctcattctcaaagaaggaccagaaacaattgctgctttcattgctgaacctgtgatgggtgctggtggtgtcatccctgctgcaaagacctattttgacaaggtccaagcaatcgtcaagaagtatgacattcttttcatagcagatgaggtgatcactgcatttggaaggctgggaactatgtttggatgcgattacta

SEQ ID NO: 35544 - DNA, 421 bp, Zea mays
  Clone ID: LIB3060-051-Q1-K1-B5
gttgcagcgtgtgtgtgggtggttaatcttctgtccacaccagtgttcacctgtgccgtgcccaagtttgcccagtccctaggtggtgaccatcgttggcaattagtccacctcgccgtaaccagaattcccagaagaagatgaaattcaagaagtagtttctgaagaggagtctgctccagtgcctgctcatcaagtggatggagctatctaactaaaggttgggtagaaggatctagaacctcctcactgcaacaaagggtaagcttgaacccggctattccatacatgaaaagacaatcacgcactgggagtggagagatggcgagagtggcacgtaccctcctggcaaaggaccgcctaaaaggcgtggtgtgctctcgggtggcgcggacctgttcatgcagtggaggatccgtgg

SEQ ID NO: 35545 - DNA, 78 bp, Zea mays
  Clone ID: LIB3060-050-Q1-K1-H6
cacgcgtccgctacctagcaacgcgcagtaagcagcgtgtgcaaagctactagcgcccggctagcttggccatgtaca

SEQ ID NO: 35546 - DNA, 234 bp, Zea mays
  Clone ID: LIB3060-050-Q1-K1-H9
cagaaaatctccactcctcgccgcacctagcagaggatcacatgggatccgccgtttgtcttctcctctcgcccccgcgcctgctccaccgcgacggcacatcccgcctcctcagcatcccgcaccggcgggtcctcctcgccgcccccaacaactcgacccctcgtcggctcctggcccccgctccgcgcgccttctactaaaactacaacagcggtgccgtggaggctccct

SEQ ID NO: 35547 - DNA, 404 bp, Zea mays
  Clone ID: LIB3060-051-Q1-K1-A1
ccatccgcacctctctccatctccctgctcctccgcctccttcttgatccagccaagccagggatcgccatgtcggactcggaggagcaccacttcgaatcgaaggccgacgccggagcgtccaagacctacccgcagcaggctggcaccgtccgtaagaacggcttcatcgtcatcaagaaccgcccctgcaaggttgtggaggtttctacctcaaagactggtaagcatggccatgccaaatgccactttgttgccatagacatattcaacgggaaaaagcttgaagatattgttccttcatcacacaactgtgatattccgcatgtgaaccgtactgagtaccagctgattgatatatcagaggatggatttgtgagccttcttacttcagatggcaacac

SEQ ID NO: 35548 - DNA, 417 bp, Zea mays
  Clone ID: LIB3060-051-Q1-K1-A10
cctgctcctacacagaaaagccgtcacctactcgcctccgggcaaaaaaaaaccgactgcacacacgacccaaatcttttcctctccacaggcgacttccaacgcaacagcagctcgtcgagcgagtcgtcgccggccggccggtatatacgcaagaaagccaagaaaaacacttctccctcttcctccatatctccaagaaccaaaggtagctagctagccgcgactcgttggctagacgattcaagcagcagcgcaggatggtggcgccggtggtgattgcgtcggccgggctgggcatgctggccggcgtggcgatggccaaccggtccctcgggaacgggctcccggcggccttcaggtggaacgcgcgcccgcgctgcgccacgtgcggcggctctggccgcgtggagtgca

SEQ ID NO: 35549 - DNA, 402 bp, Zea mays
  Clone ID: LIB3060-051-Q1-K1-A12
gtaaggttgaacacttattcgtggtacctggctctgcaaggcagttcaaaattgttcttgacttcctaggtttggtggagaaattttactacctttctggaagatatgaccttgagcttaccgttggtgatgctgtaatggaaaattcatttctacgacctcttggccatttggagttggacctgccagatgccccagaaaaagccccacgtcctcctgcacaagctgttgacccattctcaaaatttgggccaaaggcagagatatcacatatattccgcgcaccagagaagaggccacccaaggagctctcgctagcgttcacgggtctcacgcttctgccgtttattggattcttgatagggctcgttcgtcttggagtgaacttgaagaacttcccgt

SEQ ID NO: 35550 - DNA, 407 bp, Zea mays
  Clone ID: LIB3060-051-Q1-K1-A2
cacctctcttcatctccctgtgccttcgcctacttcttgatccagccaatgcagggatcttcatgtcatagggggatgaacaccacttctaatcgaaggccgactccggagcgtccaagacctacccacatcatgctgccaccgctcgtaagaacggtttcatcgccatcaataaccgaccctgcatggttgtgaaggtttctacctcaaagactgctaatcatgctcataccaaatgccactttgtggccatatacatatccatcggtaataatcttgaagataatgattctttatcacacatctgtgatattccgcatgtgaacctttctgcataccatcttattgatatatcttaagattgatttatgagccttcttacttcaaatggcaacactaatgatgat

SEQ ID NO: 35551 - DNA, 427 bp, Zea mays
  Clone ID: LIB3060-051-Q1-K1-A4
gcatcttcctaccccgtcccgatccattcatggcagcccctaccgtcgtcttactgcccgtgtggggtgctggccacctcatgtccatgctcgacgccggcaagcggctgctcacccgcgggggtcgcgcgctctcgctcaccgtgctcgtcatgcgagcgcccacggagcagctcgcggccgatctcgacgcccacatacgcagggaggaggcatcgggcctcgacgtccgcttcgtccgcctccccgccgttcagcccccgacggacttccacggcatcgaggagttcatctccaggctggtacagctgcacgcgccccacgtcagggcggctatctccagcctggcttccccggtggcagcggtcgttatggacttcttctgcacggcgctgctcgacgtgacccgcgagctcgccgtgcccgc

SEQ ID NO: 35552 - DNA, 421 bp, Zea mays
  Clone ID: LIB3060-051-Q1-K1-A5
agcaaccggtccagcactttcacgctcagctccagcaatggctgcctccaccatggcgatctcctccacggcgatggccggcacccccatcaaggtgggctccttcggcgagggccgcatcaccatgcgcaagaccgtgggcaagcccaaggtggcggcgtccggcagcccctggtacggccccgaccgcgtcaagtacctcggccccttctccggcgagcccccgagctacctcaccggcgagttccccggcgactacggctgggacaccgccgggctgtccgccgaccccgagaccttcgccaagaaccgcgagctggaggtgatccactcccgctgggccatgctcggcgcgctcggctgcgtcttccccgagctgctctcccgcaacggcgtcaagttcggcgaggccgtctggttc

SEQ ID NO: 35553 - DNA, 423 bp, Zea mays
  Clone ID: LIB3060-051-Q1-K1-A6
atcaaatccacggtttaataacgaaccgtgttaacttaccataacaacaactcaattgctatcgaattccttcctatcgaattcctatagtaaaattcctataggatagaacgtacacagggtgtacacattatatatgaatgaaacatattcattaacttaagcatactcctttttttatttaatgagttgatattaattaaatatctttttttttagatttttgcaaaggtttcatttacgcctaatccatatcgagtagaccctgtcgttgtgagaattcttaattcatgagttgtagggagggacttatgtcaccacaaacagaaactaaagcaagtgttggatttaaagctggtgttaaggattataaattgacttactacaccccggagtacgaaaccaaggatactgatatcttgg

SEQ ID NO: 35554 - DNA, 413 bp, Zea mays
  Clone ID: LIB3060-051-Q1-K1-A8
cacgacgcacgcagagccgcagagatccgtcacactgcaagttttgaaaactgaactgtaagatggcatcagcagagctttcccgtgaggaaaatgtgtacatggcgaagctcgccgagcaggcagagaggtacgaggaaatggttgagttcatggagaaggtagcgaaaactgttgactcggaggagctcactgtggaggagcgcaacctcctgtctgttgcatacaagaacgtcattggagcccgccgtgcctcatggcgcatcatctcctccatcgagcagaaggaggagggtcgaggcaatgaggaccgtgtaacactcatcaaggactaccgtggcaagattgaaactgagctcaccaagatctgtgatggcatcctcaagcttctcgaatctcaccttgtgccgtct

SEQ ID NO: 35555 - DNA, 319 bp, Zea mays
  Clone ID: LIB3060-051-Q1-K1-B10
cgctagcgaggaggtctgcagatctttgtgatgaccctgactggcaggaccataacccgcgaggttcagagctgctacaccatcgacaacgtgaatgcgagcacgcacgacatagagggcatccccgcagaccagcagcatatgatcttcgctgtcaagcagatggaggatgaccggaccctagcagtctacaacatccagaaagagagcactctccacctggtgctccgactgcgatgagcccattaagccatgagtcatttaatctgctgctgtacctgagtatatgcgtcgtctggtgccctctggtgtacctcta

SEQ ID NO: 35556 - DNA, 295 bp, Zea mays
  Clone ID: LIB3060-051-Q1-K1-B2
ggtccggctctgaaaaaaactcttgaaaacaattacttcatcatctttcgtcgttggggtggtggtggcggctacggcggcggcggcggcggctggagggactgatgtgtggccccatcctggcttctgccgagttatcttatctatctatagtatcgtgttaccgttcgcttctgtcaccgtgttagtgtccgttctacctttggattaggtgttggtaccccttttgttcgctttgggtgctcccgctatgaaacgagacgagagaagaatgagcaaggtttttgttcgcatc

SEQ ID NO: 35557 - DNA, 125 bp, Zea mays
  Clone ID: LIB3060-050-Q1-K1-D7
gagagatccttagtttagcgcgtccggtaggagctaaagcatgaggttaagcagggtgacagatacaaacttgtggatattcgggaagagatattgcggaagctaatagctgtgtatctttttat

SEQ ID NO: 35558 - DNA, 442 bp, Zea mays
  Clone ID: LIB3060-050-Q1-K1-D8
agcacgaggcgtgcaaagtattcctgactatacaacgcaatacacaaatgacaatgcagtgcagttggccgagtcgctcaagaccgcactgcttgttcttggctacacatctaccggcctatccttattcgcggcttttgggctgctgttgctagcccagcagattaactctgagaacaaatcggagtaactgacaggcactcgctgaagttgtgtaccttatgccttgtccttctatgctccaatgaggcatatgttcatagttatattcattctcttgtacctttttttgtattatttgttgcatttttctttttatatttattttttctcttttttttttttttttacttttatttatttttttttatttcatatatatttttatttttttttattttattttttttatgttttttttttttttttttctattattttt

SEQ ID NO: 35559 - DNA, 423 bp, Zea mays
  Clone ID: LIB3060-050-Q1-K1-E10
ctctcctcctccagagctcgtcgccactttccaccgccaccctcggtcacgccgtccgtggaggttaggtcagcatggtgagggtcagtgtgctcaacgatgcgctcaagtccatgtacaacgctgagaagattggcaagaggcaggtcatgatcaggccgtcatccaaggtcatcatcaagttcctgacggtcatgcatcgccatggctacattggagagttcgagtacttttatttccatcgtttcttcaatattgttgttttactcatttttatgttgtatattttcttttgttttaagttctatctttttttattttttttattattttatatatttttttttgtctttatcttttttctttttcttttattttttatttcttttttttttttttttattttttttttttttttttttt

SEQ ID NO: 35560 - DNA, 189 bp, Zea mays
  Clone ID: LIB3060-050-Q1-K1-E11
gtctgtagtctctattttatatagatgctaacaaccttgagatacagatcgcctacaggggcttttggggcataagaccatacatcaccgaaaccgaactcgtcctccacacggttgcttagccatctcggttgtttagtattttcagtttttttttactgttcttttttgattttaatttatttttta

SEQ ID NO: 35561 - DNA, 151 bp, Zea mays
  Clone ID: LIB3060-050-Q1-K1-E4
ccgaatccaaaccatacaagcaaggaatcccccgatggctcatcgggttctcctcctgctctctctcgcgtcggccgccgcggttgccgccgccgtcgacgcggaggacccgctgatccgtgcaggtggttcccggtggagatgacaatta

SEQ ID NO: 35562 - DNA, 119 bp, Zea mays
  Clone ID: LIB3060-050-Q1-K1-E5
taccttctcacggtatcacaagttggaaaggttataaggttgaacaagtgactgtctgtcctttattggcgatgtactattacaaccaataattgtagatttatccctcaataaaatta

SEQ ID NO: 35563 - DNA, 315 bp, Zea mays
  Clone ID: LIB3060-050-Q1-K1-E6
ctgcaaactacatctaatcctaagaatttctccactgacacagtgaaccaagaggcacgccacacttcctgtcacattgatctcccgtttacttaactattgccctgacaccaacatttcaaacgagccgatattcttgcactcaatacatcattccttagtaacctcacagcctcttactttctcaactaccatatttcacactctcttccaacacaaaccggattcttcaacacatatcatttccaaacgacctatctcactcagaatgtcatgctcatctatcctacaggctccatcatcaacctgaactac

SEQ ID NO: 35564 - DNA, 442 bp, Zea mays
  Clone ID: LIB3060-050-Q1-K1-E7
gtcatcgtcgcatttactcgccgttctttcgtagactcgttcatcgcttcgtcctctggtccttccaaaattccaaatcccattctccctgctcgtgcagttgagcagtccatcaaccggcactccagcttctctagcatcaagcgtgcgagctactgctttcagactgtatagccatcttagcagttacaatattccttcattcttttgttcatggtctcatctttatatgtctttttttctttttttttttttttttttttttttattctttttttttatatttttttttttttatttttttttatatttattttattttttttttctatttatctattttttttattttttttaattttttttttttttttatttttttatattttatattatttattatttttatttttttattattttttattattatttatttttt

SEQ ID NO: 35565 - DNA, 129 bp, Zea mays
  Clone ID: LIB3060-050-Q1-K1-F4
gcccgtgcacaggttttcgcccgccgttacctgcggctcggtcggggtcctcataaggctccttagaacaatcgcaggacatccaagagctcagcaacgctttctagcaagaaacccgaccctaccaaa

SEQ ID NO: 35566 - DNA, 416 bp, Zea mays
  Clone ID: LIB3060-050-Q1-K1-F7
ctcgcgactgctctcatctgttcccgcttaggattcgtttacaatggcccgtgtgtatgtcggcaacttggatgcacgcgtgacttccggggaactcgaagatgagttccgtgtgtttggagttctgctaagtgttttgggttgctcttataccatctggttttgcatttattgtttttgactactttttttattctttttttttctttttttatttttttttttttgttatttttctttttgtttattatttttctatttttttctattttttttattttttttttttttttttttttttatatttttatgtttttttttttttttttttttttttttttatttatttttatattttttttatttttttttttttttatttatttatttctttttttttttttatattttttttt

SEQ ID NO: 35567 - DNA, 361 bp, Zea mays
  unsure at all n locations
  Clone ID: LIB3060-050-Q1-K1-F8
gcgaggaaaagctaaatctgaacttggctcagacagaatcagcgagggaagatttcctgagagcgaagaaggactccccagaagacaaggagatcattcgggagctccgtttgctcgcggaacaagacaaggcactataccagaagcagaaggagctctacaaaggtctctttgggccaagtcctgaagcgaaaccgaagaaggcaaagtacctcgttgtgttttggcagtgcctggtgtcatttatcctttatctggctgggatgttcaaacggaagaacgagtaggataatttaccagaaaaatgtgtagaactggtggcctaattgaccaacctngtattataaggagtgttgaattt

SEQ ID NO: 35568 - DNA, 288 bp, Zea mays
  Clone ID: LIB3060-050-Q1-K1-G1
actcatccgaaggattatactgctccgctctcctttactcccatttttcatccttgtcgacctgttccattttaagccttcttagaatattctccactctcactccttcctacttaatctcttatcctttaacctcaaactctccattaactattagctccacgtttttttccatctatctttatctattttatattaccacacttctacgatttctactctctacattctctatcaactatcaatattatttatcttacttttactaattatatcttttcaatttca

SEQ ID NO: 35569 - DNA, 430 bp, Zea mays
  Clone ID: LIB3060-050-Q1-K1-G12
cttgacgagcgggttccagcagttcatgttcaatgtctatgacatgaagccggagctggtcggtcctctcaagtccggccaggcccccaagtacatggtgttcgcttgctccgactcccgtgtgtgcccatcggtgtccctgggcctgcttcttgtcgaggccttcaccgtttgtcttattatttttatggtctttgtcttcttcttgtccaatttctctggttttcttttcttttttttattttttttttttatctttttttttctatttttttcattttttttttctgttttttttttttttttattttttttttttttttgttttttttttttttttttttttttttttttttttttgttttttttttttttttttttttttcttttattttttattttttttttttattttttatttttttttttt

SEQ ID NO: 35570 - DNA, 244 bp, Zea mays
  Clone ID: LIB3060-050-Q1-K1-G6
ttttttttttttttttctttttttttttttttttttcttttcctttttttctttttttttttttcttttttttctttttcttttttttttttttttttttttttttttttttttttttttttttttttttttttttttttttcttttttttttttttttttttttttttttttttttctttttctttttttttcttttttttttttttttttttctttttttttttttcttttttttttttttt

SEQ ID NO: 35571 - DNA, 295 bp, Zea mays
  Clone ID: LIB3060-050-Q1-K1-D6
ctagttctagatctgcttgtgccttgattagattgtttggaaggggttgcttgaaaacgcggataaagagagattgaggaggttcattagactaattccccctgtttacccatacttcgcatgtaaagcttatattgtcgttccctttattcaaattctatatccattgcattctttctcattatattatacatacaatgatcattttctatttacactattcattactatttctcaatgtcttgtttcctgatattgttatctacacttacttctttttatacccttttttatt

SEQ ID NO: 35572 - DNA, 308 bp, Zea mays
  Clone ID: LIB3060-050-Q1-K1-H1
acacatccaaactgtgctgacctttaaagatttcatcttcgcggttcggaagtgacaagattatcggtacctacagaaattccttcaaattcctttttaagagtacaatctggcactcaaatataaagcaactttacatagtcagaaatgacattttgacatttaagaactagcactacgaattcagtaaagaggttccaccagactccttatcggtggcctgctcacgtaacaaagcacaggctaccgcaaataatatgattcttgccagacaccattcatattccattaccttgaaatttatactc

SEQ ID NO: 35573 - DNA, 418 bp, Zea mays
  Clone ID: LIB3060-016-Q1-K1-D1
gaagtctagaccaccatcatgggaggaagcggctatcagagatctgcaacgtgcaatgaaggatacggagttgggcggtcggtccgaaggagctcatattcacattgttcatctatcagatgcaaaaactagcttggaacttatgaaggatgctaaacgcagtggtgcaagtctgtctatagaaacatgccctcattacctggcattttcgtccgaagaagttccagatggagatactcgctttaaatgttctcctaccatacgtgatgacacagacagagaaaatctttggaaagctctgcttgatggacacatagacatgctaagttcagaccactcaccatccactcctgacctcaaactaatggatgaaggggacttcttaagggcatggggaggcatatcatcattgcagttt

SEQ ID NO: 35574 - DNA, 410 bp, Zea mays
  unsure at all n locations
  Clone ID: LIB3060-016-Q1-K1-D10
cgcgtgctccctgccagccgtcagccgagtccttccccatccccatggcgcccagcttggtctgcgtgacgctactctcacacatgggggtcaccgtcgagtcttcccttggctcgctcctccataacttgctcctgcgcgctctgctcgtcctatggcgctcggcatccagttttctgcgcgccgactccttgttcccatcctgtgtgcactacaagtttctttctccaatcatcgcgcagctccctcgagctctgtccatgccgtccctcgagctctgtccatgccgcgtcgtcgttcgtcgtcacgtcgttcgccatcaagcctcactgtcattcctgttgtgcctcgcttcggatgtgttcgattaaatgtcggatcaagaatccaagatgtcgctcctnctcgct

SEQ ID NO: 35575 - DNA, 428 bp, Zea mays
  Clone ID: LIB3060-016-Q1-K1-D5
aacacacacagagagaggacaactcctcacaactctcccttccctcctgtaggggccaaaagggttagagagtaagagaagtagttcattcccttgcccaacacaagaaaacaagctctcctcatcaccctaatccaagcaactgcttgtgtgttgggaaattcttgtgacccctgttatattattatccgtgtagctactagcttcattcccccctttgtacccatcaaatggctggcatgtctctgcaacacccctgggcgtttgctttcggtctactaggtaacgtcatctcattcatgaccttcctggccccgataccgacgttctaccgcatctacaagagcaagtcgacggaaggcttccagtcggttccctacgtggttgcgctgttcagcgccatgctgtggatcttctacgcactgatc

SEQ ID NO: 35576 - DNA, 323 bp, Zea mays
  Clone ID: LIB3060-016-Q1-K1-D6
atccacgcgttcacacaactccacatcacacatttcacatttctgtaacatcatcaactgccagggacttggtctacttcttccttactacctgcataagttgatcctacacctatatattctgaagaagacatcgatattaccagcccgtggaagaccaatgttctacctggcctcaacaagatctttgacaaggatggcaacaacgctgcatctgcacgcttcttgaaacccttcaacaaagagcacattgacaaggagattgaagacaataagacatatctgcagcccaatgtcgtggaagcctactaaacatctactcc

SEQ ID NO: 35577 - DNA, 419 bp, Zea mays
  unsure at all n locations
  Clone ID: LIB3060-016-Q1-K1-D7
ctctggagacccgcacccggccggctcagctagtcagcatggcgggggagacggtgctggtcaccggcgccagcggcttcatcggctcgaccctcgtccgcctcctcctcggccgcggctacaacgtccacgccggcgtcctcaaccccgatgacggggcggagacggagcacctgctcgccatggccgctggcgctggcgctggcgagggccgcctccgcatcttccgtggcgacctccttgacggcgccgcgctgaccgacgccgcgcggggctgctcgggcgtcttccacctcgcgtcgccctgcaccgtcgaccccgtcagcgacccccagaagcaactgatagtgccggcagtggaagggacgctgaacgtgctgcgcgccgncaaggaggccggtagcgtgcggcgggtggtg

SEQ ID NO: 35578 - DNA, 429 bp, Zea mays
  Clone ID: LIB3060-016-Q1-K1-D8
gggcaaacctaggctgaagccacctttcccagccaatgctgggctctacggctgccccacaactgtgactaatgtagaaactgtggctgtatccccaacaattcttaggcgcggtccagaatggtttgcaagctttgggcgcaagaacaactctggaaccaagctctattgcatctcagggcatgtgaacaaaccttgcaccgtggaagaggaaatgagcatacctctgaaggagttgctcgagaggcactgtggaggtgtgagagggggatgggacaacctgcttgcggtaattcctggcggttcatctgttccccttttgccaaagcacatatgtgatgatgtgttgatggactatgatgcactgaaggctgtgcaatctggattgtgtaccgcagctgttatcgtgatggacaaatctacggatgt

SEQ ID NO: 35579 - DNA, 405 bp, Zea mays
  Clone ID: LIB3060-016-Q1-K1-E12
gtggggactggggaggctttaattttcttccgatcgatcatagtatccgctgcggtgtgactgcctgccccaccccattgcgcctgtgcctcgcttcatccggtgcgctgcccacctcacctcactcccgtcgtcctcttcctcgtcctcgctctcgtcgcggagcggtgtggaggcgcgcgctcctggaaggcacggggcaagagcggaggaagatcatctgggtgttggagtcatccagaggcacaagctgaggaatggggcaaaaggactccaagccttcacatggatatggctactcttcttatgattacgggagtgcttcatcgggatacacctcgagaaacactgggaattcgtcctccagttatagcgtcaggtacgcgccttcttcggagaacagtg

SEQ ID NO: 35580 - DNA, 429 bp, Zea mays
  Clone ID: LIB3060-016-Q1-K1-E2
gggcaaacctaggctgaaaccaccttttccagccaatgctgggctctactgatgccccacaactgtgactcatgtacaaactgtggctgtatccccaacaattcttatgctcggtccataatggcacgcaagctttcgacgccagagctactgtggaaccaagctctattgcatctaatggcatgttaacaaaccttgcaccgtagacgaggacatgagcatacctctgaaggagtagctcgacaggcactgctgaggtgtcagaggggcatgggacaacctgcttgcgcgaattactagccgatcatatgttgcccttttgtcaaaacacatatgagatgatgtgttgatggactatgatgcactgcatgctgtgcaatctggattgggctccgcagctgatatcctgatggacaaatctacggatgt

SEQ ID NO: 35581 - DNA, 426 bp, Zea mays
  Clone ID: LIB3060-016-Q1-K1-E3
gaagttggagctcagactgctgcaactctgacacagcaaacggaacaaatgaagaggataggcaatgagctagattctgtccacttttcactgaagaaggctagtcaaatggtgaaagagattggccgtcaggttgctactgacaaatgcattatggcgttcctgtttctgattgtctgtggtgtcattgcaataattgttgttaagattgtcaacccgcataacaagaacatcagagacattccgggcctagcacctcccgccatgaacaggaagctgctgtccatcgacgctgcacgactctgagcgttgtgaatggctgcctcccgcagcacagcgcaacgcagcgcgtcagagttctcttatgagccacgatacatggcttcgcgattcttttgtgcttgtagtttacgttcgcccattctt

SEQ ID NO: 35582 - DNA, 427 bp, Zea mays
  Clone ID: LIB3060-016-Q1-K1-B3
ctgtcgccagattcttttttacgagcgctcggctttctctgcctgagctccccaaccgggctcggatttatctgctgccggctgttcatatctacagctggaatgtttaccatcgttatcctctcagttcttcttctccgttatctctcccggtcggccaagcgcttgcgggatctttctcgctgcccagcttgctccagctcggtgccaagccgacggaaaaatcctgccgaccagccgccgttcggtggcatttattcctcagcccgtcgcgttcttcgctgtccccatgccgcaacttcactgtggggttgctcctgccgcgcccctgttccaattcctatggtggcgctcggtctgcagccgtgccgtgatttcttgctcggactgcgcccagctctgcccagcgccgcggttgccgagctcg

SEQ ID NO: 35583 - DNA, 421 bp, Zea mays
  Clone ID: LIB3060-016-Q1-K1-B4
tcccggacttcattgctgagcctgacgcttcagatggcacatagccaccgttggggcgatcatcgcactgagcaggcttccggggctgccacagccacatgaagactgatcgttaagtctctacgtactaaacgacgccctggtacttccaaccgataacgccaagcttgttcgacgtgaatgcctcctggtgaccgatcggctaattgttatacatactaccgatgtctagtgtgtacatgctgtcacagacgacatgctgaagcacattaactagatcaagatcatggacctgtcaagcgccgattacgccaagctcatggtggagatcatgatggaagccaacgatgctaggatgatctacatcgctctgatagtcatcaccgatgcacgaagctatggtcagcagatcataaccgtc

SEQ ID NO: 35584 - DNA, 430 bp, Zea mays
  Clone ID: LIB3060-016-Q1-K1-B5
cgcatcagatctagcgccgtctccttcatcccgctgtccggcgagctcctcagcacgggggataggaagaccaaggttatagtttgtgttgctgctgcacataagttactgtcaatgatggctatgattattcattctaaataaagaaaacgaaatgcaaggaggatagggattacctatgcaccaatgcatgaaagagatagaattataattgaatatctcaacacagatttggagggatgacacaacatgtataaacatgattataatgaaaagggcttgtttctttcacctaactaaacattttagagagtgtggtttacttcaggacactatccatatgtgtgttgaccaacaagtggccatgtttctaaatacaattgggcataaccttagaaataggtcgattggcacgaattttggtagatct

SEQ ID NO: 35585 - DNA, 218 bp, Zea mays
  Clone ID: LIB3060-016-Q1-K1-B6
aatttccggtctaagtctatccctagatgggcaccgtccatgtcgtccagacgtttcgcatccatactccttctgtccacctgggtgactgggcccttctacagtatatgcttcttacaactcacgcggcaccatacctgcgcatcgcacaagaaatccaattcgctcgcgcacaggaagactgctctcgagagccgcatgatcatcttctcccgaac

SEQ ID NO: 35586 - DNA, 385 bp, Zea mays
  Clone ID: LIB3060-016-Q1-K1-B7
cgcatcagatctagcgccgcctccttcatcccgctggccggcgagctcctcagcacgatggataagaagaccaaaggtataggttggggtggtgctggacataagttactggcaatgatggctatgaatattcattcttaaaaaaggaaaccaaatgcaagggggattgggattacctattcaccaatgcctgaaagagattgaattattattggatattttaacacaaaattggagggattacaccacctgtattaacctggatattatggaaagggcttggttcttttaacttacttaacattttaaagagtgggggttactttaagacacttttcatatgtgtgttgaccaacaagtgggcatgtttctaaataccattggg

SEQ ID NO: 35587 - DNA, 193 bp, Zea mays
  Clone ID: LIB3060-016-Q1-K1-B9
aagtcccagcgcgcggtgctccagtggcgtcttctccctgctgtgctcgccggagctgctccagctcgaccgctcggcttcccctagcctcttcccctgcgagctcgactcctgctcgcctatggagttcttccagctccctgctccggtgactagggctcggcgtccggctccctggatgcttgccctgctc

SEQ ID NO: 35588 - DNA, 434 bp, Zea mays
  Clone ID: LIB3060-016-Q1-K1-C1
cgcatcagatctagcgccgcctgcttcatcccgctggccggcgagctcctcagcacgatggataggaagaccaaggttatagtttgtgttgctgctgcacataagttactgtcaatgatggctatgattattcattctaaaaaaagaaaacgaaatgcaaggaggatagggattacctatgcaccaatgcatgaaagagatagaattataattgaatatctcaacacatatttggagggatgacacaacatgtataaacatgattataatgaaaaggtcttgtttctttcacctaactaaacattttacagagtgtggtttacttcaggacactatccatatgtgtgttgaccaacaagtggccatgtttctaaatacaattgggcataaccttataaatatgttgattggcacgaattttggtagatctgggg

SEQ ID NO: 35589 - DNA, 415 bp, Zea mays
  Clone ID: LIB3060-016-Q1-K1-C10
ctcagcgcatttctacaggcgatgtacctgaaacaatagaagggaaaaaggtcataacgcttgacatgggacttcttgttgctggcacaaagtaccgtggagaattcgaagaaagattaaagaagctgatggaggaaataaagcaaagtgatgagataatactctttattgatgaagttcacactctgataggagcaggagcagcggaaggtgctatagatgctgctaatatcttgaagcctgcgttggccagaggtgaattacagtgcattggagccactacactagatgaatataggaagcacattgagaaagacccagcacttgaacggaggtttcaacctgtgaaagtgccagaaccaacagtagatgaaaccattgaaatcctcagaggactgacggaacgatatgagat

SEQ ID NO: 35590 - DNA, 394 bp, Zea mays
  Clone ID: LIB3060-016-Q1-K1-C11
cgtcagcagcttctgcttgctctggggggaaggagagagagagagcgagagagatctagtacagaggctagctaggtggtcctcgaacgaagatgttggcggagttcagcgggcaggtggtggaggtgccggcggagctggtggcggctggcagccggacgccgtcacccaagacgaatgcgtcgcacctggtggggcgcttcctggccgcctccgagccggccgtgtccgtgcagctcggcgaccacggacacctcgcctactaccacaccaaccaggcgctccttcgtcccaggtcgttcgcggcgaaggacgaggtgttctgcctgttcgagggggtgctggacaacctgcgtcgtctgagccagcaggacgtgctgtcaagcaagggcgc

SEQ ID NO: 35591 - DNA, 424 bp, Zea mays
  Clone ID: LIB3060-016-Q1-K1-C2
attgaccttctttatgccagtgtctccctcttagtagtaccagctgacttggatatcgcccaaggatcagtgctttatgatgttgatgaagctactgtccgtagtcttaatgggtgcagagtagcagaccaaatcattagacttgttccaaattttgagaattttcgcacggcattaagatgtttgaagtactgggcaaaaaggagaggtgtttactctaatgttactggctttcttggtggtgtcaactgggctttactggttgcgcgtgtctgccagctctatcccaatgctgtgccaagtatgctggtctcacggttttttagagtttttacacaatggcagtggccaaacccggttatgctttgttctatagaagaggaagaacttggtttccctgtttgggatccacgcaaaaatcctc

SEQ ID NO: 35592 - DNA, 429 bp, Zea mays
  Clone ID: LIB3060-016-Q1-K1-C5
agaaccgagagcagagagacatggcgccccaccagcagcagcgggcgctgctcctgttcccactcgtcttcctcctcctcctccttgccccgcccctcgccggcgcgtggggaaaggagggccacatcatggtctgcaagatcgccgagaagtacctgtcggagaaggcggcggcggcggtgcaggcgctgctgccggagtcggcgggcggggagctgtcgacggtgtgcccgtgggcggaccaggtgagctggcactaccactgggccagcccgctccactacgccaacaccccccaagtctgcaacttcaagtattctggggactgccacaattctcgtggccagcaagggatgtgcgtcgtcggggctatcaacaactacacggaccagctctacagctacggccagaagacttcgtataacctga

SEQ ID NO: 35593 - DNA, 426 bp, Zea mays
  Clone ID: LIB3060-016-Q1-K1-C6
gtgacagtaaaacggagaccggctagtgttgttcctgaaacctgttgatttatggggagtcagacaatcgcatcacaggctgggggaggtggaagaggcatgggtagtagtggtggtgccggtgcagcgcaacgcgggcagatgcagagtctggcaagacaagggtctctgtataaccttacccttgatgaggtgcagagccatttgggagaacccctacacagcatgaaccttgaggagctgctgaagagtgtctttcctgatgacctggaccctgatggtggcactaccagccaatatgagcagagttcgggcctcttgcgacagggaagtatcacaatgccgcctgagctcagcaggagaactgtggacgaggtgtggaaggacatccaggatgcaccaaacagaaatgttggggagagtggt

SEQ ID NO: 35594 - DNA, 430 bp, Zea mays
  Clone ID: LIB3060-016-Q1-K1-C7
ctcaactattgggaagggtcaagaaaagcgaggaagcaacgagccaccttctccaactaacatagccagagcattctaccgtccgtcgtagcagcgatgatggctgtgacgtctctgcagttgcgcccaacccctcgtctccttccggcgagaaatagctccacgggcactgggccgcggatggccgccttgagctgcagacacaaccagtccaccaatgtccaaggacgaacagggctcagaagccacgtaacgacgcgcagagacgccctgtcattcgtgtcatccgcgctgctggcagcgttgttcgtggtggccggtgcagcagaagctagaacttcgaggttggagaacaaaaagaaagccctggagaagctccgggagaaggcgttgggccgaaaggaggagaacggagccaccggtggcaaga

SEQ ID NO: 35595 - DNA, 389 bp, Zea mays
  Clone ID: LIB3060-016-Q1-K1-B2
actgaccagagagtgctggtgctagatcgtagcctcaagcctgaatgaaccaatgcggcaacaggacaaagaaggagaagtgcgctacatggacagttaagaatgcgcattgacagcacgaaaggatcatcgttatccctatcgcaagcattacagccgaggagataccactgcccaggagaaggagcttgttcaggtcaagcgtgaggccctgttgaagggtgcgatatatgtgagcccagatgccaagcttacgttagtggttcgcatccgtggtatcaatgccattcaccccaagacccgcaagatcttgcagctactgcgattgaagcatatcttcaacggtgtcttcctcaacgctaacaaggcaaccattaacatgctgcgca

SEQ ID NO: 35596 - DNA, 215 bp, Zea mays
  Clone ID: LIB3060-016-Q1-K1-A1
gcaggcagaggcaagaggcccctcaccctcaggtgatcaggtcgctagctcccggctgtgactagtaggcagccatgaatttcggtgggaatggcaacgcgacgatccggtgcaagtactgcagggcgagcctgagcgtgatccccggcgagcgcgccatccagtgcgcgcaatgcaactgcgtgacccgcatccggcgggccgaccgcatcccg

SEQ ID NO: 35597 - DNA, 437 bp, Zea mays
  unsure at all n locations
  Clone ID: LIB3060-016-Q1-K1-A10
ggcgcggcgcagccagagtaagcagagagttgcactaccgtgcttcttcagttcttgtgcctagtatgcactcgcttgtgaggcgtggcaatggctacggctacggctatggtggttacggcagcagcaatccccatatgaactaccaccgccaaaacaccgagtccgtgaccaccgtcgtcacggagatgaaccgaatggccgtcgacgacaagccctgctacggcggcggcgtgcagaagcaggcctgcaaggtggaggcgttccaggagcacgacgaagcgtacaagggcgccgtggccgtgcagcagaagcactcctncttcaaggaggacaaggaggaggtgcgcggtgctgctgccgncgtcagaagctggcacgacgagttatacaaggaggaggaggaggagaagcgcgtcgtcgacacggagtacggt

SEQ ID NO: 35598 - DNA, 426 bp, Zea mays
  Clone ID: LIB3060-016-Q1-K1-A11
ctcacgccacatgagcagcacccgtagggagccgccacggtgaatgtctcctgccactggatcgtgacggctcatgaattacgtcagctaaagctgagacttacgaaggcagtgacattgggcacgaaggtccacgatgcaacctacggcgtcgaaaggcctacagtgactagactgtcgactacttgaagaagctgctcctaaatgtttacgcggctgtcgtacctttggcactattcttatatgtggatgacgtcacgggattcgaaatgacatatctatattgagatgacagagcctttcactatcatcttcacatggttcgtcatactgcctataatatacgggctcgcgcatgcgatcactactgtcatattgaacgacttactgaccttgaaggggccgagtacaaactgctggaatgaa

SEQ ID NO: 35599 - DNA, 438 bp, Zea mays
  Clone ID: LIB3060-016-Q1-K1-A12
gttgagtcaaaggcaaaagaagaagctggaagggttatgattcgcatgaaggacaggtgttcaatgctgttcagccgagatgctgactctatgcccagggtgtggacaggaaaggaggacataaaagctataactaaaaccgctcgctcagcttccatgaagttgctttctacaatggctgcaattcggttggaggaggatggtgataacattgagaacactctttccgttgctcttgttgacacctcaaaacctgggactactgataggagtatccaattgaccgatccacttgcctccagttcatgggaaagggttggcgaggagaagactttaattacccctgtgcagtgcataaatttgtggaggcaattcaaggctgaaactgaatatacagtgactcaagccttagctgctcaggaagcaaataagaggaac

SEQ ID NO: 35600 - DNA, 261 bp, Zea mays
  Clone ID: LIB3060-016-Q1-K1-A2
ctctcctaatcataagggcacactgggaggtccccgaaggactgatgcctggatggctcctgccggatcaacgaggtaatcgtacgttggatgacaccctacatttctactaccgacaagatcgccgacactatcctcgcattccacgtacgtacggagatatcttccatacgcatcttccgctacatcatatccatagacacgggaccctcgtacctgctcggcgagaagctgcttacagaaccagaccggtttcagcca

SEQ ID NO: 35601 - DNA, 427 bp, Zea mays
  Clone ID: LIB3060-016-Q1-K1-A3
ggatcccaagaagcagcctcgcgctcatggcctcaaggtctacccgctcgtcggtacgcggtcccgcacttcgtcaagaaccagcgccgcttcctccactggtccaccgacgtcctcaagcgcgacccctcgcacaccctgtcgttcaaggcgctcggcctcaccggcggcgtcatcacggctaacccggccaacgtcgagcacatcctcaagaccaacttcgccaactaccccaagggcgagctgacggtgtctatgatcgaggacttcctcgggcacggcatcttcaactccgacggggagcagtggctgtggcagcgcaaggccgccagctacgagttcagcaagcgctcgctcaggagcttcgtggtcgacgccgtccggttcgaggtcgtggagcggctgctgccgctgctcgaccgggcgc

SEQ ID NO: 35602 - DNA, 425 bp, Zea mays
  Clone ID: LIB3060-016-Q1-K1-A4
actgttcctctgggaaccggaaataacctgcccttttcatttggatggggaaagacgagtccttctactgaccaacaggctgtaaaatcattccttgggctagtaaagcatgcaaaagaaattaagattgatagttggcacatcattttgagaatgcgagttccagaggaaggtccatgtgatcctattgctccattagatttgcctcattcattgcatgcgttccatcgtgtctcaagtagtgattctctcaatatggaaggttaccacacattccgtgcaggattttggaattactttagtatggggatggatgcagaagtgtcttatgcatttcattctgaaaggaagaataatccagagaagttcaagagtcacctgacaaatcagggtacatacgctaagcttggacttaaacaaggatg

SEQ ID NO: 35603 - DNA, 367 bp, Zea mays
  unsure at all n locations
  Clone ID: LIB3060-016-Q1-K1-A5
gcaggcagaggcaagaggcccctcaccctcaggtgatcaggtcgctagctcccggcttaactagtaggcagccatgaatttcggtgggaatggcaacgcgacgatccggtgcaagtactgcagggcgagcctgagcgtgatccccggcgagcgcgccatccagtgcgcgcaatgcaactgcgtgacccgcatccggcgggccgaccgcatcccggttgccggttcgncgaatatgccaacggcgatccaacggtctctatgctcgaagacttccttggtcaccggattttcaaatgccacggggagcagtggctgtggcaacgcaagggcgccagctaccagttcagcaagcgctaggtcacgagct

SEQ ID NO: 35604 - DNA, 401 bp, Zea mays
  Clone ID: LIB3060-016-Q1-K1-A7
caacatcaaagaaaagaggtatattcatacccaactttggcaggtgcatcacatactaattcaccgtcacaagtgccaccaaacggtgcaaagatgatgtggcagatgccagttcctcctgtgtctacaacatacaggaaagctattggagagcataatgatacaaaccagtcctgcatgaagttccttagagaaggcagtgtgcagtcttctccaaatggatttctatcaagtgatgctgctccaagaaccagacaaggcacttttgaccttcaacttccagccgatcattatatagatgacgatgacacatcagataacaagcccatagatttccttggtttggcatcagatgcaaaaccccagaatgatgctgagcttacattagttagtgcagaacg

SEQ ID NO: 35605 - DNA, 418 bp, Zea mays
  Clone ID: LIB3060-016-Q1-K1-A8
actgttcctctgggaaccggaaataacctccccttttcatttggatggggaaagaagaatccttctactgaccaagaggctgtaaaatcattcctcgggctagtaaagcatgcaaaagaaattaagattgatagttggcacatcattttgagaatgcgagttccagaggaaggtccatgtgatcctattgctccattagatttgcctcattcattgcatgcgttccatcgtgtctcaagtagtgattctctcaatatggaaggttaccacacattccgtggaggattttggaattactttagtatggggatggatgcagaagtgtcttatgcatttcattctgaaaggaagaagaatccagagaagttcaagaatcagctgacaaatcagggtacatacgctaagcttggacttaaac

SEQ ID NO: 35606 - DNA, 417 bp, Zea mays
  unsure at all n locations
  Clone ID: LIB3060-016-Q1-K1-A9
cacgcccgcgcccactcacgcccggccctgccccgcgccctcatcgtctcctcccggggtcccctcaaagcccaccgccgctgcccccacgccacccaccccaccccgcccccgcccctaccgcgcggtgcccgagacccagaggccagacccctttcttcaccttccttcccatcgcaatcgcaagcccccggctccggcgctcggcggtcggccaggttcgggagatcacttcgtcgcggcgaggagggagggggtcgccgttagcgcgcggcacttggatgagaagggcagcggtggaggaggatgcggaaggcgtacagggactccatcaaggtgctcgaagctgacatccagcacgccaacaccctggcctncgagtttccccgggactatgatggtgcgtgcctgcagatg

SEQ ID NO: 35607 - DNA, 438 bp, Zea mays
  Clone ID: LIB3060-016-Q1-K1-B10
aagtcccagcgcgcggtgctccagtggcgtcttctccctgctgtgctcgccggaggtcgtccagctcgaccgctcggcttcccctagcctcttcccctgcgagctcgactcctgctcgcctatggagttcttccagctccctgctccggtgactagggctcggcgtccggctccctggatgcttgccctgctcgccgccatcctgctcggccagcgcagtcccttctctgctctctctctctattccctgctcattggcagccgactccctctacctcccatggacgccagccgcgcccctggttcctgcctctgcttctgctcggaattcccatggccagagctttcccctagcccggatctcacccagtcgcccagcttggctctatccatactccagctccccctctgtttgttctcgctactgggtcgggtctg

SEQ ID NO: 35608 - DNA, 429 bp, Zea mays
  Clone ID: LIB3060-016-Q1-K1-B11
gaggctgagagctcgccttgcatgcacgcgcacacctctgcttgggtgtacgtggacagcggcagcagcggactaagagctccatgcatctgtctcctaggtgtagagatcctgctcattgtacggtagctgccaccgtctcatcgtcaaccatgtctgctgcttacaccgtggatcctcatactcatcctgctcatcaacagcagcagtgcagcaataaagtgtcgtccatggaaatggagatccccggcgaccttatcatccggatcggcgagtccgttttccctctacacaaagcggtgatggtgcccaagtgcggctacatccgccgtgccgtcgaggcggctgcggcagcggtggcggccaagcccagcagcaagggcggcgccgacgccgaccccgaccccgatccggcgggcaccgtctagc

SEQ ID NO: 35609 - DNA, 437 bp, Zea mays
  Clone ID: LIB3060-016-Q1-K1-B12
aactttgaggccttgtcgaaattaatggttaaggacttggtgtttcctgttaacgtgcatcttggccagcacttcactaaaccaccaccacgatattctgagggtgcattgattaaaaagctagaagaacttggaattggaaggccatctacttatgcatctataatgaaagtgttactggatcggaagtacgtgacagcaaaaagtcgagttctacaccctgagttccgtggtcgaatggtctcggcattccttttgcaccatttctctgaggtttctgattacaactttacagctaacatggagacagagctagataatgtctctgctgggtcaactgaatggaagggtcttctgaaagactactgggaacgattcagcaaatattgtgcagatgtgagtaaactggatggcagaaaggtagagagaatgcttga

SEQ ID NO: 35610 - DNA, 442 bp, Zea mays
  Clone ID: LIB3060-015-Q1-K1-H9
ggacaggcagtggcaagtcaactttaatccaagctttgttcaggctcgtagaaccttcgtagggaaaaatgatcattgatggaatagacatatgcacactcggtctgcatgatctcagatctcgctttggcataattccacaggaaccagttctctttgaaggaacaattcgaagcatcattgatccaattgggcagttttcatattcttaattattgtttgtctttgatcgttttcttcttttatttttattatttttattttcttgtatttttttttttatttatctttttttttttttttatttttgttattccatttatttttttttttttttattttatttttttattatttttttatttttgttttttttatttttttatttttctttttttttttttatattttttttttttattttttcttttatttttttttt

SEQ ID NO: 35611 - DNA, 180 bp, Zea mays
  Clone ID: LIB3060-050-Q1-K1-A9
ttccagttgttaaatcacctctatggccttgattcaagaggacatcttaaagttattctatcaacaaatcttatttacagtcttgatccatccttgcttctcccatctctaattgacagaaagattgaattccctttacctcatgtcaatactattccactcatcttccatatacacaca

SEQ ID NO: 35612 - DNA, 437 bp, Zea mays
  Clone ID: LIB3060-050-Q1-K1-B1
attttgacaactttccataattcactatcaactgcttctaaaggaagttgaaatgcatgtgtcatggtaatgctgataacaatttggttgtttggaaataagaaattgaagtaccatattcgtagcaatttatatttcgtcgcactattttcttcattattgatgatgatggtgctgtacagttactatgaacaactacacagggtggtcacagatgaatttaaggacatcggatatgatctgtacaaaaagactcttttgagttaatgccatagcccgtagtgcaattaggtgtacctgatcgatatctgctgcaatgcacatcaaactgcaatgtgtggtacaggcctaagcatgggcagttaattcaagatttttaagatcaggacgaactaatacagatgcatgtgtgagaagtttcttggagaaattaaaat

SEQ ID NO: 35613 - DNA, 178 bp, Zea mays
  Clone ID: LIB3060-050-Q1-K1-B12
aaccgcacaccgcagcggcaagaaaccaccgatagcccaaccgcacaagcgggacagagagcagagatccagggacatccgccgggccccccgaagcaaccacgcaccccacggccgatctcgcctggcaccccgccgacgccgcctaaagctccctatgcccactcccccgcacaca

SEQ ID NO: 35614 - DNA, 240 bp, Zea mays
  Clone ID: LIB3060-050-Q1-K1-B3
cgcgcacgcacgcaacgcacacactcaacttcaacagctaatcctctcccacaagacaggacatggctggggaggaggccaagaaggtggaggtggaggtcaccaaggagcccgaggcggcggctaaggaggacgtagccgatgacaaggccgtcatcccctctaccgacccgcctccgtcgccgccgtcggccgacgactccaaggccctggccattgtctagaaagttgcatatgatc

SEQ ID NO: 35615 - DNA, 423 bp, Zea mays
  Clone ID: LIB3060-050-Q1-K1-B6
cgagcgagcttgaccgcggggtgaacgtttaccagcacagcaagataaccaaggaccaggtcgagaatagggtttatgtcatgaccgtccagcaggcctttgacgacgcctttctcgatgcgaaggatcacaggtgatcggcgcgaggcttcggacctgccgattttgacgtttttattgcggcggagcgatgacactggcatctatagcggcgcgtcgtttggatgctgacgatctgcgatgtgtcaaaagcgcaccggctgtgctcttctgtgctgcctacaaggcaatgcttatgccgtccctgctaccaaaaagtacacatgtgtaacaagcttgctagtcggcatgtgagagttgtacttgcagaccctaatatacttgttctttttgatatatgtgataattcacccgttttttttt

SEQ ID NO: 35616 - DNA, 429 bp, Zea mays
  Clone ID: LIB3060-050-Q1-K1-B7
gtgtcacctctttttcagctgttgtttttggaaaattgaatatccgtgccgataaagggcttggcctggcaaaattcttccttggtattgggctcccaggtagcgcaaaggattgctttaatcagattgagtctttgtcattcttggagaacaatagggtcttcgttccgttgatactatcactttcttccaaagtattttcattgacttctaaagatcagctcaaggtttaagttacttcagtttttggatcttcttttcttttacttatatttattttttttcattttttggtatctttctttatattcttttatttatatttttctttatatttttttttattttttattacttttattttttacttttttttttttcttattttttatttttttttttttttttattttttttatttttttttat

SEQ ID NO: 35617 - DNA, 51 bp, Zea mays
  Clone ID: LIB3060-050-Q1-K1-B8
cttgtacttcttcagctttgtccttgattttgtggatggttggtttgcacg

SEQ ID NO: 35618 - DNA, 171 bp, Zea mays
  Clone ID: LIB3060-050-Q1-K1-B9
aaaaacacaccaacaaaaacaaactccaccttccacttccccaacttctactcctccacatcctcctctgaccttgccaccatcacatcaccgcctcaacaatccaatgtccccgatgaggcgctgaatgtttcgaaccaactgcctcgcataacatcaatagaacgggac

SEQ ID NO: 35619 - DNA, 229 bp, Zea mays
  Clone ID: LIB3060-050-Q1-K1-C1
taccgcttcacccacgcgtccgagagcataagaggagagaccgcactacttacctcacgccttaagttcagatctaagccttctcgttctggcccaatgacaacgataaacatctaagaaccaaacaaaaacagagcacgaccatcggtctctaagcaaaacgcgcagcacgccgggcgctccacgcacgtaggctagcatagcgcgcatggtgcttctggaccagctt

SEQ ID NO: 35620 - DNA, 424 bp, Zea mays
  Clone ID: LIB3060-050-Q1-K1-C3
ccagctaagaacaggtcttcgtctcaattatggaaggcaaaacagggcagctcaggtgctgtttcgtcggcatcgtgctcgtcctgggtcttgtccttgagcagtcccagcaggctgaagctagaggcaaatggtgctgcgaaaccgccaccggaaaataccattttaatcgctgcgttgactcgggttgggtcgacaatattgggttctgtgcgagtaatgccggttgcatcattatggaggacagatgtggaggtcgttggccagtgcctgcttgtgattctctttttctgtatgatattgttttatttttatcaagtacttttattttattaatttgtttttatattctttatttttaattatttttttttttttatcttttatttttttatttttttttttgttttctttatattttttt

SEQ ID NO: 35621 - DNA, 419 bp, Zea mays
  Clone ID: LIB3060-050-Q1-K1-C4
agatgctgttaacattcatgttgattttttgaaggagtacaagcaggattttgaactggatctttacccagatagcgcgactacttttcctgcaacccttgctgaacttacggagagattgaaacactggaagaacattcttcagagtaatgtataggatcgtttcccagcaatatttatactgtttgatgattgtttatctctttttgacttataatttttcttattttttattatttatttattttttaatatttaattttttttttttattatttttttttattttttatttttatttttatttatttttatttatttttttatttttttatttattatttttttttttttttttttttattttatttttttttttttttttattatattttatcattttttttttatatattatt

SEQ ID NO: 35622 - DNA, 379 bp, Zea mays
  Clone ID: LIB3060-050-Q1-K1-C6
gcgtccggagcaccatcgacatggacagcacgattctacaccgaacacatccgctacctattaccaggacatcatgaggaggaactaaccccatcatggatactctgcacaatgccaaaacaaaacgctcatcgtcaactgttccttctctaacaccactaacctagtcttacccatgctctaactttccactgatgctgatgctattacgtgcacctgatctctaccttcttataactctaactaactattctatacttcttatcgagaatgttcacttgagctaacatatatcttacaactatccataattcataatattttaaagttactcctactaaccacttctctaaccactcaactcaatctactgtaaaac

SEQ ID NO: 35623 - DNA, 135 bp, Zea mays
  unsure at all n locations
  Clone ID: LIB3060-050-Q1-K1-C9
cgtgaaaaaaaaggcggcttagagcataangtttaaaaaaaaaacacacacgcacacacaaagggcacttttcaaatcgacaaaggcgaaaggttcgcttcttgtggcatctcgctttccttcgagtgccatggc

SEQ ID NO: 35624 - DNA, 340 bp, Zea mays
  Clone ID: LIB3060-050-Q1-K1-A4
cgtctgtgttcttgttcgtacgcgtacttagcccctatcctaattgtcctcctttcagtcctttccgatccctcactcgccttccctcgcttcaagatgcatatctttgtgaagaccctcaccggcaagactatcaccctcgaggtggagtcttctgacaccattgacaatgtcaaggctaagatccaggacaaggagggcatccttcctgaccagcatcgccttatcttctccttctagcatcttgaggacagtcgtacacttgctttactactacatcctgatcgattcatcccttcattttttgcttttccttatagtttgcattcatatctttttt

SEQ ID NO: 35625 - DNA, 250 bp, Zea mays
  Clone ID: LIB3060-050-Q1-K1-D3
aaatttacaattccctcaatatatatactaatactttcattcactttcctaaaattccctatacatttaattctccaacaatatatcattctttcaactataatattctttttccacatacaaatccattcctcaatcacaacattcctcatattgttatctacacatacatctctttatactccttatacatctaattatcataataatattcttaaataataaaatccaattatgaataataaaacaa

SEQ ID NO: 35626 - DNA, 450 bp, Zea mays
  unsure at all n locations
  Clone ID: LIB3060-049-Q1-K1-G7
cgcttctctcgctagcgggttcggcagtagaaaccctaaaaaaaaagacaccgccctcgccttcgctagcggaaccgccctcccctcgccggggtaggggtttcgggggtagacgcccgccatggacgcgttccggaaacagctggacgtgctcatgggcgccaaccgcaacggcgacgtcgaggaagtgagccgcaactactacgaccgcgacgtctgccgcctcttcctcgccggtctctgcccacacgacctctttcagctcacgaaaatggatctcggtccttgttctaagattcattctcttcaactgcggaaagattatgaagaagcgaaagcaaagggaacagannattttgatagagaactcgaggatatgatagaaaggctcattggtgagtgtgacagggaaaattcagagggcccctaaacggcttgcagatgatgatg

SEQ ID NO: 35627 - DNA, 249 bp, Zea mays
  unsure at all n locations
  Clone ID: LIB3060-049-Q1-K1-G8
agggcctcctgtatcctctcacttccctcagtcctcgtccgtctgctccctcctctctgtacctagctctagctaggccttctgtagcgcggcagagatggctgcccctgccttcaccacggcggcggcggcggcagcgctgctgctgctgctcctnctgtcgctcgccgcggcggcggacatgtcgatcgtgtcctacggggagcgcagcgacgaggaggcgcggcggatgtacgcggaatggatggc

SEQ ID NO: 35628 - DNA, 433 bp, Zea mays
  Clone ID: LIB3060-049-Q1-K1-H1
cgctgttttgggctgctggttgtacacacttatgatgcttgactgttgtcagctagtggggcacttgttaccatttgagcatgtattatcaagcagtatttgatctgtatgactgtattgtgtttattttctgacttatgttttttcctgtcatgttatgaatgcaaaggaagaatctgatatggaaacgcattgacaggctggatgtccatgtacatgtatcttcatccatattcttgtgaagcttgaactgcgtggtatctgagttagagcttgcatatacaagttacctcttgtgatgcatgtaattgaatttgcatctgtttctgtatttgcaggattgttccttccgaagggggtgcacaatgtttaggaattgttattatggtttactgtaatgcaactctaaatcactatcgtaatctgatctact

SEQ ID NO: 35629 - DNA, 300 bp, Zea mays
  Clone ID: LIB3060-049-Q1-K1-H10
ccggaaaagttgggctgcttcatctagaaggtttacaaaagaaattcttgttaatgcttagagaggcgttgatgctgttggtgctttcaatgtgtataaccttgagggaattgaagctgttgttgcagcagcagaggctgaaaagagtcctgctattcttcagattcatccgagtgctctaaagcaaggtggagtcccactggtagcatgttgcattgctgctgcagaacaatccattgtgcctatcagtgtccactatgaccacggcatttccaaatcagactttcttcaagctcttta

SEQ ID NO: 35630 - DNA, 368 bp, Zea mays
  unsure at all n locations
  Clone ID: LIB3060-049-Q1-K1-H2
acgcgtncgcgacggcgtgcccgtctccccgagctcattcgccatgcctggctcagcctccgcgagaggaggacgagggctcctcttgccggcggctgctgaggcggttgtggtgctaatattgggtgcagtggcgccagcggcgggttgttatccgcgcgtgttcagcttcggggactcgctggccgacacggggaactacccgttcgtctacggcaacgactctgggtctggcggngccgcgctccggccaccctacggcgagaccttcttccaccgcgccaccgggcgcgcctccaatgggcgcctcgtggtcgacttcatcgcggacaccctgggcctcccgttcgtgcgaccgtatctgagcg

SEQ ID NO: 35631 - DNA, 439 bp, Zea mays
  Clone ID: LIB3060-049-Q1-K1-H6
ggaaagtgttcaattagaacatgaaaacgtgactcaattggtcttagttagtcttcgggacggagtggaagaagggcggagactctcgaacgaggaaaaggatcccttcgaaagaattgaacgaggagccgtatgaggtgaaaatctcatgtacggttctgtagagggacagtaaggatgacttatctgtcgacttttccactatcaaccccaaaaaacccaactctgccttacgtaaagttgccagagtacgattaacctctggatttgaaatcactgcttatatacctggtattggccataatttacaagaacattctgtagtattagtaagaggaggaagggttaaggatttacccggtgtgagatatcgcattattcgaggaaccctagatgctgtcgcagtaaagaatcgtcaaacagggcgttctaaatatgg

SEQ ID NO: 35632 - DNA, 434 bp, Zea mays
  Clone ID: LIB3060-049-Q1-K1-H8
ggaacaagggcctcctgtctgctctcacttcctcagtcctccgccgtctctgctccgggccctcctctctctacctagctagctagccagccttcctgtagcgcggcagatatggctgcctccaccacggcggcggcggcggcgtcgctgctgctgctgctgctcgtgtcgctcgccgcggcggcggacatgtcgatcgtgtcctactgggagcgcagcgacgaggaggcgcggcggatgtacgcggagtggatggcggcgcacggccggacctacaacgcctacggcgaggaggagcggcggtaccaggtgttccgggacaacctccgatacatcgacgcgcacaacgccgtcgccgacgcgggcgtccactccttccgcctcggcctcaaccgcttcgccgacctaaccaacgacgagtaccgcgccaccta

SEQ ID NO: 35633 - DNA, 438 bp, Zea mays
  Clone ID: LIB3060-049-Q1-K1-H9
cccacgcgtccggaaaagttgggcttccccatctagaagttctacaaaagaaattcttgttaatgcggagaagggcggttatgctgttggtgctttcaatgtgtataaccttgagggaattgaagctgttgttgcagcagcagaggctgaaaagagtcctgctattcttcagattcatccgagtgctctaaagcaaggtggagtcccactggtagcatgttgcattgctgctgcagaacaatccagtgtgcctatcagtgtccactatgaccacggcatttccaagtcagacttgcttcaagctcttgaagcgggatttgattcagtcatggtggatggttctcatctaactttaggggataacatcttatacacaaagagcatatcttccttggctcatgcaaaaggtttacttgtggaagctgagttgggtaggct

SEQ ID NO: 35634 - DNA, 441 bp, Zea mays
  Clone ID: LIB3060-050-Q1-K1-A1
ggaattaccggccggacccacgcctcctatcgcatgccaatggaacctttcgagcttcaagatgtggctgggtatggagtggctggggcagtaaaagggatctacgctgatgcctttggagaaagaaatttgggctctaaccttgtgggcctgatggtaaaggatggactacaaggaaaggtgaatgccaaaggttactacatttatgagaagggtgcgaagccaaagccagaccctagtgttaagcatgtgatcgaggagtaccgaaagcaggcaaacacaatgcctggtggaaagcctgttactttaatggatcaagatattttggagatgattttcttcccagttgtgaatgaggcatgcagggttatggatgaaaatgttgaaattcgagctttccaacttgatattcttcctgtctttgaatgggcttttccaaaa

SEQ ID NO: 35635 - DNA, 370 bp, Zea mays
  Clone ID: LIB3060-050-Q1-K1-A10
ctcgacgatggctgggcgaccgccgccttcctacgccaggtatccggcgcttcaaggcggcaggcccttcgccggcgaagagcacccatcagattcccgagttgtttatcccagttatcttgcacccgagggctccgtagcatcttattatgcttcaagacctgttctacctgttggatcagatgttcttagaaacgatgtaatttctcaaccaagaacgcatggttatgatggtccagcaagagtgaccaatcctgctttggctggcctgactggactacctgctggagttacggcacggtggcctagtgctctggaagacccgtctttggctggtctgagtggattaactccagtccggtcaacatgc

SEQ ID NO: 35636 - DNA, 287 bp, Zea mays
  Clone ID: LIB3060-050-Q1-K1-A3
gcgtccgcagagaatagaggaggagatggccatgctcaccttacgccttgctcctgacctgccgcgcgtatcccgccgctgcttcgggacaatgacgatgggagagcagagcggggcggcgtgctcgctccgcctcctcgacgccgcctacgacgccggcgtcaacttcttcgactccgcagagatgtaggctcacctgctccctcatctccctgcctcggttcgagagtaatgaaaggaaaggtgtctggaactctggatgcacatttgcaaacatgtttactcgt

SEQ ID NO: 35637 - DNA, 436 bp, Zea mays
  Clone ID: LIB3060-049-Q1-K1-E7
gacaacccaacccgaccccaagttcccaacgcagaggatcgggctgaatcctccgcaggtcgccgccgccgggaccgaccgacccgatcctatcgatcgaggatgtcgtacgcctacctcttcaagtacatcatcatcggcgacacaggcgtggggaagtcgtgcctgctgctgcagttcacggacaagcgcttccagcccgtgcacgacctcaccatcggcgtcgaattcggcgcccgcatgatcaccattgaaaataagcccatcaagctccagatttgggacacggctggccaagaatcattcagatctattactagatcatactacagaggcgctgctggtgcccttttggtttatgatattactaggagggagaccttcaaccatctcgcaagttggttagaagatgcaaggcagcatgcaaatgctaaca

SEQ ID NO: 35638 - DNA, 393 bp, Zea mays
  unsure at all n locations
  Clone ID: LIB3060-049-Q1-K1-E8
gcgcgccgctgctgagcgacgagcagatcgccgacaacgtcatcggcgtgctgttcgcggcgcangacacgacggccagcgcgctcacctggatcgtcaagtacctccacgaccaccccaagctcctcgaggccgtccgggcggagcaggcggcggtccgcgaggccaccggcggcgggaggcagccgctggcgtgggcgcacacgaagagcatggcgctaacgcatagggtgattttggagagcttaaggatggcgagcatcatctcgttcacgttcagggaggccgtggccgacgtggagtacaaagggttccttatccccaaaggggtggaaggtgatgcctctcttcaggaacatccaccacagccctgactacttcccagatccacac

SEQ ID NO: 35639 - DNA, 290 bp, Zea mays
  Clone ID: LIB3060-049-Q1-K1-F1
gctggtcgggacctcacagactccctcatgaaaattctcactgataggggttattcctgcacaacctctgccgagcgagaaattgtgagggacatcaaggagaagcttgcatatatagctcttgactatgagcaagagttggagactgccaagaacagctcctcagttgaaaagagctatgagctgcctgatggccaagtaatcaccatcggcgcagagagattcaagtgccccgaggtcctcttccagccatccatgattggtatggaggctgctggaatccatgagac

SEQ ID NO: 35640 - DNA, 312 bp, Zea mays
  Clone ID: LIB3060-049-Q1-K1-F3
atgtttccacgcactcagcttttacctatcctttatacttgccatgattctctcgtttatctacaaactactatctttatctctacatccagacctatacgctttctattttaattcaacatattgatcattccctcccttatcctgtctatcattctctataatatatcctattaaatacccttttattttattcactttccaattacctttgtggttcaaccataaataatcaaaaactaacctctattactactatttaaactccacttactttttcctatatcttaatcaacaattcctccctcttta

SEQ ID NO: 35641 - DNA, 180 bp, Zea mays
  unsure at all n locations
  Clone ID: LIB3060-049-Q1-K1-F6
cacattggacttgcactggtgcttgctcataattactagttcatcaacaaaccaacagagcatggccaccgaggcgagcgtgccctcctagctctggccatggcagccatcgtcgtggcgccgtgcacggcccagaactcgccgcangactacgtggacccgcacaacgcggcgcgcgcc

SEQ ID NO: 35642 - DNA, 269 bp, Zea mays
  unsure at all n locations
  Clone ID: LIB3060-049-Q1-K1-F7
acctttaactgatcnatggccttccattctctcctctccgtccttcatcttctgttccaccccctacatacttccgtctctataccgtccaccactaatgctcccttacttcacataaccatctccatccctccatccaatcaaagttcctacattcaactttttttctccttcaaactatccctctattacctcaactgcacactgcccttctactattacttctacccacattacctttcatacccatattactcctattacttcat

SEQ ID NO: 35643 - DNA, 408 bp, Zea mays
  unsure at all n locations
  Clone ID: LIB3060-049-Q1-K1-G3
ccctgcgtgctccatcgcgccgccacccagagtccttccccagcgccgccctctccctgtcggcgccctgctggccggcgctccctccagcccctccccatggccgagcgcatctccatggtggtcaggagcttgtcccatggctgagctccctctccatggtcgcgctcctcccctgctccatccatggctgccgtcgagtctccctggacgggctcaagtgccatacgccgtcggctctagtctccagctcgcctaggtcggtgttcctctccctctcctaatctccatggccgctggcgctcttgctcgggtccatggtcgcgactcgagtcacccctttgtgctggccgaccatccagccatggtggcgcgcacccttgcttnctacttcactcggcgccccct

SEQ ID NO: 35644 - DNA, 287 bp, Zea mays
  Clone ID: LIB3060-049-Q1-K1-E3
cccacgcgtccggcaaggcgagtagagcagtatgtcagtaatacagcatctatggcatgtgcttttgctcgtcgagttcatgagccccgttgtgtatttggtttccgttttcttggttggagtttttagttccaaggtccgatcatgttttgatcccataaattctcttccagccttcgagcaactgagtccatcttcctaagtcatcagccccagcgagacattgaagcatggggaaacttaaacagtatggtgatgattaatctcaacattttttttcttgcagc

SEQ ID NO: 35645 - DNA, 371 bp, Zea mays
  Clone ID: LIB3060-015-Q1-K1-G10
gggcgccctttttttttttttttaactttaattccagaacctctgttggagtgcaatgaaggctctcacccaaaaagtctgtgacgaccagcaacgagatctcaaaatgcgcactgttactgatcagacacaactggagcacgacaacaagaatgcttggagcttctgcctgatgggctatagtctacgttcaagtggaagcagcatcctgcgtgtcccctggttttcctggagctgcctcgcggatgatcctgagggactcggcgaagtcgtccaggagctgacggccatccggaaactgcgcttcgtctaccgacaggactagctttacggagtttatgtagctctggtagtgcacagtcaaggcatgt

SEQ ID NO: 35646 - DNA, 436 bp, Zea mays
  unsure at all n locations
  Clone ID: LIB3060-015-Q1-K1-G12
ctccggcccaaaccccccgcacccaacccccagccccggcaaccgatggcggggtccgcggccgacgcggagcaggagcaaaagcgggcagcggcggcggcgtacgactacgagggcgacgcgcgctgggccgagtactggtccaacgtactcgtcccgccgaacctcgcctcccgccccgacgtcgtcgaccacttgaagcgcaagttctaccagcgctacatcgaccatgatctggtcgttgagccaaggtcattcaccagttccactcaggccagcaggccagatgtaaggtcttcgtcttcgtcatccaccgagaacgtcagggagcgtaattcaggatctactgcaaggtcagcgcctncaccaccggcaccaacacatacagacagtgccgtcaaccctttacggttcgacgcacgcactatacatttct

SEQ ID NO: 35647 - DNA, 392 bp, Zea mays
  Clone ID: LIB3060-015-Q1-K1-G4
gttcgagcggcccgaggagttcgtgccggaacgcttcctcggcgacgagggcgccaggctgctgcagcacctcttctggtccaacgggccggagacggcgcagcccgggcccgggaacaagcagtgcgccgccaaggaggtggtggtggacacggcgtgcatgctgctggccgagctgttccggcgctacgacgacttcgaggtggagggcaccttcttcaccaagctcgtcaagcgccaggcgtcgccgagcgtggcgcaggcagccgccgccgtcggagcgcatcagtgagtgcgctgtataggatcatcggtggcgtgcgacgtcgtcggcgccggccaagcaataaagtgaaatgagttcacatgctcgtctgtgttcgacttcgatc

SEQ ID NO: 35648 - DNA, 393 bp, Zea mays
  Clone ID: LIB3060-015-Q1-K1-G5
gacataattaccctcacgcgaagaacccctaccttggctagtcctcctacgtatacgtctcttctcttcgcttaatcttggtcggtgatttgattctgcacttcttgggcgcattgcagagggtgctcggtctgcagctatcttaggttaaccagtcgtgtgtggtctatcggtttcgatatagtactactgctctgttataatcagcggggaggaggaagatgacggtgacgccacggatcacggtgagcgacgggcggctgacggtgcgcggccgtacggtgctcaccggcgtgccggacaacgtgtcggcggcgcacgcggccggggcggggctcgtcgacggggccttcgtcggcgcccacgccggcgaggccaagagccaccacgtct

SEQ ID NO: 35649 - DNA, 336 bp, Zea mays
  Clone ID: LIB3060-015-Q1-K1-G6
gggcgagctgcccatatagttcactcttggaacgcttacttagcgtactagagctcagggcattgtgatggagggtctcacgggctcactctaagaccgccttaacaagagcagcacgcgggggttcctcgcctacaccagcgtcggggctgactgcgcggctgtcctagcctgctacgtgctctctgtcgcagactcgccagcatctgcggcacgcaacgatggcgcgcgcctactgctgtcctcgcgctcaccgcgcgtatgacccgaccttacgttcaacaggcgggtgatggtcgtcaacgtcatcaggttcctctggatcacgtttggcac

SEQ ID NO: 35650 - DNA, 289 bp, Zea mays
  Clone ID: LIB3060-015-Q1-K1-G7
gtccgtcgtagccccacatcgtataatttttaacttggctagtcctgatactcgtacagttactagtgacacttgatcgcaggacaacaacaagataatgagctaccatctatccttcgcatctgtgtgcctgcatctgctgctgtcagcaacgctctcttcagtcatgactcatcctcgttttatctgtcaatggattatgtatattaacatgcataactagtacacgcctacccctgggatcaagaatggcgaataataccaacggaggcacctccttgtcgtggtc

SEQ ID NO: 35651 - DNA, 411 bp, Zea mays
  Clone ID: LIB3060-015-Q1-K1-H1
cttggccgcaacgtgaagtgcagcagcagccagcagcgggggctggagcactcaccactcagcagcgatcgcagcaccgcggcgagataatgagcagcagcctgtcctccggcatctctgcctcgccatctgcagcggccagcaccgctcggcgccgccatgacgcagcgccgcagcagctgacgagggtgaaggcggcggcgcggccacagctgctgcacgccggccgccggcgttcgagtgtcgggaggaggccgggcggcggcgcggtggtggtgagggccgggcctgggccactgtcggagatcgagccggacctggaggaggacgccatcgacgtgtaccgcaccaacggcatcagcccggaggacttcgagtacgggaagtatgacggacaccacacctatttcg

SEQ ID NO: 35652 - DNA, 153 bp, Zea mays
  Clone ID: LIB3060-015-Q1-K1-H10
cccactcattctttgctttcttctctaactcttcctcttttctatctcagtcattactaatagtacacactgatacaactaatattacatccattccatattacttaaatactctcatcttatttcataactctttattatacactcatattt

SEQ ID NO: 35653 - DNA, 410 bp, Zea mays
  Clone ID: LIB3060-015-Q1-K1-H12
gcgagactcttcgcctctaccctgccacgccgatgctgctgccgcacgaggcgtccaccgactgcaagatccacgggtacgacgtcccggcggggtcgatggtcctcgtcaatgcgtacgccattcaccgggacccggcgatgtgggaggacccggaggagttcaggccggagcggttcgagctcggcagggcagaggggaagttcatgatgccgtttgggatggggaggcgcaggtgccccggcgagaacctcgcgatgcgaaccatggggctggtcctgggggcgctgctccaatgcttcgattggaccagggttggggatagagaaattgacatggcaacagccactggcaccatcatgtctaaggctgtcccactcgaagctcagtgcaagccgcgagcgaacatg

SEQ ID NO: 35654 - DNA, 320 bp, Zea mays
  Clone ID: LIB3060-015-Q1-K1-H2
cgcttcgccaccgccggcgagagctagggtttcgtgcgccaccgtcacttccgcccggcatggccgagacctccacgtatcagattctggtgcgtctcctcgacgggcgtaccagatgtctccgcttctccacgcccaccgtttccggcgccgtgctcctcgacgccgtcgcgtcgatctctcgcgttcccgccgacgctctccggctcgtcaccggcggcatcgacgtatcgccctcttccgtcctcgcctcagcagctgatggccagttcccctatgcgtcagcgctgctccgccttcgaggatgcaagggtggattc

SEQ ID NO: 35655 - DNA, 423 bp, Zea mays
  unsure at all n locations
  Clone ID: LIB3060-015-Q1-K1-H3
cgcgagtgagtgaacaccagccgtattgtcccgactcctgacccctaccgatcctcgcctgctgcagccatggcgacctccgcggcgctctccaccgccgccaatcccacccagctctaccggtcccgcgcttcgctgggcaagccggtgaaggggcttggcctgagcatgggccgcgagcgcgcccagcggagcattgtgtgccaggcggcgagcagcatctccgccgaccgcgtccccgacatggagaagcggaagctgatgaacctnctnctnctcggcgccatctcgttgcccaccgtcggcatggtcgtccactacggcgccttcttcctccctgccggctccgggaacgccggcggcgggacctacgcgaaggacaagctgggcaacgacatcacngtggaggcgtggctcaacacg

SEQ ID NO: 35656 - DNA, 395 bp, Zea mays
  Clone ID: LIB3060-015-Q1-K1-H5
ctcgtcgctcgccccggttgtctcctcctcgacctcccccgtcgcgacaccgcccgatctctctagcgcacggcgggccggagaagaggaggaggggggggacgatctcattcatcggaccggcgtgcctgtgtcgtctgctgttttcgtttttttctttactctttttttttcctcctttgcttgttcaattcaatcagtatattaagatttctgatttgggggcggctcgccatgggattcggaatggggaataataacaacggggcgagctcctcgtcgtcgcggctggaccccgcggcgccgctgctgccgcgccacggcagcagcgggggccgcgagggtggtggcctgtcgtcgcagcccaagacgttcgccaacgtcttcatcgcggt

SEQ ID NO: 35657 - DNA, 437 bp, Zea mays
  unsure at all n locations
  Clone ID: LIB3060-015-Q1-K1-F9
ctctttctccgggtagtgcaccagcggaacggcgaggagcagaagggaacggngatgggaagcacaggggcgctgctttggcacccgtcgccgcaggtgcactccggtggcgtcctcttccgccagagccggcgcatcgtacgccagcgcaacttgcctctattatcgctagctgacgcggcgcttgagctcgagcgccgccgcgggcagcgtctccgctgcgctgccggcgacggggacggcgggccccgggaggctcagaaggagtctccgagcggcatcggcgcagcactcgaggatccgtctccaggacctcctgtggaaaacggtgccttcagaagcccctcacaggaagaacagagtgctctgtataattntctctatccaagcaaagacttacttccagatgataaagagatgagtatatttgatcatct

SEQ ID NO: 35658 - DNA, 316 bp, Zea mays
  Clone ID: LIB3060-015-Q1-K1-E12
aagaagacgagtgtcaagtgaacctgaaacttgcggtgtcactggctggtagcctgacggtgagtgagtgatcgagctagctgagctccgatcctcgctagctaggataccgccataccacaagtcttcttcacaagtttaggagtgacagcaacaacagatcgatggcctctgccaccgtgctcaagtcctccttcctttccaagaagtccgaatggggcgccaccaggcaggccgtcgcgcccatgccggccaccgtcttcatggtcgtccgcgccttcggctacgccgatgagctcgtgaagacccgcaaaac

SEQ ID NO: 35659 - DNA, 430 bp, Zea mays
  Clone ID: LIB3060-015-Q1-K1-E2
attctctgaagtcaggaagatgacaagacggttctgcagcagacttgggcaaggcgggtttgggggcgtgtacaaaggcgagctgccgaacggaggagtgcctgtgcctgtggcagtcaaaatgctggaggactcaacgggggaagaggagttcatcagcgaagtcgcaaccattggaaccatccaccacgccaacgtcgtccggcttctagggttctgctccgagaggtcaaggcgtgctctggtatacgagttcatgcctaacgcgtcgctggagaagtatatacgctgctcctcccaagaacagtcgttaataacaacggccagtaagatgctggaaatagcgacagggatcgcccgaggaatcgagtacctgcaccagggctgcgaccagcgcatcctccatttcgacatcaagcctttcaacatt

SEQ ID NO: 35660 - DNA, 345 bp, Zea mays
  Clone ID: LIB3060-015-Q1-K1-E3
agtcgcagcagctagcgcccggccggccagtcgagtgagtccatccttgatcgccatgcaatggccgccaccgccctgagcatgagcatgctacgcgcgccgtcggcctgattctagtccccactcaggctcatggtctcggatgccaagccgctggcaggcccaatgcggcgacagctgctgtgcgcgcaagccacctacaacgtgaagctgatcacgccacagggggaagtggagctgcaggtgcccgactacgtgtacatgctggacttcgccgaggaggaaggcatcgacctgcccttctcctgccgtgcggagtcctgctcctcctgcgccggcaaggtc

SEQ ID NO: 35661 - DNA, 372 bp, Zea mays
  Clone ID: LIB3060-015-Q1-K1-E4
cgacgcccagcttgtgcgcgcgcaatggcactcgtgtccgcctcctcgtggttcacgaccgccgtcgcggcgctccccaggaatgggcagcatcgggcgtcgtcgtcgatgatctcctcctcctactcttcctccttcctcgtcggcaagacgctgctgaggcaggccgaggcagcccggccgtcgttcgccgtgcgcgccgcggcggattccgacaggccgatctggttccccggcagcacctctccgccgtggctcgactgcagccttgccggcgacttcagctttgatccctggggcctcggatctgacccggagagcctgcggtggaacgtgcaggcagagctggtgcactgccggagggcgatgctc

SEQ ID NO: 35662 - DNA, 223 bp, Zea mays
  Clone ID: LIB3060-015-Q1-K1-E5
agccacagaatctagcgccctgacaggcaatccaatgaatcgatcctaaagggcaatgcaaaggacgccacagtcctaagcatgaacatcctacgagcgccaacatactgattctaaaccgcactcatgctcatgatctcggatagacaagccggtggcagaagaaatacggcgccagctgcagcatgcgcacgccatatacaacgtgaagcagaacacgcac

SEQ ID NO: 35663 - DNA, 425 bp, Zea mays
  Clone ID: LIB3060-015-Q1-K1-F1
cccaaatcttcccagttcccccctcccgctcgacccagatcgaggcctcgatccaccggccatggcgctggagtgggtggtgctgggctacgcggcgggcgcggaggcggtcatgctgctgctgctgacgctgccggggctcgacggcctgcgccggggcatggtctccgtggtgcggagcgcgctcaagcccatgatgtccgtggtgcccttctgcctcttcctgctcatggacatctactggaagtacgagacgcggcccacctgcgacgacgagcacgcctgcaccccctccgagcacctccgccaccacaagtccgtcatgaagtcgcagcgcaacgcgctcctcatcgccgccgcgctcctcctctactggatcctcttctccgtcacccagctcgtcgtcaggctcgaccagatgcagc

SEQ ID NO: 35664 - DNA, 425 bp, Zea mays
  unsure at all n locations
  Clone ID: LIB3060-015-Q1-K1-F10
cccacgcgtccgagaaggaccactccaagttcaaaagaaagggtgaagatctcttttatgagcacaccctgtctctgaccgaagctctatgtgggttccaatttgttcttacacatctggacaacaggcagcttctgatcaaatcaaaccccggcgaagttgttaaacctgaccaattcaaggcaataaacgacgaggggatgccgatttaccagaggcccttcatgaaggggaagctctacattcatttcacggtggagttccccgactcgctggcaccagagcagtgcaaggctctcgagtcggtacttccgccaaagccttcgtccaagctgacagacatggagatcgatgaatgcgaggagacaaccatgcatgatgtgaacaacatcgaggaagagatgcgcatgaagcangctcatgct

SEQ ID NO: 35665 - DNA, 425 bp, Zea mays
  unsure at all n locations
  Clone ID: LIB3060-015-Q1-K1-F2
tcgctaactntgatgctaacaatgaatcattagagagaaagaaagctatgtattgggaactacaggtgcagtgctcgagaacgtactccagaactgaacaagagaagcgtcgctgctttcgtttggcatagcactgatacaatgtacttgaaaaaatcttcggttgtggatctactaagggagccacatacatttggcagcacagctattgcctgttctgcgagaataaatattgatctcaacgatgatagtctctacatgcataaaaaggtgcaccaacatataaagtcgcatcagcttggactagtaacaggcactactaaatgcgctgaagaatacaagataaatgatgtatcaacagatatgctctgatgtatcttcagcatacctgacatcaaaatttcaagtgtgtcagatgaagaata

SEQ ID NO: 35666 - DNA, 396 bp, Zea mays
  Clone ID: LIB3060-015-Q1-K1-F4
gcggcaccggttccacttgcaccaccaccacgacgaggacgaggagaagaatatggcggcgaggaagcggctccgccacgctgatgagcacgacgaggacagcgactacgaggaggatgagcaaatggaagagatggtccggcggttcaggaaggcgatcatgatgaggagattcggccacggccacggccatggacgctcgtcccgcttcttacaccacatcgtgcaccgccacgccgaggaggccaagaagcaggcagatgttgaagaagaggagagcggtgtcctggcctggatcaagggcctaatgaaccggttctagagctgcctcattcgagcgatccgtgcactcacagtcacagccatggctgcttgccttgttactatgagaacgta

SEQ ID NO: 35667 - DNA, 374 bp, Zea mays
  Clone ID: LIB3060-015-Q1-K1-F5
ggaagaagggcctgctgtatcctctcacttccctcagtcctcgtccgtctgctccctactctctgtacctagctctagctagccttcctgtagcgcggcagagatggctgcccctgcctccaccacggcggcggcggcggcagcgctgctgctgctgctcctcctgtcgctcgccgcggcggcggacatgtcgatcgtgtcctacggggagcgcagcgacgaggaggcgcggcggatgtacgcggagtggatggcggcgcacggccggacctacaacgccgtcagcgaggaggagcggcggtaccaggtgttccgggacaacctccgctacatcgacgcgcacaacgccgccgtcgacgcgggcgtccactcct

SEQ ID NO: 35668 - DNA, 414 bp, Zea mays
  unsure at all n locations
  Clone ID: LIB3060-015-Q1-K1-F7
agaccttgaggctctactcgcctgctctcttcatgcaaaggaagaccctggccgacatgaccgtggggccaataaaactgcccaaaggcactgcaattgtgatacccattccgatcatgcatcgagacaagcaggcctggggcgacgacgcagacgagttcagtccgatgagatttgcgaatgggatcacgggagcagcgaaagttcctcacggcctgctggcgttctcgatggggccaaggtcttgcatcggccagaacttgtcgatgctggaagccaagtcgacgctggccctgatgctccgcaagttctccttcgctctctcccctgactacgtgcacgcgcccgtggatctcttcactctcaaacctaagtttggccttnccgtcattctgaggccactggataatgttt

SEQ ID NO: 35669 - DNA, 413 bp, Zea mays
  Clone ID: LIB3060-015-Q1-K1-F8
caggagacctgggcacttcgctaaggagtgtccatctgcgcctatgtgcaataactgtaaccttgcaggccactttgcagcagaatgcacattacaaactgtttgctggaactgcaaagagtctgggcacattgccagtgagtgcaagaacgaggccctatgccacgcctgcaacaagacaggtcacttggcacgtgactgccctacttcaggtgctaacgtcaagctatgcaacaaatgctttaaatcaggccacatcgccgttgactgcaccaacgaacgggcctgcaacaactgccgtcagccagggcacatagctcgggagtgcaagaacgatccggtctgcaacctgtgcaatgtctccggccacgtcgcacgcgtctgcccaaagacgactctggcttcagtgatac

SEQ ID NO: 35670 - DNA, 348 bp, Zea mays
  Clone ID: LIB3060-015-Q1-K1-C6
cggtcgacccagcgtccgtgctttttttttcgttttaagattacttaattaaccacggcttaaggttatgaacgatcgtgacaagtacctaaaacaaacagcctaggtagcaggtacatatcatgctcggtccggcacgtacggtccagcagctcccggcgttcagtacgccgccgcggccgacacgtcctcgccgatctcgaacatcccagcggcgtccagggacgcgaacggtgccatgtcctcggatactgaagagtacggcgccgcgaagccagcgggggtggaggacgtttcctccttagcctgcgccgtcacgaagctgaacgccgggagcggctgcggaag

SEQ ID NO: 35671 - DNA, 436 bp, Zea mays
  Clone ID: LIB3060-015-Q1-K1-C7
ccctttcaaggaggccggcctcgcctcacactcccgcccgcctccggcgattcatccacccaataaagtatccaaccctaacgatccggatcgccttaccccgcgtcatccacgcgaattgattcgattatcctcggattttccccgtttttttgtgggtttcctatcttcttcgatcggagtgctagggtttgggcgcgctcggtgggcggcgtactccagggtcatcgttagttggacgggctagggtgctttctcaccgggggaagggaagcgaatccaaacgatggagaagaagaaggtggcgatcccgctggtgtgccacggtcactcgcggccggtggtggatctcttctacagccccgtcacacccgatggttacttcctcatcagcgccagcaaggacacaaatccaatgcttcgtaatggtgagact

SEQ ID NO: 35672 - DNA, 432 bp, Zea mays
  Clone ID: LIB3060-015-Q1-K1-D1
agagattccggaaagatggcaggaaaactactctacggctggttgatatggagactgcgatattttactgtggagttcttccgcaagctcacacaggaagttgataagactggaactggaaatcccagaaatgccaatccttctgctccttcggacgatcgttacaatgatgcacatttcaggacgattgcttctaacgtgtcctcatacattggcatggtatctgaaacgctgaagaatactatccccaagtctgttgaccactgtcaggtccgcgaagctaagcggtccctgcttaacgatttctatactcaagtgggcgggaaagatgctaagcaacttgcagtactccttgacgaggatcctgccctcatggaacgcaggctgcaatgctttaagaggcttgagctgtacaagtctgctcgggacgag

SEQ ID NO: 35673 - DNA, 405 bp, Zea mays
  Clone ID: LIB3060-015-Q1-K1-D10
cggacgcgtgggtgattcttgaagagatcgagcttcttttgcaccacaaggtcgaggatgtcgtgcaactgcggatcaagctgcggctgcggctcaagctgcaagtgcggcaagaagtaccctgacctggaggagacgagcaccgccgcgcaggccaccgtcgtcctcggcgtggccccggagaagaaggccgcgcccgagttcgtcgaggccgcggcggagtccggcgaggccggccacggctgcagctgcggtggcaactgcaagtgcgacccctgcaactgctgatcacatcgatcgacgaccatggatatgattattatctatctagcttgtggtggtggttgaacaataataagcgaagccgagctggctgccatacataggtattgtgtggtgtgtgtg

SEQ ID NO: 35674 - DNA, 404 bp, Zea mays
  Clone ID: LIB3060-015-Q1-K1-D11
cggacgcgtgggtgattcttgaagagatcgagcttcttttgcaccacaaggtctaggagatggtgcaactgcggatcaagctgcggctgcggctcaagctgcaagtgcggcaagaagtaccctgacctggaagagacgagcaccgccgcgcaggccaccgtcgtcctcggcgtggccccggagaagaaggccgcgcccgagttcgtcgaggccgcggcggagtccggcgaggccgcccacggctgcagctgcggtggcaactgcaagtgcgacccctgcaactgctgatcacatcgatcgacgaccatggatatgattattatctatctagcttgtggtggtggttgaacaataataagcgaggccgagctggctgccatacatatgtattgggtggtgtgagt

SEQ ID NO: 35675 - DNA, 408 bp, Zea mays
  unsure at all n locations
  Clone ID: LIB3060-015-Q1-K1-D3
gcaaccggtccaacactttcacgctcaggcgctcagctctagcaatggctgcctccaccatggcgatctcctccacggcgatggccggtacccccatcaaggtgggctccttcggcgagggccgcatcaccatgcgcaagaccgtgggcaagcccaaggtggcggcgtccggcagcccctggtacggccccgaccgcgtcaagtacctcggccccttctccggcgagcccccgagctacctcaccggcgagttccccggcgactacggctgggacaccgccgggctgtccgccgaccccgagaccttcgccaagaaccgcgagctggaggtgatccactcccgctgggccatgctncgcgcgctcggctgcgtcttccccgagctgctctcccgcaacggcgtcaagt

SEQ ID NO: 35676 - DNA, 438 bp, Zea mays
  unsure at all n locations
  Clone ID: LIB3060-015-Q1-K1-D5
agagattccgcgaagatggcaggaaaactactctacggctggttgatatggagtctgcatatttgactgtggagttcttccgcaagctcccacaggaagttgataagactggaactggaaatcccagaaatgccaatcctcctgctccttcggacgatcgttacaatgatgcacatttcaggaggattgcttctaacgtgtcctcatacattggcatggtatctgaaacgctgaagaatactatccccaagtctgttgtccactgtcaggtccgcgaagctaagcggtccctgcttaacgatttctatactcaagtgggcgggaaagatgctaagcaacttgcagtactccttgacgaggatcctgccctcatggaacgcangctgcaatgctttaagaggcttgagctgtacaagtctgctcgggacgagattgatg

SEQ ID NO: 35677 - DNA, 437 bp, Zea mays
  Clone ID: LIB3060-015-Q1-K1-D6
gactttcttcacaagcaaaataacttcttggacctccataaaattctaagatttgctatcgatatctcaaaaggaatggattatctgcaccagaataacattatacacagagatttgaagtctgcaaatcttctgctaggccatgaccaagttgttaagatcgcagactttggtgtggcgcgacatggaagtcagcaggggcagatgactgctgaaactggaacctaccgatggatggcaccagagataattaatcataagccgtatgaccacaaagcggatgtattcagctttgccattgttctttgggagctggcaacttcaatggtcccatatgacaacatgacacccttgcaagctgcattaggagtaagacagggattgcgcttggacattccgggcagcgtgcacccaagattgaccaagctgattcgaca

SEQ ID NO: 35678 - DNA, 423 bp, Zea mays
  Clone ID: LIB3060-015-Q1-K1-D7
cctgtcgttgtgagaattcttaattcatgagttgtagggagggacttatgtcaccacaaacagaaactaaagcaagtgttggatttaaagctggtgttaaggattataaattgacttactacaccccggagtacgaaaccaaggatactgatatcttggcagcattccgagtaactcctcagctcggggttccgcctgaagaagcaggagctgcagtagctgcggaatcttctactggtacatggacaactgtttggactgatggacttaccagtcttgatcgttacaaaggacgatgctatcacatcgagcccgttcctggggacccagatcaatatatctgttatgtagcttatccattagacctatttgaagagggttctgttactaacatgtttacttccattgtgggtaacgtatttg

SEQ ID NO: 35679 - DNA, 397 bp, Zea mays
  Clone ID: LIB3060-015-Q1-K1-D8
attctctgaagtcaggaagatgacaagacggttcagcagcagacttgggcaaggcgggtttgggagcgtgtacaaaggcgagctgccgaacggaggagtgcctgtgcctgtggcagtcaaaatgctggaggactcaacgggggaagaggagttcatcagcgaagtcgcaaccattggaaccatccaccacgccaacgtcgtccggcttctagggttctgctccgagaggtcaaggcgtgctctggtatacgagttcatgcctaacgcgtcgctggagaagtatatacgctgctcctcccaagaacagtcgttaataacaacggccagtaagatgctggaaatagcgacagggatcgcccgaggaatcgagtacctgcaccaaggctgcgaccagcgc

SEQ ID NO: 35680 - DNA, 421 bp, Zea mays
  Clone ID: LIB3060-015-Q1-K1-D9
cggacgcgtgggtgattcttgaagagatcgagcttcttttgcaccacagggtcgaggatgtcttgcaactgcggatcaagctgcggctgcggctcaagctgcaagtgcggcaagaagtaccctgacctggaggagacgagcaccgccgcgcaggccaccgtcgtcctcggcgtggccccggagaagaaggccgcgcccgagttcgtcgaggccgcggcggagtccggcgaggccgcccacggctgcagctgcggtggcaactgcaagtgcgacccctgcaactgctgatcacatcgatcgacgaccatggatatgattattatctatctagcttgtggtggtggttgaacaataataagcgaggccgagctggctgccatacataggtattgtgtggtgtgtgtgagagagagagaaacag

SEQ ID NO: 35681 - DNA, 431 bp, Zea mays
  Clone ID: LIB3060-015-Q1-K1-E1
atcaattgactctggttccctaaaaggatttcctagtgattgcaaagaagcttcaaagcttgttagtcaacatttctattttctgacttctgatgacggagaatatactatttgaaaactgctatgattcaaattatttctgcagaatcttgtgtgccgaaagaatctggtaattgataagagcatccacactgcatatgtccgagcaatcagatctgcacagcattacatttatattgagaaccagtacttccttggctcttcatatgcttggccatcctatgtgaattcacgtgctgataatctgataccattagaactggccctcataattgcaagtgaattcctatattgatggccaaaatttggcagaacaatttaaccaattgtgaggtcttctgagttctttctctctgcaaacattccatgtt

SEQ ID NO: 35682 - DNA, 436 bp, Zea mays
  Clone ID: LIB3060-015-Q1-K1-E10
cccctcgtctcatctcaagagcgactagagagagagaggaagagaacaagcgataagctcatctcgcacgcaagatgcgggctccaaggggcgcaggcggctgccgcggcggccaggagcatgtggaactgatccctggcatccccgacgacgtggccgtggactgcctggcgcgcgtcccccacgcctcccaccgcgcgatgcgccgggtctgccgcggctggcggagcgccgccgcggcgccggccttcgcgtcggcgcgcgccgcggcgggcgccaacgaggacctcgtgtacctcatgcagttcgggaacccgtccggcgacgacgggcccaaggacggcgacgacgggcccggcagcaccccggcgtacggcgtggcggtgtacaacgtgacgacgggcgagtggcggcgggagcgcggcgcgccccccgt

SEQ ID NO: 35683 - DNA, 415 bp, Zea mays
  Clone ID: LIB3060-015-Q1-K1-C5
cacgtccttccgggtcctatcgctcctctccgtcgccggtggagctcatggcatcctccatggccgccgccgccaccgccctcccgctgccgtccgggacgacgcagaggccgtctgcccagggccgcctcctcttcaccgccgcacccgcccgctcccgctgccgctccctccgcctccgccccgccggccgccggtcggcccgctcctcgcctcgggccaccaaggctgtggtggcagcgttggctgatcctctcaaggtcatgatatcaggagctccggcgtccggcaagggcacacagtgcgagctcatcaagaccaaatatcaactggcgcacatctccgctggagatttgttgcgggcggaaatcgctgctggctctgagaatgggaagcgggccaaggaattcatgga

SEQ ID NO: 35684 - DNA, 415 bp, Zea mays
  Clone ID: LIB3060-049-Q1-K1-D4
gtgaaatggcataaggagctctttccaggcatagagattgacgctagccagcctccgggtgttttcaagactcagttgtacacactaactggtgtgccacctgaacgccaaaaaattatggtgaagggaggaatattgaaggacgatgcagattggtctactttgggagtgaaagatggccaaaagttgatgatgataggcacggctgatgagattgtgaaagctccggagaaaggtccagtgtttgttgaggatctaccagaagaagagcaagtgattgcactgggtcacagtgctggtctttataaccttgggaatacatgctatatgaattccacattgcaatgtctgcattctgttccagagctgaagtcagcgctgctaagctattcagatactgtaagaggtaatggca

SEQ ID NO: 35685 - DNA, 419 bp, Zea mays
  Clone ID: LIB3060-049-Q1-K1-D5
ctgtcactctctcttgtctccaagtttgtaaccctagccgccaagcttgaagctccaggcgtgctcgtgtagggccgcaggccatccgggctccggcttccagcatccaccaggcgtccttagaatacggtgcagcgagcagcaagtcgccgagcagccgagccaccgccgaacacagggcgccgccgagcagccgagccgccgccgagcgccgagtcttctctgtgtctatggcgtctccatgcaagtacacactacactggcaccgcgattgacagtcagaactttgattgcccgtccaataggtaccgagtgacttcggtacagacgacaaactttctccacacataccgcgccactccgccactcactgtgctgacggatggggtggtgctccccgtccacttcccggcagcttc

SEQ ID NO: 35686 - DNA, 424 bp, Zea mays
  Clone ID: LIB3060-049-Q1-K1-D7
cgccgttgcgaggggtcgcctcgccgtatggaagtcagccaccgagactacatgggtggctctacaattctgggacgatcttgctattgtggcctctgagcatgttaagaagggtgaccggatatttgtttctggacggcttgtgtcagatactgttgatgaggggcctgagaagcggcatgtttactacaagcttgcagttcaacagttgaatttcatcgagtcccagccagttcgattatatgaaccagaggcaagccaggatgccctaggtggaaggcgtgctgattattttaactctatctctaattcaactgaggataagaatagggataatatgagctcatctcgatcaaccgaagagctgtggcaagtgttctttgccaatcctcttgactggtgggataacaggacaaattagaag

SEQ ID NO: 35687 - DNA, 448 bp, Zea mays
  unsure at all n locations
  Clone ID: LIB3060-049-Q1-K1-D8
gaaaaatcagcacatgcaaagaaatgggctgaaccacatattgagactgctaagatgagatggattcctgttaaggagaaattggttgtcctcaagaaaaatgcagaaccttatgtacagaaggtatcgacaagatcagtggagttttatgagtcatcaagggatgctgtgacacctcacgttgtcaaagttaaagagtttgctcatccctactaccaggaagccaagaagttttctaagccttacattgatcaaattgctgagatcactaagccacatgttgagaaagttagaactactctgaagccatacactaagagagcagttcatgcgtatgggtcatttcttgggtctgcaaccacataccatcgacaggctcaggcgaccatcatggactacctncatcagcatggngtacccaagtcatttgcaacgaaggagttagttt

SEQ ID NO: 35688 - DNA, 412 bp, Zea mays
  unsure at all n locations
  Clone ID: LIB3060-049-Q1-K1-E1
gcagaaaatgcattagctgctgttaggcttactatcatccttatattcacagtgcacagtgtaaataaagaacctgatagccagtcatattctgaacttgtgtaacgcaaagtactgctccaaagtgcgtttacggctgcttttgattttggtggaagaattcttaaaaaggtgttcaaaacttggtgatatcacatcaagcttctatctgccagccattctggtctacatcgaatggctggcgtcccatccagagttggctattgactcagagatggangaacagcatgcaaatgccagatctttctttctggaaccaatgtatctcatttatgaataagttgatccttaccaaccttgcttctatggaggacaatgacgatgaggcttgcttttctaatatgagcattta

SEQ ID NO: 35689 - DNA, 256 bp, Zea mays
  Clone ID: LIB3060-049-Q1-K1-B3
ttctctgaagtagcttttctgcgcgcagcattcctagtatgtgggcctttaggttcatccaaactcaatttaagggcagcttttcctttggcctttgaggtgtttatgcttgcctcctgataatccttcttaattgcaccactggtggcagctgatgactttgatcttaacgatgtgcgacggacagattgagtttctgatggaattgaaggcgcacaagctgtggagcttgctgcttcagatccaaaattatttg

SEQ ID NO: 35690 - DNA, 421 bp, Zea mays
  unsure at all n locations
  Clone ID: LIB3060-049-Q1-K1-B4
aggaaccgctgtgtcacacacgaaccacacggcggccggagcggcggagccaccatagattggtgctctctccgtccgaagtgctctctgaaattcccccaaatatcccagccactgccgtcgtgcagtcaaagtgtcaaaccatgccggcagtagcgttcgcgtcggctccggccatattcgcctccgcctccgtgcgtccctgccgcagcgcggctccgggcatcctttcctccgactccgggcggccccgccgcggcgcgcgtggcgccgtccggtgtgaggtcgcctcctcctcggcaccgtcggcggctggaccccaggccgnccggtgggcccagaggaccgtggtcatcccgccacagcgccgcgggtgccacctcatcaccaacaagattgtaaatgagatagggaatgacct

SEQ ID NO: 35691 - DNA, 242 bp, Zea mays
  unsure at all n locations
  Clone ID: LIB3060-049-Q1-K1-B8
gaggcccctcaccctcaggtgatcaggtcgctagctcccggcttaactagtaggcagggatgaatttcggtgggaatggcaacgcgacgatccggtgcaagtactgcagggcgagcctgagcgtgatccccggcgagcgcgccatccagtgcgcgcaatgcaactgcgtgacccgcatccggcgggccgaccgcatcccggttgcgcggccggcncacgngccgncggcgnnccagcgcgcc

SEQ ID NO: 35692 - DNA, 253 bp, Zea mays
  Clone ID: LIB3060-049-Q1-K1-C1
gctgctcctcctcctcccccccagtccctcccaggctcccaccccgccttgctcgcaggctccccaaaaccctagccctagccctagccctagctctcccacacccgcactgggagatggacggcggcggcacgcaccgcacgccggaagacgtgttccgggatttccgcgcgcggcgggctggtatgatcaaagcgctcaccaccgacgtggagaagttctaccagcagtgtgacccagagaaagagaatct

SEQ ID NO: 35693 - DNA, 429 bp, Zea mays
  Clone ID: LIB3060-049-Q1-K1-C2
gctcagcggaacagctagctatagcctgtagctagcagctagcttcagtcacaggccggacggtcggctcacacacagctagccgccgccgctgctagcttagccaccagtagtccgatctgatctacaggcagggggccagcaggggcagctagctagctagccgcgcgccggcgccatgatgaacctgaacctgaagcagccgctcgtgctgcccgcgcaccacagcaatgtcgtcggctcgcgcctgtcgtcgtcgtcgccctcggcagccgccgccagcaggaggaccggcggcggcgtgtcctcccggtccggctcccggcggcacgtgcggctgccgaggatcagctgcagcgccaccgaggaagtcagcggcgccgtgtcgtccgtcaccgtggagaggatgctcacggtgacggcgtcggt

SEQ ID NO: 35694 - DNA, 431 bp, Zea mays
  Clone ID: LIB3060-049-Q1-K1-C3
cggacgcgtcacccgacgcgcgggcgatgctcactgtctatcatgcaccatggctgcgggtaatgacatacttggcatggttgggtgctaaaaggaccacaatagtttgaataatcggtccgatgaacattctacttgagcttaagcacctcaagccctttagcatccctgcaaggcttgtcatctgtaaaggccttctgatagtgattggccctattttggtgacaaccaatagggtctccttttcttggcaatagattcatctgggaagaaagagttttacgattcaacagcccctgactagcttccaaaaattagacgtgacaagttccttgaggtcccacagatcatatgcgggttgaacaatcaaaagattgcattcggcagagcatgctagactgcaagattcctgaacagatcccttctcatgc

SEQ ID NO: 35695 - DNA, 436 bp, Zea mays
  Clone ID: LIB3060-049-Q1-K1-C4
cttaaaccctagccgctgcgcacaacaacctgctactcaatgggatcaaccgccatcgattctcctcctccgttgcagctgcggcatccatccagtagtccgaccaatccatggcttcagcgttcgggaccgcctccacttgcggcattaaacatgcacctgccggcgttgcgcttgctgcgcccatgaagcacctttccctcgtctcgccctcgctggtttcgcttccgcgcaagatgaggccgcgaaggaagtacaacttcagggtaaacgctgcaaaggagctgcatttcaacaaggatggctcggctatcaggaaaatgcaaaatggggtcaacaagcttgcagatctcgtcggggttactcttggaccaaaggggcgaaatgtagtcctcgaaagcaagtatggctcacctaaaattgtcaatgatggtgt

SEQ ID NO: 35696 - DNA, 441 bp, Zea mays
  Clone ID: LIB3060-049-Q1-K1-C5
ggggacgcgccacgcgtccgcgcttcccgagcacgcaaccatggctcgactgtcagccaccggcgcgctcctcctccgcgtcctctccctcctcgccgtcgcgcactgcggtgccctcgcagtcgcagcagagcacgacaccgagcccgaatcaaccgccgccgtggccgtcagcgacgacaacgtgctatccgaccccacggtccacgctgaggcgggcaccgccagcgccactgaagaggaggccatcccggcggagcagcagcagcatgggttcgaactcctccgcctgccgtctcaccggctccaccaccaccaccacctctggtggaagcgccaccacgggatctaccgtgacgcgtcgcacaagttcccttgttctggccacggcgcgaggcgcgagcaggcagtgagccaccttgccatcttgcccgcatccgc

SEQ ID NO: 35697 - DNA, 450 bp, Zea mays
  Clone ID: LIB3060-049-Q1-K1-C6
gggggttcctctcgagtctcggcaacgacgaaaacgaaaataccgagtcgagtcagcggtgaatcccttcgccaaaaaaccaactccgcgagaggtgatgcggagcagcaagcgggacctgacgaatgctacgcgagggatcgagagggacattgcgtcattacagcaggaggagaagaaactcgttgctgaaattaaaaggacagcaaaaactggcaatgaggcagcaacgaaaattctagcccgtcagctgatcaggttaaggcagcagatttctaatttgcaaggtagccgagctcagattcgggggattgcgacacatactcaggcaatgcatgccaacacttcagtggctactggtttacaaagtgcgagcaaagcaatgggagctttgaataagcaaatggaacctaccaagcagatgaaaataatgcaagaattccaaaagca

SEQ ID NO: 35698 - DNA, 326 bp, Zea mays
  unsure at all n locations
  Clone ID: LIB3060-049-Q1-K1-B11
gttttatcctagcaacatgagtttttgcatcactgtatttcctggcaaacaatgttatnaacttagggaaagctgcattgatcactgtcaaaggacttgcagctggtgcaactgtccgatctgcagtggaaaatttcctgcaggttgatatcgtgccctttctaggcatccactcccacgccgtcgatgtcagtgaatttattctgttctcccagttgttgctatcactgtctgttacgtacgatctcaaatcaaactgtcatactgatcaaggcatgtaaataacttaaatggttcctgatcaaacttcaaagggtcaaggaaat

SEQ ID NO: 35699 - DNA, 380 bp, Zea mays
  Clone ID: LIB3060-048-Q1-K1-H12
ttccaaggggaagcttgtattagatccttcaccgccctaattgcctaatggatgaaaagcggaggatcaagatggcccttgatgtggccaaaggtatgaattgcctgcacactagcatgcctacaattgttcatcgagatctgaaatctccaaacttgctggttgacaataattggaatgttaaggtttgtgactttggactttcgcggttgaagcacagtacatttttgtcatccaaatctacagctggaacacctgagtggatggcacctgaggttctgcggaatgaacaatcgaatgaaaagtgtgatgtttatagctttggtgtcatcttatgggaactggcaacacttagaatgccatggaatgggatgaattcc

SEQ ID NO: 35700 - DNA, 308 bp, Zea mays
  unsure at all n locations
  Clone ID: LIB3060-048-Q1-K1-H3
gcgtccgttccatacgtcggctccctgtggtcttccccgcgtccggtctcatccttatccccatcgcccttatcccctggtctgtgccgctcgtacttggagaaaaatctccagccgccttacctgctgccgccgcttcccatccgacagattatttgtttgcagtcactgatcttctccctcgctcagccgagtggtcttccactcctcccagccgagctctccctctncacgcagctccctcgcggtgctccctccatagcgcccgagcgctctgtcctcggatcggagctttctctgcgtgtcgc

SEQ ID NO: 35701 - DNA, 230 bp, Zea mays
  Clone ID: LIB3060-048-Q1-K1-H5
ctctcatcctcatgcccttcgggcttatcccctggtctgtccctgtcgtactttcagaaaagtctgcatcctacttaccttctgccacctctttccatcctacacattatttgcttgcagtcactgatcttctccctctctcacccgagttcccttccactcctcccatccgaactctccctctccactcacctccctcactgtgctccctccatatctcccaaccactc

SEQ ID NO: 35702 - DNA, 418 bp, Zea mays
  Clone ID: LIB3060-048-Q1-K1-H7
cttaactcatttacttatgaccaaaggggaagaaattacttagagggctctaatgattccgtttttggcgattcatgccaaaaagggggagaaatgagcccaaagcaaaaggaccgcaccaccaccaatttcaaaaacttagtgctttccaaaagtatttatcaatgggtatcctattgtgttcaaaagggggagaaagtagtatttcaaaaatggtatatcaaaaccctcttgaacactaagaggtggatctcttttagggggagtcttgtttagtcaaaggaagagcatttgaaacagggggagaaaatttcaaatcttgaaaatgcttttgcaaactcttattcatttacctttgactatttgcaaaagatctttgaaatggatttacaaaaggatttgcaaaaacaaaacatgt

SEQ ID NO: 35703 - DNA, 349 bp, Zea mays
  Clone ID: LIB3060-048-Q1-K1-H8
gagacacagaggcctcactccacacactgtcttgtctctcagtcccagagctttcttggatcgcgaggaatccactggaaattttgcaattgtagtagagaactgtatcgtccgacgaaggtgcatggtgttggccatgggtcacggcagggaacagagacgagcaggtcggcgctctccccccagctcattgatcctgtcctcgctataaggtagtcctgcggtggcctccgaatttcactcgatcgaacacgacatgaagcggccacgcggcgccagtccccctctggctgcgatgaccaatccgaacgatgatggttacggcgtggtcgggatggaggcggacgca

SEQ ID NO: 35704 - DNA, 429 bp, Zea mays
  unsure at all n locations
  Clone ID: LIB3060-049-Q1-K1-A1
cgggctctgctccgcctcccccgatctccccacagatctcgtcgcgatgggcctcgccgccgccgccgccgcccgcgcggccctcctcctccgggccgtatccggggtcctcctcagtcctgcggcggcggagatcaagcaggagtccttcaaggacgactcccgcggctccatcctcttcgagaagttcggcttcggcctccacggcatggtgtctatctccgtcaccggcgccaagtactcctccaagctcgctaagcccgaccccgcgcagctcggcttcttcctcctctctgacgagtcgctcttcgaggccatctacgatcagccggcgcccacggatctgaaccccaacccggaatcctnccccacgtgcgtcctcgccagcccctacgtcaggcctctcttcaccttcgcagaggtcgacga

SEQ ID NO: 35705 - DNA, 444 bp, Zea mays
  unsure at all n locations
  Clone ID: LIB3060-049-Q1-K1-A11
cccgggcgagtaataagcagctttggcatgccaatgggaccttttcaactccaagatgtggctgggtatggagtggctttggcagtaaaagatatctacgctgatgcctttggagaaagaaatttgggctctaaccttgtgggcctgatggtaaaggatggacgacaaggaaaggtgaatgccaaaggttactacatttatgagaagggtgcgaagccaaagccagaccctagtgttaagcatgtgatcgaggagtaccgaaagcaggcaaacacaatgcctggtggaaagcctgttactttaatggatcaagatattttggagatgattttcttcccagttgtgaatgaagcatgcnaggttatggatgaaaatgttgtaattcgagcttncgatcttgatattgcttctgttcttggaatggggctntcccaaaacaagggt

SEQ ID NO: 35706 - DNA, 447 bp, Zea mays
  Clone ID: LIB3060-049-Q1-K1-B1
ggtgatgttatctatgccatcctgaggcgtaatcttgatgacgtgacatcatccatcagatgctcggagggtcaggcatcctcttttccctgcattccgcacgattgatgcggtgacttactcggatattgcaaccgtccaaatcgaccgctgcgtacttgatcttgccactgagcccaatgattctcttattggggtggttgctatggacgatcaccaagagcttttctcttctggccgcttgttcgaaagtggcaaggaagcgaataacccgatgacgattcaaaacccgaaggatgcaggtgaaaccgacgatgacgacgacgacgatggcgactctgatgatgatgttctccttgcgccggtgctggaaggggatacagattccgaagagattagtagcagcagcgatgatggtgatgaagatggtggtgacgatgatatccc

SEQ ID NO: 35707 - DNA, 412 bp, Zea mays
  Clone ID: LIB3060-015-Q1-K1-B10
gttctccgcacgcgcatgatcggcatgcacgatgacgacctgctactaagggctcttagggatcgcaagctctggctcaatcaatacggatgcaagcttaccaatgtcatctactgctccgttgtagagccatcttactaatcgagatcgattttctaggacacctgcacatggtaaatacctcataggctgtacatagctggaccacctgcttttaccgtcgctccagcgattcatgcgatgccgacagcagatgcacatgctaaacggcaggcatgtacatgtatgactaagaaatccggctgtgcaatcagcggatcaacagggaagatgccgtgcactacgaccgtgactttgacagtgatcccatacttgtatgtggcactgccaaagatttggatagatgctacgt

SEQ ID NO: 35708 - DNA, 411 bp, Zea mays
  Clone ID: LIB3060-015-Q1-K1-B4
gcacttatgtgattgtgtctggtaatatccaagctctgtttgtcttagtgagtcgaccacatgaatgcctattatgttctgccacactcaccttcctgttccattagctgctagtgccaactgccagctaaatcctaagcgtgtgtttggaaaatattgaacaatagtgtaaatgcataaagcttgaacctttttttactgttgatggtactgttacatgattctgcattggctcaaccatataggcatgaacaagtatgagatgaagctgggtagaatcgtagtaaaaaattaactgattagtgttttatgcctgaggtgttccagtaataagattgatagtatagaagtagggaactgtcactgtcttgaatcaaagaaactgcgtgaaagataatggtttctctttgc

SEQ ID NO: 35709 - DNA, 386 bp, Zea mays
  Clone ID: LIB3060-015-Q1-K1-B5
gtgcaggtgatggacccggacacggaggagcagtacgacttcgacccgctggacgacaccaagacgtggccggaggacctgctgccgctccgccccgtggggaggctggtgctggacaggaacgtggacaacttcttcaacgagaacgagcagctggcgttcgggccggggctggtggtgccagggatctactactcggacgacaagatgctgcagtgccgggtgttcgcctacgccgacacgcagcgctacaggctgggaccaaactacctgatgctgcccgtcaacgcgccgcgctgcgcgcaccacaacaaccactacgacggcgccatgaacttcatgcaccgcgacgaggaggtggactactacccgtccaggcacgcgcc

SEQ ID NO: 35710 - DNA, 339 bp, Zea mays
  Clone ID: LIB3060-015-Q1-K1-B6
gccgagctacacgaggagaacacgctgttgactgcgcactcgcacaacaacctgcaggagggacgctaagaggcatagttgacggtgacatgcaccacaggacctgaggacagtagcgtctgggaaccaacgaacacgacaatggggactgcatcagtgacatcatgcatggctacgaactcgacctgagtgccgctgtctagtatgactgtgacgcgtgcacgcactataagttcgacagcctgtagaagatggtcaaccgcactgtccagatgtacttgacggtcgacacgctcagagggctgtacgacctgaggacgacagacctggatgcgctgt

SEQ ID NO: 35711 - DNA, 251 bp, Zea mays
  Clone ID: LIB3060-015-Q1-K1-B7
ggacgagcatcagtctatcgctacttacgtctagggactaatactcggaaggtgagcgcccatatcactccagggagcaccaagccggtccagctcatctttcaccccaccgacctccgtgattagtcactcagcagcgccgtaacggccgtatatctggccacaagatggtacagcatgctgatcttaggtatgaatccgactcgcgtcggaggcacaatccagctcatagaccaattaatgcgcacatt

SEQ ID NO: 35712 - DNA, 403 bp, Zea mays
  unsure at all n locations
  Clone ID: LIB3060-015-Q1-K1-B8
ggctagcagcacagcagcagccagagccatcccctctcctcgctacgcttcgcttccgcggcgccgattcctcctcctcctcctccaccctcgtccgtccccttccggcgcacgagctcgcccgagatggcgaacgcgagatcgggtgtcgctgtgaacgatgagtgcatgctgaagtttggcgagctgcagtcgaagaggctgcaccgcttcataactttcaagatggacgacaagttcaaggagatagttgtggaccaggtcggggatcgcgctaccagctacgatgacttcacaaacagcctccctgagaatgactgccgatacgcgatctatgatttcgactntgttactgcagaggatgtccagaagagcaggatcttctatatcctatggtccccat

SEQ ID NO: 35713 - DNA, 346 bp, Zea mays
  unsure at all n locations
  Clone ID: LIB3060-015-Q1-K1-B9
cttccccgccggcgcctgctaggcgtccgcgaggagggccagcgatgaagggctcctgccactcgcaggcggnggcgcaggcggtacggaggcggcgctgggggtgtcttctgccgctcctcgttggcgccgccttcctcgccgagatcgcgttcctcggccgcctcgacatggcgaagaacgccgaggcggtcgagagctggaccacctccttttaccgccgctccgccgatttgggcgatgccgttggcggnggcgcagcctcgagggcaggcggcgacagcgaggacgaagagatccggctgtgcgagcagcggctcgagagggaggatgccgtgccctacga

SEQ ID NO: 35714 - DNA, 436 bp, Zea mays
  Clone ID: LIB3060-015-Q1-K1-C11
gacccacgcatgcgtgcacacggtggtaatacaagaagatatccaccatagctggcacaactagatcctagggtgcgtccaactccgcatcaacctccgtcatcagctcaagctgcaagagcactaccaacaacacgtgacccgaactagacaagctccgccccctagcccaccacaccgctcagcatctcccgctgcaacaagcccgcacctgagcttcttcatccccttcctcattcccgtgacgccgccgacaggtccacctgcactgccacctgaagacgccaaacgtgatgcacctgatgatatggagacacaactgaagctatgagaggccaccataccgcctgcgttgctcgttgagctctgcctgcaatacgcccagcacggactgatctatactgtacctatacacctatttactacgacatgcaca

SEQ ID NO: 35715 - DNA, 415 bp, Zea mays
  Clone ID: LIB3060-015-Q1-K1-C2
gcccgctgcggtatcgtcgtcttctccagacatcagcgacgagctcgccaagtggtatggtcctgacaggaggatctacctgccggatgggctgttggaccggtcggaggtgccggagtacctcaccggagaggtccctggagactatggctacgacccttttggcctgggcaagaagccagaggacttcgccaagtaccaggcctacgagctgatccatgccagatgggccatgctcggtgccgctggcgctgtcatcccagaggcctgcaacaagttcggcgctaactgtggccctgaggctgtctggttcaagaccggcgcgctgctcctggacggcaacaccctcaactacttcggcaacagcatccccatcaacctggtggtggccgtgatcgcggaggtcatcctcgtc

SEQ ID NO: 35716 - DNA, 365 bp, Zea mays
  unsure at all n locations
  Clone ID: LIB3060-015-Q1-K1-C4
aataagaagcacttaattaaccacggcttaacgttaatcaagcgatcgtgacaagtacctaaaacaaacagcctagggtagcaggtacatcatcatgctcgggtccggcacgtccgtccagcagctcccggcgttccagtacgccgccgcggccgacgcgtcctcgccgatctcgaacatcccagcggcgtccagggacgcgaacggtgccatgtcctcggatactgaggagtacggcgccgcgaagccagcgggggtggaggacgtttcctccttagcctgcgccgccacgaagctgaacgccgggagcggcggcggaggcgcgaagagagacgccagcgccgncgnctgatcggcgaatatcg

SEQ ID NO: 35717 - DNA, 411 bp, Zea mays
  Clone ID: LIB3060-015-Q1-K1-A9
cagggttctcgacggtcctttgcctctccgccatggacgcacagcgagccctgcgtgacgagctcatgggcacagctcgcaacctaacggaggaggagaagaaggggcacaaagagctgaagtgggacgatccggacgtgtgcggcccttacatggttcggttctgtcctcacgaccttttcgtcaacaccaagagcaatatcgggccgtgctcgaggatccacgatccgaagctcaaggaaagctttgagaagtctcctaggcacgatacttatatgcaaaggtttgaggcagagcttgcacaacaatgtgagaaattggtaatggacttagatagaaagataaggcgtggtcgagaaaggctggctcacgattctgctgtgccaatgccaatccctggaaaattagctg

SEQ ID NO: 35718 - DNA, 419 bp, Zea mays
  unsure at all n locations
  Clone ID: LIB3060-014-Q1-K1-H4
ggttgctgtcactcgctctgaggcctcgacgcgctgctagctgagagccgaaagaaggaatcctcggccggcagcaggagaggagagccaccgtttgatcagcgaccgggcaagagcaggccgcggccggccaccccgcccgtctctgtccgaccccgcaccagcgactcgccgagtgcaggcacaagaggggggctccatccatgaggcagccatgctggtgctcatcaacaggtatttcaggagcaggaacagcagcccggccggaggaggcggcgaagagatggcgccggcggcgacttccagcgaccacctctgtttgccgggctgcgtgcccgtgcgcgccaagcgggcctnctnctccgccgccgccgcggccacggccaccacggcgcgggcgtcgcggcacaacttcgtca

SEQ ID NO: 35719 - DNA, 410 bp, Zea mays
  Clone ID: LIB3060-014-Q1-K1-H5
gcatcgtgtgcgccagccccagggcgctggaggccagcaagacggccaggtccgtgcgcgtcttcttcgactggaaggactacctcaggttctacgacatgggcacgtactggccctacacgccctccatccagctcctctacggcctccgcaccgcgctcgacctcatcttcgaggaagggctggacaacgtcgtgaggaggcacaaccgccttgggacagccaccaggctcgccgtcgaggcgtgggggctcagcaactgctgccagaaggaggagtggttcagcgacaccgtcaccgccgtcgtcgtgccgcccaacatcgacagcgccgaggtcgtcaggcacgcgtggaagcgatacaacctcagcctcggcctcggcctcaacaaggtcgccgggaaggtcttc

SEQ ID NO: 35720 - DNA, 375 bp, Zea mays
  Clone ID: LIB3060-014-Q1-K1-H7
aataaactgcggattctttctttctcttccattcttacgtttccatattaaagtgtagtttttttacttaatttaattattataaacctattttgccaatggtggttccaaaggtacttaaccgaattccggagatgaagaagcgacttgggttgacttatacaatgttatgtatcgagaaaagacactttttttaggtcaagagattcgctgcgagatcacaaatcatatttcacgtctgatgggatatctcagtttataaaattggaatagcgatatttttttgtttataaactcccctggcgggtggctaatctcaggaatggcgatttttgatacgatgcaaacggtgacacctgatatatatacaatatg

SEQ ID NO: 35721 - DNA, 422 bp, Zea mays
  Clone ID: LIB3060-014-Q1-K1-H9
aaaagctactgacctccccaaagtttacattctgttatgatgcgctccatggtgttgctggagcttatgccaaacacatctttgtggaagagcttggtgctgatgaaagctcactgttgaattgtgtcccaaaagaggactttggaggtggtcatccggatcctaacctcacctatgcaaaagagttggttgaacggatgggtcttggaaagtcatcctcaaatgttgaacctcctgaatttggtgctgcagctgatggagatgctgaccgcaacatgattctgggtaaaagattctttgtgacaccatcggactctgttgccattatagcggccaatgctgttcaatcaattccttactttgcttctggcctgaagggagttgccaggagcatgccaacatcagctgccctttgatgttgt

SEQ ID NO: 35722 - DNA, 420 bp, Zea mays
  unsure at all n locations
  Clone ID: LIB3060-015-Q1-K1-A1
ggaaaatggcaagataatcaagacgggtgacagttctatcgccacacaaattaatgaaggcggcttcaaatctatcgcccttgtatagcgtgaaagcagtcaaataacagaaatggctcgctgggcttgttcaccagccactaagcctacttgccaggacagaatgcctactgcttggggtttgcactgttgcctactgcattcagaggtgtaccacatacgaatttagtaaaaaaaaaatgagttagtgctctgttcgactaggcatgttgtcttgcctcgtcgagggtggggagctggatacaccacctnctctatgtaagaatgtttggatgaagatatttatacatgtagtcatacatagggatagcatgccgtgcgtgcatacaaggtccaaattttgtatgtttgaattatgac

SEQ ID NO: 35723 - DNA, 372 bp, Zea mays
  Clone ID: LIB3060-015-Q1-K1-A11
ctctccttttgctcggaacgcacacaccgcccgtccccgatctccgatcccctcgtcgatcgaaagatgcagatcttcgtcaagaccctcactggaaagactatcaccctcgaggtggagtcttctgacaccattgacaacgtcaaggccaagatccaggacaaggagggcatccccccggaccagcagcggctcatctttgctggcaagcagctcgaggacgggcgcacacttgccgactacaacatccagaaggagagcaccctccaccttgttctccgcctcaggggaggcatgcagatcttcgtcaagaccctcactggaaagactatcaccctcgaggtggagtcttctgacaccatcgacaacgtc

SEQ ID NO: 35724 - DNA, 377 bp, Zea mays
  Clone ID: LIB3060-015-Q1-K1-A2
gacaacatcatggcgaggattccccaggttctggcgccgctcctcctcctgctgctccccgccggtctccgggagctgatgatcgaccgccggcccctgccggaaggcgctgccggcggcgaggtcctcctccacccgctggtgctggtgcccgggctgacgtgcagcgagctggacgcgcggctcacggacgcataccgctcttccgcgccgcggtgcggcgccatgaaggggaagggctggttcggcctctgggccaactgctccgacctgcccgcgcaccactacgtgcggtgcttcatggagcagatggccctcgtctacgaccccgtcgcgaacgactaccggaaccttgccggcgtccaaacgcgcgtgcg

SEQ ID NO: 35725 - DNA, 420 bp, Zea mays; identical to SEQ ID NO: 35722
  unsure at all n locations
  Clone ID: LIB3060-015-Q1-K1-A5

SEQ ID NO: 35726 - DNA, 343 bp, Zea mays
  Clone ID: LIB3060-015-Q1-K1-A6
cgcgtgcttacgagaaccgccactcctttaaatctcgaaggattttctgcggctaacccgttcgtggcgtgacccaatgggagaggcctcgccgtcgatcgccaaggacgtcaccgagttgatcggtaacacgccgctggtgtacctcaacaaggtgaccgatgggtgcgtcggccgagtcatcgccaagctcgagtccatggagccctgctccagcgtcaatgataggattggctacagcatgatcacggacgcagaggagaaagggctgattactccaggcgtgagtgttctgattgaaccagctaacggcaacacaggcattggactggcctttatggct

SEQ ID NO: 35727 - DNA, 442 bp, Zea mays
  unsure at all n locations
  Clone ID: LIB3060-015-Q1-K1-A7
ctctcattttcttcctcgtctccacctccttctctcctcctcgatacatccgagcacgccgaacgctgtcggaaggcacaaagcggcgagcggcgccgggcttcccctctctttctcgcccccgatctgcgccgatcggggcgaccgctctctggggacgccgatcgaaggtcgggcggcgatgcttccgatatacggaagcagtttctagttttcttcagttggtcgccacagtttccagcgctttcagccagttgtctaataacttgttgttgttgttgtacttaagattgacacgcttcgtgttgtaaagcattgccatgtttggggcatgacttgtttttgttgaaatcaattgacttccaaggggtacactaaatccttgatgcaacataataggatcaccgtactgtcttcctcagagaccttncaacttgggtct

SEQ ID NO: 35728 - DNA, 408 bp, Zea mays
  unsure at all n locations
  Clone ID: LIB3060-014-Q1-K1-H2
gagaattcttaattcatgagttgtagggagggacttatgtcaccacaaacagaaactgaagcaagtgttggatttaaagctggtgttaaggattataaattgacttactacaccccggagtacgaaaccaaggatactgatatcttggcagcattccgagtaactcctcagctcggggttccgcctgaagaagcaagagctgcagtagctgcggaatcttctactggtacatggacaactgtttggactgatggacttaccagtcttgatcgttacaaaggacgatgctatcacatcgagcccgttcctggggacccagatcaatatatctgntatgtagcttatccattagacctatttgaagagggttctgttactaacatgtttacttccattgtgggtaacgta

SEQ ID NO: 35729 - DNA, 399 bp, Zea mays
  unsure at all n locations
  Clone ID: LIB3060-014-Q1-K1-F2
atgcaatcgaaaaaaaagttagatacataagtatcatcangatgcactactggcctgggatctaacttgtacctgatgacgccttgtagtaactgctatcagtctgtgtcatgtacacaacctagatacaagcatgaatgagtggctacaactcgtactaacctgatggaaggagtggatacaactctgataccatcaacggtggtagcagcccctagctaggcggaggatcggagcctgtatcagaaatcgaaataatataagactgtcttcaacggatcacactgtcgctcccccacgctaaatttgggggctacagtgcacacgctagccgatcaacggctcacgctaccaggcgctctacgcggatgtgccccctaaccaacttctctctccccc

SEQ ID NO: 35730 - DNA, 424 bp, Zea mays
  Clone ID: LIB3060-014-Q1-K1-F5
gaaactgaagttgcactttgaggagagacgagatcatgaggaagcaatactcgcctgtgctctccttgtgcctgatggcccttgtcgtagctgctatggtctgtgtcatgtacaccacctcggcacaagcaggaaggagtggctacaactcgtacgaacctgatggaaggggtggatacaactctgttcccatcaacggcggtggcagcccctagctaggcggtggatcggagcctgtatcagaaatcgaaataatataagactgtcttcaacggatcacactgccgctcccccacgctaaatttgggggctacagtgcacacgctagccgatcaacggctcacgctaccaggcgctctacgcggatgtgccccctagccagcttctctctccccctcgttctgtggtgcctctctcaccctct

SEQ ID NO: 35731 - DNA, 64 bp, Zea mays
  Clone ID: LIB3060-014-Q1-K1-F6
actctgctaacctcaaaactacatacttattaacacatgaatttcaatcaacattttctgtctt

SEQ ID NO: 35732 - DNA, 381 bp, Zea mays
  Clone ID: LIB3060-014-Q1-K1-F7
atgcaatcgaaaaaaaagttagtatacagtaaacatcattaggaaccaatactggcctgggatctatcttgtacctgatggcccttgtcacagctgctatgatctgtgtcatgtacacaacctcgatacatgcatgaaagattcactacaactcgtactaacctgatcgaaagagtcatatacaactctgttaccatcaacaacagtgcgcagtccttacctatgccgacgatcgcaacctgtatcagaaatctaaatactataacactgtcatcaacgaatcacactgccgatccaccacactaaatttggtgcctacactgcacactctagccaatcaactattcatgctaacacacgctatactccgacttgcccaat

SEQ ID NO: 35733 - DNA, 429 bp, Zea mays
  Clone ID: LIB3060-014-Q1-K1-G1
ggccgatcgcctccgcctcgcgctgctgctctccgcgtgcctctgctccgcgtgggcgcgcccacgcctcgagccgaccatccgcctgccgtccgagcgcgcggcggccgacgaaacggacgacgacgccgtcgggacccggtgggccgtgctcatcgccggctccaacggctactacaactaccgccaccaggcggacatctgccatgcataccagatcatgaagaagggcggacttaaggacgagaacatcgttgtcttcatgtacgatgacatcgcgcatagcccggaaaatccgaggcctggtgtcatcataaatcatccccagggtggcgacgtctatgctggggtgccaaaggattacactgggcgagaggtcaacgtcgacaatttcttcgctgttctgcttggcaacaaaactgctctcag

SEQ ID NO: 35734 - DNA, 426 bp, Zea mays
  Clone ID: LIB3060-014-Q1-K1-G11
gggcaaggtcaaggaatggcatcaatcaaatagacaagaggccacctctaccggcgccatccgcagtccatacagtgacccccacgaggtcaagaacctgtacgaggagaggaaagaacctggaagagaggagcttgaggagatggcgagcgccgagggcgagaggtgggtgggactggcgacggacttctcgcaggggagccgagaggcgctgcagtgggcggcgaccaacctgctccgcgccggcgaccacctgctgctgctgcacgtcatcaaggagcccgactacgagcagagcgaggccatcctctgggaatccaccggctccccgttgattcccctcttggagttctctgaccctattatcgcgaagaaatatggagcaaaaacccgacatggaaaccttggacctcctgaacactacag

SEQ ID NO: 35735 - DNA, 424 bp, Zea mays
  Clone ID: LIB3060-014-Q1-K1-G12
gctcccgaaatccaaattgaaacagttgcaggcgattctgagctcgggtttggttccggggacggattcctgtgccggcggacgggatgtcaggccctctcgaccgatttgctaggccatgctttgaagggtttgtacataacgatgaaaggaaagagagcagatctgatgcagacaactcagaaggagataagaagactaagattgggtctttcaagaaaaaagcaattaatgcggggaacaaattcaggcattccttgagaaggagaagcaaaaaaaagaccgaaaggggggattccatcaaggacataagggacgttaaagagcttcaagatgttgagacattccgacaatgcttaattgatgaggatttgctgccaccacagcacgatgattatcacatgatgttaaggttcctaaaagc

SEQ ID NO: 35736 - DNA, 415 bp, Zea mays
  Clone ID: LIB3060-014-Q1-K1-G2
gcagatggaggcgaagagcaggctgccggaggtgaccatcgtcccggcggcgcggccgttggctggcgacggcacagtcgacgcggcaaaggcggcggcaggcaaggagcccgtaagcccgggcactccgtcctcggtggccgacggccgcagcagctgtgaggagaggcgcgcggtggacggcgtcgccctgcctgggtggaagctcgacgccctctgccaggagtcctgcccgtcgccggccatgagggcgcgcttcccctactacttctgaagcttcccgttgcagtcctgcgtgatcgagttcttgagcggcgacatctggtgcatgctcttgacgactgatggcgttcttgggtgttttccttgctcagggttttcctttcgtgcacgttcatgtatgaatgttagtatg

SEQ ID NO: 35737 - DNA, 428 bp, Zea mays
  Clone ID: LIB3060-014-Q1-K1-G3
ggagagtggtcttggacttgaacgtgcacacatgggtatcttcacagaattgggaggggtatgtgctagataccgctctgagaagcttatggagcacatcaaacttttctccacccgtctgaatattcctaagcttattcgagcttgtgatgaacaacagcactggaaagaacttacctacctgtacatacagtatgatgaatttgacaatgctgccaccacaattatgaaccactctccagatgcatgggatcatatgcagttcaaggatgtctgcgttaaagttgcaaatgtcgagctatattataaggcagttcacttctatttgcaagagcatcctgatctcatcaatgatatgctaaatgtgcttgcacttcgtttagatcataccagagttgtagacataatgcgcaaggctggtcagttgc

SEQ ID NO: 35738 - DNA, 416 bp, Zea mays
  Clone ID: LIB3060-014-Q1-K1-G6
cgagcggcggcgctcaggcgatcgagatagtgttctcggcgctggctcgtccggacggcaacagcttgctcccgaggcccggctacaagctctacgaggcgcgcgccgtgttcagcgggatggaggcccggtacttcgaccttgtacccggcgaaggctgggaggtcgacaccgacggtgtccgagctctcgccgacaagaacacggttgccgtcgtcatcatcaaccccggaaacccgtgcggtaacgtctactcctacgagcacctggccaaggttgctgagactgcgcggaagctcggcgtgtttgtcgtagcggacgaggcttacgcgcacttgacgtttggagagaggaggttcgtgccgatgggcgtgtttggggccgtggctccggtcatcacgctggggtccatttcg

SEQ ID NO: 35739 - DNA, 376 bp, Zea mays
  Clone ID: LIB3060-014-Q1-K1-G9
caccactccgcgctagctgatgacggttcagcggcacataggtgcgacgtacgacgacgacgacgtaggcgtcacacatggcatcctagttgtccgccggcgttccccggttccacgggctgcggggctacgccgcgcccaggtccgaggaggcagcgctgtcgtccgtgagggtgagcacgaagaggtcgacgtcgcagggcatgctgtgggactacatgggatccgccatcaacctgatcatggtgacgacgacgacgctgatgctgttcgcggagcggttcgggttggcgctgaccgggaaccgcaaggcgacggctgtgctgaagctggaggcgcgcgacttagggctgcacactggtgacgccgcctggtt

SEQ ID NO: 35740 - DNA, 422 bp, Zea mays
  Clone ID: LIB3060-014-Q1-K1-H10
gtggtttcttcgctggctctgccttggattcattgtgttcattgctgttgtttgggtcatacaagaatttacatctttccatattctgaaatatgtgatcttattcataggtgtgatgaacagcttattttcagtttacgatatttatgatgacttgatatcccgaagagttaacacaagtgatgctgaaaagtttgctgaaatctgcccttgcccctgcaatggttttgcatggggtgttatatggggattcatctcgtttatctttctctgcgcttcaatataccttggactggtcatattgtcttgagggttcgccattctgatctgacaatcgactctgattggctttttcgaagcttcgttgctcgaggttttggttcaagcttacatggttctggtggttgtacagtatacatgtg

SEQ ID NO: 35741 - DNA, 420 bp, Zea mays
  unsure at all n locations
  Clone ID: LIB3060-014-Q1-K1-H11
gctgccgctcgcgatatttgcgagagagagagaagagagggcccgagagccggggacgagtgcagtctggctggcgtgatgctgcttcggagcgcgtcctcgccgctgctcaactgcgggcgcgcgccggctgcggcggcgtcggtcgagcacctcgcggtggtttcgccgttgttgtcaccggcagtggcggcgcctaggcaggggccggtgctgtgccgcgccatgtccgagggggacctcgccgcgccgctcgtgcccaagaaggatgatggacacgggagggcgccgaggctatcggcgtccttgtcctcgtccgcctccatcttcgtcgaggaggacggcgagggcgaggaggaggaggaggacctgntcgcggtcgcggtcgcgggggccggcgtggacgtgccgctgccgctg

SEQ ID NO: 35742 - DNA, 367 bp, Zea mays
  unsure at all n locations
  Clone ID: LIB3060-014-Q1-K1-H12
acaccttaccatgacaatctttttttcttcgatattttctttcctcctgattacccccatgaaccaccttctgttcactatcactctggtggtctccgcctgaatccaaatctgtatgagtcgggaaaagtgtgcctcagcctcctgaagacatggacaggcactggtaacgaagtgtggaatgctgaaagctcaactgttcttcagctgctgttatcgcttcaggcccttgttctcaacgaaaaaccttacttcaacgaggcgggatacgaacaatttgtgggcaaggctgatggaaagaagaacttcatcacgtacattgagattgccttcctctgtcatgcanatccatgatgtatgttttacg

SEQ ID NO: 35743 - DNA, 326 bp, Zea mays
  Clone ID: LIB3060-048-Q1-K1-F2
ttgctggagtcacttgattaccaaggagctgatcagtggggccgtgaccaggggacctttgatgtggctggaccacctggtggtcctactggggctgaatggggtgcttgaacaacttccggtcctaaccgtgaatggtgggatcaaactgggggccctggtcctggggaatggactggttctccaagggtcggctcctactggttgggaatcagcaacccaagcccactgcccaaagctgggaataggcgttgaggcatcactttgagacgtcttgtgcgggattattccaaagtatgaatgcccgaagtcagacgacatatttt

SEQ ID NO: 35744 - DNA, 400 bp, Zea mays
  unsure at all n locations
  Clone ID: LIB3060-048-Q1-K1-F3
gcttcggtccacgcacccacccagccccaccagcggcagctccgacgccgcggcgatggtcgggggcggcgcggcggcgggcagcggcggcgcaccgagcggcgccaagctgctgcagatcctcaacgtgcgggtcgtgggcagcggcgaccgcgtggtggtgctgtcccacgggttcggcacggaccagtcggcgtggagccgcgtgctcccctacctcacccgcgaccaccgcgtggtgctctacgacctcgtctgcgccggcagcgtcaacccggagcacttcgacttccgccgctacgacacgctcgactcgtacgtcgacgacctnctcgccatcctcgacgcgctccgcatcgcgcgctgcgccttcgtcggccactccgtctncgccatgatc

SEQ ID NO: 35745 - DNA, 423 bp, Zea mays
  Clone ID: LIB3060-048-Q1-K1-F4
aaaaggcatcaccgccgcgacgacgatggcagcctcgctccaagccgcggccaccctgatgcagccggccaagatcggcggccgggcgccctttgcctcgctgccgtcccgcccgtcgtcgcaactcgcctgcagggcgttcggcgtcgacgccggcgccgccaggatcacgtgctccctgcaggacgtcgccagcaggtgcgtcgacgccgcgaagctcgccggcttcgcgctcgccacctcggcgctcctcgtctcgggcgcgagcgcggagggcacgcccaagaggctgacctacgacgagatccagagcaaaacgtacatggaggtgaagggcacgggcacggcgaaccagtgcccgaccatcgacggcggcgtggagtcgttcccgttcaaagccggcaagtaccagatgaagaagct

SEQ ID NO: 35746 - DNA, 417 bp, Zea mays
  Clone ID: LIB3060-048-Q1-K1-F6
ggcaccattcgcactctcctatcaattcaccagcaaaaatttcccagcgccggcctcgcggcagaccggcctccgtatcactgcgcaaccgatggcttcctccccgtggctgcgcaccgccggtgccgcccctgtcccgccgccagaagcagcagcagctgctgctaccgccgccgccacccccgccccgacgtcggagcaacaccgggttaaggaggaaggaaacgctgccgccgcgactgtaccgaagcaggaggaggccaagctccacttgccgcgggacaacgactcagaagcagtaacccaagagcatggacaaaaaatcaatagatatcaagcaatccttgcagcccgtctgaaggctaagtttttctctaagaaggcttttgacagagggaacatttttgaatcagaaac

SEQ ID NO: 35747 - DNA, 421 bp, Zea mays
  Clone ID: LIB3060-048-Q1-K1-F7
gccttctggcagttgctgttgtattttgcatcaaggataacattgcacaagactctgacttgtacaacatcttaagaatggtgtccttggttggtgtcgtggcttatgtcactgccttctccttcggtatgggttccattccttggatcataatgtctgagatccttccggttagcatcaagtgtgtggcaggaagcttcgcgacccttgccaactggttgacgtcctttggaataacaatgacagcaaatttgcttctgaactggagcgctgcaggtacatttgcctcctacatgacggtgagtgctttgactctcgtcttcgtcatcctttgggtaccagagacgaagggaagaacccttgaagagatacagtggtccttccagtgagctccggcattcatatgtacatgcaaatagcg

SEQ ID NO: 35748 - DNA, 374 bp, Zea mays
  Clone ID: LIB3060-048-Q1-K1-F9
cgcgacgacgatggcagcctcgctccaagccgcggccaccctgatgcagccggccaagatcggcggccgggcgccctttgcctcgctgccgtcccgcccgtcgtcgcaactcgcctgcagggcgttcggcgtcgacgccggcgccgccaggatcacgtgctccctgcaggacgtcgccagcaggtgcgtcgacgccgcgaagctcgccggcttcgcgctcgccacctcggcgctcctcgtctcgggcgcgagcgcggagggcacgcccaagaggctgacctacgacgagatccagagcaaaacgtacatggaggtgaagggcacgggcacggcgaaccagtgcccgaccatcgacggcggcgtggagtcgttcc

SEQ ID NO: 35749 - DNA, 158 bp, Zea mays
  Clone ID: LIB3060-048-Q1-K1-G1
cgtccggcaaaggattcagcacgccgcccgttgggaagggagcttcgaggccggccggtttggggggtccgcccggccggcttaaccggttgccccggcccttggggccccaaacccctaaccttggtcggggccggccggtagccaaagcccccggt

SEQ ID NO: 35750 - DNA, 328 bp, Zea mays
  Clone ID: LIB3060-048-Q1-K1-G10
aacaatagagcaacaatggggaccaggatatttgccatcgttatgggccttgccacttgcacatgcgtcgctaacgcgacaatgttcccacactgctcacagactgctatagcgtctccttctttgcacataccatccatcaattatagctacacaatgagaaaacccagatcttcaaccatataggctacaacaagcaatcgcagcaagcaacatacctgtatcgcccttgtagtatcaacaatcacacaccatatctactgggcacgcattggtacaaaccatcacggcacaacagctcgcacaactcatgctacctgcgatcaac

SEQ ID NO: 35751 - DNA, 411 bp, Zea mays
  Clone ID: LIB3060-048-Q1-K1-G2
cgccgtcgactcctcttacggaactctctctatcatctactgcctgcctccttccctgtaaacccgcatgcgcagcagcaccactacggtttgctcaggccccgaaccccacccttggattgctctgattccgaggcggctgttacccgaagtttgcagtatggcggggtacccggaagacaaccagcacgagttgaacgggtacgacgaggaggtcgacgaagaggagggacaccccgggaggcgggtaggccgggatgggggctctgggtacgctgatgctgtcagagaggatgggaagggggcgggtggcgactcgttgggaaagatttttgtcggaagcgttgcttgggagacaactgaagaatcattctccaagcattttgagaagtatggggcaataactgattc

SEQ ID NO: 35752 - DNA, 356 bp, Zea mays
  Clone ID: LIB3060-048-Q1-K1-G3
gcgtccggaaattgtcagggacatcaaggaaaaacttgcctacgttgcccttgattatgaacaggagctggagactgccaggaccagctctagtgttgagaagagctacgagctgcccgatggccaggttatcacaatcggtgcagaaaggtttaggtgccctgaggttctattccagccatccttcattggcatggaatctgctggcatccatgaagccacgtacaactccatcatgaagtgcgacgtcgatatcagaaaggatctgtacggtaatgttgtcctcagtggtggctccactatgttccctggtattggtgaccgcatgagcaaggagattactgcacttgccccca

SEQ ID NO: 35753 - DNA, 420 bp, Zea mays
  Clone ID: LIB3060-048-Q1-K1-G4
ccgcagtgcccctacccggacgcgtcgctggggccggcgctgcagacgggccagttcgacaacgtgtggatacagttctacaacaaccccgggtgcgcgtacgccaacggggacgacaccaacctggtgaacgcatggaacacgtggaccagcagcatcaccgcggggagcttctacctcggcgtcccagcgtctccccaggccgcgggcagcgggtacatcgaccccggcaccctgacgggacggtgatccccggcatccgaggcattggcaactacggcggcatcatggtgtgggaccgctttaacgacgtgcagaacaactacagcagccaggtgaagggcagcgtctgatgggcataccgcatacgaagctcaagctacagcacctagccatgcatatatatatagtggctattcg

SEQ ID NO: 35754 - DNA, 416 bp, Zea mays
  Clone ID: LIB3060-048-Q1-K1-G5
catacaatcaccttactggaacaataccatcctggattaacaggctggaactcctctgctttctggacatatcaagcaacaggcttacaggggatatcccacctgaattgatggagatgccaatgctacaatctgagaagaattctgccaagttggacccgaagttccttgagttacctgtattttggacacaatcacgtcaataccgtttgctcaatgctttccccaatgtattgaatctatgcaacaacagcttgacaggcataattccccaagggattggtcagttgaaagtgctcaatgtcctcaactttagcaccaacagcttatctggagaaataccacaacaaatttgcaaccttacaaacctgcaaactctagacgtatcaaataaccagctcacaggtgaactccca

SEQ ID NO: 35755 - DNA, 293 bp, Zea mays
  Clone ID: LIB3060-048-Q1-K1-G6
agacggctagccggcgcacggaagcggtcagcggagcggaggtgagcctctcctgcggcggattgtccccgcccccgcccccgctaggcgccatgaagctgacggtgaagaccctcaagggaacgcacttcgagatccgggtgcagcccaacgacacgattatggctgtgaagaagaatattgaagagatacaagggaaagacagctatccatggggccaacaactgctgattttcaatggaaaggtcttgaaagatgaaagtacattggaagagaataaagtcaatgaagat

SEQ ID NO: 35756 - DNA, 407 bp, Zea mays
  unsure at all n locations
  Clone ID: LIB3060-048-Q1-K1-G7
cggacgcgtgggttggcaggtggcttgtgctggtcggaaggcctattggtgcgagtgagcccagaggcccagggtttcgctgtcaccgcacacctcagcgagtctggtgccggcggctgtgacgaggacagcagcaatgcaatggcgagaggaactggaggacgggtaagcgagggcacgtgaagccgttggacgcagggtggaggctatacataacagcttgatacaattggaagaaagcattcggtcacctcaaggaagacgagccagttgtgagctccggaaccgaatcctcttcgaaggtggtaaccaggncgggtnccatccaagcacactgcaacgcgatgaagcaggccaacgcgatcagtatccggcttcagacgtgccgncgatcggaaagaaaaaga

SEQ ID NO: 35757 - DNA, 396 bp, Zea mays
  Clone ID: LIB3060-048-Q1-K1-F11
gtcttccgccactactactgctcgtcgcactcgccgccggcgccgccgccggagacctgcgacgcgcactagacctctcggccagggcgtcagctgggccgggcgtgcttctccggagaatctaacactgggccgtcacgaagcgcaggtgcaggcccagatgaaggatgggctaggctgtaatgcaggagattgagttgtgctctagagtgtactcctcctacctgtgtttccctctctctctctctcttttgtctttgtctctctaaagtgtgtacttctattttcatttaattttggtgcatttggtacggtagttgtgacgtgagtatgtatgttcgtcagtgtattccgtacataataataataataataatatgttgcctctttacctgt

SEQ ID NO: 35758 - DNA, 229 bp, Zea mays
  Clone ID: LIB3060-048-Q1-K1-H1
cgtccggtcgcctcgcatttaccactcactcactcactcgctctgcccttcaccccctctccttggtgctccttccatctcgatctcggactctccttcgcacgcatcgcaccgacggacgcagagcatggtcgcccgccgtcccaccacccgcgcgcggctcttggcgccgcatgccgctctcgcccttccgcgccgccggcggcttgccccggcgctgcccgcgcgc

SEQ ID NO: 35759 - DNA, 413 bp, Zea mays
  unsure at all n locations
  Clone ID: LIB3060-048-Q1-K1-D4
gcgtccgaagaagacgagtgtcaagtgaacctgaaacttgcggtgtcactggctggtagcctgagtgtgagtgagtgatcgagctagctgagctccgatcctcgctagctaggataccgccataccacaagtcttcttcacaagtttaggagtgacagcaacaagagatcgatggcctctgccaccgtgctcaagtcctncttccttcccaagaagtccgaatggggcgccaccaggcaggccgncgcgcccaaggccgccaccgtctccatggtcgtccgcgccttcgnctacgccgatgagctcgtgaagaaccgcgaaacgatcgcgtcggccgggccgggcattctggcgatggacgagtccgacgcgacgttgcgggaagcggctggcgtncatcgggctggagaaca

SEQ ID NO: 35760 - DNA, 299 bp, Zea mays
  Clone ID: LIB3060-048-Q1-K1-D5
gtccgttcaaccagcaaagtgagtgtgatcgatcacacactgcacacactgccatgactttcgtgggcaatgaggactagcatgagcggcagcatcacatggaggaggaggtggtccaaggagatgtgcgagtcgtcgtccagcagtagacgtcggcagatcgataggcctagtcggcactggtgcgcaagatctccggcctgtccggcgccatcgccagcctgtcgtcgttgagcccgtctgcgcaggttaactcgctattgacacacgtcctgtcgggctgcattccgcgcagcacc

SEQ ID NO: 35761 - DNA, 381 bp, Zea mays
  unsure at all n locations
  Clone ID: LIB3060-048-Q1-K1-D6
gtcggccatatccctggtggccgacctctcccgtgccccagccacagcttccccttcggccctgctgctgcaagcactcagcctctcctatggcacacggtgctcgtccagcccctttctactggtgtttgcgtcatctccctggtgctcgacgaaatgaccatgaagagttttgcgttgtgtgcagccccacctgcgacaccgtcgacccccggtgaggttttgttctcgccctgtcgttttagcgctcgacgtcaattactattgtgtgtgttgatgagggagttaaccggtaaagaagcgaggtccgtgcgacgtttggcaagtgttcgatggaaggtccgaaccgggaacctngcctttctcgcggatcttcgggtc

SEQ ID NO: 35762 - DNA, 320 bp, Zea mays
  Clone ID: LIB3060-048-Q1-K1-D7
aacaagagtactcacactagttggatgtatatggccccaaaggacgatcatgatggggatcttcacaaggaggaggaggtggtccaaggagatgtgcgagtcgtcgtccatcaggagacgtctgccgactaggaggccgagtcggcactggtgcgcaagatctccggcctggccgcctacatcgacatgctaccgtcattgagcccgtctacggaggttaactcgctcttcacctacctcttcacgggctgcataccgtgcagtaccgtggacgtatagcgtctgggcccggagctgcagcacatgcgcgcgggcctcat

SEQ ID NO: 35763 - DNA, 389 bp, Zea mays
  Clone ID: LIB3060-048-Q1-K1-E1
agacctctgagggtgaactgcgggccaccgtcacctagagatggatccgcaccaagagcaccaaggggtggtggtggtgggggtggttgtggcagatgtgtcgattcatggaacaaggtatacgtgtgtaaccttgcttggtgcagtgacaacttgactctggagaacctattcagtgagcaatgactggtgctggatgctaaggtcatctacgacagggatagcggctggtcaagggggtttggtttcgtcacctatggctctgccgaggaggtctacaatgccatatcaaaccttgatggcatcgacttggatggtagacagatccgagtcacggttgcagaatcaaagcccaggcgtgaattttgagattttgttaacgtggtttt

SEQ ID NO: 35764 - DNA, 253 bp, Zea mays
  Clone ID: LIB3060-048-Q1-K1-E10
ccggacgtctcacagcggagctacctttttcgtgcacaagatgaccaacggggaaggggtgctgggacgaggaacgctcctcacccatgccatcccagaccagaagcacgccatcgaggaggagaacctccccgagtgcacgctctacatgcacatccatcgacccaatatcaatcagcaggctctatgacctggacctcgctcgacggaacacaagatgctgcgcaaccacgccttcagttatccatgtcgt

SEQ ID NO: 35765 - DNA, 425 bp, Zea mays
  Clone ID: LIB3060-048-Q1-K1-E12
gtccgcggacgcgggcggtaaagcaaaaaccttcaggttagctagctagccacgcgcacgcggatcagcagatgaagctgttcgccttcgtgaggcgcgcgcgccggccgccgccgacggcgcccgacgacgacacagccacagccgccgccgctgcgaccacggagaagcggcgccggaggctgtcctcgtcttcgtcgtcggggtcggcgtggaagccgacgctgggcgccatctccgaggacgccgccatgacgtccgcgcccgtggcgcatgcgaaggcagcagctgcgccggccagggccaaggcgaggtcgcctcgccgtgccacccgggcggccggctacgacgacttccggcactacggccacccgacggtgctgccggccttcacgccgacggcgttcctgttctgagcggtggcg

SEQ ID NO: 35766 - DNA, 256 bp, Zea mays
  Clone ID: LIB3060-048-Q1-K1-E3
tctcaatcggaggcttccttcagggttcctagctactgacttacgtaacctctacaccataaaactggattcggctgacggctaacgcagagggccatctccatactagacggtctacagcgactcggaccatggaccgcacggtcttaaccgatgcctctcggtccaaactggatcaccactcaggcgtatcttgcactgacgtcgtgattgacaacgacacctgcctataccggcctatggacctaaaaatcga

SEQ ID NO: 35767 - DNA, 298 bp, Zea mays
  unsure at all n locations
  Clone ID: LIB3060-048-Q1-K1-E4
cgcgtccgcagatctccagctagcttccttgctacttactcccctacccgctgcaccctcgccatggatccgccgagctccgatatcgtagtcgacactccatacttccgcatctacagtgaccggcgcatcgaccgcttggtcggcaccgataccgtgccggcgggctttgatcccaccaccggcgtcacctccaaagacgtcgttgtagacagcgacgccggcgtctacgttcgcctgtacctnccggacacggctacggggtccgatgattccaagaagcttccggggctagtct

SEQ ID NO: 35768 - DNA, 422 bp, Zea mays
  Clone ID: LIB3060-048-Q1-K1-E5
gctcattgcaactgctagcaccaagggtaacacttgttagaatctacaatgcagctgagggcaatctcttgcaggaagtaaggagaggtgctgatagagcagaaatatatagcttggctttctcgaatttgcagtatttggctgtgtccagtgataaaggaacaatacatgtcttcaatctaaagataaatgtgggatcgactgcaaatgataaacctatacctgctccagatcctgaagtttcgcatataagcccccctctttcgttcattaagggtgtgttgccgaaatatttccactctgagtggtcagtagctcagttcaggctccatgagggggagcagtacattgttgcatttggacatgagaagaataccgtgtcagttgttggtatggatggaagcttctacagatgtcaattt

SEQ ID NO: 35769 - DNA, 369 bp, Zea mays
  unsure at all n locations
  Clone ID: LIB3060-048-Q1-K1-E6
gtccaagcacatcgacacacacgagcacagaagagaaacgggcacacgcaactgatcaaggcaaccaatattcaccgtcggcaatgggcgacctgatccctgggctgccggatgaagtggccagggagtgcctcgtccgggtgggcttcgaccagctgccggtggtgcgccgcatctcgcgccagtggaagtcggaggtggagtcgccggactaccaccgncagcgccgggcggaggggctggcgcgcccggtgctcgcgctggtccaggcgcagncgacaggngccgccggatgacgacgacgacgccggccccgggcacaagcgctcgacggcggccaactcgtaccggctggtgctgctggaaccg

SEQ ID NO: 35770 - DNA, 111 bp, Zea mays
  Clone ID: LIB3060-048-Q1-K1-E7
gactaggttcaatgatgaatcgatcgaattcgcttgggttagctttattattgttgcggctattattaattcgactcgctatagtgtgtaaaaaatgatacagaaccaact

SEQ ID NO: 35771 - DNA, 386 bp, Zea mays
  Clone ID: LIB3060-048-Q1-K1-D3
gaccagcaaagtgagtgtgatcgatcacacactgcacacactgccatgaccgtcgtgggcaaggaggacgagcaggagcggcagcagcacaaggaggaggaggtggtccaaggagatgtgcgagtcgtcgtccagcaggagacgtcggcggacgaggaggccgagtcggcactggtgcgcaagatctccggcctggccgccgccatcgccaggctgccgtcgctgagcccgtcgccggaggtgaacgcgctcttcaccgacctcgtcacggcctgcatcccgcgcagcaccgtggacgtggagcgcctgggcccggagctgcagcgcatgcgcgcgggcctcatcccgctctgcgccgacgccgaggcgctgctggaggcgcacta

SEQ ID NO: 35772 - DNA, 374 bp, Zea mays
  Clone ID: LIB3060-048-Q1-K1-E9
agaccaacgggcaacatagaaagtggtatccattatcaacaatagagcaacaatggggaccgggatattttccctccttatgctccttgctctttctacatgtgttgctaacgcgacaattttccctcaatgctcacaagctcctatagcttcccttcttcccccataccttccatcaattatagcttcaatatgtgaaaacccagctcttcaaccatataggcttcaacaagcaatcgcagcaagcaacatacctttatcgcccttgttgtttcaacaatcgccagtcctaactttggtgcagtcattggtacaaccatcagggcacaacagctgcagcaactcgtgctacctctgatcaaccaagtagctct

SEQ ID NO: 35773 - DNA, 304 bp, Zea mays
  Clone ID: LIB3060-048-Q1-K1-F1
cgtccgggcccagcagcaagggcggcgccgacgccgaccccgaccccgatccggcgggcaccgtggagctggacctctcggcgctgccgggcggcgccgacgcgttcgacaaggcggcgcgctactgctacggcgccaacttcgagatcacgccgcgccgagccggccgtgctggccgcggcggcgggggcctacgcggagctcgtcctggccgaggtcctcgcggcgccccaggaccgcgcggaccaccgcgcgctgctcgagtccgtggtcgacgtgctgccctcgcccgccgacgcgcccg

SEQ ID NO: 35774 - DNA, 419 bp, Zea mays
  unsure at all n locations
  Clone ID: LIB3060-048-Q1-K1-F10
gcggcgcggagtggataggcttgcactctagcttcgtcctcgtggtggcggtcctcggtgtgggggcgtccttcatccccttctttgggtccttcatctcgttcgtcgggagcaccatgtgcgcgcttctctcctttgtgctgccggctctcttccatctcagcattgtaggctcgtcaatacccttgtggaggcgggtgctggactacggcatccttctctttggtctggctttcgctggatatggtcttgtcactgctctctcctcgcattgaacaatggcccaaacagtcaaaaaagtgcagagatcacgatatcttgtgatgacaggagtcaaatggatgctaggagcaccatatatcanatagcccggctcggattagtgcgtgattgaactgatccgcttcaacccatatagc

SEQ ID NO: 35775 - DNA, 434 bp, Zea mays
  Clone ID: LIB3060-048-Q1-K1-B4
gacctacgcgtccgcggacgcgtgggcgccaatgagtccaggattaaggagaacattgacatatttggctggtgtattcctgaagatttgatggccaagttctctgaaatcaaacaggtcaggctgctgacagctgagtttgtagttcaccctcaggccggctacaatacattggaggacttttgggatggtgaaatataaaagcatacaaatttgttcagaataaaagagccaggcgaggaaacaaccacaaaaaaggggagatcgaatgcataggccccagtacgatgaatttgggggtttacgtgattgctgaacacaagtattgtgtgactaatctgtgttttgatgtggtaaatgtaaatgggttagtcacaataagagataagtgtctttgccacaagacttttggtcactagatatgggcccgtgcg

SEQ ID NO: 35776 - DNA, 412 bp, Zea mays
  Clone ID: LIB3060-048-Q1-K1-B5
gcgtcgcttcgaggggccactttggccacacctgctccgccgtcgtcaagaagggcgagcacaagggccataccgtcgccgtcaagatcatgctccaaagctaagatgacaacggccatttccattgaagatgttcgtagggaggtcaagattttgaaagccctatcagggcacgatgatctcgtcagattctatgatgcatgtgaggacgccctcaatgtctacattgtcatggaattatgtgaaggtggagagttgctagacagaatcttagcacgaggtgggagatatacagaagaagatgccaaagcgatcattgtacagattatgagcgtagtggccttctgtcatcttcagggagtagcgcatcgtgacttgaagccagagaattttctgttcacaacacgagatg

SEQ ID NO: 35777 - DNA, 230 bp, Zea mays
  Clone ID: LIB3060-048-Q1-K1-B6
attcccaccgtctctctaaccaccatcagcgccccagactcccccgccctgaaatcctccaccgcgtccagcctaaaacctcatctaccaccaccacgcctcacacgccttggtcttcgtctccctaaccgcacccttccaatgacagtgctctagccaatccgcgcatcctccctgcatcttcaccggtcgtcaccctaaccgcgcccttccaacgactaggtcgctac

SEQ ID NO: 35778 - DNA, 388 bp, Zea mays
  unsure at all n locations
  Clone ID: LIB3060-048-Q1-K1-B7
agagagctgacaaaaatcgactggccatcaatggctctggcgccggcgcctctccagtgcttcctggacgggcagcagcagaccggtgtgcacggtcacggcgacgccgcccaagcacgcgaggaggccgtcgaggatctcgtgcagggcgtccggcgatgacaaggacaaggtcccgtcgggagggaacgatcttggggtcaagcagctcgggaagctggccatggtcgcgctggccgccggcgtgctggcgctcggccccgtcgacggcgccgttgcggccaagtccggcggcagggtcggcgggcaggcgttccggtccgcgccccggtcgttcggccctcggatcaacaactncaggacgaacatctacatcaacccgncggtg

SEQ ID NO: 35779 - DNA, 372 bp, Zea mays
  Clone ID: LIB3060-048-Q1-K1-B8
actgttcattggataaattatacaaagagcggtatttaaaggctggaacctctttcacttgcaggctattcttaatcagaagggggatgttcaatacttcattggggttcaattggatggaactgagcgtgttcgataggctgctgcaaaagatggtgccatactggttaagaaaactgcacacaatattgatgaggctgcaaaggagcttcctgatgctaatttgagacctgaggatctatgggctaatcactcaaaaccagtcttgccaaatccacatatgaacgatactgcatcctggagagccatccaaaaggttcttgaaaacggttaaagcatttatttgaaacatttcataaccattaagccttt

SEQ ID NO: 35780 - DNA, 419 bp, Zea mays
  unsure at all n locations
  Clone ID: LIB3060-048-Q1-K1-B9
gccacagcttgcgcccgcaatggcactcgtctccgcctcctcgtcctccaccaccggcgtcacggcgctccccaggaatgggcagcgggcgtcgtcctccttcctcggcggcaagacgctgctgagacaggccgaggcggcccggccgtcgttcgccgtgcgcgccgcggcggaccccaacaggccgatctggttccccggcagcacccctccgccgtggctcgacggcagccttcccggcgacttcggctttgatccctggggcctcggatctgacccggagagcctgcggtggaacgtgcaggcggagctggtgcactgccggtgggcgatgctcggcgcggcgggcatcttcatcccggagttcctgaccaagatcggcgtcctcaacacgcncttctggtacaccgncggcgagc

SEQ ID NO: 35781 - DNA, 229 bp, Zea mays
  Clone ID: LIB3060-048-Q1-K1-C1
cagcgagagacgggcaggggagaggataaagggatctaaccctagcatgcgcagcgctggggttcgggggttgcgatggcggcggcggcgagacagcgggggacggtgaagtggttcaacgacaccaagggcttcgggttcatctaccccgaggacggctgcgaagatctcttcgtgcaccagtcgtcgatcaagtcggacggctatcgctcgctcgcggagggcgagg

SEQ ID NO: 35782 - DNA, 421 bp, Zea mays
  Clone ID: LIB3060-048-Q1-K1-C10
cagttcttgaaccctacaggatccaactggcattcgcagcaggcatcttacctttatgacccgtgttcctgcaacaaccgtcagccctattacagcagttacctttggtgcatttgttggcacaaaacatcaaggcacaacaactacaacaacttgtgctaggaaaccttgctgcctactctcagcaacagcagtttcttccattcaaccaactggctgcattgaactctgctgcttatttgcaacaacaactaccattcagtcagctagctgctgcctacccccagcaatttcttccattcaaccaactggcagcattgaactctgctgcttatttacaacagcaacagctaccaccattcagccagctagctgatgtgagcccttgtgccttcttgacacatcaacagttgttgccgtt

SEQ ID NO: 35783 - DNA, 398 bp, Zea mays
  unsure at all n locations
  Clone ID: LIB3060-048-Q1-K1-C11
ctcagttggaggcttccaagagaggttctgaagcaagtgtgggatttgtctgaccaagacaatgatggcatgctttctttgagagagttttgcatcgctctttatttaatggagaggcaccgagctggaattcctcttcccctagcccttcctgactctcttaggcatgatgagacactgttacgagctacaggcttgccttcaacagcatacaatagtccatcatggcaacacaatcaaggaggattaccacaaagaggccctggagcacctgnggtgcctgctggtggtgtgcggccacccttgccatcacatttgcattcacaaactgacggagctagcagaccagggcaaccaagatctcacatgcctgggatggataatcatgtggtaattca

SEQ ID NO: 35784 - DNA, 330 bp, Zea mays
  Clone ID: LIB3060-048-Q1-K1-C2
cgcgtccgtagataaccaaacagaagttactgttcagctgataaattatacaaagagcggtaagaaattctggaacctctttcacttgcagcctatgcgtgatcagaagggtgatgttcaatacttcattggggttcaattggatggaactgagcgtgttcgagaggctgctgcaaaagatggtgccatactggttaagaaaactgcagacaatattgatgaggctgcaaaagagcttgcggatgctaatttgagacctgaggatctatgggctaatcactcaaaaccagtcttgccaaagccacatatgaaggatactgcatcgtggag

SEQ ID NO: 35785 - DNA, 324 bp, Zea mays
  Clone ID: LIB3060-048-Q1-K1-C3
gtccgtggacgcgtgggcggacgcgtgggcatgggtgttggggttcttgtatccctgctagtgatgaccctctcccacagccaccaagtctgctctgtccagagaatcaagtgccagtggtgaccatgctcacaattctttaccccaccatagccagaacattctagggagttgctggcctatatgaagcttgttccataatcatctcagaaaacggagaagagggtgaagtgactgaagaaaagacatcaccacctttggaatctcaggcagagacttggctctacttcgacatctgcgagtccgagcctgactcacctacta

SEQ ID NO: 35786 - DNA, 397 bp, Zea mays
  Clone ID: LIB3060-048-Q1-K1-C4
gcgtccggcgccactgtccagtgcgcgcgtcaagcttgcttagctagccgccatggcctccctcgccgccgtctccgtgaagcccgtggccatcaagggtctcgccggcagctccatctccggaaggaagctcgccgtcgccaggccgtcggcccgctccatccgcaggccccgcgcagccgccgtggtggccaagtacggcgacaagagcgtctactttgacctcgacgacatcggcaacaccaccggacagtgggacctctacggctctgacgcgccctcgccctacaacccgctacagagcaagttcttcgagacgttcgcggctccgttcaccaagagaggtctgctgctcaagttcctgctgctgggcggcggctcacttctggcctacgtc

SEQ ID NO: 35787 - DNA, 368 bp, Zea mays
  Clone ID: LIB3060-048-Q1-K1-C5
gtccgttcaggttgacgctgcgcctgaagaagcaggagctgaagaggatgaggaatgttttagtgatacatggacaactgattggactgatggacttaccagtcttgatcgttacaaaggacgatgctatcacatcgagcccgttcctggggacccagatcaatatatctgttatgtagcttatacattagacctatttgaagagggttctgttactaacatgtttacttccattgtgggtaacgtatttggtttcaaagccttacgcgctctacgttaggaggatctacgaattccccctgcttaatcaaaaactttccaaggtccgcctcacggtatccaagttgaaagggataagttgaacaagt

SEQ ID NO: 35788 - DNA, 416 bp, Zea mays
  Clone ID: LIB3060-048-Q1-K1-C6
acggcgcacatcctggtggccttatgaagagaaggaaggtcgtggagcacatcatcgtgctcagagccaagcccaacatctcagacgctgaagagaaagacatgctggactacctatacacatcgcagtaccagatgcgagggatactcgcggtctcgctaggccgcatcgaggaccccaacagcgacaacttcacgcacgctgtgttcatgcgtttccagcagaagcaagacatcgcggagttccagagtaacgcgtactactccaaagttgtcgacgagcacgtaaagcccgtttcctatggctcggtttctgtagatttcgagtccgaggtggaagacgacattatacctctctttcgcaggggagaggattttaactacggcgtcgagtttatgctgctggtgtctttcttg

SEQ ID NO: 35789 - DNA, 186 bp, Zea mays
  Clone ID: LIB3060-048-Q1-K1-C7
ccacgacatgcgccgccaccgtctgcaccacgtgcaacacgaggtggaggaggaggctgccaccgtcccagagacgacagggagtatgggcatgaagcggtaccggttccacttccaccaccacgacgacgaggacgaggagaagaatatggctgcgagggaagcggtcctgcaagctgatgaaca

SEQ ID NO: 35790 - DNA, 324 bp, Zea mays
  unsure at all n locations
  Clone ID: LIB3060-048-Q1-K1-C9
atcttggcctcgtcaatccaccaccaccgtcgtcgctgagctcctcctccggcttcgcttcgctgtcttgcctcctcctcggtcgaagaagaagaagaagaaaacatgtgtccgggatccgtggagtcgtcgtcggcggcggcggcgggcaagagcgtgtgcgtgatggacgccgcggggccgctgggccacgcgctcgtggaccgcctcctccggcgcgggtacaccgtccacgccgncacgtacgcccgcgaccgggaaggaggcgctgccnnnngctggcacggccgacagccggctgccggtggaggacgagcgggtgct

SEQ ID NO: 35791 - DNA, 258 bp, Zea mays
  Clone ID: LIB3060-048-Q1-K1-B2
acgcgtccgcggacgcgtgggttcctcctccaccgcgtcgcgccaaaaacctcggccgcaccaaaaacgtccatcgcggccgattcccaccgcctctgtagccggcatcagcggcccaaactcgcccggcctggaatcctgcaccgcgtcgcgccgaaaaccttatcggccggcaacaagccggacaagccttgggcttcgtcggcctaaccggaccctttcaatgaccgggcgctagccaaacccggcaatcttcct

SEQ ID NO: 35792 - DNA, 258 bp, Zea mays
  unsure at all n locations
  Clone ID: LIB3060-048-Q1-K1-D2
gcgtccgccgcccgtcgcctccagatacgtgccttcggcggaaaatcggtatcgagctcgctttggtcgagtgagtaacgcgcagcgactcctctcccaaccagattttgatggatttcgggcacgcgtggcacaggcacggatatgttagcggatcgggcggccggatcaccgncggcttgctccctctcctcatgattgggcgcgctcatatccctcttttttttttctgcgcacggagactaggttggctcttcg

SEQ ID NO: 35793 - DNA, 317 bp, Zea mays
  Clone ID: LIB3060-014-Q1-K1-D5
ctagccctttgtcatccaaggtaaacaataaacaaccggcgcttttacacccgcgccaggaacaggagcaacaacaacaaggctcctcgcaacaatccattctcatccatggcgaagctcatgaacaagttggtcgattcgttcgagcacgacgagataccggacgtcggctgcgtgcgcgccgtgctggccgagctcgtcctcaccttcctcttcgtcttcaccggcgtctccgacgtcatggccgacggatccgacgggaagcccggcgacgctatgccgatggcgacgctggcagcgggggctatcgcgcacgc

SEQ ID NO: 35794 - DNA, 399 bp, Zea mays
  Clone ID: LIB3060-014-Q1-K1-D6
ccaagccttccgggggtgggtaatgggcctaatggcagggtcaggacctgaaaatgtggaaggctttacggaaccgcagtttcaaaagcttagggaaataaaaccaaagaaaagcagaacccagcggaacgcgcttgcctccgtgctgcgcctgcagaggaagatcatgagaactatcaaggagagcatggacgagcttaacagccagcgcaaaagcatctggtggagccggtggataccccaggaggaataaggcggccggaagcgcacatgttcattggtcaactctggatgaaacgttacctattaacactggtggaatggtgattggattattccactatcctactaactgctttgtacatgctgacaactggggagtaaaattcatttgaaaaa

SEQ ID NO: 35795 - DNA, 413 bp, Zea mays
  Clone ID: LIB3060-014-Q1-K1-D7
ggggaaaacccaaaaccctagcaccccccggccccgtcgccgacggccgccagagtggatagatggcggtggacgaggtgaactcggtctacgtcggtggccttccctacgaggccaacgaggagatgcttcgcgacgccttcgggtactacggcaccatcgtctccgtcaaggtgattaatgatcatgctgtcaaaggcaagtgttatggttttgttactttcactcaccccagagctgctgagcaagcaattgcgggcatggacggcaagaaattaggcaaccgtattgttcgaggtaaatgaagtgcgtacaagaggcccccgcgaatttggcccaaaatgttttcagacgagatccaaggaggtatggtagagatccatactgggacagaagggacagggaacggagct

SEQ ID NO: 35796 - DNA, 420 bp, Zea mays
  unsure at all n locations
  Clone ID: LIB3060-014-Q1-K1-D8
ccgggttggcccaagccgtccggttcccccttccttgcctccttccccggcgccccgctcttcctccttccgctccgcggcggccggcacgccttcctctcccctccgccgccgagcctctgcggcgcctaccacaagacacaactcccagctcaaatgctccatcaagccctcgcagttcgagctgcggcaccgcgccgcgggtctcgctccggcgcgagctctgctccctgaccgcgtcacgccgttttccttcgacgcggacggcgacgaccatccccgagaggagtgcggcgtgttcggagtcattggcgacccagacgcgtcgtcgctctgctacctcggcctgcagaagctgcagcaccgcggngaggagggcgcgggcatcgttgcgtcggacgccgacggcaagctcaatgc

SEQ ID NO: 35797 - DNA, 349 bp, Zea mays
  Clone ID: LIB3060-014-Q1-K1-E1
actgccggcaccgctgctagcttgctagcatacttccggtcggcaagcagtcgatcgtcgcatggcgccaggaggcagcggcgagcggtggagcctggccggcgcgacagcgctggtcaccggtggcagcaaggggatcgggcaagccgtcgtggaggagctggccaggctcggcgcgcgcgtgcacacgtgcgcccgcagcgcggcggacctggaggagtgccgccggcggtgggccgagaaggggctttgcgtcaccgtctccgtgtgcgacgtcgccgtgcgcgccgaccgggagaagctcgtcctggacacggtcagcgcggccttcgacggcaagctcgatatc

SEQ ID NO: 35798 - DNA, 469 bp, Zea mays
  Clone ID: LIB3060-014-Q1-K1-E10
accggttctcggaatctcccggctgcagacgatgcgcgttgcatgataaaataacctgcgtcactctctgaactttcgttcagtcagctcatgcccatgcatggagcagatgaccatgatacacgatgttatgactacatactcctacttacactacattgatatatcgcacttatctcgattgccgatatgctggacgtgcgctacactctacatgctgacatttctaataacgtcctgccagccttacggctaagtgttgcatacagctaatcgcaccaaagcgtacaaaacacgagtataccaacggcgccgacaccgaagcttggacccaacgtgaacgccttgtttgcccgtgtaccgaaccgaggacctgcaaacccaggcccttgcgatggtccagcgccgttggcgccaaaggctacaatgccgatctcctcgacgtccaatacggctgcctcaatttcaa

SEQ ID NO: 35799 - DNA, 390 bp, Zea mays
  Clone ID: LIB3060-014-Q1-K1-E12
cgttcggctcgatccccgcactacagcgcccgccaccaaccccgcccgcgcgtgcgctactaaagccgaggcctcacccaccacctgaccaccatgctcctccccctcctcagatcccacccgctcctccaccacgccgcgcgcctgtcctccccacgcacccgcctgctcctccgccgcgacgcaatcccgctcgcacgctccccgcctatccgcatggcggcctcgtccggctccggcgccagctcccctgcctcggcgccgccagctgccgtggtgcacaagtcaaagatcaaattttgccctgcttgtggaagtccaacgaaactggccatacctgatggcgatgagaagatgagggctggttgttcttcttgtggaaagagtcac

SEQ ID NO: 35800 - DNA, 428 bp, Zea mays
  Clone ID: LIB3060-014-Q1-K1-E2
gctccgtaaaccagagagtacggccgaccagaccaatggcactgcggctacccatctgctcgacccacgggctggcctcctcgccagcgcccatctcctccacgacgacgtgccggccggccgccgccagtgggagcttgatcccgccagctgccctgatcgcagttgccatccgctgggcgtcggcgtcggcgtcccaaaagaggggcctgctgctgacgacggcgaggggcggcggagtcgcgccggtgaggtcgagcgggatcgagacgacgtcgacctcggtgggagctgaggccgtcaccgggcaggtcacggaggtcaacaaggacaccttctggcccatcgtcgaggccgccggcgacaaggtcgtcgtcctcgacatgtacaccgaatggtgcgggccttgcaaagtgatggctcccaag

SEQ ID NO: 35801 - DNA, 272 bp, Zea mays
  Clone ID: LIB3060-014-Q1-K1-E3
ctacaagttcccatatgtactgcaccacattcgtttgtcagtaccgaagcatgtaaacgcatatgcagaagtgagaccgtgtggtatctgttttgtacctcttcgcttcaggaaattttggcctgtatcttgaccatctgagatgtattgatagagttgggtaatgctgttgggcgtatgtgtatttcttgtgcggttgtgcctgacttctcttgccggggcactgaataatcggccatgtttgaataaagaaagccggtatggttctcatt

SEQ ID NO: 35802 - DNA, 355 bp, Zea mays
  Clone ID: LIB3060-014-Q1-K1-E4
ccgacgcgtacggcagaaggctcgcgtttcgattgacaccaccgactccacgggtgagcgactacgacgaactggacgactcaccaacctacatgataagtacgagcaccgtcaggaggtaccaactctatgtaaaaagaatagcacgacgtatcgatcacggagaaaacatctgaaaaacctaatatacgccaccgaccaagctaggagctacgccatctataacgcggaacaacagaatcaagaactggactccaacttacatgtcttcatcaaacccatgacccagatccaagtcaccggaagcttatagatctacctcccaaatcatcactgaccaaagtacccgtccaaa

SEQ ID NO: 35803 - DNA, 421 bp, Zea mays
  Clone ID: LIB3060-014-Q1-K1-E7
cccacgcgtccggcggaaggcgcgggtgccgcttgacgccgccgactccgtgatggagccactacggcggtccggccggctcgccaacctccccgataagtccgtgcaccgcgaggaggttccaactttttggagaaagattaggaggacgtatggatcagtgagaaaagatctggaaaaccgggtgtacgcgaccgacgaggcgaggagctacgccatctgtaaggcggaagaagtggagcaagagctggactccagcttccccgtcttcatcaaacccatgacccagtcccatgtcaccggaggcttctggctgggcctcccaaatcatttctgccggaagtacctgcccaagcgtgacgagacgatcaccctgctggatgaggatgacaacgagtcctacacgctatacctcgcattg

SEQ ID NO: 35804 - DNA, 425 bp, Zea mays
  unsure at all n locations
  Clone ID: LIB3060-014-Q1-K1-E9
gtcaccccaaagctccgcctccgcaccttctctcactcgcccagccgcggctatggcggccaccacatccacggcggcggcggcagtatccttctccctcccctcaccaccgcactgccgcggggcccggcgccgccgcgcgccttccctcctccgtgccgcctgcaccgccgcgcccccctcccccgacctctccatccagctctcgccccgcgcgtccccgcccgcgtctaccaacggcgccgtcaccgcgcttggaccccccgtgtccgcctcctttgcccgtgaccgcgccgaggacctgcaggccgaggcccgcgcgatggcccgcgccgctggcgccacagtctacagtcccgagctcctcngccgccgctacggctcccgccccttcaaggtggcgctccgggcaggggacgtgctga

SEQ ID NO: 35805 - DNA, 451 bp, Zea mays
  unsure at all n locations
  Clone ID: LIB3060-014-Q1-K1-F1
ggaatcccggcgatctnatctcgaccgtcgctcaccgggaagctacgctacgacgaagcatggcgtccgtcaccggccgcgcgccggtcgcagccctgcgcccgtcgtcgtcgtcggccttccttggccactctagccgcctcggccgcactgctaccgcgtcgccgacgaggcggagcctcaaggcggaggccaagggcgagtggctcccgggccttccctcccccgcctacctcgacggcagcctgccgggtgacaatggcttcgacccgttgggcctggcggaggacccggagaacctgaggtggtacgtgcaggcggagctggtgaacgggcggtgggcgatgctgggcgtggccgggatgctgatcccggaggtgctgaccaaggccgggctgatcaacgcgccgcagtggtacgacgccggcaagtcggagtacttcgcgtcgtc

SEQ ID NO: 35806 - DNA, 430 bp, Zea mays
  Clone ID: LIB3060-014-Q1-K1-D2
agataagtaccttcaatatgcttttgtcggtgtgtgctagttcactagattttgacggagcgctccaagttatggagctcctaaaggaagctgggctaaaacctgattgtaaactttacacaacgctgatatcaacttgtgcaaagtgtggaaaagttgatgccatgtttgaggtattttatgagatggtcagtgctggtatagagccaaatgttaacacatacagtgcattaattgatggctgtgctagagctgggcaagtggctaaagcatttggtgtttatgggattatgagttcaaagaaggtgaagccagatcgagttgtcttcaattctttgatcagtgcatgcggtgaatctggagctctggctcgggcatttgatgttttatcagaaatgacagcagaatcctctgaatctaaaggatggaa

SEQ ID NO: 35807 - DNA, 424 bp, Zea mays
  Clone ID: LIB3060-014-Q1-K1-B4
cccactccctctcgtcgccgtcctctcccgttcgcaacgccacgctccccaccgccgagatggccccgaagcgaggtggcagggcaccggtgccggccaagaagaagacggataaagtgacgaaccctctgttcgagaaaaggccgaagcagttcggcatcggcggcgcgttgcctcccaagaaggacctgcaccgattcgtcaagtggcccaaggtcgtgcgcatccagcgccagcgtcgcatcctcaagcagcgcctcaaggtgcctccggcgctcaaccagttcacccgcaccctcgacaagaacctcgctaccaacctgttcaagatgcttcttaagtaccggcccgaagacaaggctgccaagaaggagaggcttctgaagagggcccaggctgagaatgaaggaaaaactgttgaatc

SEQ ID NO: 35808 - DNA, 455 bp, Zea mays
  unsure at all n locations
  Clone ID: LIB3060-014-Q1-K1-B8
ccgggggttttaaatcgtaagcggcggccttttttccaaggccaaatggccaacctatgtttaaaaaaaggagaaatttgttgggtttgaagaaaaattaaagggaattctatcaattttaattttccattaatttagttagtttttcttaatggaaattgaaattattaactaacagagcaaacacaaataaagaaacaactttgctgaccatgatagatttttatctagttggaagagtcctcttaatattcatctagtcttatataagtttgggtatatagaaatacaaacagaaaagagaggatagaggataggctcattacataaaaaaaagatatggaaatagccataatacataacanaaaagaaaaaaaggagcgggagagccaaatgaatcgaaagattcatgtttggttcgggaagagatcataaaaattgtaaacttaatagca

SEQ ID NO: 35809 - DNA, 427 bp, Zea mays
  unsure at all n locations
  Clone ID: LIB3060-014-Q1-K1-B9
gggagagcagcacatctcggttgatttgaagatggaacgcacggcaggctgcggtaaggcagcggatctggttccgtttagctagggttccgtctccctccaccagacctgctcaacgccttccacgggcgcacctcgacgtgccttgagctagggtttcctctgccgctacctccgttttacgcggccggcgcgcagccatggcgatggtgcaggcgggcatgggcctcacccgggtcgtggtcctcgttggcgccggcgtcgccggctccgtcgttctccgcaacggtcgcctcgccgagatcctcggtgagcttcaggggatactcgacaaggggaacaaggggaaggacggaagaaggggagacggggaaaccgatctcaacgaggctcttacctcgcaggtgcgccgncttgccatggagat

SEQ ID NO: 35810 - DNA, 429 bp, Zea mays
  Clone ID: LIB3060-014-Q1-K1-C1
cggcaatcggcatcgccaccggtagtgggagggagcaagggggggacccaggccaacgccgcgcacctttgccctcttatcatcatcaacatcaccacgggcgggggagacggccctcgaagcgtacccgtccccatcctccttttccgaaccaccggagcgcggcggcgcggcgcgagacccttcccggcttctactcctccgatcctccgcaccggctgacgagtagcccactcactgggggacgtgggatcgatcggcggctgatgggaggctagattccgcaatcccacagactagacacatccccttcgcggttgactttggcgaatcgaccttgatctgaaaatggggctgttccgggcggcgtccggcctggcccgtttggctctgcgaaggaacctcttgcgcgccgcggcaagccccttt

SEQ ID NO: 35811 - DNA, 429 bp, Zea mays
  Clone ID: LIB3060-014-Q1-K1-C11
gcctgggcaaccgaaagagctcctcccgaggctgttcgacgagtccttccgcagcacggcaacttcctctttctccaagtactccgtcgcggacagctccatggacctgggcagctgcccgttctccgaggtcgaggtgggcgggggaagtctgcgagaaggtgacgagtcggagaaggagaggccactggttctgcgcaacaaggcgccgaggtggcacgagcagctgcagtgctggtgcctcaactttcgcgggcgcgtcaccgtggcctcggtcaagaacttccagctgatagctcctgcaaagacgcagccgcagccgcaggcctccggccccccgccgccgccgccgccgtcgtcgtcgtcgtaccatgacccggtgatcctgcagttcggcaaggtcgggagggacatgttcaccatggacta

SEQ ID NO: 35812 - DNA, 424 bp, Zea mays
  Clone ID: LIB3060-014-Q1-K1-C5
ctccagcattgtgttctgattcacctgctccaatggctgttctttctgctgctgatgcgttccccggtctcagctatcgggtttgagggctatgagaagcgccttgagatcacattctctgaggcacctgtctttgtggaccctcatgggcgtggtttgcgtgccctctccagggcccagattgactctgttctggatcttgcacggtgcacaattgtgtccgagctctccaacaaggatttcgactcatatgtcctctctgagtcaagcttgtttatctatcctctgaagattgtcatcaagacctgtggcactaccaagctcctgctcaccattccaagaatccttgagcttgctgaagagctgtctatgccacttgctgctgtgaagtactcccgtgggacgttcatctttcctggtgcac

SEQ ID NO: 35813 - DNA, 293 bp, Zea mays
  unsure at all n locations
  Clone ID: LIB3060-014-Q1-K1-C8
acttttggcttggtgacagctcaatagatgtgacancggaaggaaatggaagtctgacggatagagcagatgaaatggctgacgactagccgggctaggtgccgtgcatctacctgcaaaggcggcgtaccagaagaaggtgtggacatgggagaagtctcgcatcggcatgcttgtggtcactggaaagcttngaacgatgaacgctgatattcgtcggatgcaactttcggtggggtacatgattcaatttgctatggtgaaaattttgaccgtagcttagacaataaata

SEQ ID NO: 35814 - DNA, 388 bp, Zea mays
  unsure at all n locations
  Clone ID: LIB3060-014-Q1-K1-D1
ctttacacgaccacgctagcacgccctctccgtctctccccttccggttccggttccagtggctgcatccgctgcgccaccccccgtctgctcacccaagtcccaatcccgcagcccggcggcatggcggtgagcaacaacatcacggcatgcatcaacttcctggtgcttctctgcaccatccccatcgccgcgacggngctgtggctggcctcgaggcacggcggcgaggactgcgccaggctggcccgctggcccatcgccgtgctgggcgcgctcctcctgctggtcgcgctggcgggtttcgcgggcgcctactggaaccgcaggggcctgctcgcctgctacctcttcgcgatggccgccctaatacgctcttcttggcctt

SEQ ID NO: 35815 - DNA, 423 bp, Zea mays
  Clone ID: LIB3060-014-Q1-K1-D10
ccggctcctcgcccaccaatctgtacacactccgacgccgacgcgaaatcgaaaggaccaccaagctcaaaaaagcgccgcccggcgccgatgttgctgcggcggatgcgatggatgtcggagggggacggccggtgggagctggatgcggagaccccggtgacgatggagggcacggcgcgccccgtcccgggggaccccctgccgctggggctctcacggggctaccgcatcacccgtcccaagcagctagacttcttccaccggttcatggcgtcccctctggtacccaccttctccgccatgcgcgacggcctctccgtcaaccacgcccacattttctacatgacagacaactggtcttctaccatcttggagaaaatcaatgttaagaagcttgtgtctgtcgtgaaagagaaatta

SEQ ID NO: 35816 - DNA, 421 bp, Zea mays
  Clone ID: LIB3060-014-Q1-K1-D12
cggacgcgtggggtgctacattggtccaaacctttggacaggagaatcatgtgtgcctgaaggagggttccatcattattccaccctatgctcctccgcagaaaatgcaagctcacttgatttccccagacactccacgctcaatcttcgtttacttccggggacttttttatgacacggggaatgaccccgagggcggatactatgcaagaggtgcgcgagcttcgctatgggagaacttcaagagcaaccctctgtttgacatttccacagaccaccctgccacttactatgaagacatgcagcgcgctgtcttctgcctgtgcccattgggctgggcaccgtggagccctaggttggttgaggctgtggtctttggctgcattccagtcatcatagctgatgacatcgtgcttccatt

SEQ ID NO: 35817 - DNA, 443 bp, Zea mays
  Clone ID: LIB3060-014-Q1-K1-B3
ggattcccgggttgattattccgtcgtagttccgcgcggagctcgctaagcctacgcccatcggcccctgttttcctaagccgctgctcctgcttccggggaaatttcgtgtccagtatcttgatcttccgccgccgcgcttcacgccagggctccttccaccggcgtcctccttaccgtcgtcctctactggtgctggactgctgcgggggtggagatcggcttagatcaactcttaattttgccgggactctttagagggcgcgtgcgctggtacagcaaaaaatgagtgataacctgatggaaaaggttagcgcctttggtgagcgcctgaagatcaccgggacggaggtcagcaagaagatgacggccggaatgagctccatgagcttcaagatgaaggagttgttccaggggcagactcccgctgataagattgttga

SEQ ID NO: 35818 - DNA, 332 bp, Zea mays
  Clone ID: LIB3060-013-Q1-K1-H7
agcttatgcaagctctgatgacgtctttagcctctactaagcagagcaagctgtcagggaaattttgacattgccttctaaacacaatcatgcgatcatcatacttctaatacctgctgataatttgctgcacaatatcacatactgccgcgattttacacggcgtatgcgtccacctgtaaacgatgtcagagtactaccacgattgccctgactcttacatccaggccagcacctacagcctttaaaaactttaccttatgaacctgaactacgccattcgtctacaacctgtggacccatgccattgctggctgcgccttttacatttt

SEQ ID NO: 35819 - DNA, 243 bp, Zea mays
  Clone ID: LIB3060-013-Q1-K1-H8
cgacccacgcgttcgctgccccttgcgttcccttgcgttggtttttctattcatcgctgacgattgaggctatgttgcctttaccctcggaatttcatttcgcggttggggcatggatgaagaggaactcacctccggcggctgcgactctgcgttgctggcgccggaaccgcgcgaacaggctgtcgaagaggggaggtcaccgcgagacgcggaggcgttcgaagactctgtggaagaggc

SEQ ID NO: 35820 - DNA, 422 bp, Zea mays
  Clone ID: LIB3060-014-Q1-K1-A12
ggtgatcttcgaggaggaggaagatgatggacagacaacgaggacacgccctgaagacccctcacctatcactagcggcgtggagagtggcagggaatcctcattttttgtactgacggtacgatatacaacaggggaacttggtacagaaccagccaagctgcaagttgaagaaatcccaagccaagctgaacaggttcttatacagaaccagcagctcccggccatggagaaagagaagcaatccgttcctgaatgctcgctccaaaaaagtgttagttctggatgcctcaactcagcagattggatgaatggacctgccaggccaaactttcttgacttccaggggctggactttgaggcagcatttgggctgaggagagcttacagtgaaggagacattcagatatgaaatgaggttg

SEQ ID NO: 35821 - DNA, 375 bp, Zea mays
  unsure at all n locations
  Clone ID: LIB3060-014-Q1-K1-A2
gtcgacggacgcaccgcatactcctggtggataatattcagtccactatggctctttcatggtattgttgcacgcggaaggttttcaatgcctgccccttctttgcctcatggccgtcattgggcaccatgtcattcgattgttgcggcgcctttactaattgcgttcgagctgcttctttgtatatatcttgaaagcataagagttagaaatcatccatctgttgatctgaagattgtgttcccttcccctgttgggcctttgaagccattaatccttattgacaattttagaatgtgtagagctttaatgcctgnggattgaaaaagcatgagtgatgaagctatttgggagaccacttctcatttttgggtt

SEQ ID NO: 35822 - DNA, 428 bp, Zea mays
  Clone ID: LIB3060-014-Q1-K1-A6
gattcccggtcgaccagcgtccgctgcatcaccaccaccacagccccgtgtcgggttccaggggccgtccacctcttcgcatcccggagcccaccggcttcttggctcgccgccgcgaccggacgcctcttcgctggcttcgtgcgcacgctctcggtcctgcgttgactacgcgccgcccaccagccctcgcccggaggtcggcgccagcgagctcgcgttcgagctcgacgagaacctcgcggaggctagccctgcctgcgagccatacgcccaagagctgctcgcgagtgcccaggatcgccaccgcatcttccacgaggagctggtcgtgaaggccttcttggaggccgagaaggctcaccgtggccagacgcgcgcgagtggtgacccctacttgcaacattgtgtggagactgctgtgctac

SEQ ID NO: 35823 - DNA, 445 bp, Zea mays
  Clone ID: LIB3060-014-Q1-K1-A7
cggtcggattccggcagaggcgttgccggccgggccactgccggtcggcggatatggctgtcgaagcgcacagcctcctgttattagctggagggcacaagcaattcaccagcgcgggatggccttggacgaccggcgacgaagctagatgcgcgacggcgcgactgagccaccagcaggcgttccagctccagcaggcctcgtgtgtgggcggcgtgggcctgccgctggcggctccgatctcgtcggccgcggcggcggcggcaccagcgccgatgatagcgcagcagtacgctgctggcggacggctgttcgtgggagacgcggcggagagcggcgtcacgttcggaggaggaggtgcggtgcacgtgcagcaggaggcgccccggaagcggaagcgcgccgagcaggggcagacgacgccgtcggttcttgggaccggcgc

SEQ ID NO: 35824 - DNA, 428 bp, Zea mays
  Clone ID: LIB3060-014-Q1-K1-A8
ggactttgtcgcatctgatatcaacttcataaatctttatccaagatggcgctgcaaagacattggtgcttcaaacagggatgatgccttctacaggtacaagatgcccagaatgattaccaagatagaaggccgtggtaatggtatcaagacaaatgttgtgaacatggttgacatagcaaaagcacttgccaggccagcttcctacacaaccaagtactttggatgtgagcttggtgcacagtccaaatttgatgagaagacagggatttccttggttaacggggctcatgatactgcaaagctggctggtctccttgaggtattcatcaagaagtatgtccaatgttatgggtgtggaaatcctgagacagagattctcatctcaaagacccagatgatatcactgaaatgtgcagcctgtgggt

SEQ ID NO: 35825 - DNA, 423 bp, Zea mays
  Clone ID: LIB3060-014-Q1-K1-A9
ctggaactggaaagacactggcctttggcatacccatgatcaagcaattaagcgagcgggacgatggtcggattacaaggagaggtcgtactcctcgggttctggttctagcacctaccagagagttagccaaacaagtcgagaaggaaataaaggaatcagcacccaagctcggcacagtgtgtgtatatggcggagtctcatataatgtccagcagaatgcactctctagtggtgtcgatgatgctgatggaacacctggccggataatcgatttgatcaatggcgtaagcctccagttgggagaagtccagtattaggccctggatgatgctgaccaaatgctcgcagtggggtttgcggaagatgtaggcacaatattacaacagctttctgcacgctggcaaagcatgtcgatctctg

SEQ ID NO: 35826 - DNA, 413 bp, Zea mays
  unsure at all n locations
  Clone ID: LIB3060-014-Q1-K1-B1
gcaagtaccgcagcggaatcgagaacctgttggtcctcttgatcggtggtatcccaatcgccatgcccactgtgctttcagttaccatggccattggttcgcacaagctgtcacagcagggtgccatcactaagaggatgactgccattgangagatggctggtatggacgtgctttgcagtgacaaaaccggcacactcaccctcaacaagcttagcgtcgataagaacctcgtcgaggtgttctgcaaaggcgtcgacaaagaccatgtgttgctgttggctgcaagggcttcaaggactgagaaccaggacgccatcgatgctgccatggttggcatgcttgctgatccgaaggaggccagggctggtatcagggaaatccacttcttgcccttcaaccctgttgataag

SEQ ID NO: 35827 - DNA, 418 bp, Zea mays
  Clone ID: LIB3060-014-Q1-K1-B11
cgcaggcagcatctgcatctctcgcccacctccgctccgcctactgctgctggtggtagggaggcggagaaggaggcccttgcgcccgcccgccggccggatcagagccgtagcaaccaccacccatggcggacgtgcacgaacctttggtgcgccgtaagaggaagaaggttttggtggactacttggtgaagttccgatggatcctcgtgatcttcgtggtccttcctatttcaactctgatctacttcaacatcttcctgggcgacatgtggtccgccatgaagtcggagaagaagcgccagaagcagcacgacgagaacgtgcagaaggtcgtgaagcggctcaagcagaggaacccgaagaaggacggtcttgtttgcacggccaggaagccctggatcgctgttggcatgcg

SEQ ID NO: 35828 - DNA, 418 bp, Zea mays
  Clone ID: LIB3060-014-Q1-K1-B12
gcaataggacgatcgagcaagaagcaagcagcagtaacaagaaaccatcatcgatccatgtatccaccaatggcggcgctcggaggacggcggaggagggcgtcgtcagcggccctcctgctagccttgttggcggtggccctggtctccctggccggcccagccacggccgcggggaacaagaccgggcaggtgaccgtgttctggggccggaacaaggccgagggcacgctgcgcgaggcctgcgactcgggcctctacaccatggtgatcatgtccttcctcgacgtctacggcccgcagcgcggcggctaccaccagtaccacctggacctgtcggggcacccgacggccggcatcggggacgacatcaagcactgccagttcgtgggcgtgccggtgacgctctccgtcggcg

SEQ ID NO: 35829 - DNA, 420 bp, Zea mays
  Clone ID: LIB3060-013-Q1-K1-H6
ggaatttccacctaggcgtacggtctccctcctcgcttgcgctctgtttcggtgtttcctgtttcggtgtttcctgtcggtggtggcgacgactgggcggccgacgctgccaccgccctacgccagaatgcagtggcggaaatttgatgagttagagcttattactggtctgatactcctatacgatgtcactgaaacttccaattccgcaagggctttccttcttaagaagtgttggatggtttgaggaccggaaggttgattcagcagccaaacagcagttatccccaacgttgaaactccagacagataaggagacgtacagacctggtgattcagtcactgtgactatcgaaatctgtagcccagctagtttgaaggatgatgttgggcaggcagtgtcaggcgaggatgccccct

SEQ ID NO: 35830 - DNA, 389 bp, Zea mays
  Clone ID: LIB3060-047-Q1-K1-H4
gcgtccgggcctccgcgttcctcaacgctctcgtcctccgatcgccatcaccgtcgctctcgtgctcgtgtaaccgccgcagcaccggcgccttcgcgttcccgaacccaccgcgcttcccatgcctgcgttctgcgcgtcgactcgtccttgcgagggcggcggcagcgccggcgccgggcgatggccccgaggacgagtgggggccggagcccgagggcgggtccgctgtcacgggggccgcggtggcggaggcgccggaggcgagagaggtcgcggagctcaaggcgcagctaaaggacgcgctgtacggcacggagcggtgcctgcgggcgtccagcgagtcgcgggccaaagtgctggagctcatcacgcagctcgagacgcgc

SEQ ID NO: 35831 - DNA, 433 bp, Zea mays
  Clone ID: LIB3060-047-Q1-K1-H5
gcccgtttcagattcgtgacgtactccctccctccaaccacgcccggccagccaaacgtgccatggcgctgccgtcgtcctcgacccccaccgcgtcggctccggcctccctcggcgagcggtggccgccgctggagtctacccccgcagttttcaaccagttcgtgtggtcgctaggtgtcccagaggacgacgtggagttccacgacgtgtacgggctcgacgccgacgcgttggatatggttccccagcctgtgctcgccgttgttctctgcttccccgatccaccacaggatgcaagttacccttcagaacaactcttaatttctggagaaaaggaaacacaggaccaggtttactttataaaacagatcgaatcattgggaaatgcttgtggaactattgctctactccatgctgttggaaatgcatc

SEQ ID NO: 35832 - DNA, 240 bp, Zea mays
  Clone ID: LIB3060-047-Q1-K1-H7
accagtgatggtggtgtaaaatgagatttttgcctgagggcagttatcacattttgaagactaacaaaaatcgccatctctggatgtggtattctacagggtaggggttccaggttgactcaccagttaaaacatgcatttctggttgtataacaagcaatgaaccccgtatatatacttgacagtttgactcctttggaggtttgatttttaattttggataagacattggtactcttt

SEQ ID NO: 35833 - DNA, 336 bp, Zea mays
  Clone ID: LIB3060-048-Q1-K1-A10
ttttctagggaatcgggaccaatctatcaacatgcttaacacaccattccgaatcattacgggaataaacgattatttatcttacaataaaccttaaacagaattattcctatcaaccacttctctcattaatctataaactcaagatactacagacacaaagaatagattatagtcagacagatgctcaatatcacatgcatgttcacaagatatagacactcatgactgtaatgcctactctttatatacaccacagtaatgatagttgcacaactcttattgatatacatatgaagaactttaatgtcactgtattctcctatggatctaatt

SEQ ID NO: 35834 - DNA, 402 bp, Zea mays
  Clone ID: LIB3060-048-Q1-K1-A11
gatccatcgatcgctagctagctgacgaccatggcgtccctctcctctgccgccatcaccgccccttccttcacggccgcgcccgctcgcgcagtggtcagcaggaggtccttcaccgtgcgtgcctctctccgcaaggccactgccaccgccgccgtggccgttgccgccagcgtcctgcttgccggcggcggcgccatggcccaggaggtgctgctgggcgcaggcgacggcgggctcgtcttcgagcccagccagttcaccgtcaaggccggcgacaccatcaccttcaagaacaacgccggcttcccgcacaacgtcgtgttcgacgaagacgaggtgccgagcggcgtcgacgccttcaagatctcgcaggaggagtacctcaacgcgccaggcgag

SEQ ID NO: 35835 - DNA, 377 bp, Zea mays
  Clone ID: LIB3060-048-Q1-K1-A2
gcgtccgaccgcagaggcagcaaagagaagtcatagcacggctgcacaggagcggccggacgagcgcaggcgccaagaaatcaccgcccgtcccggtccgtcggtatggtggcggcgatcgcggtggcgtcggcggggctcgggatgctggcgggcgtggccatggccaacaggtcgtcgtcgtccgacggcgccgcgcagtggaaggcccgggggtcccggcgctgcggtgggggcggcggaggcgcctccgcgctgcgaggcatgcggcgggtcggggcaaggaggagtgccgcctgtgcgcgcgctggtccgacgccggggcccggggaaaggagcagagccggttcgggttccggggcgtgcgcgggcacgcg

SEQ ID NO: 35836 - DNA, 278 bp, Zea mays
  unsure at all n locations
  Clone ID: LIB3060-048-Q1-K1-A4
cgagctgtcttgtccccctcttggcctcttctttccggcgatgggcgccggcgtcctggtcggcgacgccgccggcctgggggcccacctcgccgtacgccgccggaggacgcgcctctaccttcgcaactgggcctccaagcccctgcgcccctcggtctggctcggcgtggccgcctgtgtttcacagaatcgcgaccgccgtggccacgtgaccaggttctccgncttcggctcgagcggcagtgacgagcccggngagctgtccgaggatgaag

SEQ ID NO: 35837 - DNA, 299 bp, Zea mays
  Clone ID: LIB3060-048-Q1-K1-A5
cgtccggtgaggcactacactacactacaccacagagacccggcgacaacacacacacgcgtaagagcgattgcgctcggaacgcgaacgggacgcaatactctgtgagctagccaagacaggaataatattggctgcgtcaccaggggcgagcctctctgttccggtgaccacgacgaccttcgcggcggcagcggccgcggccggcgccgacttgctgatcgtcgtgccgagtgagacatgcgctgctcgcggtatggttcccccgtgctgatgcgcagcgcgacgatgcagcacac

SEQ ID NO: 35838 - DNA, 371 bp, Zea mays
  unsure at all n locations
  Clone ID: LIB3060-048-Q1-K1-A6
cagcgatgctcctcctgcgcgccaacgcgctcgccgccgtaccggtgtccttctccataacgccggcggcctcctatagctgcttcccctggccgtcttcatccaccactgccgcgagctgctccgtcggctcctctgccaggctcgccgccgccgtgcagtacgacccgctccgccccggctccgatgcgtgggcccatcccgacggcatggtcaccgcggagggtgacgaggagaaacagcgctatgacacggagggggagtccaacgactgggaaggggaagggccccaaggatcatcagaccccgagggcatcaacgtgccgcgccagcgctacatcgccgtccccaaggaggccctnctcgatgct

SEQ ID NO: 35839 - DNA, 344 bp, Zea mays
  Clone ID: LIB3060-048-Q1-K1-A7
tccgcgggtcgccccacgccatctgagacatgcatgatcattgtgacggttgcgcgcatactgcaccatgttccagacggtctatcagccagacttggtagaagccaattatagagaaagcggcttgccttgcgtacgctctactatccagaagcagctcttgcctcgctcacttaccgaattatagcctgatgtctcatgagagcaggtgccgatctaagctcatacgctgtgatggcctgaactctcgagaccggatactgatgccctgaggctaacaatgatagttgttcgtacgggtggaacagtccacttaacagggcgccggcgactaccctataggc

SEQ ID NO: 35840 - DNA, 323 bp, Zea mays
  Clone ID: LIB3060-048-Q1-K1-B1
gaccaacgcgtgctgcgatatgcattcatcaatgtgaccgctccgggcataccgttgcattttacaagacgttccacagctagaattgcgacaagtcatttacatagaaggtggcctcactggcgtacgccatatgcagcgatgtacgctctcaatgctcacgtccgaaactataatgcgtgtaatgacgagatctggggctacactgtgctggtacactgtgatggcccgaacgcacgagaccaggtaccattccctgggggtaacaatgctcgttctcaggccgggaggaacagtccacttatcaggggctcggagactac

SEQ ID NO: 35841 - DNA, 344 bp, Zea mays
  Clone ID: LIB3060-048-Q1-K1-B10
cggaattcccggcctcagagatggtaggcaccgtcctgctgacatggtagtaactgttattttcatacgtgcaaacactatcctgggtaaaggtcaactgatgatgtcaacagagaatggcgggataaaggtaaatggacagctgccgacaagcgacagctctgtgtatgccagagtcgatgtggccgctgctcccatcaagctttttgacgatgatattcgacggctcgagcatgtggactcagctcgtagaactggtagacatgctgttgcctccatcttggatccttcaaagaccactgacatcgattacctgccgttcttatactccagagtgatcacgt

SEQ ID NO: 35842 - DNA, 415 bp, Zea mays
  unsure at all n locations
  Clone ID: LIB3060-047-Q1-K1-H3
gccgtccaaaaggacgcttcctacctggttaaaaaccgttgcttccaacttgaagaaaatggtcccaaaggcaccgaaaaggggccaaatgccgtcgaaaatcggggtcctgttccgtgaccagcacggtttcccccttgtcaaaagcgtaaccggcagcaagatcctccgaatcctcaaggcccatgggctggcaccagaaatccccgaggacctgtacttcctcatcaagaaggcggtggcgataaggaagcaccttgagaggaacaggaaggacaaagactctaaattcaggctcattcttgtggagagcaggatccaccgncttgcccgctactacaagcgcacaaagaagcttncacccacctggaagtatgagtcaaccacagcgagcactctggtggcctaagtgtgg

SEQ ID NO: 35843 - DNA, 93 bp, Zea mays
  Clone ID: LIB3060-047-Q1-K1-F9
ccggattcccggtcgaccaagccttcggcaatttaactggaccggaagggcaacttaccttactggaagggcaacggccggccgggaaaggca

SEQ ID NO: 35844 - DNA, 408 bp, Zea mays
  Clone ID: LIB3060-047-Q1-K1-G11
ggacgctgactccctgcccaacaacatcaaggatttgctacacgagcacactgttgcagacgatgtcgcaggaagcaagtgcctggtggtgcgcggttgggcgctacacgtggccatcctggcccatcctgccagtgacggcttcatggcgctctgtggatggggctccactctggaggttgttgcagccggtcttcccatggctgcctggccctttttcgccgaacaatttatcaacgagcagctcatcatggacgtgcttggtattggattgtctgtcgctgtgatgaagccaattgaaaatgttttgattgccagtaacatgggtggtgctgttgtgatgatatatgctcctgttttttggtcttgcctgacaagcttcacacttggaatccatggtcagatagt

SEQ ID NO: 35845 - DNA, 434 bp, Zea mays
  unsure at all n locations
  Clone ID: LIB3060-047-Q1-K1-G2
ccaggttcaaccaagccttccgggcacctggaaggaccttgcggaagctgccccagctcgacgacgacgatgaatatgggcatggaccgtgtgctcaaggagaagttcggcgacgctttcaaggaaatccgtcaggtgttcgacggggaccagccggcggcggagacaacggccgaggcggtgaaccggcacctggacatactgcggccagcgatcgcgaactacggcgggagcgtggatgtgttggccgtcgatggcgaggactgcctggtgaggtacgacgggccggaatccatcggcagcggtatcaaggcggccatcaaggagaaattcccggacatcaccagtgtggtgtttaccctgtaaaacaccgactggggctatgcatattcggggcagtccacagcanatgaacatgctgatcgaacttcata

SEQ ID NO: 35846 - DNA, 273 bp, Zea mays
  Clone ID: LIB3060-047-Q1-K1-G3
acccactcatccatacgtctcctactacatttccccatctttcccatcttgaccactacaaataatatattgctacgatcaattactcaatcagaacttcccctactctttcaacaaattcatatccttattcaacccatacccatccttacaatctacaacccccttagttcttacttcatcacctttacatacttcatcctgctatctaaaaacactactcaatcatctcttattctaccattctaagttaccaactccaacataatacac

SEQ ID NO: 35847 - DNA, 429 bp, Zea mays
  Clone ID: LIB3060-047-Q1-K1-G4
ctcctcctcagaactctcccttccctcttgtaggggccaaaagggtcagagatctaggaagaggagaactagtccccaagcctaacaagaaagcaagctcttctgcaactgttggcattcgccttaatttgtatccatatcccaatggcaggcctatctctgcaacacccctgggcattcactttcggcctcctaggcaacgtcatctccttcatgaccttcctggccccgataccgacgttctaccgcatctacaagagcaagtcgacggagggcttccagtcggttccgtacgtggtggccctgttcagcgccatgctgtggatcttctacgcgctgatcaagtccaacgagacgttcctcatcaccatcaacgcggccggctgcgtgatcgagaccgtctacgtggtcatgtacttcgtctacgcg

SEQ ID NO: 35848 - DNA, 431 bp, Zea mays
  Clone ID: LIB3060-047-Q1-K1-G6
gtccaagtccaactccaacgaggcaacgactcgtcagtggtcagtacactacaccgtgaccgtcgccggaatcgatcgacccaaagctccctttagagcccgagctctatccaacccacgaacgggatcccgatgcccgtggcggcctcggttctcgccgcagcggcggtctcgcccccgctgacgtggcggagatggactcctcttctcgccgcgtcacatccacaggcgaacccgcctcccgcactgcgcccgcgggcgcccgctcctcctctccgggcctcctccgttccccgcgattcctgcgccggagccgccgtccggaggacgccgtgtgcggcggcggcggcacttggtggatgtgtgaaggcggagtccacggagcgggaggcgctcgatcgggatgctctgaagcgggtggcgctactcgc

SEQ ID NO: 35849 - DNA, 424 bp, Zea mays
  Clone ID: LIB3060-047-Q1-K1-G7
ccgggaacaagggccccgacgtgcccatcttctcggtgcagcagccgtcgttgctgcacgacttcgccgtcacggagcggtacgccatcttcccggagatacagatcgtcatgcagcccatgggcatggtgacgggcggcgcgcccgtggggtctgactccggcaaggtgccccggctcggcgtgctcccgaagtacgccacggacgagtcggagatgcggtggttcgaggtgccgggcttcaacatgatgcactcgctgaacgcgtgggaggaggccgacggcgaagagctggtgctggtggcccctaacgtcctgtccgtggagcacgcgctggagcgcatggagctcgtgcactcctgcgtcgagaaggtgcgcatgaacctgcgcacgggcgccgtgtcgcgcaccccgctctcggcggg

SEQ ID NO: 35850 - DNA, 444 bp, Zea mays
  Clone ID: LIB3060-047-Q1-K1-G8
tcccgggggccgtcgaggatctcgtgcagggcgtccggcgatgacaaggacaaggtcccgtcgtcgggagggagcgatcgtggggtcaagcagctcgggaagctggccatggtcgcgctggccgccggcgtgctggtgctcggccccgtcgacggtgccgtggcggccaagtccggcggcagggtcggcgggcaggcgttccggtccgcgccccggtcgtccggccctcggatcaacaactccaggaccaacatctacatcaacccgccggtggcgccgccgctgggcggatacgggtacgggagcccgttcttcggcggctacggctacggctggtcgccgttcagcttcttcgcccccgggccgagcgtcgccgtcggggtcggcggcggcttcgacacgctcgtcctcttcttggtgctgggcgccgtcgtcggagctgtc

SEQ ID NO: 35851 - DNA, 407 bp, Zea mays
  unsure at all n locations
  Clone ID: LIB3060-047-Q1-K1-G9
ctgcttgctctggggggaaggagagagagagagcgagagagagagagagatctagtggagaggctagtaggtggtcctcgaacgaagatgttggcggtgttcagcgggcaggtggtggaggtgccggcggagctggtggcggcgggcagccggacgccgtcgcccaagacgaaggcgtcgcagctcgtggggcgcttcctggccgcgtccgagccggccgtgtccgtgcagctcggcgaccacggccacctcgcctactcccacaccaaccaggcgctcctccgccccaggtcgttcgcggccaaggacgaggtgttctgcctgttcgaaggggtgctggacaacctgngtcggctgagccagcagcacgggctgtcaagcaagggcgccaacgaggtgctcctcgt

SEQ ID NO: 35852 - DNA, 399 bp, Zea mays
  Clone ID: LIB3060-047-Q1-K1-H11
cctccctgtccccagctcgctcgccctgatgccgcgctcggctcctctgctgactgcgcgccgctccctgttgttttggttgccgtgcgtgcgaaactgctctggtcggctgtttctgtaccccgcgcccagatcgacatggcctcatgcttggcctgccctagatccgtagctagtcactctgtgttctcgaccttgccctatcgccgaaccccagcgccatcgaccttcagctccgtgccttgtccctggctgcgcgcgcgtgcttcactgtttggttgtcgtcgcgcaagctcctctgttgggctcgccagccccttgtgtcctaaccgcgccagtccacgttcgtggtcatgttcatcgagttcaccaacgctctgttgccgattcgaccatcgt

SEQ ID NO: 35853 - DNA, 262 bp, Zea mays
  Clone ID: LIB3060-047-Q1-K1-H12
aattcccgggtttttttttttttttgttataattaatacactccgagcaactttattattatatgtattattacaaggcacagtggcacatacatacagtgatacagctgcaatatacatgaacaccctttgtctcgctcctgctttatctatgcaactgctggcatgcatgcaaaagacgcctcgggagataagacccctgttattctgctagtacgtatgcatgcatgtgcacgatcgatgggcgcgatggtcatatcat

SEQ ID NO: 35854 - DNA, 394 bp, Zea mays
  Clone ID: LIB3060-047-Q1-K1-F8
aagagaaacgggcacacgcaactgatcaaggcaaccaatattcaccgtcggcaatggggcgaatctggatccttgggctgccggatgaagtggccagggagtgcctcgtccgggtgggcttcgaccagctgccggtggtgcgccgcatctcgcgccagtggaagtcggaggtggagtcgccggactaccaccgccagcgccgggcggaggggctggcgcgcccggtgctcgcgctggtccaggcgcagccgacagcgccgccggatgacgacgacgacgccggccccgcgcacaagcgctcgacggcggccaactcgtaccggctggtgctgctggaaccggccgagggacggtggacgccgctgccgcccccgcctgggccaagccagagcct

SEQ ID NO: 35855 - DNA, 406 bp, Zea mays
  Clone ID: LIB3060-047-Q1-K1-H2
ataaaaccagtgcaagcagaagcagcgcaatggcgagcagcaccatggccctctcctggacagccttcgccggcaaggcagtgaacgtgccgtcgtctctcttcggcgaggcccgcgtgacgatgcgcaagacggcggcgaaggcaaagccggcggcgagctccggcagcccgtggtacggccccgaccgcgtgctctacctgggcccgctgtccggcgcgcccccgagctacctgacgggcgagttcccgggcgactacggctgggataccgcggggctgtcggcggacccggagacgttcgccaagaaccgggagctggaggtcatccactcccgctgggccatgctgggcgcgttgggctgcgtgttcccggagctgctcgcccgcaacggcgtcaagttcgg

SEQ ID NO: 35856 - DNA, 456 bp, Zea mays
  Clone ID: LIB3060-047-Q1-K1-E2
cccggccttcttcctccgccttcccttaacccccatatcgccatacacttctccactcctcccctgattaccacccccggcccccgcctcgatccaatccggttttttcttcgattcggcgcgtggcaacctggtcagtccaatccgtccgtgaagaatttatccgtattttcgtttgcgtcgcatcgtttctgcgaaggatttcctgttcgttttgggggagaaaggcgtcgtccttgatgtctactatcgcgaccccgccgccgccgattgcgcaagagaaggccgccagccggaataagcgcaagtaccgtgccgagccaccttccaccgagttgggcccatacgggctggagtacccgctgacggcggactgcatgggattcgagtttatgtcgcctgagaaggctgccatggcagcagcggtagccgctgccgagggtgtcagccttgacc

SEQ ID NO: 35857 - DNA, 157 bp, Zea mays
  Clone ID: LIB3060-047-Q1-K1-E4
ctcactctccctgtatacactcattaatcgcttcagatcctcgattttactctcaacgtgactcatactacttccatctctctatctcccgctccttttgctttcttaccttactttctatccacattatactactttttcacttataactctaaat

SEQ ID NO: 35858 - DNA, 419 bp, Zea mays
  Clone ID: LIB3060-047-Q1-K1-E6
agccaatacgaaatgctagaaaatcggccgcgcttaagggatgtcctcagcgtcgaggaacatgtgctagggtgtatactatcaaccccaaaaaacccaactctgccttacgtaaagttgccagagtacgattaacctctggatttgaaatcactgcttatatacctggtattggccataatttacaagaacattctgtagtattagtaagaggaggaagggttaaggatttacccggtgtgagatatcgcattattcgaggaaccctagatgctgtcgcagtaaagaatcgtcaacaagggcgttctaaatatggggccaaaaagccaaaaaaataagtgattcgtttttagcccttataaaaagaaaacggattcttgaacctctttcacgctcatgtcacgtcgaggtactgcaga

SEQ ID NO: 35859 - DNA, 429 bp, Zea mays
  Clone ID: LIB3060-047-Q1-K1-F1
tcctaagcaaaaggtctaatctgatccaaaaattcaaaagggggggaaggagcaaggttgacagcagtagtttagcctcctccatcagtggctctccaaggaggaaaccaaagggcccactggaagctctaatgctaaaaaacgctggagatggtacagccataacaacatacggaaagagggatcccaatgatgtcttggatgacgaaaatgtcgcgtcctcattccaattgatgtccaagacagttgaaggttttgctgatgagaagtatcctgcttacaaagataggcacaaacttgcaactgaacgggagaaggctataaaagagaaggctgggcaagcaagagcacaaaggtttggtggtggccacagttcagctctaatttcctctccaaaaagtgcactccctccaaaacttgctcaaatta

SEQ ID NO: 35860 - DNA, 412 bp, Zea mays
  Clone ID: LIB3060-047-Q1-K1-F11
ccggatccgagctaggcacccgcacgaccacccgcctcctgccggtcaccgggaccgggcatcgccgggcggcggcgggggaggggaaggtaggcgatgaggaaacgtgagcgggagaatccgtgcgggatctgcgggcactaccacaagtacgaggagggggaggtatgcggggtgtgcggccaccgctggaaaccgtcggacggtgagggcgccccgtcgaggcacgagtccgtcttacccacagaggtgctcaaggacttcctcttcctcgggagctacgacaacgcctcacgctccgaggtcctcatgacgctcagtatctcccacatccttaatgtacgtatttaagccctcttgtctagatgatgcacatcctattccttgtttgtgatcattaaattcggcgtct

SEQ ID NO: 35861 - DNA, 442 bp, Zea mays
  unsure at all n locations
  Clone ID: LIB3060-047-Q1-K1-F3
cgggagggggcctgctggtaccctggaccgaaccatggcgaccccaagatcaatcccagggacgtgaagggtgncaacatcctgctagacgactgctgcgaggccattgtcggtgacttcgggctcgctaaactcctcgaccatcgggactcccatgtcaccactgcggtgcggggcactgtcggccacatcgcgcccgagtacctctccactggccagtcgtcggagaagaccgacgtcttcgggttcggcatcctgctgctggagctcgtcaccggtcagacggcgctggagtttgggaagacggcaaaccagaaaggagccatgctggactgggtgaagaagacgcaccaggagaagaagctggacgtgctggtggaccaggggctgaggggcggctacgacaagatggagctagaggagatggtgcgagtagcgctgc

SEQ ID NO: 35862 - DNA, 432 bp, Zea mays
  Clone ID: LIB3060-047-Q1-K1-F5
aagacaagctggcaaaaggatgatccaaggggttcaatgccaggtggtaccggactaggacaaaatagtgagagcccaaaggcaaacagtgatggccagtctgatccttcctcagagggtgtggactcaaacaataatactgcagtttatgctgatctaaacaagtctcctgaaagtgattttgagtactgtgaaaatcctgagatccttgattcaaataaagcttctcatcaccccagtgaacgtattaatgacttgcaaaatatacagatggctgcagatggggtaacagaagtcacagagctggaagaagcacctgggctctcagcctcagccttggatgaggaacccaatgcttgtgttcaaacagtgcttctcagggattcaaacccactagaacacaatcagagaactgtggttcctagatcacat

SEQ ID NO: 35863 - DNA, 427 bp, Zea mays
  Clone ID: LIB3060-047-Q1-K1-F6
gcgtcgtcgagcgggctgaggagctgcagcgccgtgggcgtgcccagcctgctgggtccgtcgtcccggtccggccgcctggcgccgttctgcgccaacgccaccacctctggccgcgtcaccatgtccgcggagtggatgcccggccagccacgccctgcccacctcgacggctcctctcccggggacttcggcttcgatccgctgggcctcgcgaccgtgccggagaacttcgagcggttcaaggagtcagaggtgtaccactgccgctgggccatgcttgccgtccccgggatcctggtgccggaagctctgggcctgggcaactgggtgaaggcgcaggagtgggcggccgtccccggcgggcaggccacgtacctgggcgccccggtgccgtggggcacgctgccgaccattctggtgatcg

SEQ ID NO: 35864 - DNA, 432 bp, Zea mays
  unsure at all n locations
  Clone ID: LIB3060-047-Q1-K1-F7
cgcaactttggagaaaattgcacagagtgatcctaaaactgctgatattgtgttgatggagaattatgctgctttccagaacagtctttatgacttggctaatgttgtgccaacgcttgcaaagttctaccatcaagccagtgaatcatatgaactagcttgcactcgccatatcagctcactcatttatctgcaatttgagaggttatttcaattcaaccggaaagttgacgaattgacttacactattgctgctgaggagataccgtttcagctgggattatcaaaaactgacctaaggagggtactgaaatccagcttatctgggattgataagtcaattagcgctatgtacaggaggttgcaaaagacactgacctncgacgagttgtttccttcgctgtgggacaagtgcaagaaggagtttttgga

SEQ ID NO: 35865 - DNA, 360 bp, Zea mays
  unsure at all n locations
  Clone ID: LIB3060-013-Q1-K1-F6
cgcctcgagtcgattaccaaggctccagtgatccaccacttctccgagacggttcaaggtgtcatgaccatcaggtgcttcaggaaggaggaaagcttcttgcaggagaacctgaaccgggtgaactcaagcctgaggatggacttccacaacaatggtgccaacgagtggctcggtttccggctcgagctgattggaagctttgttctctgcttcacagccgtgctcatggtcacattgccgagcaacttcgtgaagccagagtatgttggtctgtcactatcatatggtctatctctcaaccaggtgttgntctgggccatctggatcagttgcttcattgaaaataaaatggtctca

SEQ ID NO: 35866 - DNA, 426 bp, Zea mays
  Clone ID: LIB3060-013-Q1-K1-F9
attcttaattcatgagttgtagggagggacttatgtcaccacaaacagaaactaaagcaagtgttggatttaaagctggtgttaaggattataaattgacttactacaccccggagtacgaaaccaaggatactgatatcttggcagcattccgagtaactcctcagctcggggttccgcctgaagaagcaggagctgcagtagctgcggaatcttctactggtacatggacaactgtttggactgatggacttaccagtcttgatcgttacaaaggacgatgctatcacatcgagcccgttcctggggacccagatcaatatatctgttatgtagcttatccattagacctatttgaaaaagggttctgttactaacatgtttactttcattgtgggtaacgtatttggtttcaaagccttacgc

SEQ ID NO: 35867 - DNA, 400 bp, Zea mays
  Clone ID: LIB3060-013-Q1-K1-G1
gtggaacagttgcacaagattttcaagctatgtggttccccttctgaggagtactgggggaagtctaaattgccacacgcaacaatattcaaacctcaacaaccctataaacgttgcatcagggagacatttaaagattttcctacatcggctctgccattggttgaaactctgcttgcaattgatccagctgagcgacaaactgcctcagctgcattacacagtgatttttttttcaaccgagccttatgcttgtaacccttcaagtctgccaacatatccaccaagcaaggagatggatgccaagttaagagacgaggaggctagaagactacgagcggctgcaaaagccaaaggagaaccagaaaagactcgaccacgtgatcgatctcggagggct

SEQ ID NO: 35868 - DNA, 424 bp, Zea mays
  Clone ID: LIB3060-013-Q1-K1-G2
cgcccctgctccggctccggctccggttctgccatgggcctttcaacagtttgactggcggccggaccgcgcctcgtgccggcccctctcggccgctgccgctctgcccagccccgccgcccgcgccgggcccagctcgccaccgtccggtgctccgtcgacgccaccaagcaggcgcaggatggcgtggcgacggcggtcgcgacggaggcgccagcgtcgcggaaggagtgcttcggggtcttctgcaccacctacgacctcaaggcggaagacaagaccaaatcgtggaagaagctagtgaatgttgctgtgtcaggcgcggccgggatgatatcagatcacctgctgttcaaactcgcttctggtgaggttttcggaccagaccaaccaatagcacttaagctactcgggttaaaaagat

SEQ ID NO: 35869 - DNA, 416 bp, Zea mays
  unsure at all n locations
  Clone ID: LIB3060-013-Q1-K1-G6
gtcctagtcaccgcgttcgcttcccgagcacgcaaccatggctcgactgtcagccacggccgcgctcctcctcctcgtcctctccctcctcgccgtcgcgcactgcggtgccctcgcagtcgcagcagagcacgacaccgagcccgaatcaaccgccgccgtggccgtcagcgacgacaacgtgctatccgaccccacggtccacgctgaggcgggcaccgncagcgccactgaagaggaggccatcccggcggagcagcagcagcatgggttcgaactcctncgnctgccgtctcaccggctccaccaccaccaccacctctggtggaagcgccaccacgggatctaccgtgacgcgtcgcacaagttccctgggtctggccacggcgcgaggcgcgagcaggcagtgagccacc

SEQ ID NO: 35870 - DNA, 375 bp, Zea mays
  unsure at all n locations
  Clone ID: LIB3060-013-Q1-K1-G7
gagatctagtagagaggctagtaggtggtcctcgaacgaagatgttggcggtgttcagcgggcaggtggtggaggtgccggcggagctggtggcggcgggcagccggacgccgtcgcccaagacgaaggcgtcgcagctcgtggggcgcttcctggccgcgtccgagccggccgtgtccgtgcagctcggcgaccacggccacctcgcctactcccacaccaaccaggcgctcctcncgcccaggtcgttcgcggccaaagacgaagtgttctgcctgttcgaaggggtgctggacaacctgggtcggctgaaccagcagcacgggctgtcaagcaagggcgccaacgaagtggctctcgtcatcgaggcctaca

SEQ ID NO: 35871 - DNA, 390 bp, Zea mays
  Clone ID: LIB3060-013-Q1-K1-G8
ggagcgagccatcgacacgatcgcgagcgcatgcacgtacgttgtcggaagctcaaggtagagcaagcaccagtgcctgatcgatggcggcccacgctctcctctccggccggcagctgctgggccgccccgtgcagtcagccgtctctaggtcgtcggcgaggaaggcgcccttcgtcgtcagggccagctccagccctccagccaagcaaggtgccgacaggcagctgtggttcgcgtccaagcagtccctctcctacctcgatggcacgctgcccggcgactatggcttctacccgctgggcctctcggacccggagggcaccgggggcttcatcgagcccaagtggctggcctatggcgaagtgatcaacggccgctacgccatgc

SEQ ID NO: 35872 - DNA, 418 bp, Zea mays
  unsure at all n locations
  Clone ID: LIB3060-013-Q1-K1-G9
cacaaatttggtgagcagattcatccaagtctatacacattgatctacaacaagttgcagaatggaaagaacactgatcacttctaacctctccatgagtgcacatgcttcaagatcgtcccggagggttcactacatctctcctgcggcctctgctgctgcacacaactccagctacaggaagaagaagaagaacgccccgtctccgccgccgtcggccgccgcaactgacaccgttgtcatctcccctcctgccactgacaatgttcagtccactgctccgaagcaggccgggcgacaggagcttgaagagctcgtggccgccaagactaacacttcaagaattgctactgcaagaacaagtgcgccgagacagtctcaggctaagcttcgccgncggcctgccccggcaatcacg

SEQ ID NO: 35873 - DNA, 424 bp, Zea mays
  Clone ID: LIB3060-013-Q1-K1-H11
ctcgcggcggaaagagagagaggagaggtgcgagctggtaagatggatcggttggaggagcggaacattaagaagggggagagggagatggaggaggcgcgcaaggaagaggagcggaaggaggaggcgggggacaggaatacccaggagccgcagcaaggtcaaggcctcagcctctcactcgccaacggcagcgacagcggcaggtctggaatgttgccgatgtcgaacccttcagctaatcccacacagcttacaattttctatggtggatcagtatgtgtgtatgactcggtgccaccagaaaaggctcaagcaatcatgcttatagctgcggctgcagcagctgcggcagccaccaaaggcagtgctgccactgcttttaatcctccaatgagcacttctgtagcagctggacaagctc

SEQ ID NO: 35874 - DNA, 409 bp, Zea mays
  Clone ID: LIB3060-013-Q1-K1-H2
gggaaataaaggagctctcgcaggcactcggtactgacatgagtgatctcatgctcgggataccttggcaaaaccacctgcttacgatcttgcagtcatcatcacgctattagttgaggataatttcgcgcacaagagcacgacaagccgagatttttgggggcgtcggcgtcgacctgtaggcgatggcggcgtactaccacggtggcgccggcacggacatccaggccagcaccgacggcctgcagacgctgtacctcatgaacccgagctacgccgtcgggctacaacctgtggaccccggccatggctggcggcgccgcggacatgtcgccgcaggcgcaggcgcagactcccggcgccgcgggtgctgctggggtcagcgccgtgctcagcctgtcgtcccgcg

SEQ ID NO: 35875 - DNA, 217 bp, Zea mays
  Clone ID: LIB3060-013-Q1-K1-H3
cccacgcgtacgcgcacgcgccatcctcaccactgtgatcccattctcttactgacacccaccctcacggaacagctaactctacaatctgactcaatccacccaccgctctaccttacagtccctgacctttctctcgctcatccaatcctcattctcacctactgccacctcaacaaacctctccttctcgtcccagtacaccacagctcctcct

SEQ ID NO: 35876 - DNA, 101 bp, Zea mays
  Clone ID: LIB3060-013-Q1-K1-H4
cttccccttccgttcccttgcgttggtgtttctattcatcgctgacgattgacgctagattgccgcgaccctcggaatttcagttcgcggttggggcatgg

SEQ ID NO: 35877 - DNA, 398 bp, Zea mays
  Clone ID: LIB3060-013-Q1-K1-F5
ggaacctacgaatcaaagttgccctgtgagcagccaagggccttgcgttcttgcacagcgacaaggccagagttatctaccgagatttcaagacatccaacgtgctcctggattcgaactacaacgccaagctgtctgacttcggtttggcaaaggacgggccaaccggcgaccagagccacgtgtccaccagagtcatgggcacctacggatatgctgctccggaatatctcgcaacaggtcatctcacgccgaagagcgacgtctacagcttcggcgtcgtgctgctggagatgctgtcgggccgccgcgccatggacaagaaccgcccggccaccgagcacaacctcgtcgactgggcgcgcccctacctcagcagcaagcgccgcgtctcccgc

SEQ ID NO: 35878 - DNA, 426 bp, Zea mays
  unsure at all n locations
  Clone ID: LIB3060-013-Q1-K1-H5
gaccccagcccccgctacacctgcgtctccgcggctcccccaaccgtcgccgtggcggctcactcactgctatctccgccgcgtccccggaagtcgagaaagagtcctcgccctcgtcctcgccgcaggaatctctgtctgctgtcgcggacagtgtgaaggtgctcaaggtggcagccaagacgaggaaagtacctgccccggaaattctctcggcgctgtccaagatcaagaaggcaaaactcgacacgtcggcattctttgagacactcggtggtactgagtctccaggcaggacgtggatgcttatcttcactgcaaagggtcggctggagaaagggcagtatttcccagtgacagcagtccaacgcttcgatgctgcnngggaacgcatcgagaaggcatatatttggccccatcgggtgc

SEQ ID NO: 35879 - DNA, 396 bp, Zea mays
  Clone ID: LIB3060-013-Q1-K1-D9
ccggttccggactggttccctgggcccggcggcggcggcggcgtcgtccggccggttaccggtgatcgatgaccggccggtctggcgctcggccttcgccccgtttctgccctcgcccctcagccggctcggcgcctgtccgagaccgacgtcctctctccatccagtcagttgaccagctcgactgctctagctcgtgctctccgtcgcggatttgatttcttcctttcagcccaacccagcccaaagccgccagatcgcggcactccgtccaaccctcggcgccaccgatccccttctccacccccttttcttcttcgtcgtcggtgaagatgattccccagagccagagcagctccctgcagcgccttcaacacgtcgagaagcggatagtgc

SEQ ID NO: 35880 - DNA, 435 bp, Zea mays
  Clone ID: LIB3060-013-Q1-K1-E1
gaacgacgctatggaaaacctcaatcttgaccttcctggacatcaggcacaggatggcaacgccgctgaaaaggtgctcagcttagaggaaagagaaagagagatgccttcatcagagaagctccttcaaactgaaccaggagagaatcaaattcccaatgaacaggatgaaaaggacatacgagatgagaatcaaactctaaaagaaaaggatgaagatgacatgcaagatacagaatttggagaggctaagaaagaagttcaacacgaattacctgtctcccattttctgatgaatctaatattgcgaaaagagagcagtgatgcaaatgaagattcagaatctgaagctgcaacgaagcaaggtgaagcgacagaagatgacagctgcacgttcatttctgaacaagaagaaagtcttgggtcacttcctac

SEQ ID NO: 35881 - DNA, 411 bp, Zea mays
  unsure at all n locations
  Clone ID: LIB3060-013-Q1-K1-E11
atcgctcctctccgtcgccggtggagctcatggcatcctccatggccgccgccgccaccgccaccgccctcccgctgccgtccgggacgacgcagaggccgtctgcccagggccgnctcctcttcaccgccgcgcccgcccgctccctccgcctccgccccgccggccgccggtcggcccgctcctcgcctcgggccaccaaggctgtggtggcagcgttggctgatcctctcaaggtcatgatatcaggagctccggcgtccggcaagggcacacagtgcgagctcatcaagaccaaatatcaactggcgcacatctccgccggagatttgttgcgggcggagatcgctgctggctctgagaatgggaagcgggccaaggaattcatggagaagggccagctcgtgcctg

SEQ ID NO: 35882 - DNA, 426 bp, Zea mays
  Clone ID: LIB3060-013-Q1-K1-E12
gccacatcgagaacacgatcgagcacacaagcacgaagactcgtttaggagaaaccacgaaaccaccaagccgtgcaagcatcatggagtacggtcagcaggggcagcgcggccacggcgccacgggccatgtcgaccagtacggcaacccagtcggcggcgtcgagcacggcaccggcggcatgaggcacggcacgggaaccaccggcggcatgggccagctgggtgagcacggcggcgctggcatgggtggcgggcagttccagcctgcgagggaggagcacaagaccggcggcatcctgcatcgctccggcagctccagctccagctcgtcggaggacgacggcatgggcggaaggaggaagaagggaatcaaggagaagatcaaagagaagctgcccggaggccacaaggacgaccagcacg

SEQ ID NO: 35883 - DNA, 367 bp, Zea mays
  Clone ID: LIB3060-013-Q1-K1-E2
agcagcctaaaaaaaccgtatcgtcttgcctgttcagtttccttctcctcttcccgcggcccggtttgccgaccaggttccaccgttccagagtagccaagcgaatcccgtgtctggttcgcgcgatggcggaggagcagtccaacccccagcaccagcaagcggaggagagggaggttatggtggagcagcagcagccgaggagggccccgaagctgaagtacctggacttcgtccaggtggcggctgcccaggccgcggtgtgcctcgctgggctctacggcctcgccaaggaccacgccggcccgctccgccccagcgttgacgccgtcgagtctgccgtcaagggcgtcgttagccccgtcta

SEQ ID NO: 35884 - DNA, 402 bp, Zea mays
  Clone ID: LIB3060-013-Q1-K1-E4
cccacgcgtccggacagaagcggcagcgacaaaggtgaaacctctgctgactgggacaaggcatgggctaagttcaagaagaaagggaagaggaccctcttttctgatttctcaccagacaagtatgtgacctggaacccacggcgcagcgagtatccgttgtcagaagaggttgatccaatcaagagaactgaaagatctaacttgatgctttggacgagtccccagttcaccttggtgggggcgattatcatcgtcttgacattactaatctacacactagtcgttcctcccaagtaactgcacaagtgacagctaggaagtgagttgtaaatcaatattatttcaaatgggaagtctggattgtacaatttttacgtgcattacaccaactacagtagt

SEQ ID NO: 35885 - DNA, 403 bp, Zea mays
  Clone ID: LIB3060-013-Q1-K1-E5
cacacaagcacttcgacgtcacacgggcgctgcacacagacacaccaagcgtcggcagcaatggcttactaccaggaggtggactactgctcggaggaggtgaggtcggtggccccggccggcttcggccgccacggcggcggcgtccagcagcacgtcgtcaaggagaagttcgaggaggtcgacacggtcgcacgcgccggcgccaaccaccaccaccaccatggtcaccacggcggccacggcttcgtggtgcgcgagaccagggtcgaggaggacatcaacacctgcaccggcgaggtccacgagcgcagggagagcttcctcgccagggctaactgagcagcccgggcggccggcatccacgcccgttcgtgcctgcctgcgtgccttatgtatgtct

SEQ ID NO: 35886 - DNA, 381 bp, Zea mays
  Clone ID: LIB3060-013-Q1-K1-E6
cggtcctctcggctctcggtgtgggaagggaaccaaaccgagacggaggcggagtacgacgcctgccttccctcttccgccgagcgcccgctgcgtcattctcgtccctcctcttcatcttcatcggccaaccgattgccgctgaccccggccatcggcgactgtcccccggtttttctttaacgatttccgattcgattccatggccggctggaccgattccaccggcagcggcggccgaagatcaggaagaagaagcttcacgacaccccgctatactactaattccaccaatgacatgatccatggaagtaccagcggcggaagcggaaggagcggcaggtggaaaagaagcaagtcaagggggtggccggccccgga

SEQ ID NO: 35887 - DNA, 276 bp, Zea mays
  Clone ID: LIB3060-013-Q1-K1-E7
gcgggtaggacaggatccagaggtagctagccatggcggaggaagcgtctgcgcctgcggcggtgacggaagcgccgccggggaagatgacgatggtggtaggggtcgacgagagcgagcacagcttctacgcgctgcagtgggcactgcagcacttcttcccgccgggccagccgcagcagtaccgcctcgtcgtcgtcaccgccaagcccaccgccgcctccgtcgtcggcctcgccggcccaggcgccgcggatgtgctgtcgtacgttgagg

SEQ ID NO: 35888 - DNA, 402 bp, Zea mays
  Clone ID: LIB3060-013-Q1-K1-E8
gagagatcacgtcgcaagaacctgaacagagtggcggacgcggacacgatggcgctggacgacatgcagcgcgacgaggtgttcaacagggacaacatcccgacgtggctgtcctacgcggggtacgccgcgctgagcctgatcgcggtgatcgccatcccgatcatgttccgggaggtgaggtggtactacgtggtggtggcgtacgcgctggcgccggcgctggggttctgcaacgcgtacgggaccgggctgacggacatgaacatggggtacaactacgggaagatcgcgctgttcgtgctggcggcgtgggcggggaaggacagcggcgtggtggccgggctggtggggtgcgggctggtgaagcagctggtgctcgtgtcggccggactgatgcac

SEQ ID NO: 35889 - DNA, 430 bp, Zea mays
  Clone ID: LIB3060-013-Q1-K1-E9
ctgcaagctaaggagagtgtgatcaccatcagctagtgctagtcccccttccttccatgcatccatggcatgcgtcagcaccttccagagctgccccattgccagaagagcaaagatcaacaccaggtccaggggcagcagcagtagcgtggcgaaggggtcaccaccaccagccttccagttccagtgcagggcgtcgactttcgcggcggacaccagcctccggctcgagctggacgagaaccccgaggcgatcatctcgggggcgtggcccgggaactgctccctcctcagctacgacgacctccgcgcctacctcgagtcgcaggagacggcggcccaggcagacgatcagcgcggcgtggcgctcctgagcgagaccatgtccacacccgtgctggtggccacagcagaccagaccctggaggac

SEQ ID NO: 35890 - DNA, 413 bp, Zea mays
  Clone ID: LIB3060-013-Q1-K1-F10
atgcttaattcatgagttgtagggatttacttatgtcaccacaaacagaaactaaaggaagtgtttgatttaaagctggtgttaacgattataaattgacttactacaccccggagtacgaaaccaaggatactgatatcttggcagcattccgagtaactcctcagctcggggttccgcctgaagaagcaggagctgcagtagctgcggaatcttctactggtacatggacaactgtttggactgatggacttaccagtcttgatcgttacaaaggacgatgctatcacatcgagcccgttcctggggacccagatcaatatatctgttatgtagcttatccattagacctatttgaagagggttctgttactaacatgtttacttccattgtgggtaacgtatttggtttc

SEQ ID NO: 35891 - DNA, 347 bp, Zea mays
  Clone ID: LIB3060-013-Q1-K1-F2
gggacctacgaatcaaagctttcctgtgagcagccaagggccttgcgttctggcacgttgacaatgccagagttatctaccgagatttcaagacatccaacgtgctcctggattcgaactacaacgccaagctgtctgacttcggtttggcaaaggacgggccaaccggcgaccagagccacgtgtacaccaaagtcatgggcacctacggatatgctgctccggaatatctcgcaacaggtcatctcacgccgaagagcgacgtctacagcttcagcgtcgtgctgctggatatgctgtctggtcgtcgtgccatggacaagaaccgtccggactccgagcacaac

SEQ ID NO: 35892 - DNA, 379 bp, Zea mays
  Clone ID: LIB3060-013-Q1-K1-F4
ggaatgcaaggaaggagagacacaatcggcggcaacagcgattgatttcgtccgccgcacctctcctctctctccgccgccgtcgccgccgccaacaagggcgaaaccttccgatttcttccacttctgctgttagggttccgcctccacctgctctgctctggtatcttctgcgcaatgccaatgctgtaatggatcgatcgtcagattcttccaatccaccaggtcttgccgtgcctgccgcctcaaagccaccacagatggccgcaaataacaacccttggagggcccctctgccaccgctgctcaatgctcgcgctggttttggtggcgatacaagcctcttctcaacctcgctgccggttcttcctcatgaaaa

SEQ ID NO: 35893 - DNA, 359 bp, Zea mays
  Clone ID: LIB3060-013-Q1-K1-D7
cggacgcgtgggctcctctgcaccccccatcctcggacatcctcgcctgcagcagacgctcctctggtgcgcgtgcgccaccggcgagatgtcgaagaaaatcgtggtgaagctgcacctgcaggacaacaaggacaagcagaaggccatgaaggctgtctcggcgctcaccggcatcgacgagatatccgcggacatggcgtcgcacaagatgacggtggtcggcatggtggaccccgtgagcgtggtgagcaagctgcgcaaggcgtcgtggtcggcgaccatcgagtccgtcggcccggccaaggagccggagaagaaggacggggaggcagccaaagaagacggcggcgaggggg

SEQ ID NO: 35894 - DNA, 460 bp, Zea mays
  Clone ID: LIB3060-013-Q1-K1-C11
ccggattcccgggctgacccgggccacactccgctgctccgccatggcgatccgctccaaggcctggatctcgctgttgctcgcgctggccgtcgcgctctccgcccgggcggaggaggagcccgccgccgccgcggagggcgaggccgtgctcaccctcgacgtcgacagcttcgacgaggccgtcgacaagcaccccttcatggtcgtcgagttctacgccccctggtgtgggcactgcaagaaacttgctccagagtatgagaatgcggccaaggcacttagcaagcatgacccaccgattgttctcgctaaggttgatgctaacgaggagaagaacaggccgcttgctaccaagtacgagatccaagggttcccaaccatcaagatattcagggaccaggggaagaacattcaggaatacaagggccctagggaggctgatggcattgtggattac

SEQ ID NO: 35895 - DNA, 425 bp, Zea mays
  Clone ID: LIB3060-013-Q1-K1-C12
cagtttggcacctccgaagcttccgtccgaatctctgctgcctccttcctcggccaggcttgcgggcgatggcggcggagcagaccgccgagcagttccggggccaggcgcggctgccccacttcgcgtccccgcggcgctacgacctgcgcctcacgcccgacctccccgcctgcgtcttcactggctcggtggcggtttccatcggcgtggccgcgcccacccgcttcctcgtactcaacgcagccgagctcgacgtcgcgaccgggggcgtcagcttcgcgcctcagggctccgaccaggtgctacaacctttggaggttaccaacgtgccagaagatgagatcctgattattcgcttcaatgaggtgctttctatcggggagggaactttgacgattgcattcaaggggactttgaatgat

SEQ ID NO: 35896 - DNA, 284 bp, Zea mays
  Clone ID: LIB3060-013-Q1-K1-C2
ttcccaactcctttaattctatctcttgaccccacactattctgccatgtcaacactgcagctcaaccacatctcgcgggagacctccgacgtggcccgactcgccgccttctacgaggccgagctgtggttcgagcgcatcccttcagccacctactagggcttacacgtcgcatggctccgcctcccgagctcccccgacgtcgcgctccacctcatcgagcgggaccccgacgcggcacccgtagcggtgggtcctggcgctccaggcgcgccaccgtcgc

SEQ ID NO: 35897 - DNA, 197 bp, Zea mays
  Clone ID: LIB3060-013-Q1-K1-C3
cgaggccttcgccaggacctagaaatttggttcttgctaccggtacctgtattggtgcgtgacgcgttcttctgcttctgcttgcggctacctttattgttacgtgacgtgtactggtatgttgtggtatggtttagcctgggttatcttgtaaaaggatctgaagtggttaaataatcgtgggtaatttcgttttt

SEQ ID NO: 35898 - DNA, 414 bp, Zea mays
  Clone ID: LIB3060-013-Q1-K1-C5
ccctcccccctccattcctccctctccctacacctccgctccctctcgccgctgtcggccacccaatccgaccgctgggccgcctcctctccgccggggccggcgattccccggagattccgcgcgattcggctcagattctgggctcctcttgtggtttctcggcgaatcggcgggatcgggactcccggctggagaatcttccgtctctttcgctaactgtttggatcattttacgtggagattgcatgccatcaccttccttgaagtgaaaaatatatgggctgatcttggcatttcatgggaggttttgaagatgatgaaccaccctcaaaacgcgcaagagcatcctcagtagaatctgcaagtttaccagactgtttcttgttttcaaaatctgccaatcctttggga

SEQ ID NO: 35899 - DNA, 421 bp, Zea mays
  Clone ID: LIB3060-013-Q1-K1-C6
cagggatctgtcttgtcacctggagctggacctgacgatggcataccatctgatctgttcaccactggaccttctcgcacaatcgctcgtcgtcgccgtccctctacttctgctcctgcttcaccaacgctcatcaattcgccgccgtcgtcgcagcagcagcagcagatcggccaagcagggaggacagctgctgccggcttcgcccgcggcgctgcccatcatcggccaccttcacctcgtcagcgacctgccgcacgtctgcctacgtgacctcgccggcaagcatggtggtgacgacggcctgatgctgctccgtctcggcgctgttcccaccctcgacgtgtcatcggcgcggaccgcggaggcgatcacgcgcacgcacgaccacgtgttcgcgtcgcggcccacgttcactctc

SEQ ID NO: 35900 - DNA, 434 bp, Zea mays
  Clone ID: LIB3060-013-Q1-K1-C9
catcacgtccgccctccccctctctctccctctccctctctcgacgacacaccaggccaccacgcacatgctttgtcccatggatgccgaccacctcatggtgttcaagaccatgctcgccgtcaggtggtagtcccggcgagcgagatctccccactccaggctctctcccatcgctcgctgccgcctcatgttgtttgcggccgtgctcgccaaccgcggcacggaggcgtcgatccgaccgggagcccttcgcaatggacaaagccttcctcctctccggcaatgagggcatcgtcggctcgtcgctaacatggggaagaggtaggagtagctcagcagtaggatggagtggccaggacagctcggtgcccacccgtcttcatcgatcgggaccctcttcccctctagcgagctattcccagtttcgagaa

SEQ ID NO: 35901 - DNA, 401 bp, Zea mays
  Clone ID: LIB3060-013-Q1-K1-D10
cttccaccggaatcgcacgcgaaaatcccgctcgagcttccaccgtgtccctccgctgcgccgtgcggcggtgccgggtcgcgccgtgccatggtgcccgccttctcggtctggtgcgcgcccggatcctcgcgcccgctggccgccagccccggccccagcgtcgtcgtcgtcgcctcctcccaacttcccgcgtcgtcgcggagcagcgaacgcaggagagcaccaggcctcacgctcgccgaggacccgggtgtcggctgtagggatggcggtggcaggtggagagcaggcatctggttcttcctcttcatgccgccgttcttcacagggaacaaggaggagaaggacgctgagaacgcgatgaggctcaaggaggagctcctcgacgccattgcacc

SEQ ID NO: 35902 - DNA, 422 bp, Zea mays
  Clone ID: LIB3060-013-Q1-K1-D12
cgagcaagaagcaagcagcagtaacaagaaaccatcatcgatccatgtatccaccaatggcggcgctcggaggacggcggaggagggcgtcgtcagcggccctcctgctagccttgttggcggtggccctggtctccctggccggcccagccacggccgcggggaacaagaccgggcaggtgaccgtgttctggggccggaacaaggccgagggcacgctgcgcgaggcctgcgactcgggcctctacaccatggtgatcatgtccttcctcgacgtctacggcccgcagcgcggcggctaccaccagtaccacctggacctgtcggggcacccgacggccggcatcggggacgacatcaagcactgccagttcgtgggcgtgccggtgacgctctccgtcggcggcttcggctccggctac

SEQ ID NO: 35903 - DNA, 316 bp, Zea mays
  Clone ID: LIB3060-013-Q1-K1-D2
cccacgcgtccggcttctcctccccctcttatcaagtcctcctcgggttagggttcggtatggttttgtggaggggcgatggcggcggctgatgtggagtaccgttgcttcgtcggcggacttgcctgggccaccagcaacgagtcgctggagaatgccttcgcctcctacggcgagatcctcgactgcaaggtcatcaccgaccgggagacggggaggtcccgcggcttcagcttcgttaccttctcctgcgagaactgcatgctcgacgctatcgagaacatgaacggctaggagctcgacggtcgtaacatca

SEQ ID NO: 35904 - DNA, 418 bp, Zea mays
  Clone ID: LIB3060-013-Q1-K1-D4
aaaaacataaaagaataaagaaaagaaaaggtcactcgtatagacatgggcccaaaccccttccccttgggccatgaaggtaccgcaggatgaggcgcatgaaggatgttgcgatgagttcgtgagagagatctaggtcgtcgtctcccagtcaactttgggttgctggaccgttgtctccttatatgtaattatttattttgtatagaactcctattatatagtaaagttgtgacatttgaccctgtgccatgattcatcatatgtgtgagacttggtcccagcacacctggtgattatgttcgcgcccgggtcttggtaccccgaaacccgggtgtgacaggtgtttgaatgtttcaactaatttttgccactaactattagttttagtgcattcaaacaccctttaatttaccaa

SEQ ID NO: 35905 - DNA, 399 bp, Zea mays
  unsure at all n locations
  Clone ID: LIB3060-013-Q1-K1-D5
ccggcgatggcggctcttgctccatccaagattctgggcaccaagctcaacttcgccggctcctcccgctacgccaccgcagcgcccaccgcgggggctcagaagatcgtctccctcttcagcaagaagcctgcccagaagcccaagccctctgcggtgtcgtcctcttctccggacatcagcgacgagctcgccaagtggtacggtcctgacaggaggatctacctgccggatgggctcttggaccgctcggaggtaccggagtacctcaccggagaggtccctggagactatggctacgacccttttggcctgggcaagaagccagaggacttcgccaagtaccaggcctacgagctgatccatgccagatgggccatgctncgtgccgctggcgct

SEQ ID NO: 35906 - DNA, 413 bp, Zea mays
  unsure at all n locations
  Clone ID: LIB3060-013-Q1-K1-C1
cgccggccgcgccgcgcccaactcctctgatcctcttccttgtccccaccctcttcggcgatggcgacgctgcagctcaaccacatcgcgcgggagacctccgacgtggcccgactcgccgccttctacgaggccgtgctggggttcgagcgcatcccttcgcccacctactcgggcttccaggtcgcatggctccgcctcccgagctcccccgacgtcgcgctccacctcatcgagcgggaccccgccgcggcacccgtcgcggtggggcctggcgccgagggcgcgccgncgtcgcagctgccccggcgccaccacctcgccttctccgtcgctgactacgacgggttcgtgaccgggctgaaggcgcgcggcaccgatgtgttcgaaaagtcgcagcccgatgggcgcac

SEQ ID NO: 35907 - DNA, 429 bp, Zea mays
  Clone ID: LIB3060-047-Q1-K1-C7
agaccgcagccgctaccggaaccttattgatgttcaacacgctgacatcatagagcgggggccagtcttccttctcagctaacaaacaggcagcctactttaggtctcgtagagcagggatgtcatcgaacatgcaagggaacaccatctctccagtaaagtacacagctcggccttcttctgtagctctaatagggtcaaacaaactcccatattcgccatgaatcttttcagcagaccattttgatgaagagccctcacagtagatagactcgtgcaagagggcataaagaggattttgatcaaatctagccacatttcgaactcttttaagaagtaatagcttatcctctgtttagcttcaacgacgagtacaagattatccacaccgttgactccatcatatctttcgcaaattaaatctactgc

SEQ ID NO: 35908 - DNA, 446 bp, Zea mays
  unsure at all n locations
  Clone ID: LIB3060-047-Q1-K1-D1
accaagccttccgccgaaagctatacgctcggccgttttctgcataaacggtggcaggcggagcaaccgggcacgcccgccgccgtcctactcccacctgcccccgtcttcgttgccggcgacgagcacccactacaccagattaacatcctataccatggcctatctgccttgttcacaaataaagttaagcaaagtacttgtcaggaggaagtttcatgagagtggacagaccaatttgccaagtcctcttcactggaaacccttgcgaccaggctgttttgaaaatcttgtgctgcgatgcaccaagaatttgtcatgggaaacatctcttccatatgcctctgcagaggatgatgccagtatcatcaagggaacaagtgttgttgaacctattgatacagaagaagctccacagattccaatcctncagagtgatgaagatg

SEQ ID NO: 35909 - DNA, 411 bp, Zea mays
  Clone ID: LIB3060-047-Q1-K1-D10
caaaacgacttagctatcaagctcgaccgacgaccgaagctaagctaccaagctactagtagtcttcttggtcacgttgttgattgcagcggtcgagcacacacaagctagctagctagccgctagagctagggtcgtcggatagatcgacatggccggcagggacagggagccgctggtggttggtagggtggtcggcgacgtgctggaccccttcgtacggaccaccaacctcagggtcagctacggtgccaggaccgtgtccaacggctgcgagctcaagccgttcatggtggtgcaccatccaagggtcgaggtcggaggacctgacatgaggaccttctacaccgtcgagatggtggacccagatgctccgagcccaagcgacccgaaccttaaggagtacctaca

SEQ ID NO: 35910 - DNA, 410 bp, Zea mays
  Clone ID: LIB3060-047-Q1-K1-D12
ctcccactcccactctccctttccactctcaggctcccactccccccctaccggctaccctacccatcacacacaaacagccactcctcacctcccccgtcctccggttcatgtcctgctgctccccatgtcgcccccactcgacctcgactacataggcctctcgccggcggcggctgccgccgctgcccacgacgacctgaagggtaccgagctccgccttggtctgccggggtccggttcgccggaccgccgtgttgtggctgccaccgcaaccaccctggacctgctcccggctaatggcgccaagcgcgggttttctgacgaggcgccgacgccatcgcccggtgcagcttccgggaagggaaagaaggtagcggaagaggaggacgacaagaaggttgcagcga

SEQ ID NO: 35911 - DNA, 399 bp, Zea mays
  Clone ID: LIB3060-047-Q1-K1-D3
gtacgcggggaaccaatttgtaatcaagattttcatatgcttgtcgcaaatcctctcaaacaggaatgtaccattcaagtgaaggattcaattggtctaactgacatcactattggcaccggagaggtggagctagggtcacttaaagatacagtacctacggacaaaatcgtgactctatatggaggatggggtttgtttgagaagccataggctggggaagttctacttcggctgacatacaaggcatatgtcgaggatgaagaggaagaagacgaagctgtgacaagcgagattgatgcgggttacgcctcatacgaggatgtgctgtactactttagtggcatgagcaagggtactgatttcgtcagtaaagaaagggaaactttcatggatctt

SEQ ID NO: 35912 - DNA, 284 bp, Zea mays
  Clone ID: LIB3060-047-Q1-K1-D4
accaagccttccgttctgtaagcctgctgccgtcttcttccgccgccgccgccgtcgtcttcgtccgtaggtcaggcagcggggaggaagaaaaagcgatcgatggcgtccaactacgtggacacgacgggcgaggagggacggttccacggccctcacagccacagcaccagcacgaccccgacgggcggcgcggcggcggcggcggcatcgccgcgcaacttccggcgcagcttctcctccgcgtcctccgcgggccacagccacggcggctggcggcggcg

SEQ ID NO: 35913 - DNA, 429 bp, Zea mays
  Clone ID: LIB3060-047-Q1-K1-D5
aaaggcatcaccgccgcgactacgatggcagcctcgctccaagccgcggccacgcctggtgcagccggccaagatcggcggccgggcgccctttgcctcgctgccgtcccgcccgtcgtcgcaactcgcctgcagggcgttcggcgtcgacgccggcgccgccaggatcacgtgctccctgcaggacgtcgccagcaggtgcgtcgacgccgcgaagctcgccggcttcgcgctcgccacctcggcgctcctcgtctcgggcgcgagcgcggagggcacgcccaagaggctgacctacgacgagatccagagcaaaacgtacatggaggtgaagggcacgggcacggcgaaccagtgcccgaccatcgacggcggcgtggagtcgttcccgttcaaggccggcaagtaccagatgaagaagctgtgcct

SEQ ID NO: 35914 - DNA, 408 bp, Zea mays
  unsure at all n locations
  Clone ID: LIB3060-047-Q1-K1-D9
gacgagcgccggggcggcgacaggcgccgngctaggcgcgcggacggcgcggtcctgcgacggctgcatgaggcggccggcgcggtggcactgccccgccgacgacgccttcttgtgccagacctgcgacgtctccgtgcactcggcgaaccctctcgcgcgccgccaccaccgcgtccgcctcccctctgcgtcctgctcctccccaccgcgcgacccggacgcgccaacgtggctccacggcctcaagcgacggccacgcacgccacggtccaagccaggggggagcaagagcaacaagcatgaggcgactcccagctttatcgccgcggctgcgtcgtcggcagcggtccccgacctcgaggcggaggagtccggctccggtatcctgggcggtaacgacgacca

SEQ ID NO: 35915 - DNA, 433 bp, Zea mays
  Clone ID: LIB3060-047-Q1-K1-E1
gagatcatgaggaagcaatactcccctgtgctctccttgtgcctgatggcccttgtcgtagctgctatggtctgtgtcatgtacaccacctcggcacaagcaggaaggagtggctacaactcgtacgaacctgatggaaggggtggatacaactctgttcccatcaacggcggtggcagcccctagctaggcggtggatcggagcctgtatcagaaatcgaaataatataagactgtcttcaacggatcacactgccgctcccccacgctaaatttgggggctacagtgcacacgctagccgatcaacggctcacgctaccaggcgctctacgcggatgtgccccctagccagcttctctctccccctcgttctgtggtgcctctctcaccctctctaatattgttcacgtgggcccacttccaattattagt

SEQ ID NO: 35916 - DNA, 427 bp, Zea mays
  Clone ID: LIB3060-047-Q1-K1-C5
cggacgcgtgggcggacgcgtgggtcagaatatcacaaattgagataactgtggacgatactctcagtgcatctgtccatccaggacacaaaggccaatacatcagtgagatagtttataacttctcaacctgattaggataaaatggtctgaactacatagctagctgacgcagttggtcaacttatctgtggtgaagatgaaggacattagggctttcaatagtcctgcacaatacacttgcactttcatgtgcaagacatggatttttatcatgatatgaagggcttgtaacataatggctcagccttgaccatttgtagaagcagcacaaagtcattttgaagtacatggatttctgtgaggattaatttttttaatatttacttgtgttgagaaatagaagggagtggtgagagctatctcg

SEQ ID NO: 35917 - DNA, 415 bp, Zea mays
  Clone ID: LIB3060-047-Q1-K1-B11
cgtgcgggtgccctacccgcggcggacgagaagaagacggggctgctccgggcgctggccggggcggcggagcggctgcggctgttcgaggcggacatgtacgacgccgacaccttcgagcccgccatcgccggctgccacttcgtcttcctcgtcgccacgcccctgacgcacgaccccaccagcaccaagtacaaaaacacgacggaggcggcggtggacgcggcgcgcatcatcctccggcagtgcgcgctgtccggcacggtgaagcgcgtcatccacacggcctcggtcacggccgcgtcgccgctcaaggaggacggtagcgggtacaaggacttcgccgacgagtccaattggacgccgctcaacctctcctacgaattcaccaacgcttacctggacgactacgtgc

SEQ ID NO: 35918 - DNA, 422 bp, Zea mays
  Clone ID: LIB3060-047-Q1-K1-B2
cttcgcggacatgagctgggacgagttccgtgcgacccggctcggcgcagcccagaactgctccgtcacgcggaccggcaaccaccggatgcgcgccgccgtcgttgcgctgccggagacgaaagactggagggaggatgggattgtgagcccagtgaaaaaccagggccactgtggatcatgctggaccttcagatatgcctcacaaacaaagaggcaaaagggtaaacctgcaggagagctttcatggaatgttgaggtgcagaaacttactccctccggtttcctattagttgtcgttttggataagcactactggtgcacttgaggctgcatatacccatgcaactggcaagcccatctctctctctgagcaacagcttgttgactgtggttatgcattcaacaatttcggatgcaac

SEQ ID NO: 35919 - DNA, 456 bp, Zea mays
  Clone ID: LIB3060-047-Q1-K1-B3
ccgggttgaaccaagccttccggttgttgccaacggtttccaaggtccattggccgcccaaaacccgaagccaccccgaggatgggccaaattcacacttcctagcccgtcctccgtccaaatctcttttcggcccagggaggcggcggaacttggtgcctgcatccgagccctagacatggatcaacctgaggaaaaccctgaattcccaagctgtgatgcctactttgaagctatccagtccaagaagaagttgccactgactttgcaagaatcactaactgctgcctttgctcagattccagtctcatccttccctgaagttccagctggtcgagtaattgaaattcctggtgatacttctgttattgatgctgtaaggactctctctgaacagaacataagggcagcaccagtactgaatccagaacctggggctcctactgattggcaggg

SEQ ID NO: 35920 - DNA, 433 bp, Zea mays
  Clone ID: LIB3060-047-Q1-K1-B4
gtggtgtaggaggaaaaggtggtgatggtcattttacgaatcgtgcaccaaattgtggggatgctggacgtggtggatggaatgagggtcctgggaacagtcgtagggaaggattgatgtcatacaaacaattcattcaggaacttgaagatgacgtttcaccagttgaagctcaaagcagatacgaggggtacaagtcagagtacatcacaactcagaagaaagcatactttgacctccataaggatgaagattggttaagaaataagtaccatcctacaaaccttgaaaatgtcattgaaagaaggaatgaactggcaagaactactgcaaatgatttcttcctaaaattgcaaagtggagatctggacatcggtccaggtttgacgggttcggcagtgagcaaatcaggaattaatagcagtaaaaatct

SEQ ID NO: 35921 - DNA, 286 bp, Zea mays
  Clone ID: LIB3060-047-Q1-K1-B5
cccggttgaaccaagaggtactcggcccatcgtatctcaaaaacaagcatcgaattatcagagcctatccaatgccctatgacaggatcatctccagcggcatacctgttctccacagcaaactgatcacatggccgccatgtcactgtaccatcagaatatctcggagaacttcaacaagctcgacgtctccaacactgtggcctaactccttcacacggctaccgcgtaccgttagctcgacgacaaaccttgcgaccaacacttcgagaacgcctaactgtac

SEQ ID NO: 35922 - DNA, 433 bp, Zea mays
  Clone ID: LIB3060-047-Q1-K1-B6
cgcctcagcgcgtcgcccgccgccacatcctacagcgacctcatcgatcaccttcaggtttcaatcatggcggacgtcgatgtcgaaccggaggttgccgccggcgctcccaagaagaggacgttccgcaagtacagctaccgcggcgtcgacctagatgcgcttctcgacatgtccacggacgacctcgtccagctcttccccgcgcgcgccaggagaaggttccagaggggtctgaagaggaagcccatggcactcatcaagaagctgcgcaaggcgaaaaaggatgctcctgctggtgagaagccagagccagtcaagacacatctccgtaacatgatcattgtccctgagatgattggaagcattgttggggtctacaacggcaagacgttcaaccaggttgagatcaagcctgagatgatcggccact

SEQ ID NO: 35923 - DNA, 431 bp, Zea mays
  Clone ID: LIB3060-047-Q1-K1-B7
aaggagagtacgtggaggagcagccatggcttcatcggtggccgccgcggcgagcacgattcctgggcacccgcctggcggacccggcgccacagaacgggcgcatcgtggcccggttcgggttcgggttgggcggcaaggcgaagcctgctccgaagaaggtggcgaagacatcgacctcctctgaccggccgctgtggttccccggcgccgtggcgcccgactacctggacggctcgctggtcggcgactacgggttcgacccgttcggtctcgggaagcccgtggagtacctgcagttcgagttggactcgctggaccagaacctggccaagaatgaggccggcggcatcatcggcacccggttcgagtcctccgaagtcaagtccaccccgttgcagccctacagcgaggtgttcggcctccagcgg

SEQ ID NO: 35924 - DNA, 411 bp, Zea mays
  unsure at all n locations
  Clone ID: LIB3060-047-Q1-K1-B9
ctgaaagtaaagagaagggagtttctggtaacgatgctactatgggtccaaagcacacgcttgcacctggtagtgttacctcttcagctgaattggcttctagcgttctgaaagggagcgaggattgggatgctgatgtaatggataagtattctattggaaaagaaggcaaatctaaaaatattgatccagttaggaaggatgattcagtagcaatcttagaacagttctttggcaatgttttatcgaaaagcggcagcaacctaccaacttatgttgagaaccagccattgaaaactgatgatgacatgatcacttctgtgccagaatcatccaaatttgctcattggtttcttgatgaagacttgaaacctgcagaagacttatcttcaaagagcctgctctncatga

SEQ ID NO: 35925 - DNA, 393 bp, Zea mays
  unsure at all n locations
  Clone ID: LIB3060-047-Q1-K1-C11
cgcggttcggttccagtttcactcccactgccgtctcggcaacctcccctgttccacgcttcgtcctcgcctgccaggctgccatggccgcgacgtcccccttcgactgcgtcctcctagacctcgacgacaccctgtacccgggcgacaccggcatcggcgcggccctgaggcgcaacatcgacgagttcctncaggccaagctcggcgtgtcggccgacgaggccgtcgtcacgcgcgccgagctcttccgcgcgcacggcagctccctcgccgggctcatcgcgctcggctacgacgtgcacccggacgagtaccacagctacgtgcacggcaggctaccgtacgacaggatcgcgcgcgacccgcagctggcgcggctgctgcagagca

SEQ ID NO: 35926 - DNA, 438 bp, Zea mays
  Clone ID: LIB3060-047-Q1-K1-C2
cttccgagaaattaggggaagtagtcacccatgccgtactgccaccattgctcaaaccacttggaggaagagtctccaacaggcaatgattacatcaatgccagccatatagagattgctggcacaaatctaacgaagttcatttctactcaaggaccacttgccaatacaattgaggatttttggcagatggtatatgagaaccactgtcctgtgattgttatgctcaccaaatttgatggtcttaagtgtgatgagtatctaccattgagcaagggacaggctgtttttggaaaatttaccattaagatcacaaagttcaggaaagatggtcagttattgttgcgtggtgtggagattcgacaggatgagtcagatgaagtgcgatctcttctccacattgagtatccggagtggcctgaccatggtgtgccaaac

SEQ ID NO: 35927 - DNA, 419 bp, Zea mays
  Clone ID: LIB3060-047-Q1-K1-C3
tcccgtgttcaaccaacccttccgaactatttctaaatcaccagcgtccccctttttttttcatttgattcaaacatttagcactgatagtcttcaacattcaatgattacatcaatgccatccatatatagattgcttgcacaaatctaactaagttcatttctactcaacgaccacttgccaatacaattgatgatttttgtcaaatagtatattagaaccactatcctgtaattgttattctcaccaaatttgatagtcttaactgtcattagtatctaccattgagcaatgtacatactatttttacaaaatttaccattaagatcacaaagttcacaaaagatgatccattatagattcatttgtgaatacattctacactatgagtcacattaaatgcgatctcttcttcaca

SEQ ID NO: 35928 - DNA, 381 bp, Zea mays
  Clone ID: LIB3060-047-Q1-K1-B10
gcagcggctcatctttgctggaaagcagcttgaggacgggcgcacgcttgccgactgcaacatccagaaggagagcaccctccacttggtgctgcgcctcatgggaggcatgcagatcttcgtgaagaccctgaccggcaagactatcaccctcgaggtggagtcttcagacaccatcgacaatgtcaagggcaagatccaagacaaggagggcatcccaccggaccagcagcgtttgatcttcgctggcaagcagctggaggatggccgcacccttgcggattacaacatccagaaggagagcaccctccacctggtgctccgtctcacgggtggtatgcagatctttgcgaagacactcactggcaagacaatcaccct

SEQ ID NO: 35929 - DNA, 417 bp, Zea mays
  Clone ID: LIB3060-046-Q1-K1-H5
attgcacagtgctacgaaggcaagccaatctttgatttcgaccgtgctcggatgttggggtctggtcttgttgggttcacgcttcatgggtcactttcacattactactaccatatctgtgaggcactattcccattcaaggattggtgggttgtccctgcaaaggttgcattcgatcagaccgtttggtctgcaatctggaacagtatctacttcgtggtcttaggtttccttcggttggaatcacctaccactatctacagtgaactcaagtctacattctggcccatgcttaccgctggatggaagttgtggccttttgcacacttaattacatatggtgtggttcctgttgagcaaagacttctatgggtcgactgtgtggagcttgtctgggtcacaatattgtcgacgtac

SEQ ID NO: 35930 - DNA, 309 bp, Zea mays
  Clone ID: LIB3060-046-Q1-K1-H9
ggatattctgtttcataattctgaaatagagttcttttttttagtattactcgtcagtaggatgtatatattaatcatcctattttaatatatattaatcatcctattttaattaggttctaatccaattagtagtaagtattttcttttttatttaatagtctctgactatcattaaataaagggtagagcaattcttttttctagagattctagagaaagtgagacaaagtgaaacgaaagagttttctttgtataagaattaggtctatatcatatctaaatagaaagggaaatcaaaaagaaagg

SEQ ID NO: 35931 - DNA, 271 bp, Zea mays
  Clone ID: LIB3060-047-Q1-K1-A10
ctcatcgatctacacacatacatagtttcttctactacacgacgacaaacatggggaggcctgcgaagatcggagagtggggtggatacgccggcgatcgtcgggatctgagggctactccggaccgtctgatcgaggtgaatgtcacggcggacaacagcagctgcatccgctccatctgcttcatctacatcggagccgatgggcaaccgtacgaggaagggccatggggtttcggccatgctggcactgagtacatgattgatctgtg

SEQ ID NO: 35932 - DNA, 419 bp, Zea mays
  Clone ID: LIB3060-047-Q1-K1-A11
gcacgatcaatgtacacattgcccgtccgcgccaccacatccagcatcgtcgccagcctcgccacccccgcgccgtcctcctcctccggctccggctccggccgccccaggcccaggctcatccggaacgcccccgtcttcgccgcccccgccaccgtcgtgggcatggaccccaccgtcgagcgcttgaagagcgggttccagaagttcaagaccgaggtctatgacaagaagccggagctgttcgagcctctcaagtccggccagagccccaggtacatggtgttcgcctgctccgactcccgcgtgtgcccgtcggtgacactgggcctgcagcccggcgaggcattcaccgtccgcaacatcgcctccatggtcccaccctacgacaagatcaagtacgccggcaccgggtccgc

SEQ ID NO: 35933 - DNA, 411 bp, Zea mays
  Clone ID: LIB3060-047-Q1-K1-A12
gctcttccagcacattataggttccacctagttgtggatcaacgaagctctgtgctagagccatcaactcaattgtatactgaactatgtcacgaggcagggatcctttggcatcgagccagctaatcggtgatgcgttggatcctttcatagaggcagctacgatgaggaccaattatagtgacaaggagatcacaaatggcactgtactactagcatctgatgtgctcaatgcaccacatgtagagatagaacgccacgtgcaagcaaatctatacacactggttatggtggatcctgactcaccaagtgcacgcttaccagagtacagggaacatctgcatagttgagctgatagcatctgatatacaagccaattttgagttgaatattacctaaactctggatagc

SEQ ID NO: 35934 - DNA, 388 bp, Zea mays
  unsure at all n locations
  Clone ID: LIB3060-047-Q1-K1-A4
aatagtaccaactctcccgaatttaaattaaaattggactttaatgctnatgctgaaggaaatggatcagaatggagaattgctgctggggaatgtccccttcccgtgtgactttcccggctttggaagaagagtgcttgtagtcagcttcgtaccggcaccgatctccggcgtccgcagctggttctttgaaggtccaagagttgttgttgcaccttcgtcgatgaaacaccctcgatcttccttcattcctgccgtccgaactttctcgaaacgccgtccttcaccaatgggctctcgtcagctcacgaacggctccgcgaacttcccccatgtaactcctcgtcgggcgaagtgcgacgagaggatgtccagcgtcgtcatgacc

SEQ ID NO: 35935 - DNA, 338 bp, Zea mays
  Clone ID: LIB3060-047-Q1-K1-A5
tactgcacactgtctcgatcacctgactccatcaccgtgcctaggtgtcgtctatgtacaagaagagcagagatatacatgatcgagcagaggcggatagaagaggatgagcaccacaactgcgtcgttactgaaccccaacgcgccgctcttcatcccggctgcgtaccgtcaggtggagtacttctcgcccgagtggtgggagctcgtcaacaccaccgcctggttacgtgaccactgcttccggcagcgccagctccactaggccgtctgcgacgacgtcgccgagctcctactcgacgacctccttgacaccaacgacctcttctacgcgcccg

SEQ ID NO: 35936 - DNA, 435 bp, Zea mays
  Clone ID: LIB3060-047-Q1-K1-A6
cgctgatatgcccttgggccacgccttccttcttatcccctgcgcctgccctcccctgctgcagcgcccgtcgcctccctttccccttccctccctccctctccccgcgggccgccagaggcaatttcgccctcgattcgaccccgattcgtccgcccgcgaccgggattccctccgccaagcgcggatctgaacgctgcgctccgtgtcgccgctcgaatccgccatgaagggggccaaatccaagggcgccgccaaggccgatgccaagctggcggtgaagagcaagggggcggagaagcccgccaagggcaggaaagggaaggccggcaaggaccccaacaagcctaagagggctcccagcgctttcttcgtgttcatggaggaatttcgcaaggagttcaaggagaagaaccctaagaacaagtctgtcgc

SEQ ID NO: 35937 - DNA, 371 bp, Zea mays
  unsure at all n locations
  Clone ID: LIB3060-047-Q1-K1-A9
gtagccacggcccttggttcccctccattattcgacctcacctcaccttgccaccaggcatggctgccgtgaccgccgcggccatctctctgtcctcctcctccgcctcctcccctgcggctgctgccaaagccaaggcggcgtccccgtcgtcgtcgccatgcatgcacctncagttcctgtcggcagcgagcccgcggcggcggtggcgggccggcgcccgcgcggtacgggcgcatgtgtccaccaccgagaccgcggcggcggggccggcgaagacgttcaagaagcaggacgaggggctggtcaccaacaagttcaagcccaaggagccgtacgtcgggaggtgcctgtccaacaccaggatcacc

SEQ ID NO: 35938 - DNA, 445 bp, Zea mays
  Clone ID: LIB3060-013-Q1-K1-A11
tcggaattagataatcgactgaggattcttgtaaatttatctcaaacctaaattcgggttttatgctatagaaaatagaagtacttcatgatgatgaatcatcaggttaagatcgatctaaaccaatccattttatatatacatacgacatgccaacggttaaacaacttattagaaatgcaagacagccaatacgaaatgctagaaaatcggccgcgcttaagggatgtcctcagcgtcgaggaacatgtgctagggtgtatactatcaaccccaaaaaacccaactctgccttacgtaaagttgccagagtacgattaacctctggatttgaaatcactgcttatatacctggtattggccataatttacaagaacattctgtagtattagtaagaggaggaagggttaaggatttacccggtgtgagatatcgcattattcg

SEQ ID NO: 35939 - DNA, 436 bp, Zea mays
  unsure at all n locations
  Clone ID: LIB3060-013-Q1-K1-A4
ggtatatcaccaaggcgatatcgagagaacgatgcactatcaagtttcttcaaaatcgtgacgacatcacctgatgaaaacggcaaggtctatgtctcaactgtacaagccaataattatccaatcacttgcacgcaatggcatcctgaggtaatttagttgtagctgtttcaggagttccacatttagtgttcttattggttcttccttttctcttgtgcactgtatttattcctaggttatattcacaacatatcaaattgtggccactcaccaaatacaagtggctttatgccacaataaaactgtcctcatttgatgcagaaagccatttttgagtggaggaaaccaatgatcccacacagcgaagatgcagtacaggttactcaacattntgccaatcattttatcagccaagcacgcaagtttcaaacag

SEQ ID NO: 35940 - DNA, 404 bp, Zea mays
  Clone ID: LIB3060-013-Q1-K1-A6
gtcttgttgccggcggcggcggcggcggcggcgcggagaaattcggcgaacgatggcggactccggaagcctgaggaagcgggaggagaaggaagaggaggacgacattgtctgcctggatccttccttcttcgtggaccgcagctacgagatgacgaccttcaccttcggatcccacgagttgcgcctcctctgcctccgcgccgcttccaattataaagaaaaatatagagttgcagtcatgttctgagaatgcacatgcagtgttgacagccgagaaactagagtggggaaactcagatcatttaagcggtattattgaaaaacatcctggtggatttgatcttgttcttggagctgatatttgcttccagcaatctagcatttcctgcctctttgatact

SEQ ID NO: 35941 - DNA, 376 bp, Zea mays
  Clone ID: LIB3060-013-Q1-K1-A7
catgagttgtagggagggacttatgtcaccacaaacagaaactaaagcaagtgttggatttaaagctggtgttaaggattataaattgacttactacaccccggagtacgaaaccaaggatactgatatcttggcagcattccgagtaactcctcagctcggggttccgcctgaagaagcaggagctgcagtagctgcggaatcttctactggtacatggacaactgtttggactgatggacttaccagtcttgatcgttacaaaggacgatgctatcacatcgagcccgttcctggggacccagatcaatatatctgttatgtagcttatccattagacctatttgaaaaaggttctgttactaacatgtttact

SEQ ID NO: 35942 - DNA, 375 bp, Zea mays
  Clone ID: LIB3060-013-Q1-K1-A8
cggacgcgtggggcacgtgcctcgcccgcttagctatagctgcctcgtgtctgtcagggtaggtgcatggtacgtacgtagcagggcttagctgcagaagtttctgatcgatcgtctgagggctccagaagaagtttctgatctgagggcctgattaatcacacaccacccatcgatcgaccaagcatcatctacttgtaggctctacagatgatgatgcttttgatctttgcttctttttttagtgtgtgtgtgtgtgtgtgttcttggagtttctcttgactgatcccgatggaaagggggctacagaagaagcctttgacgaggaggctgatcatgagtagatattgtgcagcaggttgcccaccttttgtc

SEQ ID NO: 35943 - DNA, 428 bp, Zea mays
  unsure at all n locations
  Clone ID: LIB3060-013-Q1-K1-A9
ggctgctgaaatgaacaagcggtccttcaagtacgcgtgggtgctcgacaagctcagggctgaacgtgagagaggtatcaccattgatatcgctctgtggaagtttgagaccaccaagtactactgcacggtcattgatgcccctggacaccgtgacttcatcaagaacatgatcactggtacctnccaggctgactgtgctgtccttatcattgactccaccactggtggttttgaggctggtatctccaaggatggccagacccgtgaacatgctctccttgcgttcacccttggagtgaagcagatgatttgctgctgcaacaagatggatgcaaccactcccaaatactccaaggcacgttatgaagagattgtgaaagaagtctcatcctacctcaagaaagttgggtacaaccctgataaga

SEQ ID NO: 35944 - DNA, 408 bp, Zea mays
  Clone ID: LIB3060-013-Q1-K1-B1
attaatcaatgaacatgatgagatatctatgatacgctgttttcccttttgattatgatgatggtacttgtggcccttaaggggactcgagttgtttctcgagtgcctctccgtaaggacctgttcgttggatgaccgcccgggaaaacagtgcaaccatgagggtggaatgggacgcccttagctgaataataagaggaaccggggtgtagttcgcttagccgtcgtgccgttaatgaggctcggtgtatgcggctcgctctgccaagttttgttcgccccttagggaggagtgcggtgcatttaggaaacctaacgggcggatacagccctggggaatctttgtaaaggctacatagtgataccctgttgggtcaccttggtagtgatcaatggagagtcatgatc

SEQ ID NO: 35945 - DNA, 424 bp, Zea mays
  Clone ID: LIB3060-013-Q1-K1-B10
cgcgcacctgcctcccgagtcccggccatgggacgcggcagtgacctgcttctgcgtggtggtcgtcgtccgagcacggggaccgaacgcgagcagtagcagcatcccggagcgcaggagcatggcgatggacgacggcggcgacgacttcaccttcgccgccgcccagccgcctcctagtctagtatctgcaggaggcggcggtttcataggcccgccgctgctgtacccagtcttcggccggccgagatcccctccgcgggctgctccggagacggccaccgcgcgggtgccgctaggacggttcctgctggtggacagggatccgtcgcagccgccgccgcctgctcccgcggacgacgacgacggcgacctcgactcggtgccggcggagatgttctgcccgtggtcccgtgggtggtcg

SEQ ID NO: 35946 - DNA, 286 bp, Zea mays
  Clone ID: LIB3060-013-Q1-K1-B2
ccaactcgacccacgcgtacgatgaatcgatgaacatgatgagatatttatgttacgctgtattcccttttcattatagggagggtacttcatacccttaacgtgactacacttatttctcgagtgcctctccgtaacgacctaattcttagataaccgccctgataaacattccaaccatcatactcaaatcggacccctttacctcaataataataataaccgtctttacattcacttatccttctgacctttaaataatctcataatatgcagctcgctctac

SEQ ID NO: 35947 - DNA, 403 bp, Zea mays
  Clone ID: LIB3060-013-Q1-K1-B4
agccgacgaggataaagaggagcccggctccgcacgcgggagcgagaggatcgccggggcaggatgtggtgcgcatcgtgcttggcgtccgcctgcgcgggctgcacctgcaacctctgcacgtcggcggcatcggccgtgtcccgccgctccgcgcgcctcgcttactgcggcctcttcgccgcctcccttatcctctccttcttgctccgccagttcgccgcgccgctcctcaagcatatcccatggataaatgcgtttgatcaaacaccaccagaagaatggtttcaaatgaatgctgttcttcgtgtaagcctggggaacttcttgttctttgcaatattttctctcgtgatgattggtgtgaaagaccagaatgaccggcgagatgcctggcaccatg

SEQ ID NO: 35948 - DNA, 357 bp, Zea mays
  Clone ID: LIB3060-012-Q1-K1-F8
ggacaatggagatcctctccctccctgcctagctatttttcgccgctcgtgagatggcggcgggtgaaatgccctgacctgcgtgcgtgcatatgcccggggaacggacccgccggggctgaccgttgctagggcccggcgtcgtgtccggcagcgggaggggcggaacggcgacgccgtcggagtcgcagtcgcggtcccggcttcctcctcatctccattgccttcggacgggccaaggcgccagtaggcagtagcggaagcgtggacgtgagcgagcgcatccgcgcggccattgagagcttgtgcaagacttaaccgtttccgcgtttcgtggtgcgtcatgtcgtctaattc

SEQ ID NO: 35949 - DNA, 243 bp, Zea mays
  Clone ID: LIB3060-012-Q1-K1-G3
ggtgcacacttgtgtagcccgcctcgagaattcctgcctctgcatctggtcagttctgaaatgagttgcatgttggctatgttgtgtaagctctatttatggtggtctcgctgagacgggtatttggcttcgcagttatctagctatgtgatgtactgttgtcttgtccctgggtattatatggtacactgcagccagtaatagtaatctgcaactgtgcgttaaatggtccgtcgttttcct

SEQ ID NO: 35950 - DNA, 395 bp, Zea mays
  Clone ID: LIB3060-012-Q1-K1-G4
cgacatcacggtggaggcgtggctcaacacgcacggtcccaacgaccgcacgctcgcgcaggggctcaagggtgaccccacgtacctggtggtggagcaggacaagacgctggccacctacgggatcaacgccgtgtgcactcacctcggctgcgtcgtgccgtggaacggcgccgagaacaagttcatctgcccatgccacggatcccagtacaacaaccagggcaaggtggtccgtggaccggcgcctctgtcgctggccctggttcacgccgacgtcgacgacggcaaggtcctcttcgtcccgtgggtggagaccgacttcaggaccggcgaggacccgtggtggaaggcatgaggatgatccgaaaccagcggtgctcagtgcttacaca

SEQ ID NO: 35951 - DNA, 126 bp, Zea mays
  Clone ID: LIB3060-012-Q1-K1-G5
gctacgactatacaatcctagtgcaaacaagtgatttgtttgctgaaataatgatctgcaccatacgagtgtgcgtgtataatcgtacctttggagaaataaataaccgggcagtcgggcttatct

SEQ ID NO: 35952 - DNA, 396 bp, Zea mays
  unsure at all n locations
  Clone ID: LIB3060-012-Q1-K1-G6
ggccgccacccaccccactcggccactcccccaggcggcgaggcgcggcgcccatgcgccaacccctgttcgcaggtcgcagcagccgctagcacccagatcccagagtcccagaccatgccgccactgtgccttcttattttgtccgccgaacaagccagtagtggctacatcgtgaagggcggcaaggcagatctagggcgatcatggcttacgtcgagagaggtgttggaaggtctcgtttatctgcatgaacaaggtgtcattcatagagatatcaagggcgcaaatatactgagtaccaaagagagaatgtaccatgaatcacatgaatttggtggtcatatgttcaacactcttctagagggtgttctcgacanagaaagcttgtacctt

SEQ ID NO: 35953 - DNA, 324 bp, Zea mays
  Clone ID: LIB3060-012-Q1-K1-G8
ccaatttgggagacttttacctacatttattcaaataattgatttggcggaagaggaggaggaagagtattggatggttgtatctgccatattcgagggaaaggaaacttgcagtctaccatctgaatcgagttatgcttataaatcatcatctgaaccttcaaggtctacatcattaaacgaccccattaacaattaagggcatttgcttaaaaccattcctcaattggaagaaccaggtcggccttgcccattcttggccaaagaaagtgttaattccaggcactgtgccaaaggcaatcctgcttaaggtggccataatat

SEQ ID NO: 35954 - DNA, 372 bp, Zea mays
  Clone ID: LIB3060-012-Q1-K1-G9
ggataagaagccagtcaaggtcagcaagaagaactcggctgcagtcaccaagttcctggatgagctggctaagattgacttccctggagccaaggtggtgagcgaggcggtggccaagtccggcacctcgcccctgcttccggcgatcaccttcatcttggacaaggtcgcaccgtttatccccaaggaggagcccaaggcggagccggcggcggaggccacctcccgggaagtcgccgtggaggagaagaaggaggaggccgagccagctgcagcgacggaggcggcaccggcgccggcagagacaccgtcggaggaagcggtggtagaggagaagaaggaagaagagaagaaggaagaggaagataagcc

SEQ ID NO: 35955 - DNA, 349 bp, Zea mays
  Clone ID: LIB3060-012-Q1-K1-H1
gctttctcaacaatagcggctgtggaaggcatcaaccagattgttactggcgacatgatctccttgtctgagcaggagcttgttgactgtgacacttcatacaaccaggggtgcaatggaggtttgatggactatgcgtttgagttcatcatcaacaacggcggaatcgacaccgaggaggattacccttacaagggcacggacggacggtgtgatgtcaacaggaaaaacgccaaggttgttactatcgacagctatgaagatgtaccagcgaacagtgagaaaagtctgcagaaggcagttgcgaaccagcccatcagtggtgcaaattgaagctggtgggcagagc

SEQ ID NO: 35956 - DNA, 432 bp, Zea mays
  Clone ID: LIB3060-012-Q1-K1-H10
cgacaagtccaccaactccctgctcgtcgcatccgaccccgagggcagggtgccgctgttctgggggatcaccggcgacggctgcgtcgccttcttcgacgacatcgacatgctcaaaggctcatgccgcaagtcgctcgcgccgttcccgcaaggctgcttctactccaacgcccttggagggctcaagtgctacgagaaccccaagcacaaggtcaccgctgtccccgccgacgaagaagagatctgcggtgccactttcaaggtggtggaagggtctactgtgctgacggcgctgcactgatctatcatcatcaggcggaggcgatgcgatgatgatgcagaactttgtacatgcgttggtggatggtggtgtaacatagtggctgccaacaagtcatgctcatgcaaaccgatgaatctatctctgga

SEQ ID NO: 35957 - DNA, 392 bp, Zea mays
  unsure at all n locations
  Clone ID: LIB3060-012-Q1-K1-H12
aaaccagacaagcaaggaatcccccgatggctcatcgcgttctcctcctcctctctcgcgcgtcggccgccgcggttgccgccgccgtcgacgcggaggacccgctgatccggcaggtggttcccggtggagatgacaacgatctggagctgaacgcggagtcccacttcctgagcttcgtgcagcggttcggcaagtcctacaaggacgccgacgagcacgcgtaccggctgtccgttttcaaggccaacctgcgccgcgcgcgccggcaccagctgctggacccgtcggcggagcacggcgtcactaagttctgcgaccttacgccggcagagttccgncggacctacctcggccttcgcaagtcccggcgcgctctcctcagagaactc

SEQ ID NO: 35958 - DNA, 331 bp, Zea mays
  Clone ID: LIB3060-012-Q1-K1-H3
caacagcctttctgttggatgttctgaagccaaacttgccagagcatgcttttcttcggaccaaggttttggagataaacttagtgacttacccaaatgttgctgatgccattcttgctaatggtatgttcagtcattacgaccgccctcgtattgctcagctatgtgaaaaggccggtttgtacttgcgagccctccagcattactcagagttgcctgatatcaagcgtgccattgtaaatactcatgccattgagccacaggcacttgttgagttctttggcaccttgtcaagagagtgggctttggagtgcatgaaagaccttctact

SEQ ID NO: 35959 - DNA, 327 bp, Zea mays
  Clone ID: LIB3060-012-Q1-K1-H4
ggtgagcagaaaaagaagaggatcaagtctgatacagattctgcacgattttctgctgcatctaggaggaatcaacttgaccaagctgcaagccttaaaggagagcagattggtaatcaggggactctgcaattcctcgaggctgggacagctcttcatttccttgggaaccccggcacactttgcctccatcaatgcatctttaccggggattgtgtgtgcagccaacgggtctggcaactggttgctgctagggtaaaatcagatgacgaaaaagacgagtggtttgtcgtgaaagtcatacatttcgataaggagacaaaagag

SEQ ID NO: 35960 - DNA, 127 bp, Zea mays
  Clone ID: LIB3060-012-Q1-K1-H7
gatctacacacatacatagtttcttctactacacgacgacgaacatggtgaagcctgcgaagatcggagagtggggtggatacgcccgcgatcgtcgggatctgaaggctactacggaccggctgat

SEQ ID NO: 35961 - DNA, 306 bp, Zea mays
  Clone ID: LIB3060-012-Q1-K1-H8
gagatatttgatgggtggtgtgataatgtcatcgatttggtaaacgcaagcgacgaggaagcgattcttcgccgagatatatacgaccgcccacctactataaattgggggaaaggtcgtgtcaccttgctcggcgattctgtccatgctatgcagccaaatctgggtcaaggtggctgcatggctattgaggatggttaccagctggccgtagaactagagaatgcctggcaagagagtgtcaagactggaactcctatggacatagtttcctccttgagacgttatgagaaagagagaagggtg

SEQ ID NO: 35962 - DNA, 420 bp, Zea mays
  Clone ID: LIB3060-013-Q1-K1-A1
acaagcttgggcaaaggaggtttgacggcggctacgtgcacaatggcttgcttaagggcgccgagtgggtttttgatgctgagtgtgatgttctgaaggaccttctggagaggaatcctggctatacactcacatttgctgggcattctcttggctctggtgtggtgtcaatgctagctttgctggcagtgcacaacagggagctgctcggtggcatagacaggaagaggatacgatgttttgcaatggcaccagcccgatgtatgtcactgaatttggctgtccgttatgcagatgtcatcaatgcagttattcttcaggatgattttttgcctcgcacagacattcctttggaagacatcttcaagtcactattctgcttaccatgccttctatgtggaagatgcctaatagacacat

SEQ ID NO: 35963 - DNA, 400 bp, Zea mays
  Clone ID: LIB3060-012-Q1-K1-F6
cccacgcgtccgaattaaccattgaatttgttgattgcacgtccagtggatttggcggaacatttatgatcacgttgcgtgagctggtcaactttccagattttcttgtggagagaacaaggtacgaagctgctatggagcggaactggacccacagagacaagtgcaaagtctggtggagggacgaagaaggacaggtaggaggaacttggtgggagggacgggtgatggcagtaacacctaaatcacctgattttcctgagagtccatgggaaaaatatgtcatacagtataaggaggatggttctgatcacgctcatagcccctgggaacttcatgagacaggcagtttatgggatccatggaaacatccacatatggatctcacggttcgagataa

SEQ ID NO: 35964 - DNA, 409 bp, Zea mays
  Clone ID: LIB3060-012-Q1-K1-D6
cccacgcgtccgaattaaccattgaatttgttgattgcacgtccagtggatttggcggaacatttatgatcacgttgcgtgagctggtcaactttccagattttcttgtggagagaacaaggtacgaagctgctatggagcggaactggacccacagagacaagtgcaaagtctggtggagggacgaagaaggacaggtaggaggaacttggtgggagggacgggtgatggcagtaacacctaaatcacctgattttcctgagagtccatgggaaaaatatgtcatacagtataaggaggatggttctgatcacgctcatagcccctgggaacttcatgagacaggcagtttatgggatccatggaaacatccacatatggatctcacggttcgagataaattgttatc

SEQ ID NO: 35965 - DNA, 389 bp, Zea mays
  Clone ID: LIB3060-012-Q1-K1-D8
gggagccagcaccagccaccatgggtcgcgtccgcaccaagaccgtgaagaagacctgcaggcaggtgatcgagaagtactactcccgcatgaccctcgacttccacaccaacaagaaggtgctggaagaggtctcgatcctcccctcgaagcgcctccgcaacaaggttgccggcttcaccacccacctgatgcgccgcatccagcggggccccgtccgtggcatctcgctcaagctgcaggaggaggagcgggagcgccgcatggacttcgtcccggagaagtcagcgctcgaggtcgaagagatccgcgtcgacaaggagaccatggagatgctcgcggcacttggcatggccgatctcccgggcgtagagcgccaggctgaggtc

SEQ ID NO: 35966 - DNA, 435 bp, Zea mays
  Clone ID: LIB3060-012-Q1-K1-E10
cgcctggccaaggagcggctcgccaagatgggacccatgagcaaggaggagacgatgatggccggcacgctgctgcttacggttggtctttggatctttggaggcatgctgaatgtggatgcggtttctgcagcaattcttggcctagcagtcctcttaatctcaggggttgtcacatggaaagagtgtttggcagagtctgtggcgtgggatacccttacatggtttgcagcacttatagcaatggctggctacctcaacaaattcgggctgatctcttggttcagtgagactgttgtgaagtttgttggagggcttggcatgtcatggcaactctcattcggtgtgctggtgctgctgtacttctactcgcactatttcttttgccagtggtgccgcacacatcggagcaatgttcaccgcgttcctgtcggt

SEQ ID NO: 35967 - DNA, 379 bp, Zea mays
  Clone ID: LIB3060-012-Q1-K1-E11
cggacgcgtgggcgctccgtgacgctctggcctgcgtgtacgaggcgctgggcgtgcgcatgctcgaccgagtccgcttcttacggtcccagatgcataccatcattacccgcgcctgcagcaatcttggcgtgaaggccctgcccagctggcggttcataaccctgatagctgtggctatcaaagcgcgtcgagagtttctaaagagcacaatagtcaacaatagggacatatatagtgtctttgtttgacatgatgcctacaatgtcagaaggcatgggtgagtacaacatattaaggatttgtcctttagcggaagctctattgaccttgtttcgggtaaacatgacacttttattcatagctttcatggcaaagt

SEQ ID NO: 35968 - DNA, 427 bp, Zea mays
  unsure at all n locations
  Clone ID: LIB3060-012-Q1-K1-E12
caatcctatgccctatatcgcgcttacagaagccaccacagactcggcttaaggctaggtgcttagtgcaatcatcgccgccatgaaaaacaggggaaaaccaagccgccgcacccggagttcatccacaccagctctcaacctcgggggttttgctaagggagcttcgttgggacgcacagaaggagattgtgccctcgctggggaagtctggagattcctcgttgacgttgagggaagccgcggagttactgcacaacgtgtctagcatcatccatgtctcaatcttcggtaagaatctgcaccattagtttgttgtatgcctagggtcatttagcatgtagccacacgatcgtttggacaccagaatttgtgggcgagtttcgtcgacgatggcgccgncgcgggagcagaatgcgtcatgatc

SEQ ID NO: 35969 - DNA, 382 bp, Zea mays
  Clone ID: LIB3060-012-Q1-K1-E2
gtcaagaaactttcaggcaaggcaaaacttgaagatagcagggcaacaaagcaaattggtgcacttcttagtgctcccctggaaaaatatagcaatattgttactgcattagaactttcaaactatcctcgggttatggattatcttgataatgctacaaccaaagtgatggctgtggtaataattcaaagcataatgaaaaacacaacctgcatatctacttctgacaagattgaggcactattcgatttaattaaggggctgataaaggatatggatggagctcaagatgatgagcttgatgaagaagactttaaggaggaacaaaactctgtagcgcgtctcattcacatgctgcacaatgatgatcctgaagagatgc

SEQ ID NO: 35970 - DNA, 258 bp, Zea mays
  Clone ID: LIB3060-012-Q1-K1-E3
gaccgactagcgacgaagcgcgcacaaagagaagaacctcggagctgagatggcacagagccatggcgtcgatgacaggcctctcgcagggcgtcctgcccagcaggcgcgccgacagcagaaccaggacggccgtcgtcgtcgtcagggcgtccgcggagggcgacgccgttgcgcaggcgggccgtcgcgccgtgatcgggcttgtggccactggcatcgtcggcggagccttgtcgcatgcggcgcgcgcctaga

SEQ ID NO: 35971 - DNA, 321 bp, Zea mays
  Clone ID: LIB3060-012-Q1-K1-E6
aagaagcttgagaaggacattgagaatgagaatggaggtgctggggtatattctgcgggtctcaagaaacattatatattggctaatgatgaatggaaggaagatattcttccagagatactggatggtcacaacgttgcagattttctggatccggatatcctagtaaggtgtgaagagttggaaagggaggaagggcttcgcctggaagaacatgctgcagaagatgctttctagattgatggccatgaactatctcatgaacagatggagattctggctcagattaggatgaataaggcattacttatccaagaacat

SEQ ID NO: 35972 - DNA, 419 bp, Zea mays
  Clone ID: LIB3060-012-Q1-K1-F10
ctccgatcggacggaccaccgggccagcagcggggcggatcgcgtcagcagccatggtgaaggcctaccccacggtgaacgaggactacctcaaggcggtcgacaaggccaagcgtaagctccgcggcctcatcgccgagaagaattgcgccccgctcatgctccgcctcgcatggcactccgcgggcaccttcgatgtggccaccaaaaccgggggccccttcggcaccatgaagaaccccgccgagcaggcgcacggagccaacgccggactggaaattgccatcaggctgctagagcccatcaaggagcagttccccatcctatcctacgctgacttctaccagcttgctggagtcgtggcagtcgaggtaaccggcggacctgatgtccccttccaccctgggaggcaggacaag

SEQ ID NO: 35973 - DNA, 409 bp, Zea mays
  Clone ID: LIB3060-012-Q1-K1-F11
gcggcagcggacgtggcgtcgatcatcacgcaggacgtgtacaaccagatgctgcccaaccgcgacaacacgcagtgccccgccaacggcttctacacctacgacgccttcatccaggccgtcaacttcttcccggggttcggcaccggctccagcaccgacgaactcaacaagcgcgagctcgccgccttcttcggccagacctcccacgagactaccggtggcacgacaggtgccgccgaccagttccagtggggttactgcttcaaggaggagatcaacaaggccacaagtcctccctactatggacgcggaccaattcaattgacagggcaggccaactaccagcaagccggggacgcgataggcgaggacctggtgaacaacccggacctggtgtcctcggacg

SEQ ID NO: 35974 - DNA, 401 bp, Zea mays
  Clone ID: LIB3060-012-Q1-K1-F12
ggttaaatttgatgaagcttcacagaagataaaaatcttggaggaacaacttgcagagacacagagcaagttggagcatttccttatagagaaggaaagcttgactcaaacaaatagtactttgaatgaggagttggaagtacatcagaacaagttgaacgatttacaacttgcacttgctgctgcagtagcagaaaaggaggaggcatctgaagagattcattcgctgcataaaacgctcgatggaatgattgagcacaaagcagaattagaaatacaggtatcttctactatacaagagcatgaagaactgaagagcaagtaccaaaatacaatggaagagaaacatgcgttgagtgataaatatgaaaccgcaaagaaagagctcgaggatgcaatag

SEQ ID NO: 35975 - DNA, 420 bp, Zea mays
  Clone ID: LIB3060-012-Q1-K1-F3
catgacaggggcttttgctcatggagctatttttttcattagggattacaatccggaacagaatgaagataatgtattggcaagaatgttagaccataaggaagctatcatatctcatttaagttgggctagcctcttcctaggattccataccttgggcctttatgttcataacgacgttatgcttgcttttggtactccagaaaagcaaatcttgattgaacctatatttgcccaatggatacaatctgctcatggtaagacgacatatgggttcgatatactcttatcttcaacgaatggccccggtttcaatggcagtcgaaacatatgggtggccggatggttgaatgctggtaatgagaatagtaattcgcttttcttaacaataggacctggggatttcttgggtcaatatgc

SEQ ID NO: 35976 - DNA, 437 bp, Zea mays
  Clone ID: LIB3060-012-Q1-K1-F5
gcttcgtgaagaggagaggcctgaaaccggccatcagagcgtatgacaagctggtcctcatagggtgcgagcctggccaggtcacctacgcatcagtcatcaacgtgtactgccggctcgggcgcagcgacagagcagaggccatcttctccgagatgatcgagcgaggcttcgacaggtgcgtggttgcctatggcaacatgatctcgatgtacggcaagatcaggagggcgtcggaggccacgaggctgctggccctgatgaagcagaaggggtgcgagcccaacgtgctggtgtacaactccctgctcgacatgcacggcatgcttgggaactcgaagcaagccgagaagatctggaaggagatggtgcggcgcaaggtccggcccgaccggatcagctacacgggcattattcttgcgaacaaaccggccggg

SEQ ID NO: 35977 - DNA, 392 bp, Zea mays
  Clone ID: LIB3060-012-Q1-K1-D2
catctaccagcgactcagcgagcgagagcagcacacactgcacgcagctagctaggagcagcagcagcggcggcgatggcggcctccatgatctcctcgtcagctctggcggtggcgcctcagggcctgccgcccctcggccgccgcgcctcctccttcgccgtcgtctgctccaagaagaagatcaagaccgacaagccctacgggattgggggtggcctgaccgtcgacgtctacgccaacgggagaaagggcaagggcaagggcgtgtaccagttcgtcgacaagtacggcgcgaacgtctacggatacagcccaatctacaacgaggatgactggtctcccaccggcgacgtctacgtcggtggaaccactgggcttctgatctgggc

SEQ ID NO: 35978 - DNA, 374 bp, Zea mays
  Clone ID: LIB3060-046-Q1-K1-G12
cggagacacacattgccactgcgatggccgcccaccaggactcggcggcagcggggggcaggcctcctcgtcgtcctcgcgtcctcctggcagcctccggcagcgtggccgccatcaagttcgaggtcctctgccgcagcgtcgccgagtgggcggatgtccaggcggtggcgaccgcgtccgcgctggaattcatcgatgtggcctccttccccggcggcgtccctctctacaccgacgaccaggagtggtctagctggaagcgggtcggcgacaaggtcctgcacatcgagctgcgccggtgggccgacgtcctggtcatcgcgccgctatcggccaacaccctcgcaaaggtcggcggcgggctgtgcgac

SEQ ID NO: 35979 - DNA, 399 bp, Zea mays
  unsure at all n locations
  Clone ID: LIB3060-046-Q1-K1-G2
gtcttcacactcctcgccatcacataaaaccagtgcaagcagaagcagcgcaatggcgagcagcaccagggccctctcctncacagccttcggcggcaaggcagtgaacgtgccgtcgtctctcttcggcgaggcccgcgtgacgatgcgcaagacggcggcgaaggcaaagccggcggcgagctccggcagcccgtggtacggccccgaccgcgtgctctacctgggcccgctgtccggcgcgcccccgagctacctgacgggcgagttcccgggcgactacggctgggataccgcggggctgtcggcggacccggagacgttcgccaagaaccgggagctggaggtcatccactcccgctgggccatgctgggcgcgttgggctgcgtgttcccgga

SEQ ID NO: 35980 - DNA, 420 bp, Zea mays
  Clone ID: LIB3060-046-Q1-K1-G3
ctgtttttttttttgttttttttttttttttttggcataaaataaacaggcattatggcaacgtccaggtgtacggaaaacaaatatcattgcatgacatcccgtgtctaagtataatcagagttttaaacagatgactgatgagactgatattgcacaacccagaaccaacccaacaggacacctagctgtatagatcgtcatcgtcagccgcagcaccagccgaagcaaacggatcggctgcagcagcaccagctgtcgccgactgctctgagaagcggaactcgctgccgaacccacgggactgctgcaacgtctgggcgaacgcctggtacttgcggatatcagcatcactgacactgcgccgagcatacttcatagactcctcgaagtgagctgctttgatctcggcaatctcgt

SEQ ID NO: 35981 - DNA, 396 bp, Zea mays
  Clone ID: LIB3060-046-Q1-K1-G5
ctgctccaagtgcaagggcaagggctcgaagtctggtgcttcaatgaggtgccctgggtgccagggctcaggtatgaaagtcaccattcgtcagctggggccttccatgatacagcagatgcagcagccttgcaacgagtgcaaggggactggggagagcatcaacgagaaggaccgctgcccagggtgtaagggtgagaaggtcgttcaggagaagaaggttcttgaggttcatgttgagaagggaatgcaacacagccagaagatcaccttccctggtgaagctgatgaagcgcctgataccgttactggagacattgtattcgtcctccagcagaaagaccactccaagttcaaaagaaagggtgaagatctcttttatgagcacaccctgtc

SEQ ID NO: 35982 - DNA, 424 bp, Zea mays
  Clone ID: LIB3060-046-Q1-K1-G6
cggacgcgtgggcgccgacaactctgtcaccgagaacactcggggtgcctacccgagcgagtacatccccaacgccaagataccatgcgtcggcccgcaccccaagaacgtgatcctcctggcgtgcgacgccttcggcgtgctcccgccggtgagcaagctgaacctggcgcagaccatgtaccacttcatcagcggctacaccgctctggtcgccggcacggaggacggcatcaaggagccgcaggccaccttctccgcctgcttcggcgcggccttcatcatgctccacccgaccaagtacgccgccatgctcgccgagaagatgcagaagtacggcgccaccgggtggctcgtcaacaccggctggtctggtggcaggtacggcgtgggcaagaggatcaagctttcctacaccagaaag

SEQ ID NO: 35983 - DNA, 429 bp, Zea mays
  Clone ID: LIB3060-046-Q1-K1-G8
agttgccgcaagcacagaaccaactgctgttttcactgatgtgggacgggtcaacggtacttcagcggaaaggtttagatctgcagtgagtggaagaagagcaaatgttcttggtgagattacccagattgatacacgaagtctacttcttgagaaagccaaggcaactgtccgcaaaaaattgcaggagttaaacattacatcatcttcacgatttgcagagagaagaggatctgaaggaaagctaaatccttgtggcaacaacataaaggtcaatggtgtcctctctgacaaacctggcaagggagtcaagctatgtagctcaagaagcatagaaatccaagtgcctgatactgatgacaagaatccagagcagcgccgtgtacctgtgtcaattgacgtcccaaaccccgacttccatgatttcga

SEQ ID NO: 35984 - DNA, 408 bp, Zea mays
  Clone ID: LIB3060-046-Q1-K1-H1
cccagcttccctttcgttcctcctcgccccagcgacgcggcctcccgtagaccgagcggggcaacccggcactgagaggcacgcagaggagcaggaagccggagaccaagatgtcgtcggtgttcagcggcgatgagacggcccccttcttcggtttcctcggcgccgccgccgccctcgtcttctcatgcatgggcgcagcgtacgggaccgcgaagagcggcgtcggcgtggcgtcgatgggtgtgatgcggccggagctcgtcatgaagtccatcgtgcccgtggtcatggctggtgtgctcggtatctacgggctcatcatcgccgtcatcatcagcactgggatcaaccccaaggccaagccctactacctttttgatggctacgctcacctttcgtccgggc

SEQ ID NO: 35985 - DNA, 395 bp, Zea mays
  Clone ID: LIB3060-046-Q1-K1-H10
aaactaataagctatgaccgtgagccgtcatcgtctgacaagaagaagaaagcctggtgttgtgctgctgtcgcatcagccgcccgccgagcctcagatccaccaccagcaccgatgccggtcctctgcacccaccacgttcagctccgcctctggtggcgccgtctcggtcgacgcagcgccacattcgccctcgcgctcctcgccgtcgccctcgtgctcacgctctcccgctacgccgcaggccctgcgccctccccgcccccgtcctcgttctacgggcatcgactaccggccctcgtcgacatcaccctcgtctacggcgccatcgacaagggcgcagtgtgcttggatggtacgccggctgcctaccacttccttcctggaatttggga

SEQ ID NO: 35986 - DNA, 365 bp, Zea mays
  Clone ID: LIB3060-046-Q1-K1-H12
tacttcacttactgcaaagatgccattattcacagagagtcaaggggccgacatactcctagatgacaacttcactgccaaggtgtccgatttcagtgcctcaaggccaataccgcacaaccagacccatgtgacaacattggtgcaagggacactaaggtacatggaccctgagtactttcatacaagccaactgactgacaagaatgatgtctacagctttggcgtcgtactcatcgagctactgacaagaaagaatcctatcatggatgatatcgcggaagacattataagcctaacgctgcaatttactatgctattccatggaaataagctgcttgaaatcgttgatcctgtagtatctt

SEQ ID NO: 35987 - DNA, 407 bp, Zea mays
  Clone ID: LIB3060-046-Q1-K1-H2
gctcgtaccggtctgtagttccggcccgatctacctacctgctctctcgtcttctgctcacacgctgacgcgcacgctccgagtgcgagctaagggagctagctagctacttccggcgcggcacagccacagctgtttaggtagtagctagacgtacgtacgtactcacacgacgatgacgaaggcgtggaggccgatgctggcgtcggccaccaagtgctgcgcggcggaggacgcggcggtggcccccgacggcctggcgcggtgccggccgcagcagtcggagctctcgcggcggctggcgtccttcaggcgcctgtcgtcgctggccaacagcccggcgtcggcggcgggcacggacaaggacggcggcagcgtcaagcaggccggggagatggcgggcccgc

SEQ ID NO: 35988 - DNA, 385 bp, Zea mays
  Clone ID: LIB3060-046-Q1-K1-H3
cggacgcgtgggcttctcctccccctccggttcgggttcgggttcgtgaggttctccgcggttcggtggcgtgggtgggcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggcggctacggtggt

SEQ ID NO: 35989 - DNA, 362 bp, Zea mays
  Clone ID: LIB3060-046-Q1-K1-E12
gaaagaactagtgtggccagaattagatcaattgctccgcgacgaggatgacgcaggtggtgcatcgactccatatactgctgctattcctgaatacagagttgttttcattgacaaatctgacctgtcattccaagatagatcatggacactagccaacggtactggtgtgattgatattcaacacccttgcaagtctaatgttgctgttcggaaggagctgcacaaaccagcttcagatcgctcttgtatccatctcgagtttgacatttctggcactggtcttgtgtatgaaaccggagaccatgttggtgtatatgcagaaaattctgttcaaactgtggaagaagttgaaaggctac

SEQ ID NO: 35990 - DNA, 399 bp, Zea mays
  unsure at all n locations
  Clone ID: LIB3060-046-Q1-K1-E2
caacgctgcgctctgtgtgaacgcaactagcgctgactgtgggcctccgggggatcctgctggaggactacacctgatcgagaaggtggcgcacttcgcgcgggagcgcatcccggagcgcgtggtgcacgcgcgcggggcctncgccaagggcttcttcgagtgcacccacgacgtgacgtcgctgacgtgcgccgacttcctgcgcgcgcccggcgtgcggacgcccgtgatcgtgcgcttctcgacggtgatccacgagcgggggtccccggagacgatccgcgacccgcgcgggttcgccgtgaagttctacacccgcgagggcaactgggacctgctgggcaacaacttccccgtcttcttcatccgcgacggcatcaagttccccgacgtgat

SEQ ID NO: 35991 - DNA, 414 bp, Zea mays
  unsure at all n locations
  Clone ID: LIB3060-046-Q1-K1-E4
ggagcgcgccgtgccggagccgtggaagaagaaacccccaccatttggaccacgcagggaccgaagggggaccacaagccgaccaagaaccaacccgcaagaagacgacgggcgtcggccgccgcggcggcatgggcgaatcgcttctcaccgcgctctccatggacaccgncacggcccaccaaccgcaccaaggccccttcaacttcctcttcatggacaccgncttccacgacgaacttcgacctcttccttcagccacagggccctttccgcgctgcctacatgccgcggcggtcgccccccctgacatcaaccttcccctagccgncgacccgtctccgncacctctggcgtcgctcgacgccaacgttgacatgctagatgtcggcctcggcggctcgcagcactacg

SEQ ID NO: 35992 - DNA, 408 bp, Zea mays
  unsure at all n locations
  Clone ID: LIB3060-046-Q1-K1-E6
ccatccactgatcctgatccacctcgccttctccttccttccgcgggtccgcccagggactcgacagatccattgttcacgacctcaccctattcagatcccaagcggccacgcccaagcccaaaccctacccacccatctcaaccagcgatgatggcagcggagccctcgccgtcggttccctccaccgccgctgaagacatggaaaccctcgccctcgactcatcctcttcgtccgccgccgctacggcctccgcctccgaccccctccttcggccacctacctccccgaccgccgccgcgagcgacgaccccttcgtcatcgacgacttcctcgacgaggacgacttcaccgncccggcgcccagcgtcgccggcccgccgnccgncgggcttggcgatgcggcg

SEQ ID NO: 35993 - DNA, 409 bp, Zea mays
  Clone ID: LIB3060-046-Q1-K1-E8
atcatcctttatacctcgctttctctcttccaccatacggtgccttttacggactatttaaacgcctcgctcacgtcttacccctaattacattcccccatggaaccctcatcctctcaatccatccacccatccatcccattcctgaatttatgctactcatatctgtaacttctctttatccacgttaatgccatcgaacaccccgccctcaatctatccacttgtgctcgtctctgttccccctgaggcctataaccactactctgctcatgctcctgcttcaacgcctcagcgatctacgaccaaaccgccccgcacgattgtcactactcgacacacttcgatgtccatgtgtttatcccaatctcccctgctttcctcattcttctccctcttttgcttttaa

SEQ ID NO: 35994 - DNA, 399 bp, Zea mays
  Clone ID: LIB3060-046-Q1-K1-F1
tcccgttgttcaagcagccgcgcgacggtcacacacactttgcacgcttgtctcacgtgtttaggagccaaccggctgccgagccatgtcgtcgcctgctgcaggcacggcagctgagccgcacgtcgtggaggactgcctcggcttcgtgcagctgctgagcgactgcacagtgaggcggtccacggactactccatgctccgtcccatcggccgcgtgccgtctgacacggacctgcccgtgcagtggaaggacgttgtgtacgaggacacgcgcggccttcggctccgcatgtaccggcccactggcgccgcatccggggagactaagctgcctgtgctggtgtacttccacggctgctgcttttgccttctcagcttctaggtggccagctttca

SEQ ID NO: 35995 - DNA, 369 bp, Zea mays
  unsure at all n locations
  Clone ID: LIB3060-046-Q1-K1-F11
caacttccacttcgtggaggactgggtcaggatcggcagccctgccaagaacgaggggaagaaagagcacgcatcggtgccgttcgatgaccagtgctccatcctggagaaggaggccgtgaacgtgtcgctccagaacctcaagagctaccccttcgtcaaggaagggctggccggcgggacgctcaagctggttggcgcccactacgacttcgtcaaagggcagttcgtcacatgggagcctncccaggacgccatcgagcgcttgacgagcgggttccagcagttcaaggtcaatgtctatgacaagaagccggagcttttcgggcctctcaagtccggccaggcccccaagtacatggtgttcgc

SEQ ID NO: 35996 - DNA, 407 bp, Zea mays
  unsure at all n locations
  Clone ID: LIB3060-046-Q1-K1-F12
ctccgcatttcggccacttgtggcggcgtagctagcgtactacagctccctgcatggtgatggaggggcgcacgggctcactctacggccgcctcaacaagagcagcacgcgggggttcctcgcctacaccgtcgccggggctgcctgcgcggctgtcctcgcctgcttcgtgctctccgccgcggactcgccggcatctgcggcacgcaacgatggcgcgcgcctncgnctgtcctcgcgctcaccgcgcgtctggcccgacctcgcgttcaactggcgggtggtggtcgccaccgtcgtcgggttcctcggttccgcgtttggcaccgtccgcggcgtcggcggatgcgggatcttcgtgcccatgctcaacctcgtcgtcggcttcgacaccaaatccggcggc

SEQ ID NO: 35997 - DNA, 415 bp, Zea mays
  Clone ID: LIB3060-046-Q1-K1-F2
cattaccataggctcattcatcgaaacccaaatcaaagagaccggaaaagaaaaaagggttttgatccgatcaattaaaagaaaggacccttacctgatttgaatttcatcctcctttaaataggatatgctctaagtcttcccatactttcctataatgactgcaacgattttctccattttgcgaattcctattttatttgaagtatattactatcatatacattatctaaatcgatccactttaaataaaatagaaaaaatcgaaagaaaaaaaaaaagaaagagtaaataataaaacaggatattctgtttcataattctgaaatagagttcttttttttagtattactcctcattaggatgtatatattaatcatcctattttaatatatattaatcatcctattttaat

SEQ ID NO: 35998 - DNA, 323 bp, Zea mays
  Clone ID: LIB3060-046-Q1-K1-F3
tcccttacctaatttaatttcatcctcctttaaatacatatctctaatcttcccatactttcctatattactcaactattttcccattttcctaattcctattttatttcaactatattactatcatatacattatctaaatctatccactttaaataaaatataaaaaatctaatcacaaaaaaaaacaaatactcaataataaaacaacatattctctttcataattcttaaataaaactctttcttttattattactcctcattatcatgtatatattaatcatcctattttaatatatattaatcattctattttaatt

SEQ ID NO: 35999 - DNA, 417 bp, Zea mays
  unsure at all n locations
  Clone ID: LIB3060-046-Q1-K1-F4
aaaagacaccgncctgcccttcgctagcggaaaccgccttccctcgccggggtaggggtnttcnnnncggagacgcccgccatggacgcgttccggaaacagctggacgtgctcatgggcgccaaccgcaacggcgacgtcgaggaggtgagccgcaactactacgaccgcgacgtctgccgcctcttcctcgccggtctctgcccacacgacctctttcagctcacgaaaatggatctcggtccttgttctaagattcattctcttcaactgcggaaagattatgaagaagcgaaagcaaagggaacagaaaattttgatagagaactcgaggatatgatagaaaggctcattgtggagtgtgacaggaaaattcagagggccctaaaacggcttgcagatgatgatgccaatgct

SEQ ID NO: 36000 - DNA, 416 bp, Zea mays
  Clone ID: LIB3060-046-Q1-K1-F7
gcggctcgcaagtggcctgcgttcctcttccacgctccgcccacccgtcccggggcgggccgcaacccgatccctccccgcgcccaacgatgccggccggccagccgcacgcgcacgaagccgctgccgccgcctgcgtcggcagcggcgcgaaccactccaaccaccgagtgccggcgcactcgccaccgccgctccccgcggaggtggtgccggcgtacccgcccccggagtcggaggacgacgagacctgggtgtggacgcagatcaaggcggaggcccgccgcgacgcggacgcggagccggcgctcgccttcttcctctacgccaccgtgttgtcccacccgtccctgccccgctccctctccttccacctcgccaacaagctctgctcctccacgctcctctccacgctc

SEQ ID NO: 36001 - DNA, 372 bp, Zea mays
  Clone ID: LIB3060-046-Q1-K1-C2
aaaaacaaaaggatttgttttacaaaagatgtttggcaaagtgggagggatattttcgaaaataaaacgtgatggtgaatccatcatggccatgatggattcaacatcggaaaagatgtacctctgccaggtaccaagtttttgggttaaaaagattaagctgagaccgggcgggtgacttgcacgagaagaaagtctcggtgtagtgtctccgtctgagtcgattaaggaccgtctcgatgtaagcttgatgatcgaagaccctttaactggtcacatgcctcgtcatgggtaagccttgcctcgggcagactaaggccggaataagataacacgaaatgggcgttgagcggtggcgagagtaacgtgtac

SEQ ID NO: 36002 - DNA, 317 bp, Zea mays
  Clone ID: LIB3060-046-Q1-K1-C3
ttacaaattatgcatgccaatagtgctatggatatattcgaaaataaaacggtgatcgtaaatccatcatggtcatgattgattcaacatcataatagatctacctctgccatctaccaagtttttgtcttaaaaagattaatctcacactcctcccatgacttacaccagaacataaactaagcatagtgtctacatcttagtcgattaacgaccctctcaatgtatgctttatcatcaatgaccctttaactgctcacatgccttgtaatcgctaagcctttcctacttcaaactaaagtcggaataaaataaca

SEQ ID NO: 36003 - DNA, 436 bp, Zea mays
  Clone ID: LIB3060-046-Q1-K1-C6
cacaatgattgattttctccaacatatggcattcacggttagcagagggcatttaaggcaacgatcgatatattctccccatccacaagttagctctggatactagtttgtttgctgtaagactttttcagcattatctgaaacgttaaatgtctttctatattcttgtgctgtcttgctatcatactgtttgtggatttcctacaaaaaatatctggctgaggttgataatgagtactacatccgttctcgaatatttgtcgcccggtagttcatttttgaactaaaacacggtagttcatttttgaactaaaacgcgacaaataaaaaaagaacggaaggagtgtattacagccattagtgattacggattggtcttccgcacatgagttcatgatgatgtgctcttgttgctattctatagcttgtgcaagta

SEQ ID NO: 36004 - DNA, 418 bp, Zea mays
  Clone ID: LIB3060-046-Q1-K1-C7
ctccatccagggcctcgtgctgaatgacaggccatacttcaatgagccaggatccaggaactcggctgaaacgacaggtggtgagaggtgttccctggcttacaatcagacggccttcgtcagatcatgcaagacgatgctgtattcactccggaagcctccaatgcattttgagacccttgtgttgtggcacttccacgagcatgagcgtgccatcctcgacgcttgcagggcttacatgtctgggacagtcgttgggtcgtctgctgggactgggagcaaccgcagatacgtccatgacaagtgctttgcagaattccacaagtcgctgacgctctacactgaacatctcagggctgagtttgctgcaaacacacgacgagtgatggagctggaaacagaagactagatcgtgcct

SEQ ID NO: 36005 - DNA, 360 bp, Zea mays
  unsure at all n locations
  Clone ID: LIB3060-046-Q1-K1-D1
aagggcctnctggatcctctcacttcccttaatccttgtccggctggtcccttctttgtttacctaacggtaactagccttcctgtaacccggcaaaaatggctggccctgccttcaccacggccgcggcggccgcagcgctgctgctgctgctcctcctgtcgctcgccgcggcggcggacatgtcgatcgtgtcctacggggagcgcagcgacgaggaagcgcggcggatgtacgcggagtggatggcggcgcacggccggacctacaacgccgtcggcgaggaagagcggcggtaccaggtgttccgggacaacctccgctacatcgacgcgcacaacgccgncgncgacgcgggcg

SEQ ID NO: 36006 - DNA, 400 bp, Zea mays
  Clone ID: LIB3060-046-Q1-K1-D2
cggagccctccctagtaactagcgtacctacctgttacccattcaaccaagtcccccgttgtgtttcgatatatatggcgaggtccccgtttgttccgatggatcaggggaaagagcaaggcgccggacgaggagcggccggcaataataaggagcggcagcagcaggagcaggagcaggaggaggtgctgctggtgcacagccaggtgcggcggatcaagaaggaagaccaggaggccttcagggagcgccttctgaagctgcgcctgctggagacccggcccagcgccggcggcgtggcctggcgagccccgcgctccctgtcgccgctccgccgtgccggcagcgccatcatcccggtcccggtgagcgagtgactagtagcgagcatccgtcgaca

SEQ ID NO: 36007 - DNA, 176 bp, Zea mays
  unsure at all n locations
  Clone ID: LIB3060-046-Q1-K1-D4
atcatcttcatgcagagctaattgtgcatagctttcatatttgttcgtcttgactggggataggtttggggtttagttaaatgacccaatgggttgggggtttgtgttaagcttggtgttgtcttcactgtataattgatattctgctcccatccatgtncttcgttaataaatgc

SEQ ID NO: 36008 - DNA, 409 bp, Zea mays
  Clone ID: LIB3060-046-Q1-K1-D5
cgaggataaaacaggcggcaaagtcgtatcccgcagcataaacatgattatactgtgccgcgtcggaactatgacccccagaaaaggcctggcgtaccattgatgctgtggaaaccgttagctcctatctatcctaagctcgtgcaaaacgttgctgaagggttgactttcgaggaaacaaaagagttgaggaacagaggattgaattctccaccgcttacaaaactgactaggaacggtgtctatgttaatgttgttgataaagtgagagaagcgtttaagactgtggaagttgtccggctagattgcactcatgttgggactactgactgcaagaaaattggtgtgaagttgagggatttggttccatgcattcctatattatttaaagatgaacagattatactat

SEQ ID NO: 36009 - DNA, 436 bp, Zea mays
  Clone ID: LIB3060-046-Q1-K1-D6
gaagaaacctacaaacacctacctctctacgaactacctgccgccggaaaaccctggagcgctcgaccatggatccgcagcagccggagcctgtcagttacctctgcggagattgcggagctgagaacaccctgaagcccggagatgtcatccagtgccgtgaatgtggctaccgcatcctctacaagaagcggacccgccggattgtccaatatgaagcgcgctgaatagtgaagacaagggaaaacactgaagatggttgatctattactcgccacattacctatgtaaacagtcttctgggggaaatgaaaatgtcagacttaacgtttgtatgtcgtgtgcctcctttgaacctgagctgtataatttgtaacgcttgaactggggactgatttgagaactgagacactgcagcaatatgttgatgggtcct

SEQ ID NO: 36010 - DNA, 240 bp, Zea mays
  unsure at all n locations
  Clone ID: LIB3060-046-Q1-K1-D8
tctatacaggcacctaaattgaattcttttaacttttttctacaacatcctcacttctaaaaccctttccttacccaacttaatcctcttacatcacatacccctttcctcaactttcctaataactaacatgcccacaccactcacccttcccaacacttactcatccttaatgcccaatttaacacaccctctancaacccattaaacacccctattattgttattacactcaacctt

SEQ ID NO: 36011 - DNA, 408 bp, Zea mays
  Clone ID: LIB3060-046-Q1-K1-E1
cgagatcatgaggaagcaatactcccctgtgctctccttgtgcctgatggcccttggggtagctgctatggtctgtgtcatgtacaccacctcggcacaagcaggaaggagtggctacaactcgtacgaacctgatggaaggggtggatacaactctgttcccatcaacggcggtggcagcccctagctaggcggtggatcggagcctgtatcagaaatcgaaataatataagactgtcttcaacggatcacactgccgctcccccacgctaaatttgggggctacagtgcacacgctagccgatcaacggctcacgctaccaggcgctctacgcggatgtgccccctagccagcttctctctccccctcgttctgtggtgcctctctcaccctctctaatattggtc

SEQ ID NO: 36012 - DNA, 404 bp, Zea mays
  unsure at all n locations
  Clone ID: LIB3060-046-Q1-K1-C11
cgcgcgtggtcgccatcgtggacgccgccgccttcaccgcgctcttcgaccgggacgtcgtggacaagagcgacatcctcatcgggccctacaacccgggcgccggcttcaccggcgggacgcgcgtcggcgtgtacctcgacacgcaggaggaggagcacgcgcgcgtcaagaccttcgccatggacctnctccaccgctccgcccgcacctggtccgccgacttccgcgcgagcgtcggcgccatgctggacgccgtggacgcggagttcggcaaggacgacggcagcgacaagaagccctccgncagctacctcgtccccctgcagcagtgcatcttccggttcctctgcaaggcgttcgtgggcgccgacccgtccgncgactggctggtggacaacttc

SEQ ID NO: 36013 - DNA, 384 bp, Zea mays
  Clone ID: LIB3060-012-Q1-K1-B4
ctcaaacaaaggttatgaggttgcgattgttgataatcttgtccgccgtgcttttgagaaccaggtcggtcttgattcccttacccccataacctccatccagaatcgtgtccgtagatggaagtctctcactgctaagacaatccagctctttattggtgacatatgtgattttgaattcctctcagaaaccttcaagtcttttgagccggatgccgctgtccactttggcgagcaaagatccgcgccatactctatgattgatcgttcgcgggcagtctacacacagcataacaatgtcattgggacacttaatgtcttgtttgccataaaggaatacagtgaagagtgccatcttgttaaactaggaactatgggtgagta

SEQ ID NO: 36014 - DNA, 376 bp, Zea mays
  Clone ID: LIB3060-012-Q1-K1-B5
cggacgcgtggggccggcggcgggctcggcgagccccggccccggcggcttgggcgcgcggcgccccggctggggtgcgggctgcacaggtgagcggcctccagcccctcggcggctcggcacagaccggcagcccgtcgcacgagggcgggcgtaggccctcggcacgagcgcggctgcacgagcatggccggcgcgggggcacggccggcgcggctccccggcgtccaagcggccctgcggcggtgcgggcagcaccggcgtgcggccctcggaccctttggcggctcggcgcatgccggcggacgagggcggctcagcccctcggcgcaggcgcgcccaccggcggcggttcggctggccgacgcgcgggtgt

SEQ ID NO: 36015 - DNA, 261 bp, Zea mays
  Clone ID: LIB3060-012-Q1-K1-B8
cgccacagcttgcgcccgcattggcactcgtctccgcctcctcgtcctccggcaccagcgtcacggcgctccccaggaatgggcagcgggcgtcgtcctccttcctcggcggcaagacgctgctgagacaggccgaggcggcccggccgtcgttcgccgtgcgcgccgcggcggaccccaacaggccgatctggttccccggcagcacccctccgccgtggctcgacggcagcctttccggcgacttccgctttgatccct

SEQ ID NO: 36016 - DNA, 417 bp, Zea mays
  Clone ID: LIB3060-012-Q1-K1-C1
cacatctgacggcggaagctagggcgtcgccaccgtcaatgtcttggcactcccgctctgttcagcaatcgcatcgacaggtaacagtccatcatctccgtatcacctccttggatcctcctctgttccgtgacttccacagcacgctgccaggagccctatcctcaatcatgtctttcccgccgagctacacaccttcaggagcccatcccctcctccctcaaacgacgccgggtgacaagcatgaaaagtagtaatgacgacatgcttccaaatcactttcaacagtttcttctacttctttttgtttgccttatgatgattatctactgtcagttactcagttttatgatttgactagttactttggtttgcggagctggatggaacaatctttcagggtgcttcaacattaga

SEQ ID NO: 36017 - DNA, 353 bp, Zea mays
  Clone ID: LIB3060-012-Q1-K1-C11
cggacgcgtgggcttgcattggtacacgggtgagggcatggatgagatggagttcagggaggcagagagtaacatgaatgacctggtggccgagtaccagcagtaccaagacgccacagctgaggatgaggaggagtacgaggaggaagaagaggaagatcctgctgcctaagccatcatcccaagtgcttggtaaagatatgatgtcccttgtatcgctgctagtcagcactgagtcgtttgaggtgctcgtggtgatgttaggtactagatgggtgtcattacttatgaatgcgatgttgctgtgacagaactgcatttcctattgtactatggttgtccaagttgtcatt

SEQ ID NO: 36018 - DNA, 428 bp, Zea mays
  unsure at all n locations
  Clone ID: LIB3060-012-Q1-K1-C12
cgcccccagcaggagcaacagccgtcttacggcagcggctacggatccaggcccgaggccgctgcggaggagggcggtggctatggatctggcttcggatccgggtatgggaggaagaagcaggaggaggagagctacggctctggatatgggaggaaaccgcaggcggaggagagctacgggtccggcgggtacggctctggctacggcggtcagacccggccggaggagagctatgggtcagcagggtatggatctgccaatccgcaggctgagacatacggctctggctacgggaggaagccacaggtagaggagagctacggatcggagtatgggtctgggttcggtaggaaccgcaaattgaggagagctatggatncgggtacgggaggacgccccaggttgaggagagctatggatctggt

SEQ ID NO: 36019 - DNA, 335 bp, Zea mays
  Clone ID: LIB3060-012-Q1-K1-C2
ccagttcctgcccagctgcagggctgctccaatggccaccttgtccgccatctctgggaacgtgggctactgcaaggcaccaaccctgagctggaagggaagcggagtaccaggccggattgtggtctccatgtccaccacccgaagaggcctcgtctccctaagacgacgatcccctcggtttcgcgtctacgcggcgaaggcggagacggtgagcaaagtgatggacatcgtgaagcagcagctggcgctggcggcggacgtggggctgacggcggagaccaagttcacggacctcggcgccgactcgctggacacggtggagatcgtcatga

SEQ ID NO: 36020 - DNA, 420 bp, Zea mays
  Clone ID: LIB3060-012-Q1-K1-C3
gctgttccccgcaacctatcgacccaatctcgtccgacccggcgcgtcgtcccctccgagatctgcgtcgccctctccaggtagcagaaactgttctgctgcagtctgacaaagtggagggcttaggagcttctgcttcttttatgtctgaacaatctttgctttatttgggattgttgggagagtactctcgtgcaacgaggaaaaggcacaaggttccgtcccactgcatgcgtcaagagcctgtctggttttcttgttctgatttgtcatttgctggtgctcagagccggcttggtttcctcgaaggatcagcaactactcttgattgtggactttgtcacatctgatatcaacttcatagatttttatccaagatggcgctgcaaaacattggtgcttcaaacagggatgatgcct

SEQ ID NO: 36021 - DNA, 383 bp, Zea mays
  Clone ID: LIB3060-012-Q1-K1-C5
gcaggcagcgcagcctcgagccgtcgccatggcgagcaagcacctcgtcctcgccgggtgcctcctcctcctgcccaccgcctcggtcgccaccgacgtcgactactgcagtaagaaggactacccggtgaaggtgagcggggtgcagatcgtgcccgatccggtcgaacccggcaagcccgccactttcaagatctccgcttctactgataaaaccatcgagaaggggaagctggttatcgacgtcaagtatttcttcttctacgtgcactcggagacccgcgacatctgcggagagacttcctgcccagcgaccggcgacttcgtgctgtcccaccagcagacgctggcaggcttcactccgtcgggctcctacacgatct

SEQ ID NO: 36022 - DNA, 343 bp, Zea mays
  unsure at all n locations
  Clone ID: LIB3060-012-Q1-K1-D1
atcaaaatccgcactccccattggccggcctcatatccccttatccgcttcgccacccgcggtcgcgcccaccacccgctccggccggctcttagctgcatgctcgcgccgccctcctctccatcatccagtgctctctcctcttgcgattcgctcgctcgatcctagcttcccttccaagaagcgcagcgcccatggccatggccacgcaagcctccgccgncacgcgccacctgctggccgncgcctgggcgccggcggcgaagccgcggcagctgagctcgcagctcgcgctgccgtcgtcgtccttccgcgggccggccccgctccgcgcgtncaccga

SEQ ID NO: 36023 - DNA, 435 bp, Zea mays
  unsure at all n locations
  Clone ID: LIB3060-012-Q1-K1-D10
cccacgcgagctcccagtctcccactccatccatggcgatcgccaccactacctcttgctcctcgctgaccattcgtctcctccacccgaaccccaacactaaccccgctcccagatctctccagctcctcagtagcaggaggtgcgctcgtgccgccgtagccggaggcgcggtgccttacggggctgctccccggcgtgggatttggtcgatcagggatgacttggtggtgccgaggtctccctactttccagtggattccgcggcggngcaagagcgtgggccgtcgcccatggtgatggagcggttccagagcgtcgtcagtcagcttttccagcacaggattatccgggcggtggtcctgttgaggatgatatggccaacatcattgtagcacagctgctctacctggacgctattgatcccactaagga

SEQ ID NO: 36024 - DNA, 224 bp, Zea mays
  Clone ID: LIB3060-012-Q1-K1-D11
atagcaaccggtccaacactttcacgctcaggcgctcagctctagcaatggctgcctgcaccatggcgatctcctccacggcgatggccggtactctcatcaaggtgggctccttcggcgagggccgtatcactatgcgcaagaccgcgtgcaagccacaagtggcggacccattgcactttctgacactgtcccaacctgaaaggctaatgggacactctctc

SEQ ID NO: 36025 - DNA, 435 bp, Zea mays
  unsure at all n locations
  Clone ID: LIB3060-012-Q1-K1-D12
caaattgaaagctcggcgttgccctgcctcgagctcgaaggactgtccctatacgtgggtgtccagctcctcgcatattgtggcctggtgcagattggagatccgcccggacttggatcgagtcctcctgtctttggacattcattggagtgctccattcattaggcagcatgcctaagataaagacaagccgtgtcaagtatcctgaaggatgggagcttattgaaccaacaatccgtgagttggatgccaaaatgagagaagctgaaaatgatccacatgatgggaagagaaagtgtgaagctctctggcctattttccgcatttctcatcaaaggagccgctacatatacgatctttactacagaaggaaggagatatcacaggagctntatgagttctgcctagaccagggttatgcagaccgtaacctga

SEQ ID NO: 36026 - DNA, 351 bp, Zea mays
  Clone ID: LIB3060-012-Q1-K1-B3
gcacgccgccgcttcgtctcacctagagtcgcccgagcacaccgtcgcctcctcctggcgcctgagcacgtcgtcacctcctcttgcttggagtcgctcgagcacgccgactcctcctcttgcctaaagtccctcgagcatgccgacgcctcatctcgcctgaacacgccgacgcctcatcaggtgaggggtgagccacctctgcccgcatcttcatgccccttcgacttttggtttgtcatcgctgagtttcccctagatctagggaagaaagggcggatctcatgtgtgtgggcgttctactcgagggtggaagaatcctgggcacatgtagggcggatcgcacctatt

SEQ ID NO: 36027 - DNA, 441 bp, Zea mays
  Clone ID: LIB3060-011-Q1-K1-H5
cggcggcgacgagaagtggcgagcccctagagcgggtttagttagaggctaggggcggtcgggcgcggcggcggcggcggccatgagcagcgggagcgagagcactaccgccagcaggtggcccgagctggccacgctgcgcgccctggcgcgcgacgccgcggagcagctgcggctgccgcgggccggcacgtcggcgtcagcgtcggtgtcgtcgtcgccgaggcgcgtgcgctaggaccacctccacggacacggcatgacagccaaggtgatgcacctgctgatgtggtgacccgactggagcggatagaggccaccgtaccagctgcgtagctcgttgagctctgtctgcaattagcctaggacggactgcactggactgtacctatacacctatatactacgacgtgcacatgtaccagtgtacgacgaactgct

SEQ ID NO: 36028 - DNA, 413 bp, Zea mays
  Clone ID: LIB3060-011-Q1-K1-H9
ggcgagcgcaacgggtacctcaagggcgtcgtcaccgacgtcatccacgaccccggccgtggcgcgccgctcgccaaggtcactttccgccacccattcaggtacaagcaccagaaggagctctttgtcgcagccgagggcatgtacacgggccagttcgtctactgcggtcgccgcgccaccctctccatcggcaacgtgctgcccctccgcgggatccctgagggtgccgtcgtctgcaacgtcgagcaccacgtcggtgaccgcggtgtcttcgccagggcctctggggactacgccattgtgatcagccacaaccctgacaacggcacatcgaggattaagctgccctctggcgccaagaagattgtccccagcagctgccgtgctatgattgggcaggttgctggtgg

SEQ ID NO: 36029 - DNA, 373 bp, Zea mays
  Clone ID: LIB3060-012-Q1-K1-A1
gtcgagctcgagccccagccaccgcagccatggtcctcacgaaaccctacctctccaactcgctccttccagtcccatccccgccgccgtcgagccctactctcagctccaaccatgcaagccccgttgccgcccctacttgccgtcgcagccgcctccgcatctccgccacatccacggctgcgccggctccttcgtcggctgccgctgccaccgcgtcgctgagtcgagtggacgtgctctcggaggcgctcccttttattcagcgattcaaaggcaagacggtggtggtcaagtacggcggtgcggcgatgaagtccccggagctgcaggcgttcgtgatccgcgatctcgtggctgctctcctgcgtcg

SEQ ID NO: 36030 - DNA, 400 bp, Zea mays
  unsure at all n locations
  Clone ID: LIB3060-012-Q1-K1-A10
ggaagctcaagttagaagaagcaccagtgcctgatcgatggcggcccaggctctcctgtccggccggcagctgctgggccgccccgtgcagtcggccgtctctaggtcgtcggcgaggaaggcgcccttcgtcgtcagggccagctccagccctccagccaagcaaggtgccgacaggcagctgtggttcgcgtccaagcagtccctctcctacctcgatggcacgctgcccggcgactatggcttcgacccgctgggcctctcggacccggagggcaccgggggcttcatcgagcccaagtggctggcctatggcgaggtgatcaacggccgctacgccatgctgggcgcggtgggcgccatcngcccggagatcttcggcaagatgggcatcatcccc

SEQ ID NO: 36031 - DNA, 399 bp, Zea mays
  Clone ID: LIB3060-012-Q1-K1-A12
ggataatggagcagtgggagaaaagctactacataacaacaattgctggatcatccaacgggagctcattggttgtcatgtccaaaggaactccttacacccagcaatcatacaaggttagtgagtcgtttccttacaagtggatcaataagaagtggaaagaagggttccatgtgacatccatggccaccgctgggaatcgctggggcgtagtcatgtcaaggaattcagggttctctactcaggttgtagagttggatttcctgtaccccaaccaaaggcttcaacgacgcttggaaaaccgctacaggataacttccacggcggccaccaacgaccaagccgctttcatcctgagcatgccaaagcggaagccgatggacgagacccaggaaacgc

SEQ ID NO: 36032 - DNA, 338 bp, Zea mays
  Clone ID: LIB3060-012-Q1-K1-A2
ccgctccttcctccccctatctagctagccttcccgttcctgcatcgcggcggagatgggcgccggcaccacgccgctcgcgtcggcggcggcgctgcttctgctgctgctcgcgccgctcgccgcggcggcggacagcatgtcgatcgtctcctacggcgagcggagcgaggaggaggcgcggcggatgtacgccgagtggatggcggcgcacggccggacctacaacgccgtcggcgaggaggagcgcaggttcgaggtgttcagggacaacctccgctacgtcgacgcccacaacgccggcggcgacgcgggccttcactcctttcgacctgggc

SEQ ID NO: 36033 - DNA, 342 bp, Zea mays
  Clone ID: LIB3060-012-Q1-K1-A3
ctcgaaccatcatcatatatatatatagaatcaatatggaaggagcggccgaccataggcggcaggtggacgacaagccgccgtacgccgccgtggacgacaccatgaccaccaccacgaagaagatggtggaggagcagctctcagacgacgccggcggcggcggcgagctgccagagcagaactaccgtggatggaaggccatgccctacgtcatagggaacgagacgtgcgagaagctgggcaccatcggcaccacggccaacctgctggtgtacctcaccaccgtgtacggcatgtcgggcgccagcgccggcaccctgctcagcctctggtcgggca

SEQ ID NO: 36034 - DNA, 418 bp, Zea mays
  Clone ID: LIB3060-012-Q1-K1-A5
ctccgatcgacctgctccctccccaccaccgagcccatggcggaccagctgaccgacgaccagatcgccgagttcaaggaggccttcagcctcttcgacaaggacggggatggttgcatcacgaccaaggagctgggcactgtcatgcgctcgctggggcaaaatcctacagaggctgagctccaggacatgatcaacgaggtcgatgctgatggcaacggcaccatcgatttcccagagtttctcaaccttatggctcgcaagatgaaggacaccgactctgaggaagagctcaaggaggccttccgtgtgtttgacaaggaccagaacggcttcatctcggccgccgagctccgccatgtcatgacaaatcttggtgagaagctaactgatgaggaggtggacgagatgatccgtg

SEQ ID NO: 36035 - DNA, 438 bp, Zea mays
  Clone ID: LIB3060-012-Q1-K1-A8
gcagctttagaataatctgatgaaagtatctccatccaccaaattgatatagggaatgctaggatatgctagcccaaaagagacttatgagagaggaaagtttattgtcaaaaattcaccaccccaaggatagatgcaggaagggtgtaaagcctatctcttggatgattcagctgcttcactgttcatgaggtgtcatacatgcagtaaaggtgtgctggacttttttcttgtgcttccaccttgcgtggtagacatgcaggtgtgtgttggggattgttaattctcatttcccctctgaaatagccccagctcgacctccatcaagccacctcttgttatgctagtttggagcccaaactgaattgcttgtgctctcgacgatttcctggtttcccctatgtgccttgctactcatctacacccacgtcacccccc

SEQ ID NO: 36036 - DNA, 435 bp, Zea mays
  unsure at all n locations
  Clone ID: LIB3060-012-Q1-K1-A9
ctttatttctctagtaaacctttcaacactgttcaaaacagaatttgttactgtccttgtgtctgcattttctctactatacctctgcaacacatttcaaaaagtataatgagccaactcctctacttgtaatgtcaaggaaagcaacacaggaaatgatgtgcatggtgtgcctaaagattcaacccgttggtccgttctgccaaaccccatcttgtaacagactatcgatggcaaagtactactgcaacatctgcaaatttttcgatgactaaaggactgtgtaccacttgccgttttgtaatttgtgtcgtcttgggaaaggtcttggtgttgatttctttcattgcatgaaatgcaactgctgtcttgnaatgaaattaactgagcacaaatgttcggaaaaagggctagagacanattgtccaatatgct

SEQ ID NO: 36037 - DNA, 423 bp, Zea mays
  Clone ID: LIB3060-012-Q1-K1-B11
atctcgctcgtccgcgttcagctcagctactccaatttcgcaacaagttgcaagcaataaccgaccaaggacgacgaacgggtcgatggccacgctctcctcctgcagccgcctgagtagcggcaccggcgccgcggccatccaccggcagccggcccgtgctggagccgtcctcgtcgtcacctgcaggcggagctcctccgcgaccgtccgcgccgcagccgctgccacggcggcggcgccggctgccgtagagctgcagaacaagggggtgtcgctgccgacgtgggcggagttcgagctcgggcgggcgccggtctactggaagaccagcagcggccttccgccctcgccgggcgaggggctgaccctgttctacaacccggcggcgacgaagatggccccgaacgaggtgttcggcgt

SEQ ID NO: 36038 - DNA, 440 bp, Zea mays
  Clone ID: LIB3060-012-Q1-K1-B12
cctggacccagcaaaaccggtgaaacttgcctggaacttgaagaaagatgttcacttgcatgattaaattgcaaatcagaggtacccatggccacaatgtaaattcgaaaggttttttcatcataataaaaaattgcaataattcagtgatcaatgggtaatggagcagaactctcaacttcatgattggctgttcgcttcgattaaagccaactggactgctgcagctacaatccatagagataaaacactgtagaagcaatagaagccggtacggattaaagccaagtgaacaggctaagacctctctctttctctgaaaatgtactaccaagaaccctccttatctacttacaatgacacctttcctttcttcacctgcccgtgacgcggagctgcctttgcccttccgccgctgcctagatgtttcatttcatctt

SEQ ID NO: 36039 - DNA, 438 bp, Zea mays
  Clone ID: LIB3060-011-Q1-K1-H4
agaaagggcatatcgaggaggtttttagggtggtggtggtgttgtgaggagctgctgccgctgctctccagtctccaccgatggcgatcaagaacatgacggtggcggcgacgacgcggtcgctggacgcggacatgacggtggacgagttcaaggagtggctgcggcggttcgacacggaccaggacgggcgcatcagccgcgacgagctgcggcgcgccctgcgtgccatccgctcccggttcacggggtggaggagcaggcagggcatcagttacgccgacgctgacggcgacggctacatcgacgacagcgaggtcgatggcctcatcgagttcgcgcagaagaacctcggcctcaagatcgtcgcctactgatctcacatggggcgcggcgcgcggcgggtcgggggtgggacgcactagctcgccatgagct

SEQ ID NO: 36040 - DNA, 422 bp, Zea mays
  Clone ID: LIB3060-011-Q1-K1-G1
ccagagctgctcttgtccggagacggagccgactgaacatggccggagacccgggggacgcgccggaggtgggaggcggcggcatacgctccgtgctcaccacggcctcgctcgtcgctccctccggggacgaggttcagtttcgggagatcgacggcaagatcatcggcctctacttcgcggcaaactggtatccgaaatgcgaggctttcaccccggtgctggccgcggcgtacgagcagctcaaggagcgcggcgccggcttcgaggtcgtgctggtgtcgtgcgacgaggaccggccgtcgttcgagcggttccacggaaccatgccgtggccagcggtgcctttcggcgacctcagctgcaagaagcgcctcagcgagaggttccaggtggagggcatcccgcgcctggtggtgctc

SEQ ID NO: 36041 - DNA, 336 bp, Zea mays
  Clone ID: LIB3060-011-Q1-K1-G11
actcgctgcatcacaggttcctgaatgagctggctaagattgacttccctggagccaaggtggtgagcgaggcggtggccaagtccggcacctcgcccctgcttccggcgatcaccttcatcttggacaaggtcgcaccgtttatccccaatgaggagcccaaggcggagccggcggcggaggccaccttccgggaagtcgccgtggaggagaagaaggaggaggccgagccagctgcagcgacggaggctgcaccggcgccggcagagacaccgtctgaagaagccgtggtagaagataagaaggaagaatataataacgaagatgaagataaac

SEQ ID NO: 36042 - DNA, 152 bp, Zea mays
  Clone ID: LIB3060-011-Q1-K1-G12
ggggatcttcaccaacgatggctccttcatggagaggttcaagcagatgcagcaggaggcgcagtagaagaaggccgctactgccttcgcctcatcggcttccaagcatgctaaccccaagcaggggttcgtctgctgagctgtcatttttc

SEQ ID NO: 36043 - DNA, 348 bp, Zea mays
  Clone ID: LIB3060-011-Q1-K1-G3
cagcaattcatcagctagaagttcgaaatgggggtcaagtttttagtccttctcggtgttgtcctggcctctcttgtcttccaggacgtggcatttgctagagagctcactgaggccaataatgaggatgagggaaagaacatgaaacaaggaggaatgactgaattaaaggatgagaaatggggaggtggatataatggaggatatggatatggaggtgggtatggtggtggatatggaaaaccgggctatggtggtggatatggtggaggatacaggcctaaatatggcaggggctacaggaccggatatggatacggtggcgggtatggtggatgatacggtggc

SEQ ID NO: 36044 - DNA, 431 bp, Zea mays
  Clone ID: LIB3060-011-Q1-K1-G4
tactccatcaactagagcctcattttgacttaaaaagatagcatccaaacttgtgctacagtaacttatcccttctcgcaaaccgtttcaagagcacaaagagcttattaagacgctttatctagcttatttacttaacatcctctaataaattattgactgagtaaaaatacatatgatggttaaatttcaatcattgcccatattgaacatccaaattttgttaaccagcaaccaagtgaccaatgccttaaaagaaaatctgaatctctatctggttcataagcaaggggtcattcaactacattggtgcaacctgctctaggaaatcataatgggaatggaggtgcacacaatgtccttcggatggctaacgttgtacatcgattcaagagcttagttgaatctttggaaattggtgttgtgctatc

SEQ ID NO: 36045 - DNA, 451 bp, Zea mays
  Clone ID: LIB3060-011-Q1-K1-G5
cgcacaccccggcagccgcaaacgccttcgccgtcgcgtcccgctcctccgcccgccggacgcgacccctaggacctggagagagaggtcggcatggctgccgcagtggtcgacgacgctggtatggacgccgtccagaagcgcctcatgttcgaagacgaatgcattttggtggacgagcaggacaatgttgttggccatgagtcaaagtacaactgccatttgatggaaaagattgattctgagaatctgctacatagggcattcagtgtgttccttttcaactcaaaatatgagctgctacttcagcaaaggtccgcgacaaaggttacctttcctttagtttggaccaatacctgctgcagtcaccctctgtaccgtgagtctgagcttatccaggagaactaccttggtgtgagaaatgcaacacagaggaagctactggatgagc

SEQ ID NO: 36046 - DNA, 429 bp, Zea mays
  Clone ID: LIB3060-011-Q1-K1-G6
ccagagactagggcctcagtgatgacagaaaaagatagcagtcaagcttctgctgcatcaagtcagccctttgcgggaactgttttaagagcacaaagtgtatctcaggaagcttcacctagcgtctttacttcaaagcctctcatagattcttcacttgtgaaaaatacatatgttggtttaagttcaggcggtgcccatattggacatccaaattttggtaaccagcaaccaagtgacgaatgccttaaaagaaaatctgaatctctatctggttcagaagcaaggggtcattcagctgcattggtgcaacctgctctaggaaatcataatgggagtggaggtgcacacaagggccttcggatggctaacgttgtacatcgattcaagagcttagttgaatctttggaaattggtgttgtgctatct

SEQ ID NO: 36047 - DNA, 257 bp, Zea mays
  Clone ID: LIB3060-011-Q1-K1-G7
cggaattctacccacgcgtcatgagtacttgatcaactagaagctcgtattgacttcaagtttttagtcctactttcaggttccggaacctttcttgtcttccacgacgtggcattagctaaagatctcactgaggccaataatgatgattatgtacagaacatcaaactattaagaatgactgaattaatggttcatatgtggtttactggatataatgtacgatttgtatatatacctacttatattagcagata

SEQ ID NO: 36048 - DNA, 291 bp, Zea mays
  Clone ID: LIB3060-011-Q1-K1-G9
cggagcgtgggtctccttcccggtctcctacgttcgttgccttcgtcccctccatcgcctgctgggtcgcctgccagcccgacaccgcgaatcggatccgacgacaaggtgagagggaagagattgggctcactgttcaccaagctggtcagccggctgttcgccaagaaagtgatgcagctcctgatcgtgggactctacgccctcagatacgaccacactacctatagtccgacacttgccgagaactatatcaacaggcgtaacttcttctagcatgagataaccaag

SEQ ID NO: 36049 - DNA, 420 bp, Zea mays
  Clone ID: LIB3060-011-Q1-K1-H10
accgcacgcaggcctccgactgggagacgttcaagctgtggaggctgaacgacacgacgttcaggttccgcacgtccggcaaccagttcgtgggcatcggcgccagcgacggcatcatcgtcgcgacggccaccacgccgggcctgccggagacgttccagatagtgcggtgccccttcgacaagaacagggtccggatcaaggcggcgaacggctacttcgtccaggcgatagcgaccggcgaagtgatagcggactacggcgagcccacgcggtggtccgacttcgacgcgtcagtgttcctgatgaccaccgtcgggcagcaactgcaaggtgagtaccagctctgcaacggctacggcgccgacaaggccgtgccgctgctgatggagcattggagcacgtacataatggaggacg

SEQ ID NO: 36050 - DNA, 240 bp, Zea mays
  Clone ID: LIB3060-011-Q1-K1-H11
aagattcggcggagtgaacctgtgcatttccggcttccttgtgccggagaaggttgccggcaagagcgtcgtgtgccaccgccgcgtcagcgcgcgcgttcagaatggccttgttgtgcgccacgcgggcggcgccggcatggtgctgtccaacacgggcggcaacggccaggaacttgttgccgactcgcaccttctgcccgttttcgttttcttttatagggaaggcaccgtaatcaa

SEQ ID NO: 36051 - DNA, 415 bp, Zea mays
  unsure at all n locations
  Clone ID: LIB3060-011-Q1-K1-H12
cgagaacaccaccacgaacaagaaagaaacacggccgcggcggngcggggcggggcttcttctcgttttccaactcgctgcccgttgcgtgattccgccgcgtcgcgtcgcgtgtgcatttgcgcgcgcgcgcaggagccgccgctccgatcgccctgaaaaaggtgccaattgttactgattccagatataggtgttcctgcgctggaactaactgcgccgcgaccttcctcagcaatcttatgctcatgtctcactctcaacagatggcgaatagtaagaagcctcctggcctcaggttactcggaggcgccggctcactgacaacgtaccagacactagtcctggtcctcacgttcttggcatacacatgcttncacatgactcggaagatcccaagcatagtcaagagcgc

SEQ ID NO: 36052 - DNA, 451 bp, Zea mays
  Clone ID: LIB3060-011-Q1-K1-H3
gcactacagcttaagtcactgaggtatctgtgggtacaaggattcaggtcatctccagctggagctgatattatggcaatggtacgccccttctggaacattgagtatattgttccagatcaagatgaaccttgcccagagcataagagacagattctggcatactactcccttgctggcaggaggacagattgtcctccatcagtaactctgctttacccggcattttgagtgtagatacttgctttttgccagactgaatctcatggtactaagttccattggtcccactatctgtgaagtaaatggtccctgttcttccaattgatgaggacatgcagacgttccagtgcaaagaaccccaaaggtaagctttaagcaggacggccagctctgaactgaggctagctgagaacaatcatgaatacctgaaggcagcacttatgtcaac

SEQ ID NO: 36053 - DNA, 352 bp, Zea mays
  Clone ID: LIB3060-011-Q1-K1-F8
atccaaaccagacaagcaaggaatcccccgatggctcatcgcgttctcctcctcctctctctcgcgtcggccgccgcggttgccgccgccgtcgacgcggaggacccgctgatccggcaggtggttcccggtggagatgacaacgatctggagctgaacgcggagtcccacttactgagcttcgtgcagcggttcggcaagtcctacaaggacgccgacgagcacgcgtaccggctgtccgttttcaaggccaacctgcgccgcgcgcgccggcaccagctgctggacccgtcggcggagcacggcgtcactaagttctccgacctcacgccggcagagttccgacggacct

SEQ ID NO: 36054 - DNA, 426 bp, Zea mays
  Clone ID: LIB3060-046-Q1-K1-A2
agcaacttattgaactagacatttcctcaaataaacttgaaggggaaataccttacgagtttgagtgaatgtcgtcagttgaatgtactccaaatggactccaattttatcacagggaacatttcgcctctacgtagtctaacaagcttgaacatgatcaacctctcacacaatatgttgtcagggatcatccctgcagaactgggtggtatgtcctctcttacccagctggatctatcttataatgatctacaaggcaaaattccaatggatggagtatttagaaatgcttcagctatctcacttgttggcaactcgagactctgtggtggtctgtcagatttgcacatgcccccctgccctgttgccttaaaggaaaaggcagcacaatactacatcattagagtgttgatcccaatatttggc

SEQ ID NO: 36055 - DNA, 429 bp, Zea mays
  Clone ID: LIB3060-046-Q1-K1-A3
taccgttcggaattccgttcgagacacgcatacgaggctgtcaacattacaatgattgatacacctggccttccacctgggttattgaagtgtcctactcgaatacacttctgcttcattcgcatggtaacacacgcgccatatcatctgtctgcactctcacacgcttcaacatgtctatgctacaacagactacgtgcctaccgatcatccgtccataactgaggtgctcctcgccatttacgtatctgacaacacttcataatgctccacatccatggataacaaaaacatccagttcatagaactcatctatatcactcacatcttccaaactcaaaactatcccgagcgccgtcttatctagacctgcgagtgtgtactctacacttctgagacacgcccttgcaaaagtccaaaattttactt

SEQ ID NO: 36056 - DNA, 308 bp, Zea mays
  unsure at all n locations
  Clone ID: LIB3060-046-Q1-K1-A4
ctccaattcttatcacacatcaacatttcacactctacatactctaacaagctttaacatgatcaacctatcacacaatatgttaccagccatcatccctccataactctctattatgtcctctcttacccatcttaatctatcttatcatgatctacatctcataatttcaatgcatttattatctataaatcctttagctatatcacttgttctcaactccacactctatacatctcanatcatatatgcacatgcccttcagtcatgttgccttaaaagaaaaatcaacacaatactacatcatt

SEQ ID NO: 36057 - DNA, 412 bp, Zea mays
  unsure at all n locations
  Clone ID: LIB3060-046-Q1-K1-A6
gaacatctactcgagccggtggaggtcagcggggattgaggaggaggaggggaagaggcgaggcaggaaatcaagcgggaatccaagaaccgtaaggatgaccatggtggagaggaggtacggtccctgtaccagccatggttccttcctcctacggctgctgctgctgctgccgttcttcttcctctgcttcatcgatgtgccgccggccggcgccgccgacaccacacagtcgcctgcactagacaacacgcaaaaggctatcatgaacgatgttgcgagtctggtgaactccggatccgncaacaccaggtggaacaccgcggagtcgaatccgtgcaactgggaaggaatcacctgcacaagtaacacttcttcctcggccgtgactcggatcgccttgtcaaactat

SEQ ID NO: 36058 - DNA, 442 bp, Zea mays
  unsure at all n locations
  Clone ID: LIB3060-046-Q1-K1-A8
aggaggggctaggaggaggcggatcggggagcggagatcctagccggagggatggcgganggcggcgtggagaggggcgcgctgctgccggtctcagcggacgacggcaagggaaacggcggaggggcaggcggcgacgatgccgtgctgttcaaggggtccgccatgacccgccgcggcggcaccgccgcgctctcttacatggcatgctccgtgttgctagtgatgtttaacaaagcagctctctcttcgtataatttcccttgtgcgaatgtcatcacactccttcagatggtgtgctcaacgtgccttctttatgttctgagacgattaaagatcatctccttcactaatagtgatccatcagtgccttctgattcactattctttgtgccgtttaggttattactacgcaccacacctctntccttggcttatttac

SEQ ID NO: 36059 - DNA, 348 bp, Zea mays
  unsure at all n locations
  Clone ID: LIB3060-046-Q1-K1-B1
gacctcccttccacttaaaccacgccaaaaaccaactcgggaatcctcccactggccggaatctgaccggccccgccatccccaccgncgcgcctcttccgggcagccatggacgaggccttcgcgcgcgcggtggaagacggcctcaagctcaccaagcgcctcgtcctgcccagcgggggcgggatgccgccgccgccgccgcgcccgcacctggcgatggaccgcgacgaccccgccgcggcgctgcagcagctcatgccggcggcgcccaatggcgtacgccgtcgtcgtcgacccggccgncgtcgacagccccgacgtacccagctaccagccccacgtcta

SEQ ID NO: 36060 - DNA, 266 bp, Zea mays
  Clone ID: LIB3060-046-Q1-K1-B11
ccaaatcccgtcccctccacccgcactccattggcgccgctcccctcccctggccggcgccggagatctgatccgatccgatccgatccgtttgtgcttgtgctgcaggagtgagaagtaaaaaaatatggctgccctgccactggccaccgccgaagtatgcgacgctaacccttacctgatcatgaacggcgagcttcgcgcgcttcagccaatcttccagatctacggacggcgccaggtcttcgccggccccatcgtcacgc

SEQ ID NO: 36061 - DNA, 430 bp, Zea mays
  unsure at all n locations
  Clone ID: LIB3060-046-Q1-K1-B3
gatgttgaggtctccaaagggaagcaagtccagatcatgaaggatattgagctggagcaaatatctaggggccctccatatggcgctggaggtgccctctacccccatggaactggtgcaaatgctgaactcgatgacgaaatgcttcagctgtgggaggctgcggagaggagctgcaagaaccaaacggccaagtcctcgtcatctgagcacgacatacaggcggtcgaggatctggagagcgagtgcccttcgtctgagctagcgaagggaagagagcttggaaccaataagctagaagtgtcaaagggagctgtagagcctcacgaggcgtggagcaagaacgtgcttgagaggctcacttctgatgcccagaggctgttgagcatccaagcgagcatcgaggaactgaanaagaaaatggaagggt

SEQ ID NO: 36062 - DNA, 238 bp, Zea mays
  Clone ID: LIB3060-046-Q1-K1-B7
gccctgacccctcctccccgccgccggcgccgcgtgagcacgccgggcttggctatgggctcgacttctgcgcgccccacgggcccgccaagctcccggttgcgtctgtcgctggggtgcgagtcgccggcaggtggttgtggcgatcggcggcggttggggcggtgcaccatggcgtctacgtgcgggccttatgcttcggttctcgtatcggtctcgattcttagaattttcacac

SEQ ID NO: 36063 - DNA, 419 bp, Zea mays
  unsure at all n locations
  Clone ID: LIB3060-046-Q1-K1-B8
caacggcaagatcaccgcgaggatctccaactggggcgccaccatgacctccctccgcgtccccgacgcccaggggagtgtcgctgatgtggtgctcggattcgatggcttggatccgtacgtgaaaggcatgtcaccttattttggctgcatagttggccgtgtcgcgaataggatcaaggatgggaagtttacactaaacggacttgagtattcattacctgtcaacaatggacctaacagccttcatggtgggttgaagggatttgataaggtcgtgtgggatgtcgtggagcacaaagatggcgaatgcccttcaataacttttcagtatcacagcaaggacgggggngaaagctatccaggcgatgtaaccattcgagcaacatactctcttcctgaagctactactctaaagc

SEQ ID NO: 36064 - DNA, 261 bp, Zea mays
  Clone ID: LIB3060-046-Q1-K1-A12
agaagactagtgtcaagtgaacctgaaacttgcggtgtcactggctggtatagccggagtgtgagtgagtgatcgagctagctgagctccgatcctcgctagctagctaggataccgccataccacaagtcttcttcacaagtttaggagtgacagcaacaagagatctcgatggcctctgccaccgtgctcaagtcctccttacttcccaagaaatccgaatggggcgccaccaggcaggccggcgcgcccaagccggcc

SEQ ID NO: 36065 - DNA, 388 bp, Zea mays
  Clone ID: LIB3060-045-Q1-K1-G5
caatatgcttcaaggttgcagaagtgttgatgagtttgagaggctcaacaggattaatgagggaacatatggtgttgtatacagagcaagggataagaagacaagtgagattgttgcattgaagaaggtaaagatggagagggagcgagaaggtttcccattaacctctcttagggaaataaatatcctcttgtctttccaccatccttcaatcgtggatgttaaggaagtagtagttggaagtagtttagatagcatttttatggttatggagtacatggaacatgatcttaaaggtgtcatggagaccatgaaacaaccatatacacaaagcgaggtcaaatgtttgatgcttcagctgctagaggggtgtaaatatctacatgac

SEQ ID NO: 36066 - DNA, 345 bp, Zea mays
  Clone ID: LIB3060-045-Q1-K1-G6
ggattcccggtcggcccaagccgtccggcataacccagtttaataacccgatccggtggaaaaggcacctttttttgaacatggcgggggagggagccccggtgctggtgaggcatgctggcggcgtggaggagctgcggcagctcccgccggggttccggttccgccccacggacgaggagctcgtggtgcagtacctccggcgcaaggccttgggcgcgccgctccccgccgccgtcatccccgtcgtccgcgacctctacagcctcgacccctgggacgccgtcgacgtggccggccgccctgatgcgagcagccaaagcgagagatacttcttcgcggtgc

SEQ ID NO: 36067 - DNA, 217 bp, Zea mays
  Clone ID: LIB3060-045-Q1-K1-G7
ctgacgcttctcgaattgatataagtatccatctcttaccaaacaaaataaaaagtggcatggtctacaagtggccatcgcttttcaccctgctgaacacgccgagtacctactaatccgctatgttcttcatatggagagtgcccacgatctgaagctgacaactgatcctagagatatgaacattctcctggacgactaccaagtcctacatcgt

SEQ ID NO: 36068 - DNA, 306 bp, Zea mays
  unsure at all n locations
  Clone ID: LIB3060-045-Q1-K1-G8
gatggcacaagccatggcgtccatgaccggcctctcgcagggcgttctgcccagcaggcgcgccgccaacagggccaggacggccgccgtcgtcagggcgtccgccgaggcgcaggcgcaggcgggccgtcgcgccgtgctcgggctggtgggcactggcatcgtcggcggcgccttgtcgcaggcggtgcacgccgagaccgtcaagaccatcaagatcggagccccgccgncgccctccggtggactccccgggactctgaactctgaccaggcgagggacttcgaccttcccttgaaagagcg

SEQ ID NO: 36069 - DNA, 416 bp, Zea mays
  unsure at all n locations
  Clone ID: LIB3060-045-Q1-K1-G9
ctctggtcgttgcgtcggtgctattccattcccagcacctcctgctcgcacctactcggncccagagcccaagacacccaagcagcaaccacgccatggtggcaagcgaagccggccaatttccataagcctctccacatcccctccctcccattctgagctctgggcaggtccagcattctccaactctccaccacctagttcgcttcccatccccaaattctcgctccgccagaagcgcagcatctctctcgagctgccaccggttgaacgccctgatgatgtggtggtcaggctgcattctaaatcagcaccttcatccccagttgagggatatgggtatgacttcttcaatgacgatgcaatcgctagtgcgatagcaacggagaatctgaggaggattctccagctggata

SEQ ID NO: 36070 - DNA, 300 bp, Zea mays
  Clone ID: LIB3060-045-Q1-K1-H1
ctgtttgccgtgttccgcaaggaagagagctagttatagatctttccgagtgtacagtttatttggagggaagaaggataaagatgagaatggcgatgaagcgccatcgaaagcagggatttttggaaacatgcaaaatctctatgaaactgttaagaaggcccaaatggttgtccaagttgaggctgtccgggtgcagaaggagcttgcagcgtatgcatttatatcattaatttatctatctcttgtcgatgcaaaatagccagcctgtgcgatttttttctcctatttttaagactg

SEQ ID NO: 36071 - DNA, 378 bp, Zea mays
  unsure at all n locations
  Clone ID: LIB3060-045-Q1-K1-H11
ccaacggctactacaactaccgccaccaggcggacatctgccatgcataccagatcatgaaggagggcggacttaaggacgagaacatcgttgtcttcatgtacgatgacatcgcgcatagcccggaaaatccgaggcctggtgtcatcataaatcatccccagggtggcgacgtctatgctggggtgccaaaggattacactgtgcgagaggtcaacgtcgacaatctcttcgctgttctgcttggcaacataactgctctcaggggtgggagcggcaaggttgtggacagtggccccaatgatcatatatttggtttctacagtgaccatggnggtcctggtgtccttgggatgcctacgtatccatatctctatg

SEQ ID NO: 36072 - DNA, 377 bp, Zea mays
  unsure at all n locations
  Clone ID: LIB3060-045-Q1-K1-H3
gtacaaccctgataagattgccttcgttcccatttctggttttgagggcgacaacatgattgagaggtccaccaaccttgactggtacaaaggcccaaccctgcttgaggctcttgaccagatcaccgagcccaagaggccttcggacaagcccctgcgtctgcccctccaggatgtgtacaagattggtggtattggaactgtaccggttggtcgtgtggagactggtgtcatcaagcctggtatggtagtcacctttggtccaactggcctgactactgaggtgaagtctgttgagatgcaccatgaggcgcttcaggaggctcttccgggcgacaatgttggcttcaacgtgaagaacgtngctgtcaaggatc

SEQ ID NO: 36073 - DNA, 383 bp, Zea mays
  unsure at all n locations
  Clone ID: LIB3060-045-Q1-K1-H5
gatgagattggcatagagagctagatgggtgttgacacctttttggaggggccaatgcatttcaaaagaaccagcggcggtgctctctggtcaggcgcggacggtccgcggcacagagccggacggtccgcgacctggcgcgaggcggcggtgctccctggtcagacgcggacggtccgcggcacagggccggacggtccgcgacctggtgcaggagctaggatcccctgcctgacggccggacggttcgcgcgtgcgtaggggcggcggaagatcaccggcggctcctgaatctcgctcccgggagggaccccgtttgggaggagagatcctaggagttgtctaggctcgggcagaccgacctagactnctctaatcgacgt

SEQ ID NO: 36074 - DNA, 440 bp, Zea mays
  unsure at all n locations
  Clone ID: LIB3060-045-Q1-K1-H6
tctcccttgctccagatctcccttcgcagccggccagggaccccttcacagcgcgggagatggctgatcaggaggccccagttgcagttgaggcaccaaccccagttcttggagagccaatggacttgatgactgcgctgcagctggtgatgaagaagtcaagtgctcatgatggacttgtgaaaggtcttcgcgaggctgccaaagccattgagaagcatgctgctcagctttgcgttcttgctgaggactgtgaccagccagattatgtcaagctggtgaaggcgctctgtgctgaacacaatgttcaccttgtcactgttcctgctgctaagactcttggcgagtgggctgggctttgcaagattgactccgaggggcaagcaaggaaggttgtangctgcttctgtgtcgttgtcaaggactacggtgaagaatct

SEQ ID NO: 36075 - DNA, 404 bp, Zea mays
  unsure at all n locations
  Clone ID: LIB3060-045-Q1-K1-H9
cggacgcgtgggcgccgnctnccttcccctccgctactgcgacctccccaccccactgccccgcatgagcggcggcggcggcggcggcgaggtcgtaccccacatcggcgagcggcggcggcaccgtcggaggcaaaggcaagatgttcgggcgcgcgccgaagaagagcgacaacaccaagtactacgagatcctcggngtgcccaagtcggcgtcccaggacgacctcaagaaggcctaccgcaaggctgctatcaagaaccaccccgacaagggcggtgaccccgagaagttcaaggagctcgcacaagcctatgaggttttgagtgatccagagaaacgtgagatttatgatcagtatggtgaagatccccttaaggaaggaatgggcggtggaggatcc

SEQ ID NO: 36076 - DNA, 441 bp, Zea mays
  Clone ID: LIB3060-045-Q1-K1-G2
cccaatccaaaccagacaagcaaggaatcccccgatggctcatcgcgttctcgctcggcctctctctcgcgtcggccgccgcggttgccggcgacgtcgacgcggaggacccgctgatccggcaggtggttcccggtggagatgacaacgatctggagctgaacgcggagtcccacttcctgagcttcgtgcagcggttcggcaagtcctacaaggacgccgacgagcacgcgtaccggctgtccgttttcaaggccaacctgcgccgcgcgcgccggcaccagctgctggacccgtcggcggagcacggcgtcactaagttctccgacctcacgccggcagagttccggcggacctacctcggactccgcaagtcccggcgcgctctccttagagaactccgggagtcggcgcacgaggcgcccgtgctccccaccgatg

SEQ ID NO: 36077 - DNA, 411 bp, Zea mays
  Clone ID: LIB3060-045-Q1-K1-E9
gttaaaaggtgatatttgtgaagaatccctcatggatactaaaactgctaatggttcttgggattgtagtgaactaaataatgattcctgtgggaaaacttcagccctttgcatgaaattgaatcggcctgcacttaatgttacacaagccacatctgtacctgaccgattatcttcgtctttggagaaagccagtgaaaatgtggccgcaagtggtgtcaaagagacaaaaacatttggctcagctgtttgtgatgttgacagaagtgcagaaccaattgaccgttcaaacaacaatgtgacgagcaacacaatgcgacatagtgagactattgtagtggattcagtgaacaatgtgggggatacagcaagcaactcttcactggctactaaatcatccagtatacaatc

SEQ ID NO: 36078 - DNA, 403 bp, Zea mays
  Clone ID: LIB3060-045-Q1-K1-F10
gccttcccctccggcggcaggtctctctgaatggggggtctccggcaatggcggctctggctccatccaagattctgggcaccaagctcaacttcgccggctcctcccgctacgccaccgcagcgcccaccgcgggggctcagaagatcgtctccctcttcagcaagaagcctgcccagaagcccaagccctctgcggtgtcgtcctcttctccggacatcagcgacgagctcgccaagtggtacggtcctgacaggaggatctacctgccggatgggctcttggaccgctcggaggtaccggagtacctcaccggagaggtccctggagactatggctacgacccttttggcctgggcaagaagccagaggacttcgccaagtaccaggcctacgagctgat

SEQ ID NO: 36079 - DNA, 314 bp, Zea mays
  Clone ID: LIB3060-045-Q1-K1-F11
gaaggacacaaaaacacaggtagggttaggcgacgcggcggcgagagcgcgagagtaggaggaggcgtcggccatgacggggaaggcgaagccgaagaagcacacggcgaaggagatcgccgcgaagatcgacgcggcgacgacgaaccggggcggcggcaaggtcgggcaggcggatcggctagggcaggacaagggcgggcacgcgaagctggcgtgcccgctctgccgcaccccggcgcccgacatcaagtccatgcagatccaccacgaggcgcgccatcccaagcttcctttcgagccggaaaagctcg

SEQ ID NO: 36080 - DNA, 438 bp, Zea mays
  Clone ID: LIB3060-045-Q1-K1-F2
actcaacacagcacaggcagctcgagagagagagagagagaaagatgtcgtggttcgggcaccaccaccacaaccagccggctcccccggcgtcgggccccaaccaggtgttcaagatcttctgccgcgccaacgagaactactgcctggccgtccgcgacggcgccgtcgtgctggccccggtcaaccccaaggacgaccaccagcactggtacaaggacatgcgcttcagcacccgggtcaaggacgaggaaggcatgccggcgttcgcgctcgtcaacaaggccacggggctcgccatcaagcactccctcggccagtcccacccggtcaagctcgcgcctttcaacccggaccaggaggacgcgtcggtgctgtggacggaaagcaaggacgtgggcaagggcttccgctgcatccgcatggtcaacaacaccc

SEQ ID NO: 36081 - DNA, 432 bp, Zea mays
  unsure at all n locations
  Clone ID: LIB3060-045-Q1-K1-F3
cccgtctccgccatcagtgctgccaccgacgacggctccgtctccctcatcgccggggacctatctgacgccacggacctcgtggactcgtacacgaacccgggccaatacctcctgatccgcgtacccggcgaggagctcaagccggcgtacatggtcatctcctcgccgcctaaagcggggccccggttcgaattcctcgtcaaaagcgtgccgggagctaccgcggggcggctctgcgccctccgagacggggatgttgtggagctcggcgccgtcacgggggaggggttccccctcgacaggataaatccgcccgacgtcgcgcagaccgtgctcatcttcgcggcggngacggggatcagtgcgattcgatcacttatcgagttcggtttcgctggcaaagaaagagctgatgtgaggctttattat

SEQ ID NO: 36082 - DNA, 402 bp, Zea mays
  unsure at all n locations
  Clone ID: LIB3060-045-Q1-K1-F4
ctccctccgtgctcagcttttcttgggcgtacttccctgctcgtcgtgcttggctgccgcccctgcagtggtcgacctcgcctggtcgtttcagcatcgtgcagccatgaagctctgccctcgccaagctcctctggttataccttggcctccagctcgccagaccgcggtcgtccttgctcctcggctggccgcgcacagctttcgctatccatagccgccgtcgaagctcccatggcgccgttcttccctgaagctcccctgcaccgcgtctctctctctctggtctccttccagccgtgaagttccctgcgcgcctgcgccatgccgatcntccagcgtcgcgcgctgcggcgctccagccatggccgccaagctcccctccagttntcccccgcgttt

SEQ ID NO: 36083 - DNA, 376 bp, Zea mays
  Clone ID: LIB3060-045-Q1-K1-F5
gcagaggcagcgacacgatcgcgagcgcacgcacgtaagcacgttgtcggaagctcaggttagaagaagcaccagtgcctgatcgatggcggcccaggctctcctctccggccggcagctgctgggccgccccgtgcagtcggccgtctctaggtcgtcggcgaggaaggcgcccttcgtcgtcagggccagctccagccctccagccaagcaaggtgccgacaggcagctgtggttcgcgtccaagcagtccctctcctacctcgatggcacgctgcccggcgactatggcttcgacccgctgggcctctcggacccggagggcaccgggggcttcatcgagcccaagtggctggcctacggcgaggtgatcaac

SEQ ID NO: 36084 - DNA, 418 bp, Zea mays
  Clone ID: LIB3060-045-Q1-K1-F6
gcaaaaacctgcaggcaagctagctagccacgcgcacgcagatcagcagatgaagctgttcgccttcgtgaggcgcgcgcgccggccgccgccgacggcgcccgacgacgacacagccacagccgccgccgctgcgaccacggagaagcggcgccggaggctgtcctcgtcttcgtcgtcggggtcggcgtggaagccgacgctgggcgccatctccgaggacgccgccatgacgtccgcgcccgtggcgcaggcgaaggcagcagcggcgccggccagggccaaggcgaggtcgcctcgccgtgccacccgggcggccggctacgacgacttccggcactacggccacccgacggtgctgccggccttcacgccgacggcgttcctgttctgagcggtggcgaaccgcaggcaacgc

SEQ ID NO: 36085 - DNA, 161 bp, Zea mays
  Clone ID: LIB3060-045-Q1-K1-F7
ctcaactcaatacactcacctacatatacacacatagacaaatatatcctggctcagtcaccaccaacagaaccagcctactccatcatcataccaccccaaccacttattcaacatcttctgccgcaccaactacaactactccctctccatcctctact

SEQ ID NO: 36086 - DNA, 309 bp, Zea mays
  Clone ID: LIB3060-045-Q1-K1-F9
cgctcatcttgctccgccttccgcgcatcctccaaggatcgtgatggccatggccacgcaagcctccgcggccacgcgccacctggtggccgccgccgcttccgcctgggcgccgtcggcgaagccgcggcagctaagctcacagctcgcgctgccgccgtcgtcctcccgcgcgccggccccgctccgcgcgaccgccggggaggcggtgaccgaggaggcgcccaaggggttcgtggccccgcagctggaccccagcacgccgtccccgatcttcggcggcagcacgggcgggctgctccgcaaggc

SEQ ID NO: 36087 - DNA, 393 bp, Zea mays
  unsure at all n locations
  Clone ID: LIB3060-045-Q1-K1-G1
attcctttccagctcgcaccgcggttgaacagcgtttcgttgtttcctccccaacttgcaacgggcctcgatctagatccactcttcccccttctccttccggtcctccccccgagactattcatataggcgggtaggcgtccgaggcctcgtttgttctcggcttcttgtctccaagggtgctactccgtccgcgcttggtctgctctcgtccttccggaggccgcggcgcaacatggcgaagatcaagccgaaggccttgctcgcgcaaagcaaggtgaagaaggtccccggccaaatcagcgtggccacgatcgtcacctacatgatcctcggcgtcctggtcgtgtcctccgtttacgctggctacaggtactgctgngcagtcacagg

SEQ ID NO: 36088 - DNA, 238 bp, Zea mays
  Clone ID: LIB3060-045-Q1-K1-G11
ctatcaccctccaagttcagtcatctgacaccattgactacgtttatgccaatatccattactaggactgcatccatacagactagtagcagctcatattacctttcaaacagcttaacgacagtctcacgcttgctcactacatcatccacaatcagagcaccctccaccttgtgctccgtctcattttaggcatgcagatctttgtgaaaaccctgacctgctagactatcaccct

SEQ ID NO: 36089 - DNA, 378 bp, Zea mays
  Clone ID: LIB3060-011-Q1-K1-E3
ttcccaactcgaggcacgcgtcacgcgttcgcagactagcaaggaatccctttatggctcatcgcgttgttcttctcctctcgctcgcgttcgccgtcgcgattgccgccgccgtctacgcggaggaccctcttatccggcaggtggttcccggtgtagatgacaactatctggagctgaacgcggagtcccacttcctgagcttcgagcaacggttcggcaagtcctacaaggacgccgacgagcacgcgtaccgtctgtccgttttcaaggccaacctgcgccgcgcgcgccggcaccagctgctggacccgtcggcggagcacggcgtcactaagttctacgaccttacgccagcagaatttcgtctgacctacc

SEQ ID NO: 36090 - DNA, 447 bp, Zea mays
  Clone ID: LIB3060-011-Q1-K1-E4
ggattccgggctacaccacacccacccgacgacgatcacacacgcagaagatcgagttcgttcgatcgtgaccgtgacgcagtggctataagctagccaagacaggaataataatggcggcgtcgacggtggcgagcctctctgtcccggtgacgacgacgaccttcgcggcggcgggcggcggcgacgtgctgatcgtcgtcccgaggagggcgggcgccaagcgcgtcgtctggttccccgcggcggcgcgccgcggcggcaggcggttggtcgccgtgcggtccaacgtgccggccacgccgacggagatctccgacaaggtgtctgagagcatcaagcaagcggaggagacttgcgcggacgaccagaatggcgacgccgagtgcgcggcggcgtgagacgaggtggatgagctcatcgccacgggcagccacgcccgcgaca

SEQ ID NO: 36091 - DNA, 332 bp, Zea mays
  unsure at all n locations
  Clone ID: LIB3060-011-Q1-K1-E5
atcaattgtaaatagacatggtaataaccgagaactgatcgggcatagtacgataaagcagcatgtgaaatcagtgccagctccagtacgtgttgttaatgatagtgtcaagtgtttcagcatgcctagagcctctaaggtggagattccttggcctgcctattcaccagcggaggatcctttgcttgataaatctaatacagaggtaattctggagcttgaggataaagttcatgatggtgatgacaaanagacaaaaactgttgtaaaaaaggtggtttcaccattcccaactaaagcggncttctctgaggaatcctttgaagcacggg

SEQ ID NO: 36092 - DNA, 264 bp, Zea mays
  Clone ID: LIB3060-011-Q1-K1-E6
acaactgcaatactaccatagttcacacgcagtgacaagcttcttaagcatacaaaccaaggacgatcgacacaacctaacaaggcgctgccagttttctccactacaaattattgaccacacttggacgttaaggtgttgcaccatttacaagccatgctaatgatatgaaggtgacgattattaggggtggtcactagtacagtcatcctgctatatatacccttttccccccatggagctagctgatagacatgccttcct

SEQ ID NO: 36093 - DNA, 451 bp, Zea mays
  unsure at all n locations
  Clone ID: LIB3060-011-Q1-K1-E7
cagacaagcaaggaatcccccgatggctcatcgcgttctcctcctcctctctctcgcgtcggccgccgcggttgccgccgccgtcgacgcggaggacccgctgatccggcaggtggttcccggtggagatgacaacgatctggagctgaacgcggagtcccacttcctgagcttcgtgcagcggttcggcaagtcctacaaggacgccgacgagcacgcgtaccggctgtccgttttcaaggccaacctgcgccgcgcgcgccggcaccagctgctggacccgtcggcggagcacggcgtcactaagttctccgacctcacgccggcagagttccgccggacctacctcggcctccgcaagtcccggcgcgctctcctcagagaactcggngagtcggcgcacgaggcgcccgtgctccccaccgatggtctccccgacgatttcgactgg

SEQ ID NO: 36094 - DNA, 450 bp, Zea mays
  Clone ID: LIB3060-011-Q1-K1-E8
atacactactgccgtgcccccctcccttctctctctcttcgccgcagcgtcggccgacggcaaaaccctagatctctctccctcttaaaccctctcaacaagtgcgggaggatgtcagagccgtccaaggtaatccacatccgcaacgtcgggcacgagattgccgagtctgatctccttcagctgctgcagccgttcggcatggtctccaagatcgtcatgttgcgtgccaagaaccaagctcttctgcagatggaagacctccatgcttccgtgagcgcgctgcaatattacacttctgttcaacctagcataaggggaaggaatgtatacatgcagttctcatctcaccaagagcttaccactgaccagagctctcatggaagggattctgatcaagggtccgaacccaaccgaatacttttagttactatccaccatatgatctat

SEQ ID NO: 36095 - DNA, 362 bp, Zea mays
  Clone ID: LIB3060-011-Q1-K1-F1
ccaccatccggaagaacatgccggtggaggagggcgggccgggcgaggagatggagaagttcctcaagcagccggagacgacgctgctggacatgctgcccacgcagatgcaggccatcaaggtcatgacgacgctggacatcctctcgtcgcactcgcccgacgaggagtacatgggggagttcgcggagccgtcgtggctggcggagcccatggtgaaggcggcgttcgagaagttcggcggcaggatgaatgagatcgacgggttcatcgacgagtgcaacaacaacctggacctcaagaaccgctgcggcgtcgggatcgtgccgtacgaactgctgaagcacctatctaagcctgca

SEQ ID NO: 36096 - DNA, 408 bp, Zea mays
  Clone ID: LIB3060-011-Q1-K1-F10
ctccgatcggacggaccaccgggccagcagcggggcggatcgcgtcagcagccatggtgaaggcctaccccacggtgaacgaggactacctcaaggcggtcgacaaggccaagcgtaagctccgcggcctcatcgccgagaagaattgcgccccgctcatgctccgcctcgcatggcactccgcgggcaccttcgatgtggccaccaaaaccgggggccccttcggcaccatgaagaaccccgccgagcaagcgcacggagccaacgccggactggaaattgccatcaggctgctagagcccatcaaggagcagttccccatcctatcctacgctgacttctaccagcttgctggagtcgtggcagtcgaggtaaccggcggacctgatgtccccttccaccctggga

SEQ ID NO: 36097 - DNA, 345 bp, Zea mays
  Clone ID: LIB3060-011-Q1-K1-F11
gagttccttgagccactttttctgatttacaaatcactgtgtgactgcggggacaagggcatcgttgacggcagccgtctggacctcctgttctaggtgttcacgtcctgattctccctggtgaatctttacatgcggtaggaatcggatcgacacaccaacatcttcgacaccatcagcacgcacctttgtttcggcacacatcgcaagtgactaccggtcaagagacaggtgtcgctgatcacttaccttcgaggtaatcgttcaatgatgacatcaaaccttccacaaatcctccatattattgacgtcatccaattgatttaactgctcacggaaattact

SEQ ID NO: 36098 - DNA, 433 bp, Zea mays
  Clone ID: LIB3060-011-Q1-K1-F12
gcgtcctccgcgttcctcaacgctctcgtcctccgatcgccatcaccgtcgctctcgtcctcgtgtaaccgccgcagcaccggcgccttcgcgttcccgaacccaccgcgcttcccatgcctgcgttctgcgcgtcgactcgtccttgcgagggcggcggcagcgccggcgccgggcgatggccccgaggacgagtgggggccggagcccgagggcggttccgctgtcacgggggccgcggtggcggaggcgccggaggcgagagaggtcgcggagctcaaggcgcagctaaaggacgcgctgtacggcacggagcggggcctgcgggcgttcagcgagtcacgagccaaagtgctggagctcatcacgcagctcgagacgcgcaaccccacgccggctcctacggaggcgcttacgctccttaacgggaagt

SEQ ID NO: 36099 - DNA, 449 bp, Zea mays
  Clone ID: LIB3060-011-Q1-K1-F2
atccctaatggagcgaagacaattgaaactgcttctgggcatattgctccagtgacgggccgtgcgctgtcacctgatagcaactactcttgagacaggttctagagataccacagatatactatggaggaatcataatacagatatcctaacataagacacgtgatcaagaactctgatctacttacactactgcaccagtcagtatgttctctaacatcagttatcatgattagcaggaactaagatactatgagacttgaagacgtacatgcattccttatcatgctaggatattacacttatgttcaacgtagcataatgagaaggaatgtatacatgcaattctcatcttaacaagagcttaccactgaccagagctctcatggaaggaattctgatcatgggttcgaacctaacctaatacttttagttactattcaccatat

SEQ ID NO: 36100 - DNA, 454 bp, Zea mays
  Clone ID: LIB3060-011-Q1-K1-F3
cattcataggctgcctgcctgcctgctgatctcgcacctcaaacccacacacagcagcataggttgagatagatggccagtctgtggaagaccaaggttctgcctggcctcaacaagatcttcgacaaggatggcaagaaggctgcagctgcaggcttcttcaagtccttcaacaaggaggagattggcaaggagattgaggagaagaaggcagaactggagcccaaggttgcggaggcttatgaagcatctcctcctgaggtcaaggctctgttcaaggataagaagccagtcaagatcagcaagaagaactcgactgcagttaccaagttcctcgatgagctggctaagattgacttccctggagccaaggtggtgagcgaggcggtggccaagtccggcgcctcgcccctgtctccggcgatcaccttcatcttggacaaggtcgcaccgt

SEQ ID NO: 36101 - DNA, 402 bp, Zea mays
  unsure at all n locations
  Clone ID: LIB3060-011-Q1-K1-F4
gcaaaccaaaccccttctagggtttgcgctccgggcatgatccccttgtagccaccggctcccatggccctagccgtgtcctgctggccatgaccacctcggcttccccactcttccccaacccgcgcaagcgccacctcgacgcctccccccttccccgccacttccacggcccgcagagccaaacccgcctaagccagcgccaccgccgccggttcttcttgccgctaccaccgaaggcgcggtccttcgcttccgacatgggaaatcacatgtccagtgccttcggttggcccagtgatgacgggcgggggctcctctgttgctggatcggcaaggcgcggggtctcacggtggccatggatgtggaggcggngacgggactgcatttggtggaccggc

SEQ ID NO: 36102 - DNA, 367 bp, Zea mays
  Clone ID: LIB3060-011-Q1-K1-F6
gggaaccaagaccccttctagcgtttgctctcctttcatgatccccttgtagccaccggctcccgtggccctagccgtgtcctgctggccatgaccacctcggcttccccactcttccccaacccgcgcaagcgccacctttacgcctccccccttccccgccacttccacggcccgcagagccaaacccgcctaagccagcgccaccgtcgccggttcttcttgccgctaccaccgaaggcgcggtccttcgcttccgacatgggaaatcacatgttcagtgccttcggttggcccagtgatgaccggcgggggctcctctgttgctggatcggcaaggctcggggtctcacggtggccatggatg

SEQ ID NO: 36103 - DNA, 442 bp, Zea mays
  unsure at all n locations
  Clone ID: LIB3060-011-Q1-K1-F7
ggcacactggtctggaaatcagtagcctgttggctgctgttgctattaatcagttgggagagagggagatggccaggaggaacatcggagtcgcagtggacttctcgtcgtgcagcaaagcggctttgcggtgggcgtcgacgaaccttgccaggaacggcgacaggctcatactcatccacgtgaacagctcctgccagaacgagcggngcgccgttcatctctgggagcagagtggttccccattgatccctctggccgagttttcagacgtcgccaggacatacggtgtgtcaccggacaaggagacgatcgagatcctnactcaagcggcaaaccatagagggatcgaagtctttgcaaaggtgttctacggcgacccagcanagaagctctacgaagcagccgacctggtcccgcttagctgcatggtcgtcgggag

SEQ ID NO: 36104 - DNA, 442 bp, Zea mays
  Clone ID: LIB3060-011-Q1-K1-E2
gctggaacaaattcgggtaaggtgacgtggtgagctgctgtctgtagtgtgtggacaactgcagtagtaccatggttcacaggcagtgacaagcttcttaagcatacaaacgaaggaagatagacacaacctaacaaggcgctgccagttttctccactacaaattattgaccagacttggacgttagggtgtcgcaccattgacaagccatgcgaatgagatgaaggtgatgatgatgaggggtggtcacttgtacagtcatcctgctatatatgcctttcgccccccatggagctagctgatagacatgccgtcctagtttgctcgtgtgtacacagctgggagggagctattatatttagtggatcgggtcagggttgaacttgagagactccttccagatgagctcctttatagcttcttcggtgagcgatggctgct

SEQ ID NO: 36105 - DNA, 407 bp, Zea mays
  Clone ID: LIB3060-011-Q1-K1-C7
agttctttggcttggacaggacatttagttcatgttgctattcccggatccaggggggagtacgttcgatggaataatttcttagatgtattaccctatccccaggggttgggtccccttctgactggtcagtggaatctgtatgcccacaatcctgattcgagtactcatttatttggtaccactcaaggagctggtactgccattgctacctcttttggtggactccatccacttacacatagtttgtggctgaccgatattgctcatcatcatgctatctatagcgtctattaaggtcatggccatgatatatctatcgttctaaccttctaatcgtatacagtatgatagttcttttacaaacgcactttctcgctggaatgcaatatttgctttctattaca

SEQ ID NO: 36106 - DNA, 363 bp, Zea mays
  Clone ID: LIB3060-011-Q1-K1-C9
acgctccttcgtccctctatctagctagccttcccgttcctgcatcgcggcggagatgggcaccggcaccacgccgatcgcgtcagcggtggatctgcatctgctgctgctcgcgccgctagccgcggcgagtgacagcatgtccatcgtcatctacggcgagcggagctaggaggatgctctacggatgtactctcagtggatttctgcgcacggtcggacctacaacgctactaatgaagaagagctctattgcgaggagctcatgaacaaaatcgggtacttaaacacttaaaatgcattcgagaacgcggtagtacaaagctaatgataaaacatcaactggtttaatatcttaatttg

SEQ ID NO: 36107 - DNA, 428 bp, Zea mays
  unsure at all n locations
  Clone ID: LIB3060-011-Q1-K1-D10
caaagagttctagatgagattcgctggcgttactacgaggaaaccgttatgatactggatctcgtgccttatcgagcatcgtatcccatcttaaagttggtttattcggcagcagcaaatgctactcattatagggatttcgacaaaacgaatttattcatcactaaagccgaagtcagtaggagtactattatgaaaaaattcagacctcgagctcgaggacgtagttattctataaaaaaaacgatgtgtaatataacaattgtactaaatatagtaaagaaatcaaaataatctttagatcaatctaagatttcgattcccagtaaaaaaaaaagaaatataatagaaaaatatgggacaaaaaataaatccactcggtttcagacttggtacaacccanaatcaccattccttttggttcgcac

SEQ ID NO: 36108 - DNA, 412 bp, Zea mays
  Clone ID: LIB3060-011-Q1-K1-D12
cgccgcctggccgccggggcaccccttcgggggttccttggcgcgccaatccgggccgtggcggcgtcggcgtcggcggcccccgcggcggcggccaagaccatcgcggtcggggaccggctccctgacgcgacgctctcctacttcgacacgtcctcccccgacggcgagctgaagacggtgacggtccgcgacctcaccgcggggaagaaggtggtgctcttcgccgtgcccggcgcgttcacgcccacctgcacccagaagcacctcccggggttcgtggccaaggccggggagctccgcgccaagggcgtcgacaccgtggcctgcgtctccgtcaacgacgccttcgtgatgcgcgcgtggaaggagagtctggggatcggggacgaggtgctgctcctgtcggacg

SEQ ID NO: 36109 - DNA, 374 bp, Zea mays
  Clone ID: LIB3060-011-Q1-K1-D2
gtctcccttttctttttgtagtatagtgagagtgacgcgactagtggtatacaaagggaaatggtgaatggagcgcaaggtagcgattcttctgcttgtgggcgtctatgtttaggataacatggctgcgttgcttgttgcctagaacaccctcaagatcattcccttcaagcttccgtccgttggccctttatatgtcctctttctcatgaaatcaatttttatttgctgtatttattttcacttccttatggatattcgcatttttcacttctattttaatgagccctttgttattcttcactaattctccttcttttttcaagatattagcttcttttttaatcacctttttttatccaaccttttgttct

SEQ ID NO: 36110 - DNA, 442 bp, Zea mays
  unsure at all n locations
  Clone ID: LIB3060-011-Q1-K1-D3
agataacacacacacacacaaaccccaatcccctgcggcggcgatggacccgtcatcggcgggctccggcggcaactccctcccgtccgtcggccccgacgggcagaagcggcgcgtgtgctacttctacgacccggatgtgggcaactactactacgggcagggccatccgatgaagccgcaccgcatccggatgacgcactcgctgctggcgcgctacggcctcctcaaccagatgccaggtgtaccgcccaacccggcccgcgaccgcgacctctgccgcttccacgccgacgactacatcaacttcctgcgctccgtcacgccggaaacgcagcaggaccagatccgnctgctcaagcgcttcaacgtccgcgaggactgccccgtcttcgacggcctctacagcttctgccagacctatgcgggcgcctncgtcggc

SEQ ID NO: 36111 - DNA, 447 bp, Zea mays
  unsure at all n locations
  Clone ID: LIB3060-011-Q1-K1-D4
caccactgctacccaaccctcgcttccccaaaccctagccaagggacacggtggccggcgatggacggcgacggaggaggcgctggtgcgctgcaccaccacacgcgctcacccgaggacgtcttccgcgatttccgcgcgcgccgagccggcatcgtcaaggcgctcaccacggatgtggagaagttctatcagcagtgcgatccagagaaagagaacttgtgcctttatggtttgccaaatgagacttgggaggtcactcttccagctgaggaagtacctcctgagcttccagaaccagcactggggataaactttgcccgtgatggaatggtcgaaaaagactggttgtctctagttgcagttcatagtgatgcatggctcctgtctgttgcattctattttggagctcgttntggatttgacanagatgccaggagaaggctc

SEQ ID NO: 36112 - DNA, 435 bp, Zea mays
  Clone ID: LIB3060-011-Q1-K1-D5
cggcctcaaccgcttcgccgacctcaccaacgacgagtaccgcgccacctacctcggggccaggaccaggccgcagagggagaggaagctcggcgccaggtaccacgccgccgacaacgaggacctgccggagtccgtcgactggagggccaagggcgccgtcgccgaggtcaaggaccagggcagctgcgggagctgttgggctttctcaacaatagcagctgtggaaggcatcaaccagattgttacaggcgacttgatctccttgtctgaacaagagcttgtcgactgtgacacttcgtacaatcaggggtgcaatggaggtctgatggactatgcatttgagttcatcatcaacaatgggcggaatcgacaccgagaaagattacccttacaagggcacggacggacggtgtgatgtcaacaggaaaaacg

SEQ ID NO: 36113 - DNA, 422 bp, Zea mays
  Clone ID: LIB3060-011-Q1-K1-D6
ggaattcgagccacgcgtacgcgtactgggtctcaaccgcttcttctccaaactctagacaagggacacgccagccgggtagtgaccactaccaaggaggcgctggtgcgctagaccaccacacgcgctcacccgaggacgtcttccgacgatttccgcgcgcgccgagccgacatcgtcaaggcgctcaccacggatgtggacaagttctatcagcagtgctatccagataaagagaacttgtgcctttatggattgccaaatgagacttgtgaggtcactcttacagctgaggaagtaccttctgagcttccataaccagcactgtagataaactttgcccgtgatggaatggtcgaataagactggttgtctctagttgcagttcatagtgatgcatggctcctgtctgttgcattcta

SEQ ID NO: 36114 - DNA, 447 bp, Zea mays
  unsure at all n locations
  Clone ID: LIB3060-011-Q1-K1-D8
aaaccagacaagcaaggaatcccccgatggctcatcgcgttctcctcctcctctctctcgcgtcggccgccgcggttgccgccgccgtcgacgcggaggacccgctgatccggcaggtggttcccggtggagatgacaacgatctggagctgaacgcggagtcccacttcctgagcttcgtgcagcggttcggcaagtcctacaaggacgccgacgagcacgcgtaccggctgtccgttttcaaggccaacctgcgccgcgcgcgccggcaccagctgctggacccgtcggcggagcacggcgtcactaagttctccgacctcacgccggcagagttccgccggacctacctcggcctccgcaagtcccggcgcgctctcctcagagaactcggngagtcggcgcacgaggcgcccgtgctccccaccgatggtctccccgacgatt

SEQ ID NO: 36115 - DNA, 440 bp, Zea mays
  unsure at all n locations
  Clone ID: LIB3060-011-Q1-K1-E1
accccgtgcaagaccaagcccctgctcctcctcacctggcgaggctccgatccctccgtccccgccgtgctcctcaactcccacatggactccgtccccgcggagcccgagcactgggcgcaccctccattcgccgcgcaccgcgacccgaccacgggccgcatctacgcgcgcggcgcacaggacgacaagtgcctccccgtccagtacctcgaggcgatccggggcctgcaggccgcggggttcgctcccgcccgcaccatccacatctcgcttgtccccgacgaggagatcggtggcgcggatgggttcgacaagttcgcccgatcggaggagttccgcgccctcaacatcgggtttatgctcgacgaggngcaggcgtcgccgacggacgtgttcagagttttctacgcggacaggctggtgtggaggctcgtcgt

SEQ ID NO: 36116 - DNA, 434 bp, Zea mays
  Clone ID: LIB3060-011-Q1-K1-E11
caggatgtcaagcaagacaaatcaaagtctgtcaatgaaatgtgcccatctctatgaagtaaaatgttctctggctttaagtctctgtagattataccttggcaatgtaggtattcaagtgctgtgaccacttctgcagcatagaacctgaccgcatcctccttcagaaccttcataggttgcctatcaaggagcataaagagttccccaccagcacaatagtcaacaataagacatatatgtgtctttgtctgaaatgatgcatacaatgtcggaaggaatgggtggtccaacatatcaaggatttgtcgttcagcggtagctctatggaccttgtttcggttaagcatgacacttttatccatagctttcatggcaaagtattcacctgtgccaagcaacttcaccaaatggacactgccagtatcaccaga

SEQ ID NO: 36117 - DNA, 390 bp, Zea mays
  Clone ID: LIB3060-011-Q1-K1-E12
ctcgaccacgcgtacgcgctggccaagagcggctcgccaattatgggacccatgagcaaggaggggacgatggtggcctgcacgctgctgcttaccgctggtctttggatcttttgaggcatgctgaatgtggatgccgtttctgcagcaattcttggcctaacaatcctcttaatctcaagggttgtcacatggaaagaatgtttggcagaatctgtggcgtgggatacccttacatggtttgcagcacttatagcaatggctggctaccttaacaaaatcgggctgatctcttgggtcaatgagactgttgtgaaatttgttggaaggcttggcatgtcatggcaactctcattcggtgtgctggtgcttctgtacttttacttgcac

SEQ ID NO: 36118 - DNA, 396 bp, Zea mays
  Clone ID: LIB3060-011-Q1-K1-B2
aaagaagccattgccttcagcttctcctgctgatcagaagaagccatcaccgtcgcctgcttccgatcagaagaaaccagtaccgaaggagcagagagcaaaggcagctggcactcctccaaaaccaaaggccaaagatatgaaggggagtcaagagaaaaagccacaaccacaacagaaagtgcctcctccggttagcgcatgaagcttcctgctgcgaaaatggttactgatcatgtaagatacatcttgtgaagttatctcatgttcaacactcatgcttgtatgtttttgatatttggtttatggtgttatgggacgaggggtgcccaatctagaatgtgcttggtttgagcgattgcgcacgcacaacataattggtgagaattggttttg

SEQ ID NO: 36119 - DNA, 457 bp, Zea mays
  Clone ID: LIB3060-011-Q1-K1-B4
ggtctcaccatctcatctcatcccaccaccaccaccaccaccaccaccaccaccatcggtaggataagatagcaaatatatggccatcatactcgtacgagcagcgtcgccggggctctccgccgccgacagcatcagccaccaggggactctccagtgctccaccctgctcaagacgaagaggccggcggcgcgccggtggatgccctgctcgctccttggcctccacccgtgggaggctggccgtccctcccccgccgtctactccagcctcgccgtcaacccggcgggagaggccgtcgtctcgtccgagcagaaggtctacgacgtcgtgctcaagcaagccgcattgctcaaacgccagctgcgcacgccggtcctcgacgccaggccccaggacatggacatgccacgcaacgggctcaaggaagcctacgaccgctgcggcgagatctgt

SEQ ID NO: 36120 - DNA, 436 bp, Zea mays
  Clone ID: LIB3060-011-Q1-K1-B5
ctccgccacccgacaaactactcaataaccctagctaaacccccacgccgccgcggcgacctcctccgccggcgggatggacagcctcaggggagccaagttgccgggcgtgccgaagggcgggagtgcgctcgtgaaggtggcgctgctcggcggcgcggggctctacgccgtcctcaacagcttctacaacgtcgagggcggacaccgcgccatcgtcttcaaccgcctcgaggggatcaaggacaaggtgtaccccgaaggaactcacctgatgatcccgtggatcgaaaggccgatcatctacgacgtccgcgcccgacccaacctcgtcgagagcacctccggaagccgcgacctccagatggtgagaattggtcttcgtgtccttactcgacccatgccagaccagctacctaaaatctacaggaacttg

SEQ ID NO: 36121 - DNA, 429 bp, Zea mays
  Clone ID: LIB3060-011-Q1-K1-B6
cctgagcaaaggagggaaaattactcatatgatattacttatgtcacaaacagtgagcttggttttgattatctaagagataaccttgcaatgactgtagatgaacttgtcttgaggaacttcaattactgtgtgatagatgaagttgattcaatccttattgatgaagcaagaacacctcttataatatcaggcctagctgaaaagccaagtgatcggtattacaaagcagcaaaaatagctgaagcttttgagcgagacattcattacacggtggatgaaaagcagagaaacgttttacttacagaagaaggttatgctgatgctgaagaaatactggacatagatgatctgtacgatcctcgtgaacagtgggcttcgtatattctaaatgcaatcaaggctaaggagctctttcttaaagatgtc

SEQ ID NO: 36122 - DNA, 438 bp, Zea mays
  Clone ID: LIB3060-011-Q1-K1-B7
gtgagtgaacaccagccgtcttggcccgcttctcccctgctgcggccatggcgacctccgcggcgctctcgaccgccgccaaccccacccagctctgccggtcccgcgctgcgctgggcaagccagtgaaggggcttggcctggggatggggcggtagcgcgcaagccagcggagcatcacgtgccaggcggcgagcagcatccccgccgaccgcgtccccgacatggagaagcggaagctgatgaacctactcctcctgggcgccatatcgctgcccaccgtcggcatggtcgaccactacggcgccttcttcgtccccgccggctccgggaacggcggcagcgggacctacgccaaggacaagctgggcaacgacatcacggtggaggagtggctcaacacgcacggtcccaacgaccgtacgctcgcgcaagggc

SEQ ID NO: 36123 - DNA, 450 bp, Zea mays
  Clone ID: LIB3060-011-Q1-K1-B8
cttaattcatgagttgtagggagggacttatgtcaccacaaacagaaactaaagcaagtgttggatttaaagctggtgttaaggattataaattgacttactacaccccggagtacgaaaccaaggatactgatatcttggcagcattccgagtaactcctcagctcggggttccgcctgaagaagcaggagctgcagtagctgcggaatcttctactggtacatggacaactgtttggactgatggacttaccagtcttgatcgttacaaaggacgatgctatcacatcgagcccgttcctggggacccagatcaatatatctgttatgtagcttatccattagacctatttgaagagggttctgttactaacatgtttacttccattgtgggtaacgtatttggtttcaaagccttacgcgctctacgtttggaggatctacgaattc

SEQ ID NO: 36124 - DNA, 420 bp, Zea mays
  Clone ID: LIB3060-011-Q1-K1-B9
atccatcagctattcagctatcacaaaagaaaaaaaaagggaaagggccgcgacgagccgacgagcaacgacgaccatggcgacgatggccgcttcttcctgccacgggcaacttctcctgtttctcctcgtggccgtcgcgtcggcctgcctcggctccgcggcagcgcatcaagccggatctggagagggctacacgatcgctggccgcgtcaagatcgatggcatgagcgtgaagggctttggtcttgcaacaaagacatcaaacacaaaagtgatacttaatggcggccagagggttacatttgccaggccagacggctactttgcattccacaacgtgccagctggaactcatctgattgaggtctcctcaattggttacttcttttccccagttcgagtagatatcagtgcaag

SEQ ID NO: 36125 - DNA, 453 bp, Zea mays
  Clone ID: LIB3060-011-Q1-K1-C1
cccacgcgtccggaatttccttcttttttttttccttccccaacttctccctgcgtcggccgaggctgcggcgactgaccacagctttcgaccctttccagtggagggaacggggttagcgagcggcctccgctgcgacggcaacggcgtgggagggccatggcggcccccgcgctcgccttccccatgttgctggctgcctcactgctctccgtcgccgctcctgcgctggctcgaagcccatcttgccctgatggttggcaaggcggccctgttcagaacagatgcttcatgtacatatcagcctccctttcttgggatagatccgaggctgtctgccataactacagcgggcatcttgctgcagtatcatcagtccaggagctaaacttcgtgaagtctctctgtggatcatcatccacaggatgctgggttggagggcatcactacagc

SEQ ID NO: 36126 - DNA, 381 bp, Zea mays
  Clone ID: LIB3060-011-Q1-K1-C10
gctggcctatatgaagcttgttccataatcatcttagaacgcgaagaagaagtggaagtccctggggagaatacaacaccacctttggagtctcatgcacggttttgtctctactttagcatctgctgatcttagactaactcatttattaactgatctgtatctactggaagcccattctgaagttgatagattggctactagattttattaaagccaactggactgttgcaactacaattcatagagataaaacactgtatatgcaatttaaaccggtacggatttaagcctaatgaacaggcttagacctttatttttctgttaaaaatgtactactaataacctacatatctacatacaattacacctcttcttttc

SEQ ID NO: 36127 - DNA, 394 bp, Zea mays
  unsure at all n locations
  Clone ID: LIB3060-011-Q1-K1-C12
gtcgtcgcagaacgaggtgctgctccgggagaagctgcccaccagggagctctacctgaacctgcgctcctccgacacctgggtcgccgagtacaggaagtggatggacagggcgggccacggcatgccctactacttcggccacagcaccctgtcgccgccgcccgtgccggccgtcgtggagcaggcgcccgcaggggccgtcgcggggatctcggcctcgttcccggccaagggcggcgtcggcatggtgcacgcgcccaacccgaccaacaggtacttccgccacgtcgtgcactgcaagggttgcagggcaaccgtcaaaaagtacacctcgttgaagaccgtgttcgcggccctcgcggcggcggccctatcggccgncatcctggcg

SEQ ID NO: 36128 - DNA, 448 bp, Zea mays
  Clone ID: LIB3060-011-Q1-K1-C2
cgcagcgttcggaatttacttcttttttggtccttgcccaacttctccctgcctggagcgaggctgcggttactgaccacagctttcgaccctttccagtggagggaacggggttagcgagcggcctccgttgcgacggcaacggcgtgggagggccatggcggcccccgcgctcgccttccccatgttgctggctgcctcactgctctccgtcgccgatcctgcgctggctcgaagcccatcttgccctgatggttggcaaggcggccctgttcagaacagatgcttcatgtacatatcagcctccctttcttgggatagatccgaggctgtctgccataactacagcgggcatcttgctgcagtatcatcagtccaggagctaaacttcgtgaagtctctctgtggatcatcatccacaggatgctgggttggagggcatcactac

SEQ ID NO: 36129 - DNA, 427 bp, Zea mays
  unsure at all n locations
  Clone ID: LIB3060-011-Q1-K1-B12
caaccggtccaacactttcacgctcaggcgctcagctctagcaatggctgcctccaccatggcggtctcctccacggcgatggccggtacccccatcaaggtgggctccttcggcgagggccgcatcaccatgcgcaagaccgtgggcaagcccaaggtggcggcgtccggcagcccctggtacggccccgaccgcgtcaagtacctcggccccttctccggcgagcccccgagctacctcaccggcgagttccccggcgactacggctgggacaccggcgggctgtccgccgaccccgagaccttcgccaagaaccgcgagctggaagtgatccactcccgatgggccatgctcggcgcgctcggctgcgtcttncccgagctgctctcccgcaacggcgtcaagttctgcgaggccgtctggttc

SEQ ID NO: 36130 - DNA, 411 bp, Zea mays
  Clone ID: LIB3060-045-Q1-K1-C8
acgccggcggctgccatcgtaggagggcacaggcatcagcgaacatccctcactctcggggcctgacctgaccacgagagcaacatgggcggaggacacgacatgcacgggcagcactacggccacaacggcggcgtgaagggcttcgtgtccaacctcgtccacggcggcggcggccatggccatggaagcggctacggccatggccatggaaacggctactgccatgggaatggcggctacagcggcagccacgggtaccctactcccgccgccgccggcacgtactctcattcgcacggcgcgtaccctcacccgcacggctgccacgggtaccctcctacagccaactaccccgcgcactcggcgcactacgggcacacggagtcgtaccacaccagccacaacagc

SEQ ID NO: 36131 - DNA, 379 bp, Zea mays
  unsure at all n locations
  Clone ID: LIB3060-045-Q1-K1-D1
gcggcggcggccagcggaggagggcacaggcagcagctaacatccctcactctcggtgcctgacctgaccacgagagcaacatgggcggaggacacgacatgcacgggcagcactacggccacaacggcggcgtgaagggcttcgtgtccaacctcgtccacggcggcggcggccatggccatggaagcggctacggccatggccatggaaacggctacggccatgggaatggcggctacggcggcggccacgggtaccctnctcccgccggcgccggcgcgtaccctcatccgcacggggcgtaccctcacccgcacggcggccacgggtacccttcttccggcacctaccccgcgcactcggcgcactacgggcaca

SEQ ID NO: 36132 - DNA, 270 bp, Zea mays
  Clone ID: LIB3060-045-Q1-K1-D11
acaaatcccatcctctccctcctctactgcacctgcaccacagtagctagctggctgtctttgctacggcggctctgtaatctggtccactagcgctccattcgaccccacccacaaccatgggtggcgtgaccggcgcggccgtctctttggccttcttcttcttcttccctggcggcggcaaaggcaaagggttcgggttcgcgttcccgtcggcttcatgccggcaacttcacattccgcggcggcaccggcggccgcgcgcgcgtg

SEQ ID NO: 36133 - DNA, 373 bp, Zea mays
  Clone ID: LIB3060-045-Q1-K1-D2
cggacgcgtgggcggacgcgtgggcggacgcgtgggcggacgcgtgggcagcgactgagcgagcgagagcagcacacacgcagctagctaggagcagcagcagagcagcggcgatggcggcctccatgatctcctcgtcagctctggcggtggcgcctcagggcctgccgcccctcggccgccgcgcctcctccttcgccgtcgtctgctccaagaagaagatcaagaccgacaagccctacgggattgggggtggcctgaccgtcgacgtcgacaccaacgggagaaagggcaagggcaagggcgtgtaccaagttcgcgacaagtacagcgcgaacgtctaccgatacaggccaatctacaacgaggatga

SEQ ID NO: 36134 - DNA, 402 bp, Zea mays
  Clone ID: LIB3060-045-Q1-K1-D3
cctggaaccaggatagggacagagacggagccacggtcgcacagagcagtcttagcgccgggcacggccaccgggagtagctctggccatgaggacctcaacggctacctgtgctatcctccctccgcctacctgctcctcccgtagtttaccgctccgcagcttcatcggtctccggtggtccgccccccgtttccaggttagggagcgagctggtgcgtccgtagcggttgtcaatggcaagccgggatgcagcttcagactcggagtacctactttaaatgtttgtcaatctcgccaaaggtctgttgtcattagaaatgaacatgctcaaaatgctgaccttccacgaaaatattcaaaaagagagaagaaaccatttcctatcccagtgctggagtt

SEQ ID NO: 36135 - DNA, 392 bp, Zea mays
  Clone ID: LIB3060-045-Q1-K1-D5
ggctcctgccttcctgcctcggcgcatcgactcgcggagagggacagcacagcgccggctccccatcctttctccattcccagatcgaaggtccataaaaaaccatccttttgcatctgattgagcactgtctttgtgcaagagaacaatttagttgtacatacaaacaaaaagaagtgggagtatttttcagagtttattagaagagactgtttcgaggacccaggtcagagaaaggcgagaagctttagcagcggcaatggtctggtcaatggacccgcaggtgaccgtccacggcgactgggtgtcagccgtggtgccgctgatgaagctgctgtgcctggcggtgatcggcctgctcctcgccaacccgcgggtccaggtcgtgccca

SEQ ID NO: 36136 - DNA, 293 bp, Zea mays
  Clone ID: LIB3060-045-Q1-K1-D9
ccaaaaacagcccacagctgaagcgagaacacgaatgctcagtgatatttctgtcgaggtctgcacactcgtctactaccgagaccgtcggcggccatcgtcgcacacgctgtgctcatgctaagtgtcgaggctcacacgtactactactacccgaccgcgaggccgagaccgaagctatgcgcctgcaaaaacgtcttgcacgaaacccgcccgcgtgacacagaggcaaatccctgtcgtcacggcgagaggaagagcacgagaaagggcgacagtgcttattacatcga

SEQ ID NO: 36137 - DNA, 400 bp, Zea mays
  unsure at all n locations
  Clone ID: LIB3060-045-Q1-K1-E10
gcctgggttttagggcccttccttaaccgcccggcggccttgaacctgaaggtattgcccaagcccaaacagcggttgctgaaggcccatcagagggaggaggccatggagatgagcgacctggacctgtggaagcacgagaagccgccaaggatctgccccttgcccccgtcgctcccgccgncgncgtcagcgttcgacgaagcggcgctcgtgccgtcgctcaacttcgccgtggtcgacgacggcatcttccgctccggattcccagggaccgtcaacttccggttcctcaagtccctcaaccttcgctccatcgtgtacctgtgcccggagccgtacccggngacgaacacggagttcctagaaaagaatgggatcaggctcccaccagttcgga

SEQ ID NO: 36138 - DNA, 137 bp, Zea mays
  Clone ID: LIB3060-045-Q1-K1-E12
tcaaaatgcaccagggacagcgaagcgacctcctttcgaccggcgatcggtcgcagcgccgatgcccccgcacgccaaagccgccggcgtcatacgctccgactccggcgcgggacggcgccagcattgctcgccgc

SEQ ID NO: 36139 - DNA, 429 bp, Zea mays
  Clone ID: LIB3060-045-Q1-K1-E2
ctcgtcacttcgctaccagctcgtttccatccacgcggatttgattgctcctgttcgttcctttgcgatcttgctctgctctgctctgctcccgggctctgctgattgctggtacttcttgtggaagaaccccgctttggaaagaaccatgctgtatgtccctgtccaccaaactgaccaccagcttccgtatcggtatgcatcttcagtgcttctctgcagaagaaacaacaactccggtccagagtcttatattgcgctgccttcagatgtacatggaccagaaagaagtggtcgatgccctctgccaccactcgaagatagagccctgcattactgaacttgcttggcgacaacttgagcatcaaaatcctctgtttttcaaggcgtactatatgagactaatgcttaagaatcaaataatggtct

SEQ ID NO: 36140 - DNA, 407 bp, Zea mays
  unsure at all n locations
  Clone ID: LIB3060-045-Q1-K1-E4
gcggagcagggcatcgtgccggggatcaaggtggacaagggccttgtcccgctcgccggctccaacaacgagtcgtggtgccagggcctggacggcctggcgtcccgcgaggccgcctactaccagcagggcgcgcggttcgccaagtggcgcaccgtcgtcagcatccctaacggcccctccgagctcgccgtcaaggaggccgcgtgggggctcgcacgctacgccgccatctcacaggacaacgggcttgtgccgatcgtggagccggagatcctgctggacggcgagcacggcatcgagcgcacgttcgaggtggcgcataaggtgtgggccgaaaccttctacgccatggcggagaacaacgtcatgttcgagggcatnctgctgaagccgttcatggtgac

SEQ ID NO: 36141 - DNA, 415 bp, Zea mays
  Clone ID: LIB3060-045-Q1-K1-E5
aggttcttgaggttcatgttgagaaggggatgcaacacaaccagaagatcaccttcggtggtgaagctgatgaagcgcctgatactgtcactggagacattgtattcgtcctccagcagaaggatcactccaaattcaaaagaaagggtgaagatctcttctatgagcacaccttgtctctgaccgaagcactatgtgggttccaatttgttcttacacatctggacaacaggcagcttctcatcaaatcagaccctggtgaagttgttaaacctgaccaattcaaggcgattaatgatgaggggatgccaatttaccagaggcctttcatgaaggggaagctgtacatccatttcacggtggagttccctgactcgttggcaccagagcagtgcaaggctctcgagacagtact

SEQ ID NO: 36142 - DNA, 417 bp, Zea mays
  unsure at all n locations
  Clone ID: LIB3060-045-Q1-K1-C6
ggcgtcgtggtcgtcgccctcagccgccgcctcgggcgcccgattcggccccttccggagcggagggcagcggctcgcgccgtgtccgtcgctcgtccgcggaactcccgccccgacgctcgtcctcaggccccacccggacggccgtggccatggcctcctcgcgcacaccggcccctctccctcctcgcggtgccgcgccgtcgccgccgaggtcgggggcctcaacatcgccaacgacgtcacccagctcatcggcaacacaccaatggtgtatctcaacaacgtcgtcaagggatctgtcgccaatgtcgctgctaagctcgagattatggagccctgctgtagcgtgaaggacaggatagggtacagtatgataaatgatgctgaacagaagggctngattactcctggaaa

SEQ ID NO: 36143 - DNA, 407 bp, Zea mays
  Clone ID: LIB3060-045-Q1-K1-B11
ggttccctttcctcgagtttcctattttcgtctcctccccacagcagcccggcgaagaccctagtaagcaaaccaccggagcagcggcgcttgcgcgggcggagccatggcggacgacgattacaacaaaaattgacatggggtatgaggatgagcccccagaaccggagattgaggaaggagctgaagaagagcctgagaacaacgaagatgcccctgatgacgtcataggtggtgagggtgaagataaggaacaggaaaagaccaagcgtgaacgcaaaacaacaaaatacatgacgaagtacgaacgtgcgcgcatcctgggtacacgagccttgcagataagcatgaatgctccagtcatggttgagcttgagggtgaaactgaccctactgagattgcaatg

SEQ ID NO: 36144 - DNA, 395 bp, Zea mays
  Clone ID: LIB3060-045-Q1-K1-B12
gctagccgccggtctcttgctctgatagcttgctccaggacgtacgtacgtacgtagatcgagccatcgatcgctagctagctgacgaccatggcgtccctctcctctgccgccatcaccgccccttccttcacggccgcgcccgctcgcgcagtggtcagcaggaggtccttcaccgtgcgtgcctctctccgcaaggccactgccaccgccgccgtggccgttgccgccagcgtcctgcttgccggcggcggcgccatggcccaggaggtgctgctgggcgcaggcgacggcgggctcgtcttcgagcccagccagttcaccgtcaaggccggcgacaccatcaccttcaagaacaacgccggcttcccgcacaacgtcgtgttcgacgaaga

SEQ ID NO: 36145 - DNA, 444 bp, Zea mays
  Clone ID: LIB3060-045-Q1-K1-B3
tccggattccggtcgcgccagcgtccgctcctcaagactcgttgcttctcccccagctcggaggagctcctcgcatcggagcagccgccgatcaacctgcgctcgggctcagcgctggaaggtgttggaagagaatagcctgaaggttcacagtaaccttcatctgttggaagatgtatcgggctaagagggctgcattgtcaccgaaggtgaagcgccgcgtcggcaagtacgagctcgggcgcaccattggggaagggacctttgccaaggtccggtttgctaagaacaccgaaaacggggaacctgttgctatcaaaatccttgacaaggagaaggttaagaggcacagattggttgagcagattaagcgtgaaatttgcatcatgaaattagtaaggcaccctattgtagatcgactgtttgaggtgatgggaaagtaaa

SEQ ID NO: 36146 - DNA, 340 bp, Zea mays
  Clone ID: LIB3060-045-Q1-K1-B4
atcgtatctgcggaacaagcagcgaaggatcggagcctatccaatggccgagggcaacagcagctccggcggcgacctgttctccagcggcaagctggtggcgggggccgccgtgtcggtgttccagcagaagagcgtggagaacgtcgacaagcaggaggtcgccggcgcggcggccgagctcctgcacgcggcgtccgcgtacggtaagctcgacgacaagccggccgggcagtacgtcgagaaggccgaggggtacttgaaggagttcagcgcgggcgcgggacacgccaccgagcaggagcagcctgcggcggcagcaggcgacgacgcggcgccc

SEQ ID NO: 36147 - DNA, 389 bp, Zea mays
  Clone ID: LIB3060-045-Q1-K1-B5
cacgcgtccgggtagccgccggtctcttgctctgatagcttgctccaggacgtacgtacgtgcgtagatcgatccatcgggcgctagctagctgacgaccatggcgtccctctactctgccgccatcaccgccccttccttcacggccgagcccgctcgcgcagtggtcaccaggaggtccttcaccgtgcgtgcctctctccgcaaggccactgccaccgccgacgtggccgttgccgccagcgtcctgcttgccagcggcggcgccatggcccaggacgtgctgctgggcgcatgcgacggcgggctcgtcttcgagcccaaccagttcaccgtcaaggccggcgacaccatcaccttcaagaacaacgccggcttcccgcacaacg

SEQ ID NO: 36148 - DNA, 396 bp, Zea mays
  Clone ID: LIB3060-045-Q1-K1-B8
cgctgctgcgctgcacgaataatcaattccgagtgaaataaattacatatagccatgtagaagagagtcctttctaggtgagtaggtgtcctcttacgcgtgggtgagagaacccactaggagccacagccacctcacagtctgttctcctgttggatcgggaggagcagagccgacgcgacgggatcaagatttgtatttgaacccggacgacgggaggagtacgaggcccagtcatggaggaggagaagcaagtgatggagggtgccgctacggcggcgaggcggcggctggtgatcggggtggggttctgggtgcagggcttccggctcttcccgtggctgggcgtcaatttcttcctcagggacggcatgggcgttgctgcctcctcgctgc

SEQ ID NO: 36149 - DNA, 405 bp, Zea mays
  Clone ID: LIB3060-045-Q1-K1-B9
cgttgctgtcatagtctgctggatcaaggagggagattcaaagttgtttttccttgcaacaatctatgctttgcttggaattcctctgtcatatttgatatggtacaggccactctaccgtgcaatgaggactaacagtgctttcagttttggatggtttttcctgtgttacctgatccacattggtttttgcataattgctgccattgctccaccaattgtatttcatgggaaatcattaactggtattctggctgcgattgacactttctctgaacatgtgataattgggatcttttactttgtggggtttgcactgttttgtctggagacactgctgagcattggggttcttcagaaagtgtacatgtacttcagagggaacaagtgaagccagtcatgatg

SEQ ID NO: 36150 - DNA, 393 bp, Zea mays
  Clone ID: LIB3060-045-Q1-K1-C1
gagcagcgagccatcgacacgatcgcgagcgcaagcacgtacgttgtcggaagctcaggttagaagaagcaccagtgcctgatcgatggcggcccaggctctcctctccggccggcagctgctgggccgccccgtgcagtcggccgtctctaggtcgtcggcgaggaaggcgcccttcgtcgtcagggccagctccagccctccagccaagcaaggtgccgacaggcagctgtggttcgcgtccaagcagtccctctcctacctcgatggcacgctgcccggcgactatggcttcgacccgctgggcctctcggacccggagggcaccgggggcttcatcgagcccaagtggctggcctatggcgaggtgatcaacggccgctacgccatgct

SEQ ID NO: 36151 - DNA, 401 bp, Zea mays
  Clone ID: LIB3060-045-Q1-K1-C2
caagcacttcgacgtcgcacgggcgctgcacacagacacaccaagcgtcggcaccaggggcttactaccaggaggtggactactgctcggaggaggtgaggtcggtggccccggccggcttcggccgccacggaggcggcgtccagcagcacgtcgtcaaggagaagttcgaggaggtcgacacggtctcacgcgccggcgccaaccaccaccaccaccaccatggtcaccacggcggccacggcttcgtggtgcgcgagaccagggtcgaggaggacatcaacacctgcaccggcgaggtccacgagcgcagggagagcttcctcgccagggctaactgagccgcccggcggccggcatccacgcccgttcgtgcctgcctgcgtgccttatgtatgtct

SEQ ID NO: 36152 - DNA, 376 bp, Zea mays
  unsure at all n locations
  Clone ID: LIB3060-045-Q1-K1-C3
tgccaactgtggggcctaaccgccacccgttcttggaaagcagcgcgctacttacttgaaagtaaagggagatacttgccgcgttgggattctccaactccaaccaagacgaacgatttcatcccactaatcctttttcttttcttttcgtttttatttttaatttcttggttcggttcttgatcacctgttcttccttatgaccttatccaggaaattagattatcaggtgcttctatttgtttgtgcatctcttgtttgcgcctgcgatctggaccttttttggctcctcaacaaaagagaagatgagnccttctngttggtagttacaaccggtggcgtctctggttgtgcaggtgcattttgtgtgaggatc

SEQ ID NO: 36153 - DNA, 436 bp, Zea mays
  Clone ID: LIB3060-045-Q1-K1-C4
catatcctcactcgccgccgccgccgctcgtccctcgccccatcgcgatggcccgggtcaaggtgcacgagctgcgggggaagagcaaggcggatctgcaagcgcagcttaaggagtttaagtcggagctctccctgctacgcgtagccaaggtcaccggcggggctcccaacaagctctccaagatcaaggttgtgcgcacctccatcgcgcgcgtgctgaccgtcatctcgcagaagcagaagtcggcgctgcgtgaggcgtacaagaagaagaagctgctcccgctcgacctccgccccaagaagacccgcgccatccgcaggcgcctcaccaagcaccagctctccttgaagaccgagagggaaaagaagcgtgagaagtatttccccatgaggaagtacgctatcaaggcctagatcagtgaaagaacatt

SEQ ID NO: 36154 - DNA, 284 bp, Zea mays
  Clone ID: LIB3060-045-Q1-K1-C5
cgaccttcaagtctcgctacgtagcagtgcaataaaaaaagcagccgcaatggcgagcagcaccatggccctctcctccacggccttcgccggcaaggccgtgaacgtgccgtcgtcgtccgccttcggcgaggcctgcgtgacgattcgcaagacttcggctaaggccatgccggccgcagcattcttcactatttaccgtgttttccttgtttattgtataagatcggagcttgtcgtcatcgctttcccgaacgcacttgatgctgttactgtctgttatc

SEQ ID NO: 36155 - DNA, 431 bp, Zea mays
  Clone ID: LIB3060-044-Q1-K1-H3
gtcatatgttgggagcgacaattgtggtagcgtggttggaggacggggaaggggctgatggctgtagactggtgagggtatgtcagtgttaagggccccttggtggcgcctccctctcctagttggcgacgaacagtttgccacttcttccacaagctcgaggacggtcaatgaccttgctgtctcctccttgaggaaggcacgtcgagcttgatctatggcgtgcttggtctccacttcgagctgcttggtgacagcctcacattccagcttttccttggctgcggtggcgatctcgtttttggaccctccttgcttcatgttgcccaggcagacgtcgaccttggcaaggtgctcttgcaccttgtccatgtgcttggtgagatcagcagcgagggtctcgagccactccatttctgtggacatggtgg

SEQ ID NO: 36156 - DNA, 101 bp, Zea mays
  Clone ID: LIB3060-044-Q1-K1-H4
acatatacatacaactctatgcttgaagcatctgcctctgcccaacagtgggaatacttctaatatctgtatagagaaatcgctctgtctcatcactatct

SEQ ID NO: 36157 - DNA, 417 bp, Zea mays
  Clone ID: LIB3060-044-Q1-K1-H5
ccctctcctccctccgcgcctccctcccttcccccacccgatttcacacgtctgtcgcgctccgagccctctccccacgtgctcgtctctctgccgccctccctttcgcctccccactcgtttcaggcgggtacgggacctgggcggcgacttcaatctcgtccgcgggaaggttgagacggcgggggctggaggtggtgtgcgaggccacgaccgggcggcggccggactcggttaagaagagggagcgccagaacgacaagcaccgcatccgcaatcacgcgcgcaaggccgagatgcgcactaggatgaaaaaggtcttaagagctcttgaaaagcttaggaagaaacctgacgcgcagcctgaagaaataattgagatagagaagctgatcgctgaggcatacaaagccatcg

SEQ ID NO: 36158 - DNA, 406 bp, Zea mays
  unsure at all n locations
  Clone ID: LIB3060-044-Q1-K1-H6
agtttatggacattgtgatatgtttgggaaggcaaaggacttgtttgaaacgaccgggcttgtttcttaaattctcagacatatatccacgagcattcgtcattcaaagcagacacatatacatacaactctatgcttgaagcatctgcctctgcccaacagtgggaatacttcgaatatgtgtatagagagatggctctgtctcatcactgtctagatcaaagcanatattcatggttgctcatcaaggcatgcagagctgganagccatatttgctggagcatgcacttgactcgatactngaaagaggagagatccctgatgtacagttgattactgaatcgatatgccagtctattgctcatagagattatggaaggacgctgcagctcttgaatataatga

SEQ ID NO: 36159 - DNA, 439 bp, Zea mays
  unsure at all n locations
  Clone ID: LIB3060-044-Q1-K1-H7
caagtttaggagtgacagcaacaagagatctcgatggcctctgccaccgtgctgaaggcctccttccttcccaagaagtccgaatggggcgccaccaggcaggccgccgcgcccaggccgcccaccgtctccatggtcgtccgcgcctccgcctacgccgatgagctcgtgaagaccgcgaaaacgatcgcgtcgccggggcggggcatcctggcgatggacgagtcgaacgcgacgtgcgggaagcggctggcgtccatcgggctggagaacacggaggccaaccggcaggcgtaccgcacgctgctggtcacggcgccgggcctgggccagtacatctccggcgccatccttttcgaggagacgctgtaccagtccgncgtcgacggccgcaagatcgtggacatcctggtggagcagggcatcgtgccggggatca

SEQ ID NO: 36160 - DNA, 156 bp, Zea mays
  Clone ID: LIB3060-044-Q1-K1-H8
aaacctggtattacatttggccaagaaagaaagaatgagcaaaatgttgcagagggagaattttgaaaaagaaaaaaaaaagaaaaaagcttgactggatataccagaacacaaggtagtatgttccagctgggaataaaaaaagcagccgcaatg

SEQ ID NO: 36161 - DNA, 398 bp, Zea mays
  Clone ID: LIB3060-045-Q1-K1-A11
gcgcaccggcgccgccgcatgcctcgtcgcctacttggcgttcccggcgctctgcgacaagggcctcctcccaccgacatccaaagacaagtcccagctggacataccgctagacgggctcacaccactacgcctaagagacatggtgttctcgcccactactacacatgcgaacatgacagagtgcctaaaatgcctggtcgacgcaacgaggagttgttccggcgtcatattcaacaccttccgagacctggaggactccgacctccagaggatcgccaatggcgtcgtcggagtgccgatctatcctgtcggccccctccacaagatctctccatgcaccgaggacagcttactggcgccggaccgggcgtgtctagagtggctggacaagcaag

SEQ ID NO: 36162 - DNA, 375 bp, Zea mays
  Clone ID: LIB3060-045-Q1-K1-A2
gagacatggcgccccaccagcagcagcgggcgctgctcctgttcccactcgggttggtcctcctcctccttgccccgcccctcgccggcgcgtggggaaaggagggccacatcatggtctgcaagatcgccgagaagtacctgtcggagaaggcggcggcggcggtgcatgcgctgctgccggagtcggcgggcggcgagctgtcgactgtgtgcccgtgggcggaccaggtgcgctggcactaccactgggccagcccgctccactacgccaacacccgtcaagtctgcaacttcaagtattctcgggactgccacaattctcgtggccagcaagggatgtgcgtcgtcggggctatcaacaactacacggacc

SEQ ID NO: 36163 - DNA, 421 bp, Zea mays
  Clone ID: LIB3060-045-Q1-K1-A3
taccggtctcggagattccggggtaggcgtacgcgcaccatcgaccttcaagtctcgctacgtagcagtgcaataaaaaaagcagccgcagtggcgagcagcaccatggccctctcctccacggccttcgccggcaaggccgtgaacgtgccgtcgtcgtccgccttcggcgaggcccgcgtgacgatgcgcaagacggcggcgaaggccaagccagcggcggcgtccgggagcccgtggtacggccccgaccgcgtgctgtacctgggcccactgtccggcgagccaccgagctacctgacgggcgagttcccgggcgactacggctgggacaccgcggggctgtcggcggacccggagacgttcgccaagaaccgggagctggaggtgatccactcccgctgggccatgctgggcgcgc

SEQ ID NO: 36164 - DNA, 346 bp, Zea mays
  unsure at all n locations
  Clone ID: LIB3060-045-Q1-K1-A4
cacccccttccggcacacgggctcgaccacctgactccatcaccgtgcctgtctgtgttctagggacaagaagagcagagatatacaggagcgagcagaggcggggagaagaggatgagcaccacaacggcgtcgtcgctgaaccccaacgcgccgctcttcatcccggcggcgtaccggcaggtggaggacttctcgcccgagtggtgggagctcgtcaacaccaccgcctggttccgggaccactgcttccggcagcgccagctccacgaggccgnctgcgacgacgtcgccgcgctccttcccgacgacctcctcgacaccaacgacctcttctacgcgcccg

SEQ ID NO: 36165 - DNA, 426 bp, Zea mays
  Clone ID: LIB3060-010-Q1-K1-H7
caccgtcaacacggaggagttctccaccgactacgaggtcatcgtgcctccgcacaccgtcatcacggtgcgcatcctggccacgcagggcacctgccaggtccccttctcctacacgcaggaggatattttgactaccggggagaagaaggtcaccaagtatgacgatggcatcttccgtggagtcaacagctttggtttcaagtccgaggtcaccgagaggaagatcaatggcgaatgagacgatgcaccacatgtcatatctatggatcggagacactgtgccaaagtctgcttatctatctatatctgcatcaataattcagccacgtacgctaccatctgcatatatgtcagtataggtggcgcatgtattgcttttaataattggtgtcatctaagccatgcaagcatgtgtgctttata

SEQ ID NO: 36166 - DNA, 435 bp, Zea mays
  Clone ID: LIB3060-010-Q1-K1-H8
cacaatcctaaggatggaaatacttaaatcgagacttgggctaggaacaggtgatgctccgcccgggtcaattaaggattggatgcgtatgtaggcctgttgatcaaggactatcttatctagccacatgccctgagaatgggacagggtaagcttgaacccggctattccatacatgaaaagacaatcgcgcactgggcgtggagagatggcgagagtggcacgtaccctcctggcaacggatcgcctaaaagggttggtgtactctcgggtggcgcggacctgttcatgcagtggaggatccgtgggaatagtagacatcaaggtttacgagaaacatatgtcgtgtggttagagatccttagctgagtaaatcgattcggatcgccgttatatccccggacagtggagacttgagctccgacctacaaccta

SEQ ID NO: 36167 - DNA, 428 bp, Zea mays
  Clone ID: LIB3060-010-Q1-K1-H9
atgaaattatcttccgttcaccagtgaggcatgcttatatatttgagcaacttcatcaggagaaatcaagcactccagcattatcctccacttgcagtagtatccagcaggggcagtgctcacatttcaaagatattcagggtcatttatcatctaaagggcacaaagtcccaaccatttactttggaagaggtcggtcttcattgttgcctagtggttcatcagcagatccactcctgcttaatttatgtaaaacgatggagggccagagccagcatagctccgaagataatatatcatctggtcggtttcagctaataaaggaggatttgataaatgcaacggttgacgcgagtgacatttttgagtcatttgatagttgcccatattatctaagtgatcataccaaatgtgccctcatgtcatca

SEQ ID NO: 36168 - DNA, 445 bp, Zea mays
  Clone ID: LIB3060-011-Q1-K1-A1
atcgagtgtggagatgctacagatgccaactttgagaaatacaatctcagtagaggctgcgtagctggcattcttacacttgatacagtggcagactatcttccgagaaggggacccctgaagcagagaaggacaggtattgcgtatatagcaaacgtcgcggtgcggaaggaggagcgacggaaagggatcgcgaagatgttggtccaagaagcagaggctcgggcaaggagctggggatgccggtcgatggcactgcactgcgacgtaaacaacgtggccgcgctacgcctgtacagaaaccaaggcttcaagtgcatacgagtgccggaaggagctaaatggcccgaacccaagatagctaaaggagcggagtacaacttcatgatgaagctagtgcccaaggcttgagtcttgaaccttataagatctgactagggaaaaa

SEQ ID NO: 36169 - DNA, 408 bp, Zea mays
  Clone ID: LIB3060-011-Q1-K1-A11
ctggcgcggaggacgcaccagctggacggccatcgggatccggcggatgtccagctggcgcggaggacgcaccgtacgatcgtcgtcaacatcgtcttctcggtgatcaccaagcttgcgatcgtcgggctcgcgctcgccgggcatccgctcatctgggcagccgtcctcgcggacgtctgcacatgcatgctggtgatcatgtacagcatgctgctgctgagatcggactcgaacgggcgccggaaggtgaagaagtgctgtgcctcgtcgcaacatgggtcacactcacacgccaggaagaagcattgtgtctcccaccactgttcagatggcccgtgcaacaagttgacggcaggctgtttccaggaatcgccgactgctggtaagcatgccttgcatgatcat

SEQ ID NO: 36170 - DNA, 427 bp, Zea mays
  Clone ID: LIB3060-011-Q1-K1-A12
ggcgccatacgcaaatgccctgaagaaactcgagaaagatatcaaggacaaacaagcaagcgtgaacgagaagattggcgtcaaggaatccgacacgggtctcgcgcctccccatctttgggatgttgccgccgaccggcaacgaatggccgaagaacagccgctccaagtggctcgttgcacaaagattattcaggatgagaaagattccgacaagagcaaatatgtgatcaacgtgaaacagatcgccaagttcgtagtgaacctgggagagcgcgtcagcccaacggatatcgaagaaggcatgcgagttggtgtcgaccggaacaagtaccaaattatgctaccactcccgcccaaaatcgatcccagtgttacgatgatgacggtcgaggacaagcccgatgtcacttatggtgacgtgggt

SEQ ID NO: 36171 - DNA, 439 bp, Zea mays
  unsure at all n locations
  Clone ID: LIB3060-011-Q1-K1-A2
gccaccatcgaccttcaagtctcgctacgtagcagtgcaataaaaaaagcagccgcaatggcgagcagcaccatggccctctcctccacggccttcgccggcaaggccgtgaacgtgccgtcgtcgtccgccttcggcgaggcccgcgtgacgatgcgcaagacggcggggaaggccaagccggcggcggcgtccgggagcccgtggtacggccccgaccgcgtgctgtacctgggcccactgtccggcgaggccgncgagctacctgacgggcgagttcccgggcgactacggctgggacaccgcggngctgtcggcggacccggagacgttcgccaagaaccgggagctggaggtgatccactcccgctgggccatgctgggcgcgctcggctgcgtcttcccggagctgctcgcccgcaacggcgtcaagttcggc

SEQ ID NO: 36172 - DNA, 386 bp, Zea mays
  Clone ID: LIB3060-011-Q1-K1-A3
aaaaaaaaaaaaaataaaaaaaaaatttaaaaattaaacaataaaaaaaaaaaacaaaggaaaagagcaaaaccataaaaataatactccacagccttcaccgtctaggacattaacgttccgtcaacgtaaccctttagctattccctcttgaccatgcacaacacagctcatgaacgccaagccggccttacaatccggtaacccgtgatacgttccccacctcaagctgtacctgggcccactgtctttcgagcttggcgagctacctgacaaacgacttcccggacgactactgctaatacacccacatgctgaatgtcgacccggagacgttctccaataaccaatagcttgaagtgatccactctcgatgggtcatgctg

SEQ ID NO: 36173 - DNA, 447 bp, Zea mays
  Clone ID: LIB3060-011-Q1-K1-A4
acgcgccacgcgtacgcaaagagctaccctgaccagatttggccgcttcctcctctgcctcccgctagccctaggccagccccccgagatctgctccgcgcgagcagccatggcggagacgctcgacatgaccctcgatgacatcatcaagaacaacaggacgagtaacccctcctccggcggggcccgacgcagccgccgcggattcgcccctggcggcggcagccgcggagtcgggccgaccaggcgctccttcaagagggctgggaacaggcatgcgccctaccagcccgcgaaggcccctgacgctgcgtggcagcacgacatgtaccctgcggtcgccgcaagaagccggcggcggccggagggtctcggcgctcgagacgggcaccaagctctacatcttccaccttggaacttggggtttcgaacgacgatatcaaggag

SEQ ID NO: 36174 - DNA, 453 bp, Zea mays
  unsure at all n locations
  Clone ID: LIB3060-011-Q1-K1-A6
caaagagctaccctgaccagatttggccgcttcctcctctgcctcccgctagccctaggccagccccccgagatctgctccgcgcgagcagccatggcggagacgctcgacatgaccctcgatgacatcatcaagaacaacaagaagagtaacccctcctccggcggggcccgccgcagccgcggcggatccgcccctggcggcggcagcggcggggtcgggccgaccaggcgctccttcaagagggctgggaacaggcaggcgccctaccagccgncgaaggcccctgacgctgcgtggcagcacgacatgtaccctgcggtcgccgcaggaggcggcggcggcgggagggtctcggcgctcgagacgggcaccaagctctacatctccaacctggactntggggtttcgaacgacgatatcaaggagctggtctctgagctaggtgatctg

SEQ ID NO: 36175 - DNA, 289 bp, Zea mays
  Clone ID: LIB3060-011-Q1-K1-A7
aaaaaaaaaatttaaaaaaatataaccaaaaaccgagaactagatgaacctacgcaagactggttgtactcgccgaagtatccctaacagtcaccgcatgagcgtccaactcatgattaacagactcaaacccaatccgccctgttaccgaccgcgcggcctcagagctcgagtacacggtcttcgccgcgctagggcgcacccgcgacgcactacgctatgcacgcttaggtctgagatacggcaagagctataacagcccggaaaaggtccacacgctgctcaggat

SEQ ID NO: 36176 - DNA, 452 bp, Zea mays
  Clone ID: LIB3060-011-Q1-K1-A8
gtcgttgagccttaaccagctcaccaccatgtttgatctcagcgagcagcatgcccagagtattgttagcaaaatgatgatgcatgaagagcttcaggctagctggcaccagccaacaaagtgcaccgtgtttcacagcctggatcaaaccaggcttcaggagctactcttccaggttgcagaaaaaatatcggtcctggtggagacaaacgagagggcatacgagttaagaactggtggtactcttgaagggctaccgtccaggcgcatgggcgaggctcaggattcatccaagtggcaggagagctttgtcgcatcacaggggcggcagggtggtggcaaccggtttggatactccggtagaagtgcagcatctggtcaaagtggtggactccagaggggcaagggcaatcatgtttcccgcggtggatacggtggcaatacacgatttt

SEQ ID NO: 36177 - DNA, 429 bp, Zea mays
  unsure at all n locations
  Clone ID: LIB3060-011-Q1-K1-B1
ggccattcttctcgccttactccctcacagaacccagtaaaatattgccagtcccgccgtcgagatggccccacgccgcctgctcgtcctcgccgtcgtcgccctcgcggccaccgccgccgcggccaactccggcttcgcggactcgaacccgatccgccccgtcaccgaccgcgcggcctccgcgctcgagtccacggtcttcgccgcgctcggccgcacccgcgacgcgctccgcttcgcacgcttcgctgtgaggtacggcaagagctacgagagcgcggcggaggtccacaagcggttcaggatcttctccgagagtctccagctcgtccgctccaccaatcggaaaggcctctcctaccgncctcgcatcaaccgcttcgcggacatgagctgggaggagttccgtgcgacccggctcggcgc

SEQ ID NO: 36178 - DNA, 422 bp, Zea mays
  unsure at all n locations
  Clone ID: LIB3060-011-Q1-K1-B10
ggcagaagaaaaaaagagatctacaaggagtcctaaagggtcccctgcaaccaaaggtgctgctgctaagaagcagcgagcaagtccaatggcaaaacagccagcagggatcaagaaggttagcggaactcggggaaagaaaaaaccaaaggtgggagaagatgaaatcgaagagctctcaagttcctcccaggataacgacgcagatgatgatagtgacgaggactgggccgaataatgcgatggtacagacgacggataggttgggccgttggggaagcatatgcataattgatgtgcggctgaagagaaggatggattgggggatggcacagaaactgcctgttttcatggactggtttggctggtcatgtctgacgacggatctagaatatggaatatcctgatctgntgtcaagctg

SEQ ID NO: 36179 - DNA, 396 bp, Zea mays
  Clone ID: LIB3060-011-Q1-K1-B11
ctcattgccattgtgtaatcctcatcctccgtcgagatcaaggaagaaagaaagcaaccatggcggcaaccggaatgtccccctccccctcggccgcaataactcgccacatccatgctcgtcgttcctgtgctgctgcttccttgtccctccgccgctcgggcttcctggggcgcgtcgtgctggccgcggtgccagtggccgtggacgccacccggcgccgccgcgtctccgtgtcggtgcggatggcctgggacggtccgctctcgtcggtgcgcctcatcatgcagagcaggaacgcgaagctgagcgagaagctcaaggagcacatcgaggacaaagtgggtcgggcggtgtccaagcactgccacctggtccgggaggtggacgtgcgcc

SEQ ID NO: 36180 - DNA, 298 bp, Zea mays
  Clone ID: LIB3060-010-Q1-K1-H4
gcgtttacaaggagttcctggtggcgacaattaggatgagcaaaacctcaaggcattgggttgccacccgcgaagcgaagagaggatgccagcggctatcgcactgtatcaggcagtgtcttgcctgtgtagttttgtactgaagttgtgaacgattagcttcattgtgtctgtttaaaccaccgtcactttaattcatcgcgttcggctgcacgtggtcgttgatgacgacacgatcagaaaccgttgatgacaacatgatcagaagttgtgaaaaaaaaactgtcatgcaatggaa

SEQ ID NO: 36181 - DNA, 431 bp, Zea mays
  Clone ID: LIB3060-010-Q1-K1-F6
cttctctacggtccgggaatcggaagctcacggcagaagccatgaggcagacgcatcttttgttgctcgcttgtttctgggtcctgtcaacatgctccttgctacttgatgcttcctccgatggactgttaagaatcaacctgaacaagaagagactggacaatgaagctttgactgctgctaaattggcgaagaaggagagccaccttcgaaggtctgtgggtgctgaccagtatctcagtgcctcaactgatgacatagtccctttggacaactacctggacacccagtactttggacagatcagcatcggcacgccaccacagaacttcacagtgatattcgacactggaagctccaacttgtgggttccctcatccaagtgctacttttcgatagcgtgctacttacaccataaatacaagtcaacc

SEQ ID NO: 36182 - DNA, 290 bp, Zea mays
  Clone ID: LIB3060-010-Q1-K1-F7
cgacccacacgtacgatttcgtccgccggacaagccattagtggctacttcgcgaagggcggcaaggcagatctagggcgatcatggcttacgtcgagagaggtgttgtgaaagacaaatggactatatggcgactgagcataatctcagacttcttctgggccattgtgagctatatcagaatcttctttgacacactgttctcattggacaaaactgacaacttcaagaaagggtatggtgctggtaagaagtgggatggtggacctggtgattgttagcggatccca

SEQ ID NO: 36183 - DNA, 431 bp, Zea mays
  Clone ID: LIB3060-010-Q1-K1-F8
ctgtggggcctcgcggtcccatcctgctggaggactaccacctgatcgagaaggtggcgcacttcgcgcgggagcgcatcccggagcgcgtggtgcacgcgcgcggggcctccgccaagggcttcttcgagtgcacccacgacgtgacgtcgctgacgtgcgccgacttcctgcgcgcgcccggcgtgcggacgcccgtgatcgtgcgcttctcgacggtgatccacgagcgggggtccccggagacgatccgcgacccgcgcgggttcgccgtgaagttctacacccgcgagggcaactgggacctgctgggcaacaacttccccgtcttcttcatccgcgacggcatcaagttccccgacgtgatccacgcgttcaagcccaacccgtggtcgcacgtgcaggagtactggcgcgtgttcgacttcctg

SEQ ID NO: 36184 - DNA, 376 bp, Zea mays
  Clone ID: LIB3060-010-Q1-K1-F9
ctctcccgcgcgcgcgggtgagccgggttctcctcctacgtctcgccaccctgctgggatagcccgccggtcgtccacgccatggccacccaatatgcgcggctctccctgccatgccgcctgccctcgccgctccctccgccggtgccgacgacgacccgccggctgccgcgcgccgccgcggcggcatgcagcggcgtacaccttcccgcggtgcccacgcgtcggtgcggcggtcacgcgcgcccgcggcccgtgccggcctcgcgcctccgaggtcgaagtgcatcaacaggtggctgaagctgaccatgtggtggacagcaacatgctgccctactgcagtcataaccgcaagtgagaaaatcagcatcga

SEQ ID NO: 36185 - DNA, 162 bp, Zea mays
  Clone ID: LIB3060-010-Q1-K1-G1
cgaactctcacgccctgacaaaaccgtccttcatttatacgcacccaccagatgaaaagggccaaagccaaaaggcattaccgccgcgacaactatggcagcctcgctccaagccgtggccaccctgatgcaagcggcctagatcggcggtcgggcgccctt

SEQ ID NO: 36186 - DNA, 315 bp, Zea mays
  Clone ID: LIB3060-010-Q1-K1-G4
ataacaataagcgtgaaccatggcggacgagtacggccgcagcggctacggcaggtccggcgccggcgacgactacgacagcggctacaacagcaagtccggcactgatgactacggccgtggcgaaggtggctacaacaagtcgggcggcgatgacgactacggccgcagcggcggcgatgggtacggcaggtccggcggcgacgactacggccgtggcaccggcggcggtggctacaacaagtccggcggcggcgatgactacggccgtagcggcggcgacgactaccggcgtggcaccggccgtggcgggta

SEQ ID NO: 36187 - DNA, 420 bp, Zea mays
  Clone ID: LIB3060-010-Q1-K1-G5
gcgagagagggtcgtcgaggtcgtctctagctatagctagagctagctgcgagagagagagagagagagatcgagaggtatacgtaggcccgccggcaactaactaacatgtcgtcgtcgtccgggacgacgatgccgctggcgtaccagacgtcggcgtcgtctcccgagtggctgaacaagggcgacaacgcgtggcagctgacggcggcgacgctggtggggctgcagagcttcccgggtctggtggtcctgtacggcggcgtggtgaagaagaagtgggccgtgaactcggccttcatggcgctgtacgcgttcgcggcggtgtggatctgctgggtgacctgggcctacaacatgtccttcggcgacaggctgctgccgctgtggggcaaggcgcggccggcgctgagccagggc

SEQ ID NO: 36188 - DNA, 423 bp, Zea mays
  Clone ID: LIB3060-010-Q1-K1-G7
ccgcgtgcctagcgccggctaccgcgactgtggcgtcggcggctgggaccagcggccgtgagtcccctctctgaaagctccgtctgtcttcaccatctgtgtcttcaccatctgtgcaggttcggcgaaaacatcataaccttttcttccccaacaacgcatactcttagctagggtttcaacgcatctgtcgacgggagctagggcgtcgccgccgtcaatgtcgcggcactcccactctttttcgtcaaccgcatcgagcggagggccacctgtgtcgccgctttcttgcatttgttttgcttcgcatttcgaacaggtaacggtccatcatctccatatgacctccttgtatcctccttcgttccgtgatgacggcatacaaactgaataagattctgtatttcgaatacgattctggag

SEQ ID NO: 36189 - DNA, 418 bp, Zea mays
  Clone ID: LIB3060-010-Q1-K1-H1
gctggctcgagcaggagagaaagaaagagacgatagcgcccgaaccccactcggggcgcccgtgccgatataatccaatcgaaaccgccacactgtttgccgccagcccgctagtaacctgcttaatttaggcatacgtgagactctgagagaaggtactgaccacacaagggaggccactcccgcccggttcgtccgcgtcgtcgccgatccgtacgcaactcccgtgatccgatccggacgtacggccgctctctctccgggctagctggcgatcgccgactgcatggggccggcggtcggcgacggcgaccgcggccccggcgccgcggcggagcacaaggtgaacctgtcggcgcggcagccgttcgtggagtcggtgcggacgtgcctgcccgagacgtttttccccgacgac

SEQ ID NO: 36190 - DNA, 425 bp, Zea mays
  Clone ID: LIB3060-010-Q1-K1-H10
cgaatcccaaacggaggagggcactcggcgaggcaggtggcgattctgcgattctcctgtcaccttccgtcgtctccatccccttccatttccggcgagggtcaaagcaggcctcttgctcttgggggtggtttgagagagggagagaacatggccgcggcggcggtgttggtggtgctcacggtgtcagcgctggcgggggcagcggccggcggtgatatcgtccaccacgatgacgaggcacccaagatccctggatgctccaacgattttatcctggtaaaagtgcaaagctgggtcaatggcaaagagggtggcgagtttgttggcgtcggtgctcggtttggtccaaaaatcgtctccaaggagaagcacgcaaaccgaactaaactcacgctggcagaccctatggactgctgctcttc

SEQ ID NO: 36191 - DNA, 429 bp, Zea mays
  unsure at all n locations
  Clone ID: LIB3060-010-Q1-K1-F3
attttgtccgccggacaagccagtagtggctacatcgcgaagggcggcaaggcagatctagggcgatcatggcttacgtcgagagaggtgttgtgaaagacaaatggactatatggcgactgagcataatctcagacttcttctgggccattgtgagctttatcagaatcttctttgacacactgttctcattggacaaaactgacaacttcaagaaagggtatggtgctggtaagaagtgggatggtggacctggtggtggtgggcggggcccatatggcggtggaggaggtggaggattcggcggcggaggtggaagtggttcacggngtcctcgcactctatctgacatccaatccaatgaccacagttctctccctgcttgtggatcctgctgtggctaataagcgtgcaaccgttccgcctgat

SEQ ID NO: 36192 - DNA, 431 bp, Zea mays
  Clone ID: LIB3060-010-Q1-K1-H11
ggacgtccgtcaaaaacctatacgatgaaatgacggagcggattgactccgctgctcggacgggcaatgttcctgaagaaactagagcgaaacacaaagggttttctgagtgggatacgggtattacctcaaaagaccaccacccgatcgttcagattctgatagatgggaaagacaaggctgtagctgacaacgaaggcaatgtgctgccgacgctggtgtacgtggcacgagagaagaggcctcagtaccaccacaacttcaaagccggggcgatgaacgctctgatccgagtatcgtccgtgataagcaacagccctatcatcctgaacgtggactgcgacatgtattccaacaacagcgacacgatcagagacgcgctgtgcttcttcctcgacgaagaaacgggccacaggatcgcgttcgtgcag

SEQ ID NO: 36193 - DNA, 154 bp, Zea mays
  Clone ID: LIB3060-010-Q1-K1-H3
cggacgcgtgggcgcgtgcgtcggctgcttgcttccacgtgtaacttggctgccgtcgacacgcggacgcctacacggtacgccgccatcgccatggctgcccagttctgtacaaccattgtcctctcgtgacattccatagaggactgacagc

SEQ ID NO: 36194 - DNA, 388 bp, Zea mays
  Clone ID: LIB3060-010-Q1-K1-D4
agcaatggctgactccaccatggcgatctactccacggcgatggccggtacccccatcaaggtgggctccttcggcgagggccgcatcaccatgcgcaagaccgtgggcaagcccaaggtggcggcgtccggcagcccctggtactgccccgaccgcgtcaagtacctcggtccctactccggcgagcccccgagctacctcaccggcgagatccccggcgactacggctgggacaccgtcggtctgtccgtcgaccccgagaccttcgccaagaaccgccagctggaggtgatccactcccgctgggccatgctcggcgcgctcggctgcgtgttgcccgagctgctctaccgcaacggcatgaagatcagcgaggacgtctggttc

SEQ ID NO: 36195 - DNA, 429 bp, Zea mays
  Clone ID: LIB3060-010-Q1-K1-D5
ggcatgcttgtagggctatgctcccacattcctgaggttcgtgcactgtgcatgaacgaaggcgtcatcccagcccttgtagacttatcagtcgagtggaacacactgtggcatgggattgctcggtcaagttgcttcagcttctgaggaactttaggcgatgtgaccagttcagcagttcatgctcacgagagcttgctgtcgatcatgtttcagagatcactcgcaatggttcaatttgcatgcagctcgatatcgaaagtcagtcccggtatatttcaagaaagctcaaccttttctcaaaacctcgggcgctgaccctggcttgagaaatggaaggtgtcggttggatcgagccctattacgcaacgctaactgccagatgtacagatagtatcaggtcgcgttcgtcgcgatgaaatgtttgtg

SEQ ID NO: 36196 - DNA, 419 bp, Zea mays
  unsure at all n locations
  Clone ID: LIB3060-010-Q1-K1-D7
ccgatctcctctcctcttccccgaatctcgggcgccgccgtaaccctagcccccgcgatccgctcgccggagggaaggagggatctccgcaggcgcccatggaggtgaagttgtggaacgacaagcgcgagcgggagctcctggagagctacgcggacctgtacgcgatcatcaaggccgtggagaagctggaacgggcctacgtccgggacctcgtctcagccgccgactacgaggcggagtgcctcaagcttatctcccagttcaactccctctcctcctcgctcgccggcgccgtcaccgtccctcgcttcgtccaggcgtaccgnctcgattgccccgccgcgctcaaccgncttctccagtcgggcgtcccggccaccgtcgagctccgcgccgcgtccgcctcatccgcgccg

SEQ ID NO: 36197 - DNA, 427 bp, Zea mays
  Clone ID: LIB3060-010-Q1-K1-D8
agccgccaccaggtgcagagtctttcgtcatctcttctccggcgaagaacccccagtcggccaccagatcacttgttaaactttgttgaggggtgatggcggtttctttcgcaaacctcagctccgaggcagggcttaaaaagcttgatgagtaccttctcactcgcagctacatcactggctaccaagcttccaaggatgacttggctgtctacacttcgttttcgtctgctccctcgtccaagtatatcaacgtagcaaggtggtttaatcacattgatgcgctcgtgaggctgagcggaattactgcagagggccaaggtgtgaaggttgaatcgtcagcagttccttcagccccaactccagatgttgctgaagcacaggccccagttgctgaggaggacgacgacgatgatgttgacctttt

SEQ ID NO: 36198 - DNA, 332 bp, Zea mays
  Clone ID: LIB3060-010-Q1-K1-D9
cccagaactatctcgctcgtccgcgttcagctcagctactccaatttcgcaacaagttgcaagcaataaccgaccaaggacgacgaacgggtcgatggccacgctctcctgctgcagtcgcctgagtagcggcaccggcgccgcggccatacaccggcagccgtcccgtgctggagccttcctagtcgtcacctgcaggcggagctcctgcgtgaccgtccgcgccgcatgctctgtcacggcggcatctccggctgccgtagagctgcagaacaaggggttgtctcttcagacttgggcggattactagctagggccaacgcttgaatgtt

SEQ ID NO: 36199 - DNA, 426 bp, Zea mays
  Clone ID: LIB3060-010-Q1-K1-E10
attgttggaggctaagacaatctcttttcgggaatggaacttgcaggcggacatctgccatgcataccagatcatgaagaagggcggacttaaggacgagaacatcgttgtcttcatgtacgatgacatcgcgcatagcccggaaaatccgaggcctggtgtcatcataaatcatccccagggtggcgacgtctatgctggggtgccaaaggattacactgggcgagaggtcaacgtcgacaatttcttcgctgttctgcttggcaacaaaactgctctcaggggtgggaaccggcaaggttgtggacagtggccccaatgaccatatatttgttttctacagtgaccatgggggtcctggcgtccttggaatgcctacgtatccatatctctatggtgatgacctcgtagatgtcctgaagaaga

SEQ ID NO: 36200 - DNA, 315 bp, Zea mays
  Clone ID: LIB3060-010-Q1-K1-E2
cgaagcacccgctacttgcgtctcggcacgcccttatcaccaccgccgtaagcttctctacggcgctaccgctagaacgcgcgctcagtctcaacatgccaccaccatcgccgtctcgaacgctggtgcccacttaccgctgtcccctgtaccggtgtcccttgtaagctgctgcaccttcgctgcctactcgagctccgtggtgcgagggcaaggtccggtcaaccggccggaacccctgtgtactatggttgttgtcgtgaactctgaggccaggggtctgccgtgcaatcgcatccgacttgacctgacctt

SEQ ID NO: 36201 - DNA, 416 bp, Zea mays
  Clone ID: LIB3060-010-Q1-K1-E3
gtgacgccgccatcgtcaagatggttccctccaagcccatgtgtgttgaggccttcactgactaccctcctctcggtcgtttcgccgtccgtgacatgagacagaccgtcgccgtcggtgtcatcaagtccgtcgtcaagtccgacaagcagggtgccggtaaggttaccaaggctgccgtctaggccggcaagaagtaaacggattgacacttttgttcccaaaagctcgtcttttctttgcttcggtgctcttctcaaggtcacatgagttgagcatttcactaacgataccacctttctgctgtcacgaccttgcatgaaacatgatggcgaggcagttgcttcgagggatctgggtttatggcttagattattagtttgcagcagcaattcaaaactcattgttgattgcac

SEQ ID NO: 36202 - DNA, 424 bp, Zea mays
  Clone ID: LIB3060-010-Q1-K1-E5
ctcatcctccgtcgagatcaaggaagaaagaaagcaaccatggcggcaaccggaatgtccccctccccctcggccgcaataactcgccacatccatgctcgtcgttcctgtgctgctgcttccttgtccctccgccgctcgggcttcctggggcgcgtcgtgctggccgcggtgccagtggccgtggacgccacccggcgccgacgcgtctccgtgtcggtgcggatggcctgggacggtccgctctcgtcggtgcgcctcatcatgcagagcaggaacgcgaagctgagcgagaagctcaaggagcacatcgaggacaaggtgggtcgggcggtgtccaagcactgccacctggtccgggaggtagacgtgcgcctcttcgagcgcggcggctagctcggccggggccccaagacgtcgcgct

SEQ ID NO: 36203 - DNA, 429 bp, Zea mays
  unsure at all n locations
  Clone ID: LIB3060-010-Q1-K1-E6
ctcagcttgcaggttgcagccgatgagaatcgagcgtgatctccacatggccacaggggacggagaaactagctacacgaaaaattctaggattcaagagaaaactatgtttcagatcaagcctgtccttgaggaggccacaagagcagtatacacagctctccaccctcaaaccatggttgttgctgacttaggctgctcatctgggcctaacacactacgcttcgtatccgaggtgattggcatcatagctcgccattgcaaagaatatggccgacaacatgaccacacacagcttcagttcttcctgaatgacctgcccggaaacgacttcaacaatctcttccagctgatccagcagttcaataagtcgacggcaataaaccacaagagtgaggcagttgaggcactacctnctccgtgctatat

SEQ ID NO: 36204 - DNA, 88 bp, Zea mays
  Clone ID: LIB3060-010-Q1-K1-E7
attagattggatttattcaaccctgttattatcgcgctctttgtacacgacaaggggggggatatattctagctgcaggtgaaacttt

SEQ ID NO: 36205 - DNA, 408 bp, Zea mays
  Clone ID: LIB3060-010-Q1-K1-E9
cgcagtgcacacccttgctgacgggctcggtgcagctcaattcatcaatgcaatttctgagtttgcccgtggagtagttaaacctacaatagcacctatatgggcacgggagttaataccaaacccacctaaaatgcctcctgggccaccaccatccttcgagtgcttcgggttcaaacattttgttatggatgtggcagttaacaatattgcacatgtcaagagtgaatactttcaaaccaatggacactattgctctacatttgatgttgccattgccaaggtttggcaagctaggacaagggcaatcaagtacgaaccaaatttcaaggtgcatgtttgcttctttgccaacactcgccaccttctcacacatgtgctacccaaggttggtggcttctattgaaa

SEQ ID NO: 36206 - DNA, 400 bp, Zea mays
  Clone ID: LIB3060-010-Q1-K1-F1
cgagcggagcgaggaggtagcgcggcggatgtacgccgagtggatggcggcgcacggccggacctacaacgccgtcggcgaggaggagcgcaggttcgaggtgttcagggacaacctccgctacgtcgacgcccacaacgccgccgccgacgcgggcgtccactccttccgcctcgggctcaaccgctatgccgacctcaccaacgacgagtaccgcgccacctacctcggcgtcaggagcaagccgcagagggagaggaggctcggtgacaggtacctgggcggcgacaacgaggacctggcggagtccgtcgactggcgggccaagggcgccgtcgcggagatcaaggaccagggcagctgcgggagttgctgggctttctcaacaatagcggctgtg

SEQ ID NO: 36207 - DNA, 427 bp, Zea mays
  Clone ID: LIB3060-010-Q1-K1-F10
gtccgcacagctttggtagccttgattgccttcatgccgacgaacccaggtggggcattgggctcactggattacaaaccagaagacagacgagcacttgctataaaatcacgtgaggtgccgccgaaatttggctccccacaacgtcagaaactaattgatgagatccatgagcaaatgctcagtaaggctcctcctatcccccaaacgctgccaaatgtgccaaacgaggagctcgcacctgactcttgtgatgagcatgcagacaaggtagatgaaggtggcaacacatccaagtccatgtcaggctcgtcgagtggccatcctgtgcctgaagctgaatcgctggctgcagaaaacacgggtgaagcatcagcagttgaggttgccaaccatcaagtgcctgaagcgagccgtatagaaagca

SEQ ID NO: 36208 - DNA, 419 bp, Zea mays
  Clone ID: LIB3060-010-Q1-K1-D3
agaagatttggtgcttcggacctgagactaccgtgcccaaacatggttgttgatatgtgcaagggagtgcagtatctcaatgaaatcaaggattctgttgtggctggtttccagtgggcatcgaaggagggtgcactggctgaagagaacatgcgcgggatttgcttcgaggtctgtgatgtcgttcttcatgccgatgctatccacaggggtggtggccaggtcattccaactgccaggagggtcatttatgcttctcagctcacagccaatcccaggctgctggaaccagtttacctggtggagatccaggccccataaaatgcacttggtggcatatacggtgttctgaaccagaagagaggacatgtatttcaggagattcaaaggcctggtaccctgctctacaacatcaaggc

SEQ ID NO: 36209 - DNA, 404 bp, Zea mays
  unsure at all n locations
  Clone ID: LIB3060-044-Q1-K1-F3
ccacgcatccgctatatatanataatctaaatcgataagaactgtcttttctatatactttcccccgtctgtttctaccacaggtcttatgcaatcaatctgatcatatacatatcccttcaacacaacataactcatccaaagtatctcagacgactcaccaaatcacgaaacccaattataaaatgcattcctatatgaacagtgcctaaccgcatagataatctcacattaacccgtcaattttggatccaattcagcatttttcttcccaagtttctgcaagaaattgcaataatatcgattcatacatatgaaaaaattctctatttatacaaacgctttacctacacgataatcatacacgaatactgaaaaatcaaaatgaaataaataaaaaataa

SEQ ID NO: 36210 - DNA, 413 bp, Zea mays
  unsure at all n locations
  Clone ID: LIB3060-044-Q1-K1-F7
cccaaggatctcgtcggacgctagaggaagggacgggggacgggcgatggcggggggcgccggcagcggggtggactgggagagcctggcggaggccacctccggggcaatcggctcgctcgtcagcaccaccgtgctctacccgctagacatctgcaagaccaagttccaggccgagcttcagacgcaccagggcgcgcagaagaaatataggaacctttcagatgtgttctgggaagcgatttgtaaaaggcaatttttgtccctatatcagggccttaacacgaagaacatccagtcttttggttcctcgtttttttatttttatgggtatagctattttaaaagactctacctggagaagagtggagcanagtctattggaacaacagcccaatttgttagttgcagct

SEQ ID NO: 36211 - DNA, 382 bp, Zea mays
  Clone ID: LIB3060-044-Q1-K1-G1
cccaactcatttttttttcccagctcgcggaacgggcggcctcgttgcaacttgcagggagccagtcctctcgctttctcaccgcgattcgcctcgcttccatccgattcgattcgggagctagaggagagagaggagaggagaggcagtgatgccgctggctgagtcgcccccgtggcgccgcaaggccacagatttcttctccacgtccagtgtcaagctgaagcaggcaggccaatcggccggggataatatagttgatgttgctgggaaggttgggtccgtggtgaagagtcggtgggctgtcttccaagaggctaggcagcagcagcagcagcagcaacgtccgccgcatgagacagtgcaagagcgtatcatcact

SEQ ID NO: 36212 - DNA, 435 bp, Zea mays
  Clone ID: LIB3060-044-Q1-K1-G2
aaccattttcgctaatctccctccaccgagccggccgaatcaaatcgaaccgcgggcggcgcgcacgcgcagcgactgccggcgatggcgagcctcaccctgccgccggcgccccccaacccacgccaggacgccatcgacctccacaaggccttcaaagggtttggatgtgacagtacaacagtgataaacatacttactcatcgcgattcggtgcagcgtggactcattcaacaggaatacagggctatgtatcatgaggaactctcccaccgtatttcatctgaactcagtggaaaccacaagaaagctatgtcgctgtggattcttgatcctgctggacgtgatgcaactgttttgagagaagctctaaatggtgacactatggatctgagagcagccactgagattatatgttccaggacaccatcacag

SEQ ID NO: 36213 - DNA, 435 bp, Zea mays
  unsure at all n locations
  Clone ID: LIB3060-044-Q1-K1-G3
ggttccctttcctcgagtttcctattttcgtctcctccccacagcagcccggcgaagacggtagtaagcaaaccaccggagcagcggcgcttgcgcgggcggagccatggcggacgacgattacaacaaaaattgacatggggtatgaggatgagcccccagaaccggagattgaggaaggagctgaagaagagcctgagaacaacgaagatgcccctgatgacgtcataggtggtgagggtgaagataaggaacaggaaaagaccaagcgtgaacgcaaaacaacaaaatacatgacgaagtacgaacgtgcgcgcatcctgngtacacgagccttgcagataagcatgaatgctccagtcatggttgagcttgagggtgaaactgaccctcttgagattgcaatgaaggagctgagagcgcgcaagataccct

SEQ ID NO: 36214 - DNA, 434 bp, Zea mays
  Clone ID: LIB3060-044-Q1-K1-G4
cgcgaggcggccgacatgatcaagaagggcaagatgtgcgtgctgttcatcaacgagctggacgccggcgcggtgcggatgggcggcacgacgcagtacacggtgaacaaccagatggtgaacgcgacgctgatgaacatcgccgacaaccccaccaacgtgcagctcccggggatgtacaacaaggaggagaacccccgcgtgcccatcatcgtgacgggcaacgacttctcgacgctgtacgcgccgctgatccgcgacgggcgcatggacaagttctactgtgctcccacccgcgaggaccgcgtgggcgtgtgcaagggcatcttccgcagcgacggcgtccccgacgaggacgtggtgaggctggtggacgccttcccgggccagtccatcgacttcttcggcgcccttcgcgccagggtgtacgacga

SEQ ID NO: 36215 - DNA, 255 bp, Zea mays
  Clone ID: LIB3060-044-Q1-K1-G5
ctttctcattccacctccttctcaatcacctctatcttcaacaccaccatactctacccactatacatcttctataccaacatccaatcccaacttcacacacaaccattctcacacaataaatctactaaccttccacatattttctattaatctatatttaaaacacaattatactccctatatcctcaccttaacactaacaacatccattcttatctttcctacattccttattcatatacctatacatat

SEQ ID NO: 36216 - DNA, 431 bp, Zea mays
  unsure at all n locations
  Clone ID: LIB3060-044-Q1-K1-G7
gcgtagtgcggagctccagtgaaggaaccaaacagcgcaacacacgaacacaccaggcggcaggctccaccccgtccttttcctgccttttccccccgtcgagttaatccatccagtcgccaaaagctttgctaaatttcacgtgtctcgcctcgagtcgtccctaatccgacgatgccttgttctactcctaaaaaaacccaaagatcctgactttctcttgctgctagcctcccttttcccttctcccttaatcgcactgttggaagctcttcgctgtcacccccacccacctccggcgctcttttttagcattttccttgggctctggactccaaaatcccagccttttgtttgcttctctgtctcctgctgattggtgtcnccgggtccaggactcttgatttgctcctcgcggggttcggtcccat

SEQ ID NO: 36217 - DNA, 442 bp, Zea mays
  unsure at all n locations
  Clone ID: LIB3060-044-Q1-K1-G8
accaaagccatcggaggagcaactggacgaccatggcctcgccgctgctcaagtcgcactctcagctcgccgccgccgccgccctgcactccgtgaggagagccgaccgctgccctgcgacactacacctgggcaagttccatgaccacgggctcaggtccggccgttctaagagatccggttcagcgagggtgggcgccttcccgtcgctggacgtggtgccgctgatggtgacgatggtggagcacgtggacatgtcgcgggactacgtcgtgaccaagtccatctggcatctcagcgacgtagccctcaagagcgtctataccttctacgccatgttcaccgtctggggagtctgcttcttcgcgtccatgaaggatcccttctacgacagcgagacgtacaggagccagngtggcgacgggaccgtgcactggtacta

SEQ ID NO: 36218 - DNA, 341 bp, Zea mays
  unsure at all n locations
  Clone ID: LIB3060-044-Q1-K1-H1
ccggctgcgagcgccacgcgtctcggtggagcgtctcgcgtaccggcttccggctcatcactttcctctcggttgctgtctcttccagcatcggcnaggttcatcnccttcatgcctcgtcatctggagcctcgctcggccctaccagctcgcattgtacccccggccccgccgtgtctgttccctggttcgtcattcaagcgcccaggtcgagccatcgccccgcttgggaaatggcagccacggctcatcncnncgtctcgaacctccatccagcttcctcacaattcccttgtnntccttggcgccttcgccaaagggccccctctccttcaaatctt

SEQ ID NO: 36219 - DNA, 221 bp, Zea mays
  Clone ID: LIB3060-044-Q1-K1-F1
cctacaccattctctccctaactctcctttccattcacctcccctccccctcccatcacttatcctttctccatccataaccccacatccattccccacaccaccaatccaatctcttctccacataacatactcccactcctctactccccctccccttaactacttttcactcatatatcttatcaatttttatctcttctaaccttcttctcccatct

SEQ ID NO: 36220 - DNA, 343 bp, Zea mays
  Clone ID: LIB3060-044-Q1-K1-D12
caggacctgtcactccgtctgtccatcgacggtgagaagagctcgctgaacactaaggatgcactgtggttcgacccccaggatcaagtgcagaagatcatgaacaacatcaagcagtcgtcagcgcttcctccgtccatgtcctcagtcgcagccgagggcacaggcagcaccatgaacaaatacccactcctgcgccggcgccggcgcttgttcgtcatagctgtggactgctaccaggacgatggccgtgctagcaagaagatgctgcaggtgatccaagaagttttcagagcagtccgatcggacttccagatgttcaagatctcaggggtcacgctgt

SEQ ID NO: 36221 - DNA, 430 bp, Zea mays
  Clone ID: LIB3060-044-Q1-K1-D2
gtcctgactttgccatctctctcctcgtctcctttcctctctctctctctctctctgtcgctctccaatcttctttcctcttctttgatcaccagccaggccaaccgcagatataactccttccgattctcccctccgtggactccgcttgattcgacaaaagtatatgaccactcgacgatcacaagaagtagcagattgctagctaggaacttggtgtctccggccgtgctccatttgatcgtgaaagaacacagctgcaacaccgtggctttccgtttgcttgatcgtctcccaatgctgcgaaggaacctaccgaatctctccctccagataagcccgccacccgccgcggcatctgacgcaccggcgacgtattccgaaggaagcgacgaggtagggttcttcgcaaaccctagctccggcgcgg

SEQ ID NO: 36222 - DNA, 338 bp, Zea mays
  unsure at all n locations
  Clone ID: LIB3060-044-Q1-K1-D3
cccactctacccactcatccaatccttcttctccatcattatcctttcttttccactcattctctctctctctctgtcggtctcctatcatctttcccatcctctaatcaccaaacataccaaccatcataaataacctctccccaatctacacttccatcactacaattaattcctctaaacattattaccactcaaccatcacatcaaatcccaacatccatactcttaacctcattaatctcatcaatcttcatttcatcatcaattaacacatctacctcaccccatctacnactctccttcatcctcttaccattctttcaactaacactacc

SEQ ID NO: 36223 - DNA, 440 bp, Zea mays
  unsure at all n locations
  Clone ID: LIB3060-044-Q1-K1-D6
gacgagtgtcaagtgaacctgaaacttgcggtgtcactggctggtagcctgagtgggagtgagtgatcgagctagctgagctccgatcctcgctagctaggataccgccataccacaagtcttcttcacaagtttaggagtgacagcaacaagagatcgatggcctctgccaccgtgctcaagtcctccttccttcccaagaagtccgaatggggcgccaccaggcaggccgccgcgcccaggccgcccaccgtctccatggtcgtccgcgcctccgcctacgccgatgagctcgtgaagaccgcgaaaacgatcgcgtcgccggggcggggcatcctggcgatggacgagtcgaacgcgacgtgcgggaagcggctggcgtccatcgggctggagaacacggaggccaaccggcaggcgtaccgnacgctgctggtcac

SEQ ID NO: 36224 - DNA, 439 bp, Zea mays
  Clone ID: LIB3060-044-Q1-K1-D7
cctgtcgttgtgagaattcttaattcatgagttgtagggagggacttatgtcgccggaaacagaaactaaagcaagtgttggatttaaagctggtgttaaggattataaattgacttactacaccccggagtacgaaaccaaggatactgatatcttggcagcattccgagtaactcctcagctcggggttccgcctgaagaagcaggagctgcagtagctgcggaatcttctactggtacatggacaactgtttggactgatggacttaccagtcttgatcgttacaaaggacgatgctatcacatcgagcccgttcctggggacccagatcaatatatctgttatgtagcttatccattagacctatttgaagagggttctgttactaacatgtttacttccattgtgggtaacgtatttggtttcaaagccttacc

SEQ ID NO: 36225 - DNA, 408 bp, Zea mays
  Clone ID: LIB3060-044-Q1-K1-D8
gcgtctcctgccctggcggggacgccgctgctgacagggcacctgatcgattgatgtcctcgggcagtcagcggcgctcaagagtcacgagcttactggttgtaagcaacgatcgacgaacgaaggggtgtagggagtggaagcaagaggctcagcgttctgttcatggagagccgcaaggaggagcaggcggcggtggggtggatgacggtgccggcgttcggggagtgggacgtgaagaacggcgccgtgccggactactccatggacttctccaagatccgcgagatgcgcaagcagaacaggcgcgagctctcccgggccagcctcggcggcggcgacgacgacgacgacgacctactccagaagaagcagcagcagcagcaggaggagggaagcaaggcccag

SEQ ID NO: 36226 - DNA, 414 bp, Zea mays
  Clone ID: LIB3060-044-Q1-K1-E10
acggtccggattcccggtggcgcacgcgtccgtgctgctccaatccgctcttttatgactcggccagcggaaggggagagaggagggggagaggacggtggagaaggtggacgcggggctttccgacttcgacgcccacttcgatcgcctcttcgcttccccggacgccgcctccgacggcaaggtgaagctgctgctcttcctggccgaccgcaagcctgactcctccctctcctggtgccccgactgcaacgtggcggagccggtgatctacgagcggctggaggcactggagggcaaggacgcggtgctcctgcgcgcctacgtcggggacaagcccacttggcgtgacccggcgcacccgtggagggtggaccccaggttcgggctcaagggcgtgccaacgctgatccg

SEQ ID NO: 36227 - DNA, 441 bp, Zea mays
  Clone ID: LIB3060-044-Q1-K1-E3
gggagacccattaccaatgccaagaacaagaaaccagagaggacagccgcgaatacgagtcggaatcccctccaaaaacccaccataccgtctcccccatctgcaagaacaagatcaggagagcatcctagggggaagaaacaggagggggaaaaagaagcccagaaagaccaactgaccaaacaaaaaggtggcatctttgtgtcaccgaggcaccgccgatcacagaccaaagcccgctcctctggtccatcccaagcgtacagcagccgagatttcttcgatctgcgcctgcgtttttttttcttgtaaagattttagttttccccccttcaactgttgctagccttgagtcgctgagaagtttcgaaaaggggtggtgtgagtgtcggatagctcaggatggatccggcgttgctggacgacgtcatacgccggctt

SEQ ID NO: 36228 - DNA, 360 bp, Zea mays
  Clone ID: LIB3060-044-Q1-K1-E4
aattccttctctacccactcatcctgcacacccattaccaacgccaataacaataaaccacacatcacatcccctaatacgatgcaaatatacttcaaaaacccaccataccactataccacatctccaataacaatatccacatatcatcctacacacaccaaacctcaccctcaaaatcaaccccacaaacaccaactcaccaaactcatatcctccatctacctatcatcaattcaccacctatcacaaaccaatcaccactcctctattacatcctacaccttcaacaacctacactcattccatcctcactaacatcaatttttatcttaaacacattacctttccacatttcaa

SEQ ID NO: 36229 - DNA, 412 bp, Zea mays
  Clone ID: LIB3060-044-Q1-K1-E5
gggaccgtgggcaccggccgcggccatggcttcccatccttctcggcggtcaccgcaccagcacccacctcccgaatgttcaccaccaattccaatccctacgcttcgatgccgcaccgcgcgtaaggcgctgccaaaggcgctcgaccttgaggtaccgtcgtctgcgggaagcacctgaagaatgtcaactggcgccgtggcgacctccgtgcctacgtcgtggtgtaccttgacccctcccgccgcgccgctacccgccccgacgacggcggcgggtgcaaaccaacctggaacgagcgcctcgtcctcccgcttccgccccacctctccccgcacgacccctccatcctcctgtccctcgacgttttccactctaagccctccgattcgcccaagccgctcgtcggat

SEQ ID NO: 36230 - DNA, 429 bp, Zea mays
  unsure at all n locations
  Clone ID: LIB3060-044-Q1-K1-E6
cgctcctctccgtcgccggtggagctcatggcatcctccatggccgccgccggcacggccaccgccctcccgctgccgtccgggacgacgcagaggccgtctgcccagggccgcctcctcttcaccgccgcgcccgcccgctccctccgcctccgccccgccggccgccggtcggcccgctcctcgcctcgggccaccaaggctgtggtggcagcgttggctgatcctctcaaggtcatgatatcaggagctccggcgtccggcaagggcacacagtgcgagctcatcaagaccaaatatcaactggcgcacatctccgccggagatttgttgcgggcggagatcgctgctggctctgagaatgggaagcgggccaaggaattcatggagaagggccagctcgtgcctgatgagatngtcgttaatatg

SEQ ID NO: 36231 - DNA, 408 bp, Zea mays
  Clone ID: LIB3060-044-Q1-K1-E7
gtgctctgttctgctgcgcctgcggggcttcagtgcagcgcgtgcgccgtgcggtggcgcccgccagccaccctcgccgtcgggtcgccttgccacgtcgccgcccgcgcccccggcccaccacctgaggccggtcgcccatccataacgcccgcagtccagtccccaccaggcaccagcccacatctcttctcccacagaacagactcccacgccgtctccgccccctccccttcacggctttgcgcgcgtagatcggaggaatggtgagcgcgtcgagcctgctgctcccgtcgtcggtgcgggacctggcctcctgcgtctccgacggcgccgtccgcgtcgcctgcaccaccccggcgtccacgttcacggtctcctcctccttgccgtcgccgccgtccacgc

SEQ ID NO: 36232 - DNA, 407 bp, Zea mays
  Clone ID: LIB3060-044-Q1-K1-E8
gaaagatatggcacaatcaagcactcaagaccaagcgactaagctagatgctgccggccgggagctcatcacaacctacgatgagcttaatccaactctggtcgatgaattatgggaagagccaagcgctcttgagttcttgcagtatgttgcgaggaatcggccatttgttgtaagaaaaggtgctcaagactggactgctgttcaaaagtgggactcgcactatcttctcaatgttcttgggaacagtctcgtcaatgtagcaatcactcctttcggcaacgcatatgcagtgttgaaagaagaagatggttcactatcctatgtcaggccactcgaacggctcgagcctttcgacatggtcatccgctacatttcagagcaggagttgaatcagtcaggaccta

SEQ ID NO: 36233 - DNA, 323 bp, Zea mays
  Clone ID: LIB3060-044-Q1-K1-D11
atatagataatctaagtctaaaagaactgtcttttctgtatactttcgcctgtctattgctaccgcgggtcttatgcaatcgatcggatcatatagatatcccttcaacacaacatatgtcatcgaaaggatctcggactactcaccaaatcacgaaagccatttataaaatggattcctatttgaagagtgcctaaccgcatggataatctcacattaacccgtcaatttttgatccaattctttatttttcttggtaattttctggaagaaattttaataatatcgattcatacagaagaaaaagttctctattgattcaa

SEQ ID NO: 36234 - DNA, 347 bp, Zea mays
  unsure at all n locations
  Clone ID: LIB3060-044-Q1-K1-B7
cccacgcatgcactctatatctcccgacgtctactcgttctctgtttccctccatgccctcaatgtaggctcaatctaaacgctgtccccttccctcatcaaaaccctanctcatcacctcaccaccattctgtccactatcctattccactgctcctctccccatctctcttgccatcacatctgatgttcttctcccacaacgcattcctctacctgtaccccatctactcaccaacctccatgacttcctctaataacgttactacccattacgagtgataacttaagcttcactacatcaagatactcaactatgacatgaaccgcctcgtcattaacttcct

SEQ ID NO: 36235 - DNA, 372 bp, Zea mays
  Clone ID: LIB3060-044-Q1-K1-C12
gcaacatagaagctgtttggatgggacactctcctcctttgctaaggctcgcaattgtggatttggcattaccaaaaactcctaatgataactctctgtcattgtttgctgatccccttgttccagagagattttattgtgcgcatggtggggggcttgacatggtcacactgcacttcctaccattttcataccctgaaatgtcttcgacaccaccctctgtgcatcctgtcctcactacagggaacagcgaaacaagctcaccttttctttctggatttgttaccatagctgatgcatatggtcatgtacagttagctggcatcacatgcttgggtgaatgctttgtggtggaaatgaaaggtttgaaag

SEQ ID NO: 36236 - DNA, 398 bp, Zea mays
  Clone ID: LIB3060-044-Q1-K1-C2
cgtagctgatttccagcaacagaaaacactggttctaaatccgaaatttgttgatgggatgagatcaattctgcgcaacacaagcttggataaggaattcattgcgaaagcaataactttgcctggtcaaggggagattatggatatgatggaagttgcagatcctgatgcagttcatgctgtccgtaactttattaagaaagagcttgccgtgcaacttaaagatgatcttcttgcggctgtgaaaagcaacaggagttctgaggcttacacatttaaccatgatagtatggctcgccgtgcattaaaaaatacatgccttgcataccctgcgtcattgaatgagccagaattcgttgagcttgcactgcatgagtacaagtctgcgactaacatga

SEQ ID NO: 36237 - DNA, 387 bp, Zea mays
  unsure at all n locations
  Clone ID: LIB3060-044-Q1-K1-C4
caaacactgcccgagacatagacagcgggacgtcgagatggccgacggngaggacggcggcgncgcgcgccgncgggccgncatcacagactaccgcaagaagctgctcaactgcagggagctagagtcgcgcgtcggcaccgtgagagaaagccttaaaactgcaaagaaggattttaccaagactgaggacgacttaaagtctctgcagagtgtggggcaaataattggagaagtactccgacctcttgataatgaacgctntatcgtgaaggccagcagtggtccccgatacgtggtcggttgccgaagtaaagtggacaaggagaagttgacatctggtactcgtgttgtacttgacatgacgacctttgacataatgcgcac

SEQ ID NO: 36238 - DNA, 425 bp, Zea mays
  Clone ID: LIB3060-044-Q1-K1-C5
gaccagctgaagcgaacacagagctgctcgccgtgtaacgcagcaggcagcaggacgcataggcggcaggtcacacacacagcacacgcagatcttcgatcaccaccatgggttctctcggcagcgccgcgcagcagcagcagcaaccgcacgccgtgtgcctgccgtacccagcgcagggccacatcaccccgatgctcaacgtggcgaagctgctgcacgcccggggcttccacgtcaccttcgtcaacaccgagtacaaccaggcgcgcctcgtccggacccgcggggcggcggccgtggccggcctcccgggcttccgcttcgccaccatccccgacggcctgccgccgtcggaggacgacgacgtcacgcaggacatcccctcgctgtgcaagtccaccacggagacctgcctcggtccc

SEQ ID NO: 36239 - DNA, 346 bp, Zea mays
  Clone ID: LIB3060-044-Q1-K1-C6
cagctgaagctaacacagatcttttcgccgtgtaacgccatcatcaacagcaggcatattcggcatgtcacacacacaacacactcacatcttatatcaccaccatggattctctcagcatcgcccctcatcatcatcagcaaccgcactccatgtgcctgccatacccatcgcaagaccacatcacccctatactcaacgtgtcgaatctgctacacacccggagcttccacgtcaccttcgtcaacaccgactacaactcaggcacgcctcgtccggacccgctatactgctgccttggccaacctacctgacttccgcttcgccaccatccccgacgtcctgc

SEQ ID NO: 36240 - DNA, 268 bp, Zea mays
  unsure at all n locations
  Clone ID: LIB3060-044-Q1-K1-C7
tccttaccancttaatctaacacatatcttttctccttgtaactcatcattcatcagcaggcttattcagaattttacacacacancacactcatatcttctatcaccaccatttnttctctcatcatctcctctcatcatcatcatcaacctcactccttatacctaccttacccatctcatttccacatcacccctattctcaacttttctaatcttctacactccctattctttcacttcaccttcatcaacacctattacaacc

SEQ ID NO: 36241 - DNA, 442 bp, Zea mays
  Clone ID: LIB3060-044-Q1-K1-C8
gcttcaggttcgtacttttgaggcgcaatgtgggtcgttggcgcagtatgggggggagcacatgcggtccttcgcaaacatctgcaacgctggcatccttcctgaagcagtgtcgaaggtcgctgctcaggcttgcaccagcattccttccaacccctggagttctatccacaagggttttagcgcctaagaatcgtaaggtgaggcgaaatatttcagccgctccaccgcaacgaactggtttacattaccagtcctcaggggggtcctagttcttgaaccactattatagctgttccaccgttccagattacatagctatgcccaatttccggtgtacatattatagtcggaaagttatttggcaattgtattggtcgttgctgtatatattccctatagtttgttagcagatgtgtagtttgtgattccattaaaatga

SEQ ID NO: 36242 - DNA, 419 bp, Zea mays
  unsure at all n locations
  Clone ID: LIB3060-044-Q1-K1-D1
agcagctccgctcgtcgatcagctctcggctgaccactcatcgccagtgggtgcctgccggccaggtctcgccgccggcaccgccgcggtagagaagggagggagagggggaaaaaactggcccaaatcgagaggtacagcacgaaaaagagaggcaagagagataggggaccggagggcggcgggccggggcccaagaccgaggggctcgtgcgcaggaagctgatgaggctcctgtcgctcgtccccttcggctgccgtgctggacccatcgacgacgcgccgncgcccgtggaccacgccgccgccgcgaggaggcgccggaggaggagggccaacagggccgnccagctgctgggggctgctgcgggtgcgccgcagcagtggcgcccctcgctcggcgacatctgcgaggagta

SEQ ID NO: 36243 - DNA, 442 bp, Zea mays
  unsure at all n locations
  Clone ID: LIB3060-044-Q1-K1-B6
ctcggggtctcccgacgtcgactcgtcctcggtttccctccatgccctcaatggatgctcgggctgtccgctgtccccttcccgcgtcgaaaccctagctcgtcacctcgccgccgtgctgtccgctgtcctagtccgcggctccgcgccccatctctcttgccgtcgcatctgatgttcttctcccgcaacgcattccgcgacctggaccccatcgactcgccggcctccatggcgtcctcgaagaaggttgcgacccgtgacgagtgggagcggaagcttcgcgacgtcaagatacgcaaggaggacatgaaccgcctcgtcatgaacttcctcgtcactgagggcttcgtcgacgccgncgacaagttccgcatcgagtccggcacccagccggagattgacctagcgatcatcgcggatcgaatggagggtaagagag

SEQ ID NO: 36244 - DNA, 430 bp, Zea mays
  Clone ID: LIB3060-010-Q1-K1-B8
ggaaaaaaaatcacccccaaactccgaccgagcatcttccccggtaggccttatccggtttctgcttgcacctctccagtgagccagtcaccgccagtccacgccatggcttctcgcgccactctcctgccgctcttcctcttcctcctcgtggcgcccgcgcctgcgctcgccacatccggcaccatcgtcttcaccacgctgggccggagccgctacgcctttgacgtcttcgcgctcccgatcgccccgctctccgccgcctccgcggagctgcgcctcacggacggcgcctccgtcaactacaacggcaacttcgcgccctcctcctccggaccgccctccctcctcttcgtctccgagcgcaacggctcgctcaacctctacctcacccccgtccccacatccgcctccgcccgtcgccgcgacg

SEQ ID NO: 36245 - DNA, 70 bp, Zea mays
  Clone ID: LIB3060-010-Q1-K1-B9
gatacaaaaactaactgcaaactttgatttaacaacacacccggaaaaccctaaggggggcttccttgca

SEQ ID NO: 36246 - DNA, 113 bp, Zea mays
  Clone ID: LIB3060-010-Q1-K1-C1
gaaacagcagtagcgttagcttcacgatttggttgccgtcgtagcatcgccttcatcgggaggggtcttttccaaccgtgccgatactacatacaaagagatgatcattcaag

SEQ ID NO: 36247 - DNA, 433 bp, Zea mays
  Clone ID: LIB3060-010-Q1-K1-C11
ccattccctactcgctccgtggttcccccagctccctcttccatgggcggggtctgctgctcctggcgcatggcatgggcacctgcgcctcttccccagaagtcgccatgacctcaccaagaccccagccgagctcgcccccggtcccttgcttcccatggcactcgccctcttctccctgacacgcgccctcccagccgagcagctcgccctcgctccctcaaactcgccgcgcgcgccctgctccctgcgcgccgcggcttcctagctcctctccagcgtctatcacagtccgagcctcctccacgccggccggacctccacctcgcccatggcggcttcccccgctcagcgtactccctcgctggtggtcgggcagcagtcgcagctgcaaccgagtggagaaacccagggtgccgttgaaccccatcct

SEQ ID NO: 36248 - DNA, 206 bp, Zea mays
  Clone ID: LIB3060-010-Q1-K1-C12
acattcactactcgcttcgtggattcattatctaagtctaccatgggctgcgtctgatggtactggctcatggtatggtcacctaagcctattccacagaactctccattacctcaccaagacctgaatcgagcttgcccttagtcccttgattcccatggcactagatctcttctttctgacacgcgctcttacagacgagcatc

SEQ ID NO: 36249 - DNA, 433 bp, Zea mays
  Clone ID: LIB3060-010-Q1-K1-C2
gaaacccctactcccccaggaagcaatggctttccccacccagggccaggtcatcacctgcaaagcggcggtggcgtacgagccgaacaagccactcgtgatcgaggacgtgcaggtggcgccgccgcaggccggcgaggtccgcgtcaagatcctcttcaccgcgctctgccacaccgaccactacacctggagcggcaaggatcctgagggtctttttccttgcattcttggccacgaagctgctggaattgtggaaagtgtcggtgaaggagtaactgatgtgcagcctggggatcatgtcattccttgctaccaagcagaatgcaaagaatgcaagttttgcaagagcggaaagaccaacctctgtggtaaggtccgtagtgccacaggcgtaggtgtcatgatgaatgatatgaagagcaggttctct

SEQ ID NO: 36250 - DNA, 409 bp, Zea mays
  Clone ID: LIB3060-010-Q1-K1-C3
tgagacattgctcattgaatgtccacaaagtagttgtgttcctgaactctaaatggagatctaagaccaatttgtgaaacaacagttggttttgataccatatgcaaggtgaactcgcagttaataagcaatgcatgcatagatgccctttctgctgaaaagtattactattttattcggatgatgggacgtaaagcatctcatgtagcattggaatgtgctcttcagtcacatccaaatatggttatcctaggcgaggaggtttctgcgttaaaacttacaatatttgatattacaaagcagatatgtgatgctgtggaggcaagagctgaaaaagacaaatatcatggagttgtacttattcctgagggccttgttgagagtattcctgaactgtatgctttgctcc

SEQ ID NO: 36251 - DNA, 428 bp, Zea mays
  unsure at all n locations
  Clone ID: LIB3060-010-Q1-K1-C4
cttttccttcccccgctttctccttccttcctcctactcccggctcccctcacccagccaccggccatgtcggtggagacggagcggagctccaccgagtcctccggggcttccgggctcgacttcgaggacaccgcgctcacgctcaccctccgnctcccgggctccgcgccttccgccgccgccgccgccgcggcttccctgtccctctcctcctcgtcgtcctccgccttccccgaccccgaccgcaagcgcgcctnctccgacgctgaccccggccgctcctacccgctcgccgcgtcctccgacgctgcaccggcacccaaggctcgtgtggtgggctggccgccggtgaggtcgtaccgcaagaacgcgctcgccgacgccgcgggctccagcaaggccgccaagttcgtcaaggtggccgt

SEQ ID NO: 36252 - DNA, 390 bp, Zea mays
  Clone ID: LIB3060-010-Q1-K1-C5
cacctggtgctgcccgcgccattttcacctcccactgtcctttcgtccagtccccagccctgcagtccaaccgtggaggttctggaaggcggtgtatcccttctagaaccttctcgagatgcagagcgccgtggctttacggccgggccccactcggctgctggtgagcagcccttgtcggccgctcctctcgggccgcccgattagtgtctccgccgttggcgccgtcgctaccagaagcagcgccgtgggccctagcggtctggggctcggtctgatgccagcctagaccgatcgggatggcacgtgcctgcagcgacaggtgtcatgcatgcgcggccggggatgctgtggcggccccagctgcagaagacggatgctgactcatga

SEQ ID NO: 36253 - DNA, 427 bp, Zea mays
  Clone ID: LIB3060-010-Q1-K1-C6
gcagtcaccaaaccaaaaccgctctcgagtctccatgcattctctccgatcatccggaggtgtcgagtctccagctctagctagccttagcctcgagcaagggacgaaggggccaccatgagcgtggtgatcctggacgggtccacggtgcgcggattcgtggcggacgaggcggacttcgcgcgcagtctggacgcgcggttcgccgcgctggacgccaacggcgacggcgtgctgtcccgcgccgagctccggcgcgcgctcgagtccttccgccttctcgacggcggcggcttcgggtccggccagccggcgccgatccccgccgaggtcgccgcgctctacgacgccgtcttcgagcagttcgacgccgaccacagcggcgccgtcgaccgcgccgagttccacgacgagatgcgccgcatca

SEQ ID NO: 36254 - DNA, 424 bp, Zea mays
  Clone ID: LIB3060-010-Q1-K1-C7
caaggtctcaaactctcaaataattgatgaaatgaactaattaattaatgaactgaatctatatccaacatgatatacatagtacaccgggctcgcgtggctgttcctgggcgtcccgaccagcgacaccctgctgtacaaggaggagctggagaagatgaaggagatggcgccggacaacttccggctggacttcgcggtgagccgagagcagacgaacgcggccggggagaagatgtacatgcagacgcgcatggcggagtacaaggaggagctgtgggagctgctcaagaaggacaacacctacgtctacatgtgcgggctcaagggcatggagaagggcatcgacgacatcatgctcgacctcgcagccaaggacgggatcaactggttggactacaagaagcagctcatgaagagcgag

SEQ ID NO: 36255 - DNA, 425 bp, Zea mays
  unsure at all n locations
  Clone ID: LIB3060-010-Q1-K1-C8
gatccggaagttctgtgggtagaggactagagactgcagatcgagggtctggcagcgggccgtggcagttgggtgattacgacgaagagagatgggcctcctcgacaagctgtgggacgacaccgtcgcaggcccgcgcccggacaccgggctcggccgcctccgcaagcagcctgtgcgttccgccgtcgtcaagatcagtgatccggccggggacgctgcggcgttcgtgccgacctcgccggcttcgggtagcgaggagacgccggtgaaggtgacgcgcagcatcatgatcaagcgccccgcggggtacccgtcgtcgccgaggagcgcggcaagcacgccaccggcctcgccactggggactacgccgnccatctcgccgtttgccggcgccggtggtcggttcagaaggaaatcatcgt

SEQ ID NO: 36256 - DNA, 90 bp, Zea mays
  Clone ID: LIB3060-010-Q1-K1-C9
gattcccggccgacccacgcgttcggatcctgaagttttgttgcaagttttactttatactgcatatcaacgtaataacaggggggctaa

SEQ ID NO: 36257 - DNA, 417 bp, Zea mays
  unsure at all n locations
  Clone ID: LIB3060-010-Q1-K1-D10
cggagtagtacgtggacgatgccaatcccagcgtttgtgtttgtcgcccatacgcctgcccctctttccccctctccgccttgactcactcacttagccactcttcttcctcctgatcaatccgctctccagcacttgttcggaagaaaaagaaggtagaacacgctaacgagacaacaaggatcatggggcgcgggcgcggccacctcctgctgccggcagcagccgcctgcctgtgggcgctgtcgtgcgcgctgctgctgcgcgcgtnccctcaccgcgctggcgccggcgccggcgggctgctggaggtcgggctcagcaagcgcggcggcgggctcgaccagcgcgcgctggcggcggccaaggccgcgaggcaacaagaagcaagccgtctcggggcctncggcggcggcg

SEQ ID NO: 36258 - DNA, 433 bp, Zea mays
  Clone ID: LIB3060-010-Q1-K1-D11
caagcaaagagtggtgcagcttgtcaactcaacatcggatgaggacctattaagtcagggccttacgttgaatgatgatttacaacgtgttttagcaaagcacgatgcaattgctgctggcatagccattcgattacaaaaaccaaaatcagccccggcccgcgcagacagttctccaacgaagcctgagccgacaaaggaaacagaacaaaggtctgctaaagttgccagtagtgtgactccatttgagcagttagcacttcctgcaccaccatcatcaagtgcttcaaagtctcatggagaatcagctgttagcccaaatattgatttgcttagtggtgatgagttttttaaaccagaacctgttcattcccaagctcttgttcctttagtcactcaggcttcagcttcttcaagccccagtactttagac

SEQ ID NO: 36259 - DNA, 420 bp, Zea mays
  Clone ID: LIB3060-010-Q1-K1-D12
cggacgcgtgggcggacgcgtgggcgcccttctggtacaccgccggcgagcagcagtacttcaccgacaccaccaccctcttcatcatcgagctcatcctcatcggctgggccgagggccgccgctgggctgacatcatcaagcccggaagcgtcaacaccgaccccatcttccccagcaacaagctcaccggcaccgacgtcgggtaccctggtggcctctggtttgacccgctcggctggggcagcggctcgccggagaagatcaaggagctgcgcaccaaggagatcaagaacggacgcctcgccatgctcgccgtcatgggcgcctggttccaggccgagtacaccggcaccggccccatcgacaacctcttcgcccacctcgccgaccctggccacgccaccatcttccaggcct

SEQ ID NO: 36260 - DNA, 205 bp, Zea mays
  Clone ID: LIB3060-010-Q1-K1-A1
cggacgcgtgggcaaagccaaggcgcggtgcagccagagtaagcagagagttgcactaccgtgcttcttcagttcttcttcctagtatgcactcgcttgtgaggcgtggcaatggctacggctacggctatggtggttacggcagcagcaatccccatatgaactaccaccgccaaaacaccgagtccgtgaccaccgtcgtcac

SEQ ID NO: 36261 - DNA, 427 bp, Zea mays
  Clone ID: LIB3060-010-Q1-K1-A10
cttgaccgtggcgagaagattgaactgcttgtcgacaaaactgaaaatctgcgttctcaggcacaagatttcaggcagcagggcaccaaggtgcggcggaagatgtggctccaaaacatgaagatcaagctgatcgtgctgggcatcatcatcgcgctcatcctcatcatcatcctgtcggtgtgccatggcttcaagtgcggcagcaagtgaggagggggacttacggatggccgtgccctgccctgccctgccctggcacctgcgagaaggaggagactacatgtggagttttttttttttgcttctttagtcgtcgtgttaagtcgtcctgcgccgataattcttggtggtcaccagataaagagtcattcctggtgtcggtgttgattgctgttggttggtcgggaaatgactgggtgaaccg

SEQ ID NO: 36262 - DNA, 401 bp, Zea mays
  Clone ID: LIB3060-010-Q1-K1-A11
caccaagagcaccaaggggtggtggtggtggcggcggcggcagcagctttgtcgattcagggaacaaggtatacgtggggaaccttgcatggggcgttgacaactcgactctggagaacctattcagtgagcaaggacaggtgctggatgctaaggtcatctacgacagggatagcggcaggtcaagggggtttggtttcgtcacctatggctctgccgaggaggtcaacattgccttatcaaacctggatggcttaacctggattgtagaccgatcccaatcacgggtgcagaatcaaagcccaggcgtgaattttgagattttgttaaagtggtttagaggtcaatagcgtgtgttcacaaggtctaagttggaaccggtattctttctttcgtatgag

SEQ ID NO: 36263 - DNA, 405 bp, Zea mays
  Clone ID: LIB3060-010-Q1-K1-A12
ggcctccctctcctctgccgccgtcaccgccccttccttcgccgcaccagcgccagcccgcgccgtggtcagaaggaggtccttcaccgtgcgcgcctctctccgcaaggccaccggcaccgccgccgtggcaatggctgccagcgccctgcttgccggcggtgccatggcccaggaggtgctgctgggcgcaggcgacggcgggctcgtcttcgagcccagccagttcaccgtcaaggccggcgacaccatcacattcaagaacaacgccggcttcccgcacaacgtcgtcttcgacgaagacgaggtgccgagcggcgtcgacgccaccaagatcttgcaggaggagtacctcaacgcgccaagcgagacctactccgtcaccctcaccgtgccgggaaccta

SEQ ID NO: 36264 - DNA, 424 bp, Zea mays
  Clone ID: LIB3060-010-Q1-K1-A2
cttgctctctatttcagatggcctgcataagaaggagttccttaattatgctaaattcgtgttgtggtggatttcattaggtgtggcttcatcaattggactaggttctgggttgcatacatttgtgctgtatctaggtcctcatattgctctgttcactattaaagctgttcagtgtggccgaattgatttgaaaatggctccatatgataccatacagcttaaggttgggccatcatggctcgacaagaaatgttctgaatttggtccgcctgtgtatccagcatcagctcattctgttaggatccccgtctttgatttactacctcagatacagctggaagcagttctttggggcattgggactgcacttggcgagcttcccccttattttatatcacgagcagctcgcttatcaggaagc

SEQ ID NO: 36265 - DNA, 426 bp, Zea mays
  Clone ID: LIB3060-010-Q1-K1-A5
aaaaaaaaaaaaaaaggggtatggggcaattaatgactttgaaaacgcgaaatagctgatgagggaagttgttgttgagaaataggaaagtggaatgaaatccagtcttagtcaaatatttcatatctcttctcttcttgtccaaacagaaggaaaaggagacaatttgagctgagcggaaaatccatatctctcttatccatttagagcatatggatcgatttataagaatcgaatgttttgtttttatgttattttgtgatagaatgaaaaagaattctatatagaatgggttgggaattatgcctagatcccgtataaatggaaatttcattgataagaccttctcgattgtagccaatattttattgcaaataattccgacaacctccggggaaaaaagggcatttacttattatagagatg

SEQ ID NO: 36266 - DNA, 427 bp, Zea mays
  unsure at all n locations
  Clone ID: LIB3060-010-Q1-K1-A6
cgaaaaggaaaacttgtgcctttatggctaccccaacgaaacatgggaagtaactttgccagcagaggaagttcctccagagatccctgaaccagctttgggtataaactttgctagggatggcatgaacgagaaggattggttggcgttagttgctgtccacagcgatgcctggttactagctgttgcattctactttgcagcccggtttgggtttgacaaagaggccaggcggcgactcttcaacatgataaataacttgcccacaatatttgaagtagcgactggggttgccaagaaacaaaacanggagaaggaacccaataataccagcaaaagcaacaaaccaagttcgaaaatgacaacaagacccgagtctcatttgaaggcgacaaaagtggcgccccctaaggatgaagatgatgag

SEQ ID NO: 36267 - DNA, 405 bp, Zea mays
  Clone ID: LIB3060-010-Q1-K1-A7
caattggcgttggccgaagaagaggagaagcgaagcaagcaggcttcgagaacaagggggagggggaggaccaagcgaaagggggaactagagcaagatgggcggcgaactgctgcttgcgctcctcctcgtctctgctgctgcggcccttaaggtccttgaagttggcattggaaccattaccttggaattaatccagaaggccttaatggaaccagtaaccacccatccaatgcctggttgaacagcttacacttaatcctacactttacaatataccattgcgcaatttaagcacatacttggagtgaaaccagcaccacagaatgcactaagcaatgttcctgtcaaaacttattcaagatcactggaactttcaaaagagtttgacgctagatctgcatg

SEQ ID NO: 36268 - DNA, 406 bp, Zea mays
  Clone ID: LIB3060-010-Q1-K1-A8
aagggaagggaaccctcttgaccgccggcggcgaggggagatgccgccggagaggacgaggaagtcgaggacggaggagctgtgggagcgcgaggtcggcggtctcccacccaagcgcttcgccaactccgtcatggcctccaaggagtttgtgcagtctctcaacatccaaaagcggctacggaagcacaggagttgcgtcaacacgataagcttcagcgcggacgggaggctgctcctctccgggtccgacgaccggaccctcgtgctgtgggactgggaggaggcggcgccggccttgtcgttccacactgggttcagcagcaacgtgtaccacgcgctgttcatgcctgtctccggtgacaggagcatcgtctcgtgcgcttgctgaatgggatgtgatcca

SEQ ID NO: 36269 - DNA, 428 bp, Zea mays
  Clone ID: LIB3060-010-Q1-K1-B10
cacgcactagtacgtagtaagcgagcttagctactgatcgtcgtcaagcactcgagctcgatctctcgaagcggctagctgctagctgctagcagccaattaatggcgaagccttcgcaggtgctggtgtcggcgctcgccgcctgggcggtggtcctgctgctgctgtgcgccgccgcgccgcggggcgccgacgcagccacggcgtgcgacgccgcgcagctgaccccgtgcgcgggcgccatcatcgggagctcgccgcccaccgcggcgtgctgcagcaggctcagggagcagcagccgtgcctgtgcacgtacgcgcgcgaccccaagctgcagcgctacgtcagctcgcccaacggcaagaacgccatggccgcgtgcaaggtgcccgtgccgtcgtgctaatttaaacttctgttagcgcc

SEQ ID NO: 36270 - DNA, 436 bp, Zea mays
  Clone ID: LIB3060-010-Q1-K1-B11
gcggcggggagggagacagatgcgggaggcccaccgcggggtcgccggaccagatggacacgccggataggccccgcgccggcgccggcgccgggttcgaggattctcctgtgttcaatttcatcaacaatctctcgcctataccaccacctaaacctttagactcagcacataatgtgcagctattcaagtcatcagatttggcacctgtttcttcgatctttgcctcaccacatgttaatccaacaaagggaactaaagttctgatcagggacgaatctgttcagcttcctcatgaattgcactcacctagcagtgtcagaactcggataggcacctcaggctcttttagaatgatcagatgcaaagacattgtgccagagaattgtaatatcacttgtcaactaaacgaggcatctattgattcttcagatca

SEQ ID NO: 36271 - DNA, 430 bp, Zea mays
  Clone ID: LIB3060-010-Q1-K1-B2
ggcagccggattccgaagcgcaccccctcggccccagccaaaagcatcgcagtttctaatcgtttggagagcacacaagaatgtcgttcgtgcagctctctggtgctggagtcgctgcagtggccttcacgaacaagagcctagtctctcggcacgcagcgctacgggtctgctcgtcgaggcgctcgatccgtagcctggtcgttaaggctgcaactgtcgtcaccccaaagtacacttcactgaagcctctgggagatagggtgcttgtgaagcttggtgccgcagaggagaagacagttggtggcattttgcttccatctactgcccagactaaaccacaaggaggtgaggttgttgctgttggagcaggaaggaccatcggggacaagaaaatagctgtggatatagagactggagcacaagtagt

SEQ ID NO: 36272 - DNA, 427 bp, Zea mays
  Clone ID: LIB3060-010-Q1-K1-B3
cgacgagcagagggccccccggagcggctcggagcaatggcggcgggataccgggcggaggacgactacgactacctcttcaaggtggtactgatcggcgactccggcgtcggcaagtccaatctgctctcacgcttcacgcgcaacgagttcagccttgagtccaagtccaccatcggcgtcgagttcgccacccgctctctccaggtcgacggcaaggttgtcaaggcccagatttgggacactgctggccaggaacgatatcgtgctattactagtgcgtattatcgaggtgctgttggggcgttgcttgtatatgacgtcactcgtcactcaacctttgagaacgttgagcgttggctgaaggagttgagggaccacacagatcccaatatagttgttatgctggttggcaacaaatctgatc

SEQ ID NO: 36273 - DNA, 428 bp, Zea mays
  Clone ID: LIB3060-010-Q1-K1-B4
gtcggaggtggaggacgaggcggcgacgtcgctgctcgccaacggtgcagccgacgtccgccggaggagggaccaggcgaaggcaattctgtccacgcaggccgtcaggatcgccaccaaggccgagcagcatgagcgcttcatctttaaggtcacacacttgctgggtgttcttggatttgggggattttgctatctcttgggtgccagaccacaggatgtgccatatgtgtactgcctgttctatgtcatatttgttccgctccgctggatttactaccgctacaagaaatggcattactaccttctggacttctgctactatgccaacacctttctccttgtaatgattctcttctacccagaggatgaaaaactttttatggtttgcttctcgtttgcagagggtccgcttgcttgggcattaa

SEQ ID NO: 36274 - DNA, 332 bp, Zea mays
  Clone ID: LIB3060-009-Q1-K1-H7
actttgaggagagacgagatcatgaggaagcaatactcccctgtgctctccttgtgcctgatggcccttgtcgtatctgctatggtctgtgtcatgtacaccacctcggcacaagcaggaaggagtggctacaactcgtacgaacctgatggaaggggtggatacaactctgttcccatcaacggcggtggcagcccctagctaggcggtggatcggagcctgtatcagaaatcgaaataatataagactgtcttcaacggatcacactgtcgctcccccacgctaagattgggggctacagtgcacacgctagccgatcaacggctcacgc

SEQ ID NO: 36275 - DNA, 347 bp, Zea mays
  Clone ID: LIB3060-009-Q1-K1-F1
gacagagctcttccctcccacacgctcgtcgctctgtccgccagaaatctcgtcgctggtagaagagaatcgtgccatttgtcatgtcaggaggatcttcaccatcatcaatgcgaaacagctttaattctttgtctaaggacctagaccttccttcagagcaaggttgtctctccattgttgtacttggggcttgtggtgaccttgctaagaagaaaacatttccagccctctaccacctctttgagcagggattcatacaatctggatgagtccatatatttggttatgctagatcaaatctttctgatgatgggttaagagaacgcattcgtgggtattctcaa

SEQ ID NO: 36276 - DNA, 239 bp, Zea mays
  Clone ID: LIB3060-009-Q1-K1-F10
agaacagtagttgaagtttgtagggacttcttgaagaacatgtgcaatagagaatcctgccggtttttacaccctgggacacatacagcggctgcgagcgccaatgttgaagtatgccgtgattttaaacgaggagaatgcaatcgacctgtctgtcgctttttgcatccatatacaagttgaagttttctgttagctaaacttgagtgctctgcctaacgttgcctgtactgttgtgc

SEQ ID NO: 36277 - DNA, 384 bp, Zea mays
  Clone ID: LIB3060-009-Q1-K1-F11
accaagagagtacgtggaggagcagccatggcttcatcggtggccgccgcggcgagcacattcctgggcacccgcctggcggacccggcgccacagaacgggcgcatcgtggcccggttcgggttcgggttgggcggcaaggcgaagcctgctccgaagaaggtggcgaagacatcgacctcctctgaccggccgctgtggttccccggcgccgtggcgcccgactacctggacggctcgctggtcggcgactacgggttcgacccgttcggtctcgggaagcccgtggagtacctgcagttcgagttggactcgctggaccagaacctggccaagaatgaggccggcggcatcatcggcacccggttcgagtcctccgaagtc

SEQ ID NO: 36278 - DNA, 247 bp, Zea mays
  Clone ID: LIB3060-009-Q1-K1-F2
gtcctttcgtccagtccccagccctgcatcccaaccgtggaggttctggaaggcggtgtatcccttctagaacctgctcgagatgcagagcgccgcggctttgcggccgtgccgcactcggctgctggtgagcagcccttgtcggcccctacggtcggcccgcccgcttagtgtgtccgccgctggcgccgtcggtaccataagcagcgccgtgggccctcgcggtctggggctggggctgctgcca

SEQ ID NO: 36279 - DNA, 394 bp, Zea mays
  Clone ID: LIB3060-009-Q1-K1-F6
gctttctctggagcagaaatcaaagaccaactgttacgcatgaagctgcaagacactgcagaggagattgctaaaaggcttggacaatgccctttggcagcaaaagttcttggttcccgaatgtgcaggagaaaggatattgctgagtggaaagctgctctaaagcttggagatttaagtgatcccttcacatctttggtatggagctactaaaagttagatccatgtctgcaaaggtgcttcttgtattgcagcttgtttgcaaaaggtcacggatatagacctgataagttggttcacctagtggtggcagaaggatttattggttcatgcaatttgagtaggagaacagttgaagatggtgggatggattacttcaatggatatggtctct

SEQ ID NO: 36280 - DNA, 227 bp, Zea mays
  Clone ID: LIB3060-009-Q1-K1-F7
cccacgcgttcgagcgcatgcatgtagctttggcggtggagacgaagaagggcctggtgctgctggacttctgggtgagcccgttcgggcagcgctgccgcatcgagctggcggagattggcattggctactagtactcggagcatgatctgatgggcggcgccaagagcgacatcctacttcgctccaacccggtgctcaagaagatccccgtgcttcttcacgac

SEQ ID NO: 36281 - DNA, 422 bp, Zea mays
  Clone ID: LIB3060-009-Q1-K1-F9
gcgcctcgcgcgcccacccaccttcacgcgctctcccagctagatcgaccccactggcgatcgcgcaggctcccctatcccttcctgttccttcaaaaagactggactggatcttcccagagttcccgttcggagagccgccggatcttcttcgacgaggcttcgatctgctgctctccgtcggcgtgttggggacttgcaccttatccgaagatgtcttttcggagcatggttcgcgatataagggaaagttttgggaatatatcgaggcggaactttgaggtgagaattcaccacagagggaagtctcttgggtcttcaagtgacttgcaagacaggcctgctgaagttcagcaaagcaggtgggctagccttcctcctgagttgctctgcgatgtgatgaaaaagttggaggaagatga

SEQ ID NO: 36282 - DNA, 427 bp, Zea mays
  Clone ID: LIB3060-009-Q1-K1-G12
gctagcgcttatagcttgtcagccatggccaccgccgccgcgtctagcctcctcaagtcctccttcgcgggctcccggctcccggccgccacgcggaccacaccggcgtccctcgtggtggccaccggcccgcgcggcgccggcgcggggcccatctgcgcgtccatgtccatgtcctcctccaacccgccctacgacctgacgtccttccggttcagccccatcaaggagtccatcgtgtcccgcgagatgacccgtcgctacatgacggacatgatcacctacgccgacaccgacgtcgtcatcgtgggcgccggctccgcggggctgtcctgcgcgtacgagctctccaaggaccccgccgtgagcatcgccatcgtggagcagtcggtgtcgccgggcggcggcgcgtggctgggcgggcagc

SEQ ID NO: 36283 - DNA, 168 bp, Zea mays
  Clone ID: LIB3060-009-Q1-K1-G4
cccaatccaaaccagacaagcaaggaatcccccgatggctcatcgcgttctcctcctgctctctctcgtgtcagccgccgcggttgccgccgacgtcgacgcgtatgacccgctgatacggcgattaggtcccggtggagatgacatcgatctggagctgaacgcgga

SEQ ID NO: 36284 - DNA, 421 bp, Zea mays
  Clone ID: LIB3060-009-Q1-K1-G6
caagtgcgcgaccaaaaagctcggacatcctgcgcgactcaagttcaattcgtcgaaattattcaatcgaagaaaagatcttcagcaattaattaccgaagaaaagaaggctcctgtatgacatcaaccggaacccgtagtcgtgcttgcgactatcgcgtcgaattagtcagggtaagttggttcgtattcccattaactaggtctataaatagattaaatagaattgttggtcacaataaatattattaatttagcatgcgtatattgtgatgattgatttagataactcgctaaatcagctaattaagttacacagtttagagagttaataaaaagcttataattaatatagattttctagggtaatatgtcaattagattaatggatatagtcgatgtcctgctgtgatatccatgg

SEQ ID NO: 36285 - DNA, 393 bp, Zea mays
  Clone ID: LIB3060-009-Q1-K1-G9
caagcttcctccgcggcctcccgtcgagcaaccatggcggcggcggtaaccctcctccggcttcctctcgcccgactctcctaccacctccgctccgtaccttcctctcgtctgccgtctccgcgcctacgtatctttgcctcccatcgccttttctcctccctggaccatgtctccgcctctgcttccgcctccgcggccgtggccgaggttgtaggcgtgccggacgcggaggagtcggtagaggaggaatctgcggccgaggcggaggcggaggcgcccaggtcgttcgtgctcccacggctgccgcggccgaagctgagcgtgaaggagcggaaggagctggcctcgtacgctcacggcctcggcaaaaagctcaaatcgcaacaggtc

SEQ ID NO: 36286 - DNA, 406 bp, Zea mays
  Clone ID: LIB3060-009-Q1-K1-H12
ggccacgttcctgggaagctcaccggcgctcctcgcccgtcccatcgccaagccccacatctcctgcgcgcagacaccgcgcccgccaagcgcccagaaccagccgccgtccagcgagcaaccgcaagcacaaacacagcagcagtccgtgcaagcgcagccacagcaggcggcggcgaggccgaagcgcgcgggcggcgcggactccacggactgggtggcctcgtcgctgacgcggcggttcgggatcggcgcggggctggcgtgggccggctttctggccgtcggcgtcgtgtccgagcagttcaagacccgcttcaaggtcgcgcaacagcaggccaacaccaaggacgtggaacaggagcaggaggtcgtcctgcccaacggggtccggtactacgagatg

SEQ ID NO: 36287 - DNA, 331 bp, Zea mays
  Clone ID: LIB3060-009-Q1-K1-H2
cacgatggagagaagccttcctcgacaatgtctcgttccacagcagccagttctctgtcaaggagttgccggacaacaccggggagttctccaccctctaccacggtgttcccgggcacctacccaatcctgacgacgaagcctccgagtccattctcttccgggtgaagatggtctgccgtatccacgggtcaggcgacttggttctcgactacgaggtaaaccccaggagcgacctacctccccttccccgggtggtcgtcgtgttcagctgcgagaggtccctgagccacgtcacgtggtacgtgcgcgggcccttcgagtgctaccc

SEQ ID NO: 36288 - DNA, 376 bp, Zea mays
  Clone ID: LIB3060-009-Q1-K1-H5
atcccttccttctcctcacccagcagcagccggtcggcctcggctagatctcgccggccgcctccaattggttgtccactgtggccgggccgaggggtacttatctataggcccgcagatctgcgcctgcgcccgtgggaatctccgcacctcgctatccgtctcttggatagatcgatcttccgtcgctggttccccttcgccccacacgagtacttccaaggaactggaacttccagccggcacggggattcgagcttctgctctatcagcaactccactgggcgctgagggtctgtagcagagcggtgcgatcggggcagaagggagccatgatggaggggcaagcgtggctggcgcttctggtcgtggtggc

SEQ ID NO: 36289 - DNA, 232 bp, Zea mays
  Clone ID: LIB3060-009-Q1-K1-H6
ggcgggcgcggtgcccagggacgcgcgctcgtcgcacaactgcctgtaccgcgccgtggacatgtacctgaagacacacccggtgctggacgagatcgagtcgggagaaggggtgcaacgttatggacccgctcaagctgtcgtaccaggcgcggatgcacgcgtcgcataacaagcggctgccgctgcatgccgtgctcagcgtgctctactacgaccagctggagatccg

SEQ ID NO: 36290 - DNA, 437 bp, Zea mays
  Clone ID: LIB3060-009-Q1-K1-E9
gcgagtgagtgaacaccagccgtattgtcccgaccccgaccgatcctcgcctgctgcagccatggcgacctccgcggcgctctccaccgccgccaatcccacccagctctaccggtcccgcgctttgctgggcaagccggtgaaggggcttggcctgagcatgggccgcgagcgcgcccagcggagcattgtgtgccaggcggcgagcagcatcttcgccgaccgcgtccccgacatggagaagcggaagctgatgaacctcctcctcctcggcgccatctcgttgcccaccgtcggcatggtcgtcccctacggcgccttcttcgtccctgccggctccgggaacgccggcggcgggacctacgcgaaggacaagctgggcaacgacatcacggtggaggcgtggctcaacacgcacggtccccaagaccggacgc

SEQ ID NO: 36291 - DNA, 373 bp, Zea mays
  Clone ID: LIB3060-043-Q1-K1-H8
ggcatgcatgggttccctaggctcaagcaccattagcagcatgaacatggcgaagcaggcagccaccaccgttggtgctaagaacggcgctgttgctgtcgccgatcagcagaaagtagagggccccaggacgatgaactgcagtagctacaccttccacatgccgctgcactacccgcggtacaagaaggctgactacgagagcatgccggagtggcgcgtcgactgcctgctccgcgagtacggggctcccgtcgacggcgaactcgacagcaagcgaaagttcgccatgggcgccttcctctggcccgaccagtactgaaggaacccgtggcccgagctgaagctgctgagcctgagctaacaagagatg

SEQ ID NO: 36292 - DNA, 394 bp, Zea mays
  unsure at all n locations
  Clone ID: LIB3060-044-Q1-K1-A1
agaagacgagtgtcaagtgaacctgaaacttgcggtgtcactggctggtatagcctgagtgtgagtgagtgatcgagctagctgaagctccgatcctcgctagctagctaggataccgccataccacaagtcttcttcacaagtttaggagtgacagcaacaagagatctcgatggcctctgccaccgtgctcaagtcctccttccttcccaagaagtccgaatggggcgccaccaggcaggccgccgcgcccaggccgnccaccgtctccatggtcgtccgcgcctccgcctacgccgatgagctcgtgaagaccgcgaaaacgatcgcgtcgccggggcggggcatcctggcgatggacgagtcgaacgcgacgtgcgggaagcggctggcg

SEQ ID NO: 36293 - DNA, 423 bp, Zea mays
  unsure at all n locations
  Clone ID: LIB3060-044-Q1-K1-A3
actgaaccaccgacagacaacatggccgcctccgcctccaccgtctccggcctcgcgggcgcctccctggccagccgcccggcgttctccaccagcttcacgcggggcagccgggtgtcggcgaggaaccccctgatgagcaggaacctggagaggaatggcaggatcacctgcatgacgtttccccgggactggctgcggagggacctgagcgtcatcggcttcgggctcatcggctggatggggccgtccagcgtcccggccatcaacggcaacagcctcacggggctcttcttctccagcatcggccaggagctggcccacttccccacgcccccgcccgtcacctcccagttctggctgtggctagtgacgtggcacctgngcctgttcatcgtgctcaccttcggccagatcggattc

SEQ ID NO: 36294 - DNA, 405 bp, Zea mays
  Clone ID: LIB3060-044-Q1-K1-A4
ccgctcctctcacaacccagtcgctcaaaaccctagagctctcgcctgctcgcctcggccgccggagcgagctccccatcttcatccgtcaaccatggcgacccagatcagcaagaagaagaagttcgtcagcgacggtgttttctacgccgagctcaatgagatgctgacgcgggagctggcggaggatggctactctggcgtggaggtgcgcgtcacgccgatgcgcacggagatcatcatccgcgccacgcgcacgcagaacgtgctcggcgagaagggccgcaggatcagggagcttacctccgtcgtccagaagaggttcaacttccctgagaatggcgtcgagctttacgccgagaaagtcgtcaaccgtgggctctgtgccatcgcgcaggccgagtc

SEQ ID NO: 36295 - DNA, 247 bp, Zea mays
  Clone ID: LIB3060-044-Q1-K1-A5
ccacgcattcaactcaaccaccaacaaacaacattttcttcttcccctccactctctccttcctctcggacggatctctttcaaacctacctattctcttcaacatattaactcctaactaccatataaccctacaaccccccttcaccatctacctccatacctacatcaccatcacatacaatacttatcctcctcactctcttcctatcctcatatacctcatcctctctactctcaccatctc

SEQ ID NO: 36296 - DNA, 401 bp, Zea mays
  unsure at all n locations
  Clone ID: LIB3060-044-Q1-K1-A7
gcacgcaacgatgcccttcttgctcacgccgggcgctcgggcggtgccctcagcgtgaacgctctcgcgcctactgcttccgctccacctacaaattactaatggccggcataaccgtcacgtccccgcctcccccctcctataccctcgcctccgcaaccgccgcagacgattcttcgcggcctcctcctcctcctcgcctcagatggcggcgcctgccgacgccgccggtggctcctctgacgcgttcgaagtgatccgcgttcaccaggcaaaagctgttcgtctttctccagctgaagaaatacggaccattatggaccgaagtgtcaaaagtgttcttgctacccattctcaggattatgctggntatccatctgggtcatgggttgattttgcat

SEQ ID NO: 36297 - DNA, 421 bp, Zea mays
  Clone ID: LIB3060-044-Q1-K1-A8
cccgctccttgctcgcctccacccgcggccaccaccgccctgcggcccccgccgctggctagcctccaccgcgccgcgagtcacgccgttcatgcaccggctggtcctggagcacgggaggacgagcatgtcctggttcggccccagccccaaggtgaccatcgtcgacccggacctggccaaggacgtgctgtccaacaagttcggccacttcgagaagctcaaggtcccggcgctgtccaagatgctgggctccggcgtggccagccacgagggcgagaagtgggtcaagcaccggaggatcctcaaccatgcgttccatcttgagaagctcaagcgcatgctgccggcgttttctacgtgctgcgaggaactggtgagcaggtgggcggcggagtcccttggctccgacggctcgtgc

SEQ ID NO: 36298 - DNA, 275 bp, Zea mays
  Clone ID: LIB3060-044-Q1-K1-A9
attcgacctcaccttgccaccagccatggctgccgtgaccgccgcggccatctctgtgtcgggctcctccgcctcctcccctgcggctgctgccaaggccaaggcggcgtccccgtcgtcgtcgccatgcaggcacctccagttcctgtcggcggcgagcccgcggcggcggtggcgggccggcgcccgcgcggtgcgggcgcaggtgtccaccaccgagaccgcggcggctgggccggcgaagacgttcaagaagcatgacgaagggcttgtca

SEQ ID NO: 36299 - DNA, 432 bp, Zea mays
  Clone ID: LIB3060-044-Q1-K1-B1
gatcaatatatatgtggaacgccattatatcatgtggagattcccagaactgcagagcttgctgaaagaggctgctcttttggtgattgaatcactaaagcaggataacagagaagccctggactgggcttgtgttagaaaagaagcattctcgtcagacaagaatgagtactctcatctgcttgtttcagacttcactgacacaacgccgtcgctcccaccagaagaactgcgaccatttatggtcggtccaggaatgttgcatgagatgccacctgttgaacaagaagctggacccgagagactccgtgctcctcgtgaagtcgctgggcgtaatcctgcagtagtcttccttgaatcactgctcccatgggtcgactatggtgacaatcatcaaggtgcaaatgacgacgacaacgacgacgaatgatc

SEQ ID NO: 36300 - DNA, 350 bp, Zea mays
  Clone ID: LIB3060-044-Q1-K1-B10
cacgaataaatctgagctgatttctgtgaaatttatatgcgaaccccttgaaattcgtgtggtccaaacacggcctaaaagaactttgtctagagaaaccctctaggtaacacagacgcgcaaaccttcaagtatcgatctcagagaggacatgcagaagatgatttgcagtttgctgcggggtaggctcctcagggcctttgggactgcttttgtcttcgcctgactccaccttttatttttgtttgaacttgctaccagctggatacttccagagaatccgtacagtacagcccttggctgttgaattccaagtcttcgctaaatgaaccattcagacatcgccatct

SEQ ID NO: 36301 - DNA, 375 bp, Zea mays
  Clone ID: LIB3060-044-Q1-K1-B2
ttcccatctctacccactcatccttatcaatatatatctctaactccattttatcatgtgcacattcccaaaacttcatagctggcttaaaaatacttctcttcttctcattcaatcactaaatcactataacatataacccctccactctactttttttacaaaataatcattctcctcatacaacaatcaatactctcatcttcttttttcatacttcacttacacaactccatctcttccaccataataacttccaccatttattctcaatccatcaatatttcattaaattccaccttttaaacaataatctttaccctaaaaacttcctactcctctttaattctctcaaccttatccttcattaatctt

SEQ ID NO: 36302 - DNA, 427 bp, Zea mays
  unsure at all n locations
  Clone ID: LIB3060-044-Q1-K1-B3
gctggcgaaggcgcggcgcgcagggccagtagcaaccctcccatggcctacgctgcgcctgccatggcgtcgtccctcaccggcttccaaccccctctttccccgtcccacctcataacccatccgcatcggttccctgcgcgccccaaccccaccaccggcctnctccggctcaccccgtctcgccgccgcggtcgtccccccgtggccgtccgcctcgcaatatctgcctcgtccacctcagccccgcccccgtcggcggatcggtcggaggccgcgtcgtcgctggagagatacctctcggcgacggtgacgggagcggtgatgggaacgggggcgaccccaccagcttcggccccgccgcgcgccccgccggcgatgaaggggggacggaagcagtatagcgcgttgggggctgtcacgctcg

SEQ ID NO: 36303 - DNA, 399 bp, Zea mays
  unsure at all n locations
  Clone ID: LIB3060-044-Q1-K1-B4
cttctctagttctctgatcctcagcacttagcatcaagcttagcacaccggcgagagggggtccacctncaccttcctgtccaccctcgccagcaggtccgcggcagccgatagcctgcgcagcgccgtgccgtccttcgccaagatcgtcaggttcttgcccgcgcaggcgcagatcagccgcaggcggcgcgcggcggtgctgcccacgccgagggcggcggtgtcgggcaccgagaaggcgccgtcgagcaagcacgagcgcgtggtcagggtgcacagcacccaggagttcgacgacgcgctcaaggccgncaagaaccggctggtggtggtggagttcgcggcgagcgacagcgaggacagcagccagatctacccgaccatggtgcagctcag

SEQ ID NO: 36304 - DNA, 121 bp, Zea mays
  Clone ID: LIB3060-044-Q1-K1-B5
aaaatcctcacccccttccacccacctctttccttatcccacctaataacccatccatatcactccccttctctctccaaccacaccacctacctccttcatctcacccactcttctcaac

SEQ ID NO: 36305 - DNA, 449 bp, Zea mays
  Clone ID: LIB3060-043-Q1-K1-H7
gggaagggagcggaagagaggtgggtgaccgtcgctcctccgtccagccttccagttccaggcgtggcgaactacgcaagcggcaagctcaccgctcctcgagtgaggcccaggttccgtcgccgccgtactcagcagcggagaccggcgagtcaacaggtagtagagggggaaggaggggagcagttcctgttcgcccggtcaccgcgcggcccgagcaatcccgctgctgcgtccgcctcagtttgccgtcgccctgttgcacgtacggctagggtttggagatagatccgcccgcagcgcccgccagctcgtgtggaggcgcgccgtggtgcgggggttccttgctccggaagcttcagggcgtgcgaaccggttcggtcgcaatgtcgggatcgtcggcggcaggggaggacatagtgcagcacctatcgtccaattctaacccg

SEQ ID NO: 36306 - DNA, 299 bp, Zea mays
  Clone ID: LIB3060-043-Q1-K1-G1
tataatttcaattatgattacattgactctcctacctctatagatgcagaactttttaactaatcataattgaataatcacaataattaaattaataataaaaatactaactttttgtaatcccatcataacaaatatgaatatgatattcttcatcttgataactcattgtttgattccctttatgctccactggagttttacacttaggtatggtctgcaatatctcctgacctatatgcgcctttgtttttcacaaataggtctgctggttgttgcatggattattttcctacata

SEQ ID NO: 36307 - DNA, 402 bp, Zea mays
  Clone ID: LIB3060-043-Q1-K1-G10
gttgatatgtggcacccaaaattatacaacatccaagtggagagagaataatggtgagtcatgttgattatgatcaacgacctgatatctttaggggaacaattagatatgcgagtgtccatgctcatttggggtgcactggtagtaggagggatgatttacagtcactggcatacacccttattttcctgataagaggaagattaccttggcaaggctaccagggagataccaagagtttccttgtttgcaagaagaaaatggctacttctacggagatgctttgatgctattgtccagctccattcaaacagtttcttgagattgtcacacatatgaaatttgacgaagagccaaattatgccaagcttatctctctgtttgatgggttgattgaagcac

SEQ ID NO: 36308 - DNA, 391 bp, Zea mays
  unsure at all n locations
  Clone ID: LIB3060-043-Q1-K1-G11
cactcgctggtcgttgcctgctgcggattgcccccaggcggccccactcactccgctgttgatatttcgtttggttctcctttccgtcttgtccgtcgccgaggccttcttcccctcgctccccagctccagcaggcagatcagatccatccaaccacgaacaggaaggaaggtaggaggcctgaggggctgaagttgaaccatgagtgccgtcgcggtttcgtcgtcgctgaacccgaacgcgccgctcttcatcccggcggcgctgctgcaggtggaggacttctcgccgcagtggtgggacctcatcaccaccaccgnctggttccgcgaccactggtcccgcgagcacgcccacctggacgagatagccgagcagctcgagttggtc

SEQ ID NO: 36309 - DNA, 429 bp, Zea mays
  Clone ID: LIB3060-043-Q1-K1-G3
cccaggctagtccgattcaaacccgcccgtttcccttgtccgagccacgcaagccgagctcaagcctgatatgccagagcgggctgctcggcgctccacgcgatggcgcagaaggagaccaatggcagcaacggcgagcacatctccacccgcccgccgccgaccccgtcgcccctccgcttctccaagttcttccaggctaacctgcggatcctggtcactggtggggcgggcttcatcggctcgcacctcgtggacaggctcatggagaacgagaagcacgaggtcattgatgctgataactttttcaccggttcaaaagataacctgaagaagtggatcggacacccaagatttgagctcatccgccatgatgtcactgagccacttcttgtggaggttgaccagatctatcaccttgcttgccct

SEQ ID NO: 36310 - DNA, 53 bp, Zea mays
  Clone ID: LIB3060-043-Q1-K1-G6
accattgcccttgaaaccttcttcaaaaccttggcccttcacccccccccttg

SEQ ID NO: 36311 - DNA, 419 bp, Zea mays
  unsure at all n locations
  Clone ID: LIB3060-043-Q1-K1-H10
cccgactcgacccacgcctcccatgcgaggcatcaaggtctacttcaatctctttacnacagagtggagactggagagggttaggaacactttcaagggaatcgagggatcccacacgtggccctttcagattatgtagcatatctcctgagatagtacttcttcaacaacttgcactatcgattgagtacatgccctttctatagtcagattgcaaagaaatggcttgactctcagtttgccagatctaaagcatcagttgaacggtcataatggcgaataaacaaagatctcggccaagcatctctaaaaggttcagcttggttgtaatcaataaactggaggaatgtagataccaatgtcgtcttactccatcagaagctactagcttctaatgaagaaccaaatttctggaaaaa

SEQ ID NO: 36312 - DNA, 251 bp, Zea mays
  Clone ID: LIB3060-043-Q1-K1-H11
cgtcatcaaggtctacttcaagcgcaccagagcagagtggagactggagaggattaggaacactttcaagggaatcaagggatcccacacgtggccctttcagattatgtagcatatctcctgagatagtacttcttcaacaacttgcactatcgattgagtacatgccctttctatagtcagattgcaaagaaatggcttgactctcagtttgccagatctaaagcatcagttgaacggtcataatggcg

SEQ ID NO: 36313 - DNA, 399 bp, Zea mays
  Clone ID: LIB3060-043-Q1-K1-H12
ggctactccctcctccggctcccgcgtagcgactccaagaagcagcaggagcgtcgagctcgagcagcagccatggatggcgaggaggttggcaggaggggtattcctactctgctgaagccgtcttcctcctccagcgacggcagtgccggggaacaagagcacatcgcttctgacgtcactcagctcataggatggacgccgctggtcgaattgaagcgaatcgccagcgaggctgggatcgatgcgcggatcgtcggcaagatggaggcttaccagccactttgctccatcaaggaccgctctgctttgagaatgatagaggatgctgaggagaggggattgatttcgcctggagtcacaacactggtggagccgacgagtggtaacatggggtta

SEQ ID NO: 36314 - DNA, 224 bp, Zea mays
  Clone ID: LIB3060-043-Q1-K1-H2
tcccggaccaacccggcctgcacacaaactcacgcgcttacaacaccccagccatttagttgatctagctaagcacactcgaacattgctcgatccacatctacggttgatactacccacaactatatcactcctacagtcctcgatcctactgcacgccatacatctcaacccccaattacgccttcttctacccaccacaccattacccaataaacatccat

SEQ ID NO: 36315 - DNA, 236 bp, Zea mays
  Clone ID: LIB3060-043-Q1-K1-H4
cgacccaggcgtccggctggactacctcggcaaccccagcctgatccacgcccagagcatcctcgccatctgggcctgcgaggtcgtgctcatgggtggccgtcgagggctaccgcattgccggcgggccgctcggcgaggtcgtcgacccgctgtaccctggcggcaggcttgaaccccctcggcctgccgacgaccccgaagccttcgccgagctcaaagtgaaagagctcaag

SEQ ID NO: 36316 - DNA, 108 bp, Zea mays
  Clone ID: LIB3060-043-Q1-K1-H5
agtagtagtagtagtagtagtagtagtagtagtagtaggtttttttgggggtcttgtttatgggagcgacggttcagtgatgcggatatgagacggatgcatcttttg

SEQ ID NO: 36317 - DNA, 460 bp, Zea mays
  Clone ID: LIB3060-043-Q1-K1-H6
ggggcgtccgcacaaacagacaagcatacaacaccgttgccatttagctgttcttgctaggcagttgcgcgctgacagggagccgcagctagctgtctactacggcacaactatctcctgcgcgcgtgctcgatcgatctgaaggccagacctgtgcctgtccaattttgccttgttctacccaccacaccagtagtcgagaaggttccatataagcgcaagcagacagcagcaaaagagctaaggagagtctgagacaaggttcgaacagatggaggatgtggtgaagttcgtctttggagtttccggaaatgtcatcgctctcttcctcttcctttccccagtgcctacgttctggaggatcatcaggaggaagtcgacggaggatttctcgggggtgccgtacagcatgacactcctcaactgcctcttgtcagcttggtacgggctgccgtcgtgt

SEQ ID NO: 36318 - DNA, 403 bp, Zea mays
  unsure at all n locations
  Clone ID: LIB3060-043-Q1-K1-E12
cccacgcgtccgtgcaactccatctccttttccggtcttcccgaccgagcgatccagccagcgagaggttgcgagaagtagccgccgccggaggagcacgccaaggccgccgcctacgaggacggccatggggttctgggtgaccacgctcatctttctcctcgccggcgtcgccgcatccctcttcacgctcctctgctgcaaccgcgggccctccacaaacctattccatttgaccttggtgactacagctgtaatttgttgttggatgatgtatgctatcgtttaccttgctcagatgaagccattgatcaaccccatcctgagcggngagtgatctctcctctgcattaaaaagaatgaaagctaggtctgctgtaccattattcagtctgtgaacttc

SEQ ID NO: 36319 - DNA, 96 bp, Zea mays
  Clone ID: LIB3060-043-Q1-K1-E6
ggtagttgtgtagtgcccgcgcgcatgagaaactggacaagagcactttattagcacaagttggggatgaacatcgcgcgcattgctttgtggcct

SEQ ID NO: 36320 - DNA, 340 bp, Zea mays
  Clone ID: LIB3060-043-Q1-K1-E9
accatctgcgtctgccagatctggcatttgttcagggtctcgaccaacgagctccaggccggcggctacgcacgtatgtcgagcacggacaagcagatctcccccgacgccaagtccggaacggcgtactcgaagccgcgccggctgcggaccgacgaggtccccgggatcgtcgacgacttcaggcgggccgcacggaacgcgatccaggctggtttcgacgccgtcgaaatccacggcgcgcacgggtaccttctggagcagttcatgaaggacagctgcaacgaccgcacggaccagtacggcagcagcctggagaaccggtgccgtctcgccgtgg

SEQ ID NO: 36321 - DNA, 446 bp, Zea mays
  Clone ID: LIB3060-043-Q1-K1-F1
cggagatcgaccgggcggcggcggcgcgggtgcggcgggagctgtggtgcgggctgacgtacggggtgatccagacggccgggttcatgcggctcaccttctgggagctgtcgtgggacgtgatggagcccatctgcttctacgtcacgtccatgtacttcatggccggctacgccttcttcctccgcaccaagaaggagccgtcgttcgaaggcttcttcgagagccggttcgcggccaagcagaagcgcgtgatgcgcgcccggggcttcgacctccgcaggtacgaggagctccggagagcctgcggcgtggcggcgtcgccgccgctccaggcccggaccccctgcgcgagcgcgggcgcggcgcgggagagcggccattgccactcctactgccattgccattgatcttggcctcgctcggttcattcctttctttttttt

SEQ ID NO: 36322 - DNA, 403 bp, Zea mays
  unsure at all n locations
  Clone ID: LIB3060-043-Q1-K1-F10
atctcaaaaagcgatatctgtcagctttacatggtgtggaaaccgctttgctacgggtgccatggtaactgcaaggactcaccaaattgtttctgcgggttgattcccattggcaatggggttcgtaaatctggcctctggcagaaaactcaggagattatccgtggtcttggtcctaatccatctagcgatcttcgtgattctagcgagacgcctgctgggttgactaacctgggagcaacttgttatgcgaatagtattctacagtgcctttacatgaacacatncttccgatctggtattttctcattggatctggatgttttgaagaagcatccagttttagatcagctggttcggttgtttgcacaactacagtctagcaaaatggctttcattgatt

SEQ ID NO: 36323 - DNA, 185 bp, Zea mays
  Clone ID: LIB3060-043-Q1-K1-F4
aattcccggtcgacccgggcgtgcgtcaggatcactcatgctcccactcttaccaattgcttctcgggttagggttccttaggcttttgggggggtgctatggcggggggtgatgtggagtaccgttgcttcgtcggcgggcttgcctgggccaccagcaacgagtcgctggagaatgccttcgc

SEQ ID NO: 36324 - DNA, 145 bp, Zea mays
  Clone ID: LIB3060-043-Q1-K1-F7
actctctcaccatcttccttcctactgccttcaattcttaactaaacattaatattatatccgataactctaaacataaccactgcctcacaaaaacttaatctgataatttcaatgatcatcacattcactctcctacctctat

SEQ ID NO: 36325 - DNA, 289 bp, Zea mays
  Clone ID: LIB3060-043-Q1-K1-F8
ctcagggacacacacgcacgcagacggcagatctcccccaaccgctctctctccctccctgtcggtctgttcaatctgtcggctcggcatggacgctccgagcaactgcacgcgtcctgcgcgcgccaagtgaccgaacaagctgagctctgctgctacagttgcttgcccctgtgccaaactggcaggaggtaggtagcttatagcatagcagctagagctaagctgtggtgcgtagcggcagctagagctagcttgtgcacgcgcaggtgcgtgctagctagctagc

SEQ ID NO: 36326 - DNA, 443 bp, Zea mays
  Clone ID: LIB3060-009-Q1-K1-C8
ctgcaagctaaggagagtgtgatcaccaacagctagtgctagtcccccttccttccatccatccatggcatgcgtcagcaccttccagagctgccccattgccagaagagcaaagatcaacaccaggtccaggggcagcagcagtagcgtggcgaaggggtcaccaccatcagcctgccagttccagtgcagggcgtcgactttcgcggcggacaccagcctccggctcgagctggacgagaaccccgaggcgatcatctcgggggcgtggcccgggaactgctcccttctcagctacgacaaccttcgcgccttcctcgagtcgcatgagacggctgcccaggcagactatcagcgcggcgtggcgctcctgagcgagaccatgtccacactcgtgctggtggccacagcagaccagaccctggaggacttctagtgccact

SEQ ID NO: 36327 - DNA, 433 bp, Zea mays
  Clone ID: LIB3060-009-Q1-K1-C9
gatcgatctaaaccaatccattttatatatacatacgacatgccaacggttaaacaacgtattagaaatgcaagacagccaatacgaaatgctagaaaatcggccgcgcttaagggatgtcctcagcgtcgaggaacatgtgctagggtgtatactatcaaccccaaaaaacccaactctgccttacgtaaagttgccagagtacgattaacctctggatttgaaatcactgcttatatacctggtattggccataatttacaagaacattctgtagtattagtaagaagaggaagggttaaggatttacccggtgtgagatatcgcattattcgaggaaccctagatgctgtcgcagtaaagaatcgtcaacaagggcgttctaaatatggggccaaaaagccaaaaaaataagtgaatcgtttttagccct

SEQ ID NO: 36328 - DNA, 251 bp, Zea mays
  unsure at all n locations
  Clone ID: LIB3060-009-Q1-K1-D1
gtcgccggcgaggtctccggctcgttccccggcaacgacggtctcatggtagcggtctggangattaatacggtcgcggttgatatcgaggaagactccgagaaagtcgaagccctaatcgagaaggttgacgtgatcaagaatgatgttgattcaattgtggatcctatcatcggcaaggttgtcaagtgcaaagatatttagagacaagtggtgaactgaagatgtgagacattagttgggctggtctg

SEQ ID NO: 36329 - DNA, 421 bp, Zea mays
  Clone ID: LIB3060-009-Q1-K1-D10
agccagttccccctgtcaattgttcttgtcggggttggtgatggaccatgggacatgatgcaccagtttgatgacaatatacctgctcggtcatttgacaatttccagtttgtgaatttcacggaaattatgtcgaagagcatagcagctgacagaaaggaggcagaatttgcattgtcagcgctgatggaaatccctacacagtacaaagcaacaattgatctccaactcttaggccgtcgccaaagaataaccccaagaattgctctgccaccaccaacaaggaccgcgtattcgcggtccagtagctttagccaacagtctggtgtttattcgcgatcaagtagctttgaccaacaaacaagtggcgcctctcagcaacgttctgagagcttgaaacagcagaagaaacctgcagcca

SEQ ID NO: 36330 - DNA, 397 bp, Zea mays
  Clone ID: LIB3060-009-Q1-K1-D12
aataagacgacttgtttcattgattcttgaagagatcgagcttcttttgcaccacaaggtcgaggatgtcttgcaactgcggatcaagctgcggctgcggctcaagctgcaagtgcggcaagaagtaccctgacctggaggagacgagcaccgccgcgcaggccaccgtcgtcctcggcgtggccccggagaagaaggccgcgcccgagttcgtcgaggccgcggcggagtccggcgaggccgcccacggctgcagctgcagtggcaactgcaagtgcaatccctgcaactgctgatcacatcgatcgactaccatggatatgattattatctatctagcttgtggtggtggttgaacaataataagcgaggccgagctggctgccttacataggta

SEQ ID NO: 36331 - DNA, 261 bp, Zea mays
  Clone ID: LIB3060-009-Q1-K1-D3
ggcctttggcctttactttatgcagtcatatattgggttattttaccatgcttgtttgcatcgtgatatactggcccttcggcgagtcctcatccatcgtctcatagtgtaccaggtattagaaaatctaattgagaattccattccttacctcaagtacagttacatgaagtacatagctgttcacaagaaaaagcgtgggaaagaatcgacagtgggtaggtcagtgcggttatcaacaagagtggagaaagagtattt

SEQ ID NO: 36332 - DNA, 97 bp, Zea mays
  Clone ID: LIB3060-009-Q1-K1-D4
ggaggagcagccatgtcttcatcggtgttcgccgtggcgagcacatttctgtgcactcgtctggcggtcccagctccacagaacgtgcgcgtcgtgg

SEQ ID NO: 36333 - DNA, 363 bp, Zea mays
  Clone ID: LIB3060-009-Q1-K1-D5
gactttcttcacaagcaaaataacttcttggacctccataaaattctaagatttgctatcgatatctcaaaaggaatggattatctgcaccagaataacattatacacagagatttgaagtctgcaaatcttgtgctaggccatgaccaagttgttaagatcgcagactttggtgtggcgcgacatggaagtcagcaggggcagatgactgctgaaactggaacctaccgatggatggcaccagagataattaatcataagccgtatgaccacaaagcggatgtattcaggtttgccattggtctttgggagctggcaacttcaatggtcccatatgacaacatgacacccttgcaaggctgc

SEQ ID NO: 36334 - DNA, 281 bp, Zea mays
  Clone ID: LIB3060-009-Q1-K1-D6
gcacaagcaaaacacatagaagctcaagtaagctgaggcaagcccagaataagagaaaagaagctataatgagagatgggaagaagcgaatgcagcacaagcccagctgctgtgggagccggctgcgcgtgcgcggtctgcggctgcgccgcggtggtgtactgcgcggtggacgctgcggcgctctgcaggccctgcgacaccgatgtgcacgctgcgaacctgctggcgtcgcgccacgagcgcgtgcccctttccatggtgactgctgcatccggcgt

SEQ ID NO: 36335 - DNA, 164 bp, Zea mays
  Clone ID: LIB3060-009-Q1-K1-D7
gttagtcgtccgccctcgctagtgtcattcacactcttgtcttctccccggccggaccggagtcaggtaggcgaagctggaaaagcaagcggctttggaagttggaattcatggcgtgcaccttgtgctgtctccaccagtccacctgtccgtgtggccgcgcc

SEQ ID NO: 36336 - DNA, 330 bp, Zea mays
  unsure at all n locations
  Clone ID: LIB3060-009-Q1-K1-D8
cgacttgtttcattgattcttgaagagatcgagcttcttttgcaccacaaggtcaaggatgtcttgcaactgcggatcaagctgcggctgcgggtcaagctgcaagtgcggcaagaagtaccctgacctggaggagacgagcaccggcgcgcaggccaccgtcgtcctcggcgtggccccggagaagaaggccgctcccgagttcgtcgaggccgcggcggagtccggcgaggctcgccacggatgcagctgaggtggcaactgcaagtgcgacccctgcaactgctgatcacatcgatcgacgaccatggatatgantattatctatct

SEQ ID NO: 36337 - DNA, 376 bp, Zea mays
  Clone ID: LIB3060-009-Q1-K1-E10
ggcctcgctaacgcgcccgcgctagcgcgagtggtggcacccacgcacactcttctgccccacgagtccggaccccggaggagccaagccatggcgtccacctcctgctgcctcctccaccagtcaaccgcccgcctcggcgcgtcgccgcgcctggccgccgccccgccgcgcagcgcccagctgctcgtctgcaaggcccggaagcaggaagccgccgcggaccagagcgacgtctcgcgccgcgccgcgctcgcgctcctcgccggcgtcacgggcggcgccggcgccaaggtgggtcctgccgccgcgggatacggagaaacagccaacgtgttcggcaagcccaaggcgagcaccgagtacatagcgtaca

SEQ ID NO: 36338 - DNA, 399 bp, Zea mays
  Clone ID: LIB3060-009-Q1-K1-E11
acggcggcggcggcggcagcgctgctgctgctgctcctcctgtcgctcgccgcggcggcggacatgtcgatcgtgtcctacggggagcgcagcgacgaggaggcgcggcggatgtacgcggagtggatggcggcgcacggccggacctacaacgccgtcggcgaggaggagcggcggtaccaggtgttccgggacaacctccgctacatcgacgcgcacaacgccgccgccgacgcgggcgtccactccttccgcctcggcctcaaccgcttcgccgacctcaccaacgacgagtaccgcgccacctacctcggcgccaggaccaggccgcagagggagaggaagctcggcgccaggtaccacgccgtcgacaacgaggacctgccggagtccgtcgac

SEQ ID NO: 36339 - DNA, 185 bp, Zea mays
  Clone ID: LIB3060-009-Q1-K1-E3
ggcagcgaagatccaaagatagcacaatcgcatctcacacgccgagctatttgtactttgagagaatccccttatcccacaaggagcgagtaatgtgaggcagagaccgacacagatggcagcggttatggtgtctcgccaaggccaggagctgcagcggtacagcgcgagcacgggcgggcgcg

SEQ ID NO: 36340 - DNA, 194 bp, Zea mays
  Clone ID: LIB3060-009-Q1-K1-E4
ggaagaagaggggaggcgcgacaaaaagggcgccgcgccacgcatcgtccccgactcctggatcgtgtagcctcgctctccttctcccgatctgatccgaagcgctgctgtgactacgacgacctaagggcacgatgcatttgaccaacctgctgctggaggagcccatccggatggcctgcatcctggagcca

SEQ ID NO: 36341 - DNA, 424 bp, Zea mays
  Clone ID: LIB3060-009-Q1-K1-E5
cggacgactcaccaaagcacgaaagccagttagaaaatggattcctatttgaagagtgcctaaccgcatggataagctcacattaacccggcaattttggatccaattcgggatttttcttgggaagtttctggaagaaattggaataatatcggattcatacagaggaaaaagttctctattgatgcaaacgctgtacctagaggatagggatagaggaagagggaaaaatcggaatgagataaataaagaataaagccaaataaataagtcgaagatagaagagcccatattcaaaatgaggaaatggaaactcgaaaaggatccttctgattctcaaagaatgaggggcaaggtgattgataccgagaaagatttcttcttagtataagacgtgatttgatccccatatgtttgggaaaag

SEQ ID NO: 36342 - DNA, 252 bp, Zea mays
  Clone ID: LIB3060-009-Q1-K1-E6
gagatcatgaggaagcaatactcccctgtgctctccttgtgcctgatggcccttgtcgtaactgctatggtctaggtcatgtacaccacctcagcacaagcatgaatgagaggctacaactcgtacgaaccttatggaagggggggatacaactctgttcccatcaacggatgtggcagcccctagctagtcggtggatcggaacctgtatcagaaatcgaaataatataagactgtcttcaacggatcaca

SEQ ID NO: 36343 - DNA, 86 bp, Zea mays
  Clone ID: LIB3060-009-Q1-K1-E7
tgcggcggcagccacatcgagtaatttatcgagtcaggtgagagggcggtagcagatctcggcgtccgtgtccatgtgtgctgccg

SEQ ID NO: 36344 - DNA, 221 bp, Zea mays
  Clone ID: LIB3060-009-Q1-K1-E8
gcaaaagccaaaggcatcaccgccgcgacgacgatggcagcctcgctccgagccgcgggcaccctgatgcagccggccaagatcggcggccgggcgccctttgccttgctggcgtcccgcccgtcgtcgcaactcgcctgcagggcgttcggcgtcgacgccggcgccggcagtatcacgtgctccctgtaggacgtggccagcagggtgcgtcgactccg

SEQ ID NO: 36345 - DNA, 193 bp, Zea mays
  Clone ID: LIB3060-009-Q1-K1-C7
gccgcccaagtcctctggccccaagaagcggggcaagacggagatccaggagacgctggtcacgcccctgttgtacaccagggacttcgacgagatggagcgcctgttggacggcgagatcaacaagcagctcaaccaggcggagttctacgccctgctacaggagttcaggacagactacaaccagacccac

SEQ ID NO: 36346 - DNA, 420 bp, Zea mays
  Clone ID: LIB3060-009-Q1-K1-A11
cgctcgtctcttgcgcccgccgcctcccgtccttaccctctccgctcaccctctcgaggccccgcgccggcgccgtctcatttctggctgcccaaccgtcgccggcgacggcaccgagatccggcaggaatcttgctctcttctgttctttatcaccgacgtcgccatcgctaactgaggccgccgtagcactgccgccaccgaaggctgcggtggaagagacgaagccccctgtgccgaccggggacgagaagggggaaccgaccgtggaggagctagcgggcctgctggacgtccgggtgggccgagtggtgaaggcgtggaggcacccggaggcggacaccctctacgttgaagaagtggacgtaagtgaagcggagccccggaccatctgcagcggcctcgtcaactttcttccca

SEQ ID NO: 36347 - DNA, 427 bp, Zea mays
  Clone ID: LIB3060-009-Q1-K1-A12
gatcgcgagcgcacgcacgtaagcacgttgtcggaagctcaagttagaagaagcaccagtgcctgatcgatggcggcccaggctctcctctccggccggcagctgctgggccgccccgtgcagtcggccgtctctaggtcgtcggcgaggaaggcgcccttcgtcgtcagggccagctccagccctccagccaagcaaggtgccgacaggcagctgtggttcgcgtccaagcagtccctctcctacctcgatggcacgctgcccggcgactatggcttcgacccgctgggcctctcggacccggagggcaccgggggcttcatcgagcccaagtggctggcctacggcgaggtgatcaacggccgctacgccatgctgggcgcggtgggcgccatcgccccggagatcttcggcaagatgggcatta

SEQ ID NO: 36348 - DNA, 433 bp, Zea mays
  Clone ID: LIB3060-009-Q1-K1-A2
aaagcattaccataggctcattcatcgaaacgcaaatcagagagacaggaaaagaataaagaattttgatcaaatcaatagaaggaaggatcccttacctgatttgaatttcatgctcctttaaataggatatgctctaagtcttcccatactttcctataatgactgcaacgattttctccattttgcgaattcctattttatgtgaagtatattactatcatatacatgatctaaatcgatccactttaaataaaatagaaaaaatcgaaagaatcaaaataagaaagagtaaataatagcacaaggtattctgcttcataattctgaaatagagttcttgttttagtattacttctcattaagatgtatatattaatcatcctattttaatatatattaatcatcctatttttattaggttctaattcaa

SEQ ID NO: 36349 - DNA, 234 bp, Zea mays
  Clone ID: LIB3060-009-Q1-K1-A6
agaagggaaccgataccaagcaacccaatccaaaccagacaagcaaggaatccctcgatggctcatcgagttctgctcctgctctctctcgcgtgtgtcgtcgcggttgccgatcttcgcgacgcggaggacccgctgatccggcatatggttcccggtggagatgacaacgatctggagctgaacgcggtgttccacttactgagcttcaggcagcggttcgtgaagttctac

SEQ ID NO: 36350 - DNA, 383 bp, Zea mays
  Clone ID: LIB3060-009-Q1-K1-A9
aacttaatcccctggcctcataactccaagtgtataggcaaaacaagtattcatcacttgtatgcacacatttagggggagaatggtctataatttgaatctttgagactaacttcattttcaaatctattatgtgtgtagtctcaaattagaaaggaatgttcgggcaaagacaatcacttccactgcaaattttgatgggtatcaaagattctttgctccaataaatgtatcttttatacatttcataagggaatgggtttctcttttatatgctactccaacatcatctaaaattggtaaacatgtatcacatccttttggattgcaaatgtctaaagtagcatagcttataaattctcctatttagaacttaattgatt

SEQ ID NO: 36351 - DNA, 317 bp, Zea mays
  Clone ID: LIB3060-009-Q1-K1-B1
cgactacttctggttccagagccaggactagttcttccggaagcgcgcggcggcacaccgtagcaccgtgttccgcaccaacatcccgcccaccttccccttcttcgtgggcgtggacccgcgcgtggtcgccatcgtggacgcctgcgccttcaccgcgctcttcgacccggacctcgtggacaagcgcgacatcctcatcgggccctataacccgggcgccggctttaccggcgggacgcgcgtcggcgtgtacctcgacacgcaggaggaggagcacgcgcgcgtcaagaccttcggcatggaccttcttcacc

SEQ ID NO: 36352 - DNA, 395 bp, Zea mays
  Clone ID: LIB3060-009-Q1-K1-B11
cgcccgtccgcccagaactatctcgctcgtccgcgttcagctcagctactccaatttcgcaacaagttgcaagcaataaccgaccaaggacgacgaacgggtcgatggccacgctctcctcctgcagccgcctgagtagcggcaccggcgccgcggccattcaccggcagccggcccgtgctggagccgtcctcgtcgtcacctgcaggcggagctcctccgcgaccgtccgcgccgcaaccgctgtcacggctgcggcgccggctgccgtagagctgcagaacaagggggtgtcgctgccgacgtgggcggagttcgagcttgggcgggcgccggtctactggaagaccagcaacggccttccgccctcggctggcgaggggcttaccctgttc

SEQ ID NO: 36353 - DNA, 432 bp, Zea mays
  Clone ID: LIB3060-009-Q1-K1-B12
ctctcgtggagacgactgggccgccgtcgttgctgccctacgcggctacacccacgtcttcttcgggcccttagccgcgacgagcgccaccagggagtagaagaggttaaccttctggttggaaacgatgtacttcgaaggctatggcttccgtggaagtactttcgagcagacatatcgctgctatcctgcgtctttcatcgacaagccacaacttgaggccggtgacaaaattataatgccaccatcagctcttgatcgtcttgcatctctgcatattgaataccctatgctatttgaagtccacaatgcagcagcagaacggacttcgcattgtggtgttctggagttcattgcagaagaaggcatgatctacatgccatattggatgatgcaaaatcttcttttgcaagagggagatatggtgttcat

SEQ ID NO: 36354 - DNA, 420 bp, Zea mays
  Clone ID: LIB3060-009-Q1-K1-B2
cgagatcatgaggaagcaatactcccctgtgctctccttgtgcctgatggcccttgtcgtagctgctatggtctgtgtcatgtacaccacctcggcacaagcaggaaggagtggctacaactcgtacgaacctgatggaaggggtggatacaactctgttcccatcaacggcggtggcagcccctagctaggcggtggatcggagcctgtatcagaaatcgaaataatataagactgtcttcaacggatcacactgccgatcccccacgctaaatttgggggctacagtgcacacgctagccgatcaacggctcacgctaccatgcgctctacgcggatgtgccccctagccagcttctatcttcccctcgttctgtggtgcctatctcaccctctctaatattgttcacgttggcccac

SEQ ID NO: 36355 - DNA, 243 bp, Zea mays
  Clone ID: LIB3060-009-Q1-K1-B3
aagggttcagcccatcgcaactcccgggctatccgcccacctcattaagaaggtgatgcccgtcgtctttattcgacagagcaagccgaggcgccttatggactgggtgtacatgttcttttaagataatgcttgagtgattgtgaatgccaagggtgagatgaaaggttccgctatcactggacctattgtctatgagtgtgctgatctttggcctaggattgctagcgcatcatacgccat

SEQ ID NO: 36356 - DNA, 68 bp, Zea mays
  Clone ID: LIB3060-009-Q1-K1-B4
atatatgtattattacaaggcacatacatacagctgcagagaacggatgcgtgaacacccgttgtctc

SEQ ID NO: 36357 - DNA, 101 bp, Zea mays
  Clone ID: LIB3060-009-Q1-K1-B5
acacccagcgcaaagcgatggcgtcgctcaccatgatggcgttcttcgacgccctcgaggtggccgcgcactagcgccgtaggacacttcacgtggtcaag

SEQ ID NO: 36358 - DNA, 427 bp, Zea mays
  Clone ID: LIB3060-009-Q1-K1-B8
agagaaggatgggcttcgagaagcagatcctgagatccggcaccggccccaagccgataaagggccagaaggtcaccgttcactgcaccggctacggtaaggatcgtgatctgtccaagaaattttggagcaccaaggaccctgggcagcagccattcagtttcagcattggtcagggttcagtgatcaaaggatgggacgagggagttatgaccatgcaagtgggtgaagttgctcgtatccagtgcacgcctgattatgcttatggagccagcgggttcccagcctggggaattcaaccaaactcagtgcttgtgttcgagattgaagtcctcagtgcccagtaattcggatctgtcagctatggaaacgttggccatgcttctcaagtaatgaaataattccgttgtcacctcatgcttcatac

SEQ ID NO: 36359 - DNA, 424 bp, Zea mays
  Clone ID: LIB3060-009-Q1-K1-C10
ggcggcgtcagcaggcggaggcgcggtgcgcgcgctgtcccagaaggagcaggacatacagatgatgctcgcggccgacgtccacctcggcaccaagaactgcgatttccagatggagcggtatgtctttaagcgtcgcaccgacggcatctacatcatcaacctgggcaagacatgggataagctccagctcgcggcgagggttattgttgccattgagaacccgcaagacatcatcgtccagtcggcccggccctacggtcagcgtgctgtcctcaagttcgcgcagtacactggcgcccatgccatcgctgggaggcacacccctggtaccttcaccaatcagcttcagacctctttcagcgagcctcggctgctcatccttactgacccaaagactgaccatcagccaatcaaggagtct

SEQ ID NO: 36360 - DNA, 425 bp, Zea mays
  Clone ID: LIB3060-009-Q1-K1-C12
agcccttgctcgttcgttcaccaccacagctccgatcgatccgcaaggcaggcaagatgtacaacgcgccgtcggcccaggagatgtcctacttggagcacgtgcagaggcgccacgaggagaagggctgcctctacgcctgcatcttcactgcgctgtgctgcttctgctgctacgagacctgcgagtgctgcctcgactgcctctgctgctgctgcaactagccggggctagctccggaggacggtcgagacgcagcagatggaggtcgcctccgtctcttctacctacctaccaatctacctagtgatgatgattcagttcccgtttagtctggtggtgtgcaagtgcaaacataataacgcacgcatgtcgtaacgtagtacaggagagatgttttactctgtcagtttccagttgagcat

SEQ ID NO: 36361 - DNA, 255 bp, Zea mays
  Clone ID: LIB3060-009-Q1-K1-C2
gccattcatgacagaaggttcttgtttacacttaatgaagatctcataccaagacggttgtgatgagccggtcattggctacattctaaaggaaactcttaaggctctggaataccttgaccggcagggtcaaatacatcatgatgttaaggctggtaatatccttattgatggtgctgaggtagtgaagcttggagactagggtgattgtgcgtggatgtttgatagaggtgacaggcatagatctaggaatac

SEQ ID NO: 36362 - DNA, 398 bp, Zea mays
  Clone ID: LIB3060-008-Q1-K1-H8
catgatgtcgccatggattactatggctagcgcctagctacatcctcctctgataatacaatagagatcattggcgtaagtggaacctcacaccagcagcttgcaactttgagtggacaccagggcccagtatggcaagtcgcatgggctcattccaagtttggttccatgcttgcatcctgcagctacgacggccgagtgatcatctggaaggaaggaagcaagcctgatgaatgggcactggtacacacctttgctgagcacaaattctccgtgaattccatcgtgtgggcgcctcatgagctgggtctatgcttggcttgtggttcatcagatgggaacatttcaggcttcactgatcgttctgatggaggttgggataccacgcgtattgatca

SEQ ID NO: 36363 - DNA, 217 bp, Zea mays
  Clone ID: LIB3060-009-Q1-K1-C6
cttcactgccgcaaaaatcgcatcagaatgaaccagttgaaatggatgctaaaccagttgtatatgcagaggaacgatttgtcgtatgtcctcctagtgccagtgggattcatgtgcatgttgaaattgctaaagatggtctactgctcatttctcctgtgaccggtgaatgaggaatcagtacggtgctagactggatcagaaatactttgagcag

SEQ ID NO: 36364 - DNA, 254 bp, Zea mays
  Clone ID: LIB3060-008-Q1-K1-G11
caagcttccttcgcggtctcccgtcgagcaaccatggcggcggcggttaccctcctacggcttactctcgaccgactctcctaccacctgcgctccgtacctttctctcgtatggcgtatacgcgcctacgtatctttgccttccatcgacttttctactacctggaccatgtcttctgctttgcttacggcttcgcggtcgtagcccaggttgtaagccagccgtacgccgaagaatctgtagaagatgaatc

SEQ ID NO: 36365 - DNA, 285 bp, Zea mays
  Clone ID: LIB3060-008-Q1-K1-G12
caggaggccggccacgcctcacactttcgcccgcctccggcgattcatccacccaagaaagtatccaaccctaacgatccggatcgccttaccccgcgtcatccacgcgaattgtttcgattatcctcggatttccccgtttttttgtgggtttcctatcttcttcgatcggagtgctagggtttgggcccgctcggtggccgggtactcaaggtcaatcgttagttgaacgggctagggggctttttaaccgggggaagggaagcgaatccaaacaatggagaa

SEQ ID NO: 36366 - DNA, 410 bp, Zea mays
  Clone ID: LIB3060-008-Q1-K1-G2
gagccgcgaccccgggcaggtttccctacggacggggcatccgaccgcgacgacctggcgccgccgccgcgacgaatctctggcctcccactaccgccgcgacgtccagctttgttctactccaaggtccagctctggcttgccgtcctccgcccgtactccacgctactggatctctagcttgctcgtacgggatctctgtactccacgctactggcttgagccatggcaaagaatgtttctagggcactttggaacactgtgtatgagaaaggtctggttgatgtgctccttgaacataaggacatcccaaagttcaaaagtcaaaatggttggactgctgagggatggaacaatttcacaaactagttcaatgagaggtattctttttgcccatactccaaacagca

SEQ ID NO: 36367 - DNA, 395 bp, Zea mays
  Clone ID: LIB3060-008-Q1-K1-G3
ctgcaagctaaggagagtgtgatcaccaacagctagtgctagtcccccttccttccatccatccatggcatgcgtcagcaccttccagagctgccccattgccagaagagcaaagatcaacaccaggtccaggggcagcagcagtagcgtggcgaaggggtcaccaccaccagccttccagttccagtgcagggcgtcgactttcgcggcggacaccagcctccggctcgagctggacgagaaccccgaggcgatcatctcgggggcgtggcccgggaactgctccctcctcagctacgacgacctccgcgcctacctcgagtcgcaggagacggcggcccatgcagacgatcagcgcggcgtggcgctcctgaacgagaccattttcacacccg

SEQ ID NO: 36368 - DNA, 129 bp, Zea mays
  Clone ID: LIB3060-008-Q1-K1-G4
taccggttcggaactcgagccacgactcacacttccgcttaaagctaacgatagtgatttcactttcagttacggctactaccaaacgggtccgggcatctatggcatgcagtcatcactcttccatat

SEQ ID NO: 36369 - DNA, 432 bp, Zea mays
  unsure at all n locations
  Clone ID: LIB3060-008-Q1-K1-G5
attcactatcacccactagcacttcaagcgatcactcaataacagataaaagaatataccttttaggttcccgctccagtggtttggtaaggtgtggtattgcggatgaatcctcaaatgaaggccaaaattctgtacatgaacagtcttgtcagagccatgactctgttaaagaaattgatgggtatggtcagccagataagaatacaaacacaggagatgaggataatctttgtttcatatcctccaaatcatttcagagaacaagaaagaaagataccaaacagcagaaacactacttcacaacgaaaaatgcttcacaggctccattgtcattttggcctcactgggcttatgagatgtatgattcgtattcactttccaggagagctgcaggaaaactctatatctntatattatagagagataagt

SEQ ID NO: 36370 - DNA, 291 bp, Zea mays
  Clone ID: LIB3060-008-Q1-K1-G6
attacccccaggccccagcgtgcgtggtctccttcctctcgtggcgacgaccgagcggccgtcgctgcctacgtgcccagtcctgttcgtcccttcgccggcgacggccacgacctggttataggcaaagtttgtcctgaactgttcatcatggtggaaggctgggtattctctgctttgttagtggtgtttctagcgttcacaacaccttgtgagtcattctacttgccaggtggttatatgcacacatattatcaaggtgaagtattaagggctaaggtgaacttcttt

SEQ ID NO: 36371 - DNA, 386 bp, Zea mays
  Clone ID: LIB3060-008-Q1-K1-G7
gccagtgagtgaacaccagccgtcttggcccgcttctcccctgctgcggccatggcgacctccgcggcgctctcgaccgccgccaaccccacccagctctgccggtcccgcgctgcgctgggcaagccagtgaaggggcttggcctggggatggggcgggagcgcgcaagccagcggagcatcacgtgccaggcggcgagcagcatccccgccgaccgcgtacccgacatggagaagcggaagctgatgaaccttctcctcctgggcgccatatcgctgcccaccgtcggcatggtcgtcccctacggcgccttcttcggccccgccggcttcgggaacggcggcggcgggacctacgccaaggacaagctgggcaaacacatcac

SEQ ID NO: 36372 - DNA, 407 bp, Zea mays
  Clone ID: LIB3060-008-Q1-K1-G8
gtccgtccatgccgtggcgaccatggttcaacaaccaggtaccgggccttcgacgagcaccggggcatggaggtggcgtggaaccaggtgcagctgcacgacttcctgcgcggcccggcggagctggagcgcctctacggcgagatccacctgctcaagtccctccgccaccgcgccgtcatgcggctccacgcgtcctgggccgacgccgccgcgccccgcctcgccgtcaacttcgtcaccgagctcttcacctccggcacgctgcgccagtaccgcctccggcacccgcgggccggcgccgtcgcggtccggcactggtgccggcagatcctcgacgggctcgcctacctacacgcgcgcggcgtcatccaccgggacctcaagtgcgacaacatttttgtcaa

SEQ ID NO: 36373 - DNA, 412 bp, Zea mays
  Clone ID: LIB3060-008-Q1-K1-G9
cccaaagccggaaggggcgccatggcctcgtcggatctggagagcaaggccaaggaggccttcgtcgacgacgacttcgagctggccaccgagctctacagccaggccatcgacgccgggcccgccaccgtcgacctctatgccgaccgcgcccaggcgcacatcaagctcggcaactacactgaggctgtggcggatgctaacaaagcaattgagcttgatcctatgatgcataaagcttactaccggaaaggtgctgcatgcattaagcttgaagaataccaaactgcaaaggctgctcttgagttgggttcttcttatgcatcaagcgattcaaggtttgctcgtctattgaaggaatgtgatgagcgcatcgctgaggaatctagccaggcaccagtaaagaatgttg

SEQ ID NO: 36374 - DNA, 333 bp, Zea mays
  unsure at all n locations
  Clone ID: LIB3060-008-Q1-K1-H10
ctctcccggggacttcggcttcgatccgctgggcctcgcgaccgtgccggagaacttcgagcggttcaaggagtcagaggtgtaccactgccgctgggccatgcttgccgtccccgggatcctggtgccggaagctctgggcctgggcaactgggtgaaggcgcacgagtgggcggccgtccccggcgggcaggccacgtacctgggcgccccggtgccgtggggcacgctgccgaccatactggtgatcgagttcgtggccatcgncttcgccgagcaccagcgcaccatggagaaggaccccgagaagaagaagtaccccgggggggcctt

SEQ ID NO: 36375 - DNA, 175 bp, Zea mays
  Clone ID: LIB3060-008-Q1-K1-H12
tatcctgatgcgcgagattcttggcgattctgctactggtttttatttttattttgctagttcttgaaatttctttcacgagtggcagtagccaactgttggtaacgtcattctaggcttcctgtagccccttttcgagaccctgccgaattattgtcctctccctgtgcgtgtg

SEQ ID NO: 36376 - DNA, 380 bp, Zea mays
  Clone ID: LIB3060-008-Q1-K1-H2
aacaagggcctcctgtctgctctcacttcctcagtcctcgtccgtctctgctccgatgcctcctctctctacctagctagctagccagccttcctgtagcgcggcagatatggctgcctccaccacggcggcggcggcggcgtcgctgctgctgctgctgctcgtgtcgctcgccgcggcggcggacatgtcgatcgtgtcctacggggagcgcagcgacgaggaggcgcggcggatgtacgcggagtggatggcggcgcacggccggacctacaacgccgtcggcgaggaggagcggcggtaccaggtgttccgggacaacctacgctacatcgacgcgcacaacgccgtcggcgacgcgggcgtccactccttccgac

SEQ ID NO: 36377 - DNA, 375 bp, Zea mays
  Clone ID: LIB3060-008-Q1-K1-H4
gtccctatcccgaaagttattatagactcaagactcagatccggatgcaaccattgtagaaataaccttgggtgatcgtcttggcgatctccttgatacgatgagtgcgctaaagaacttggggctaaatgttgttaaagctagtgtctgtctcgattctactggcaagcatatcaagtttgctataactagagcgttcactggccgtaaaattgatgatccagagttgttagaagcagttcgactgacgatcattaacaacatgatacagtatcattcggagtccagcagtcaattggctatgggggcaacttttgggccagaagcctctacggaagaggttgatgtggatatagcaacccacattgatatcta

SEQ ID NO: 36378 - DNA, 427 bp, Zea mays
  Clone ID: LIB3060-008-Q1-K1-H5
ggtcatggcaatagtggaggaattcatgtcgttacagaatagcgacagtggcaaggagaaatttcaagatgatgaagagatcgtggagactgagaacgtggcatcggtttccagcacgtcaaagctggcagttgcaaagctgatcgatggatatcttgctgaggttgccaaggatcccaaccttcctcttccgaagctgaccgcgcttgctgaaatggtgtcttccctaccccggccaacgcatgacggcctctaccgtgccattgacatgtatctgaaggagcaccccagcctgtcgaagagcgagaagaagaaactatgcgggctgatggactgcaagcagctgtcgcaggatgcgtgtatgcacgccgtgcagaacgagcgtctccccttgcgtgtggtcgtgcaagttctctttttcgagcag

SEQ ID NO: 36379 - DNA, 382 bp, Zea mays
  Clone ID: LIB3060-008-Q1-K1-H6
cgccgtctccaccattccgccgttccctccacgctcactcgccagttcggcactccctgctgtggcccccccttgccgagacggcgcggacgccccgtcgcccaccccgatggctgccactctcctccacgccggcaccgcctcgctccagagctcgtcttcgcccgcacgcgcgggcgccgtcaccgcctttcaccccctcgcgtccaccccatccatacgccttgcgcgctcctcgttctcgtccaatcgccgtctcgaggtttcactccgggcgggttcggccggtcaccgtttcgtgggtaggggagcaccccggggccgtcgcgtcgtcgccgccctagcaggggagcaaactgggggttccgaggtgggcgatgac

SEQ ID NO: 36380 - DNA, 432 bp, Zea mays
  Clone ID: LIB3060-008-Q1-K1-G10
gttcggagcgcacacacacacaaccagatctcccccaaatccacccgtcggcacctccgcttcaagatgcagatctttgtgaaaaccctgactggcaagactatcaccctcgaggtggagtcgtctgacaccattgacaacgttaaggccaagatccaggacaaggagggcatccccccagaccagcagcggctcatctttgctggcaaacagcttgaggacgggcgcacgcttgctgactacaacatccagaaggagagcaccctccaccttgtgctccgtctcaggggaggcatgcagatctttgtgaaaaccctgaccggcaagactatcaccctcgaggtggagtcctctgacaccattgacaacgtcaaggccaagatccaggacaaggagggcattccttcagaccagcagcggctcatctttgct

SEQ ID NO: 36381 - DNA, 426 bp, Zea mays
  Clone ID: LIB3060-043-Q1-K1-C1
taattccccggtcgagccatgcatacctgcgtctgcttgacgtcctgtgctaggccattaacttccgttcggacgaactctgttaaggagagggatccccagaacgacaagcaccccatcctcaatcaccctcccaaggcctacattcccactatgattaaaaaagtcttaatagctcttgaaaagcttacgaagaaaccttacacgcagcctgaaaaaatcaattagatacacaaccttatacttcacgcatacaaagacatctacaagacggttaacgttggctccattcatatgaacactgccaaccatcccaaatatccacttgcaatgcataaaaacgccattgagatacttcctggtttgtatgctccaaactcttaaccttgctcttccacctaggattcttcaaaaatcgctatcata

SEQ ID NO: 36382 - DNA, 186 bp, Zea mays
  Clone ID: LIB3060-043-Q1-K1-C10
tctaaatccaacgtacaataacctcaacgacagctcagaccacattgactgaacccttaagtatgacatatgacataacaaatctgtactacagtgtcctcctccctgcctttagaacatatcaaaacaaacacatgcactcaccgattatacgacacaagctatgcctaatacatcaacgatcac

SEQ ID NO: 36383 - DNA, 373 bp, Zea mays
  Clone ID: LIB3060-043-Q1-K1-C2
tcttccaaccaaaaaccggctttataaacctgctacaaacaacttcaacacctggtcaggtcatcagatgtctgctggtacctataaacaaaaatcatcctctaagtcatcaaatcctaacaatcaccaagatctcattaaaatatcatcttttcaacgagaaaatcttttaacaagtatggatacatgttcagaacactattacaccatactatctccgactctgacaaaatgcatccacctgaactatctccacaatcgcctactcaccttattacagaacatctttccacctcataacaccctactgcgactacatcattaaacctcatccatacagtacatacattatcaacaccttaatatcagattt

SEQ ID NO: 36384 - DNA, 221 bp, Zea mays
  Clone ID: LIB3060-043-Q1-K1-C5
ctcgatctccatctcgaccgtcgctcaccggtaagctacgctacgacgaaccatggcatgggtgaccgcccgagcccgggtcgcagccctgcgcccgtcatcctcgtcgggcttccttggccactctaaccaactcggccgaactgctaccgagtcgccgacgaggcatagtctcaaggcggatgccaaagtcaagtagatcccgaaccttacctctcacg

SEQ ID NO: 36385 - DNA, 402 bp, Zea mays
  unsure at all n locations
  Clone ID: LIB3060-043-Q1-K1-C8
ccatccagatggctttcacccanctcaacttcgcgggctcctcccgctattccaccgcagcgcccaccgctgagactgaaaggtattgtctcccttggcagcaaggagcctgcccagaagcccaagcccgctgcggtatcgtcctcttctccagacatcatcgacgagctcgccaagtggtatggtcctgacaggaggatctacctgccagatgggctgttggaccggtcggaggttccggagtacctcaccggaaaggtccctggagactatggctacgacccttttggcctgggcaagaagccagaggacttcgccaagtaccaggcctacgagctgatccatgccaaatgggccatgctcggtgccgctggcgctgtcattccagaagcctgcaacaag

SEQ ID NO: 36386 - DNA, 455 bp, Zea mays
  Clone ID: LIB3060-043-Q1-K1-D5
ccttcctgaattccccgggcgggccacgaatccaccggcaccaaccgatccactgccctgcatcatttcatcggcaagatccaacaccacaagagccgtttttcaaacgctggtgctcacgctcactgttaccaactccaaatgctacgctctctccacgctgctccggagactcaggaacccaagcgacaatcttcacagctgataccccacgctcatacaccactgcacctctttccacgtgacctgccaccccaacaaccgcgtcaccctcctaacatctttataattagaactcatctggtcatctggtccctgaactttgcaaactcgagcatcttcagtatctggaactttataagaataacattcaacgaacaatcccttctgagcttctcaatatcaagaatctaataagctacgacttgtacaagaacaacatttcactgacaata

SEQ ID NO: 36387 - DNA, 352 bp, Zea mays
  Clone ID: LIB3060-043-Q1-K1-D6
aaccaatcccgctccctccagtattcttctgcctgctcccaagctcgccatgagccgctgctatcacgctggtgatcgctctcctcgccaccaactcggagaacctcccacatcagactcttcgcctgaccctcacgtaccaccaaattagatttcacatacttaacacctagctcatccacccttcctactggcagctcgtctcctacctccatcactacagcttcatactactagatcctcatcataagcactaaccagcttcactagcccatccgcttgtaaaaccaactcattttcaacatgtcgaactatataaccctaacactcaagaaacattctctcgtcatct

SEQ ID NO: 36388 - DNA, 323 bp, Zea mays
  Clone ID: LIB3060-043-Q1-K1-A4
aacttgcaggacggtgactacaagaacttttacgcttctaaatttcgccaaacgttccggagctctgctggcgttgggattattttgcctaccaaacttttccgggtggaggtgaactattgtcgcatcctaaagcaagctgagcatgacagcgcgaagactggaatccagttcagcttttcctcgcccatgtaggaacttgccatggcagccgaagtagctgcactttcctctgtagacttgcattcttcccgttcttttcatgctgaagcaattgaagaggtttacgtgctcccttttcttgtgacgcttgttcattgaca

SEQ ID NO: 36389 - DNA, 356 bp, Zea mays
  unsure at all n locations
  Clone ID: LIB3060-043-Q1-K1-A8
gccggccaagatcggcggccgggcgccctttgcctctctgccgtcccgcccgtcgtcgcaacgcgccggcanaacgttcggggtcgacgccggcgccgccaggatcacgtgctccctgcaggacgtcgccagcaggtgcgtcgacgccgcgaagctcgccggcttcgcgctcgccacctcggcgctcctcgtctcgggcgcgagcgcggaaggcacgcccaagaggctgacctacgacgagatccagagcaaaacgtacatggaggtgaagggcacgggcacggcgaaccagtgcccgaccatcgacggcggcgtggagtcgttcccgttcaaggccggcaagtaccagatgaaga

SEQ ID NO: 36390 - DNA, 326 bp, Zea mays
  Clone ID: LIB3060-043-Q1-K1-B12
gggagagatgccgctggccacaactgctccgccgccctgtcctccgccgagtccagcagcggcaccagtccggacgcagctcctctcctccgtcgcgaagctcgcgctcacggccgcgctcgtctgcggctctggcggtcccgctgccgtcgtcgtcgtcgttccggccgccgctcaggccgtcccgttcgtccgtccttctcctcccctgcaaggaaggcccttagcctcctccactccttacgcacagtcccagaagctgcagcttggcctcgacaagctcggaaagatcaggccatgcccgtccaccaacccggggtgcgtgt

SEQ ID NO: 36391 - DNA, 379 bp, Zea mays
  Clone ID: LIB3060-043-Q1-K1-B5
ttccaccaaggcttccgccaagccttcccttgctttttcttccccttttaacaaattcttcttcggttgggggttccttaaggtttgggggagggccaatggcggcggttgatgtggagtaccgttgcttcgtcggcgggcttgcctgggccaccagcaacgagtcgctggagaatgccttcgcctcctacggcgagatcctcgactccaaggtcatcaccgaccgggagacggggaggtctcgcggcttcggcttcgttaccttctcctccgagaactccatgctcgacgctatcgagaacatgaacggcaaggagctcgaccgcccgtacattacccgtaaccaagcccaatccccttgccgttgccgttgccgccg

SEQ ID NO: 36392 - DNA, 82 bp, Zea mays
  Clone ID: LIB3060-043-Q1-K1-B8
tccatatcagacgtgccacctccaccatcaactgtctaacacatagcttcctcgatatgaattctatctactaataaagcct

SEQ ID NO: 36393 - DNA, 296 bp, Zea mays
  Clone ID: LIB3060-042-Q1-K1-G2
tccggaattgaatgttcggctcgagccacgcgtgcgcagaggaaaagggcaaaagccaaaaggcattaccgacgcgacgacaatggcagcctaggtccagagccgcggtcaccctgatgcagccggccaagatcggcggccgggcgccctttgcctcgctgccgtcccgcccgtagtcgcaactcgcctgcagggcgttcggcgtcgacgccggcgccgccaggatcacgtgctccctgcaggacgtcgccagcaggtgcgtcgacgccgcgaagctcgccggcttcgcgctcgcc

SEQ ID NO: 36394 - DNA, 258 bp, Zea mays
  Clone ID: LIB3060-042-Q1-K1-G3
gtctatactacatcctgcagcggacgtttgttgcactcgcaccgggtatctggtagctcgcgacaggactaggatgagctagcctgtgatgaggtgtgtgactccatggacgcggcccatcaggacgcgcgggactgggactgggaggtccagctgccagaccacaggagctgattcttaatgcgccaacaccacggcagcatcgataatacccttgacgatcaagaagaaccagacgagctcgacctgctgctgact

SEQ ID NO: 36395 - DNA, 265 bp, Zea mays
  Clone ID: LIB3060-042-Q1-K1-G5
gtaaactcgactctctccccaatcggattgtttcattggcatttgatgtgatttctcgagttggggaaacaggaccgggatggcgactagtttcaccacatttttcttcacttcttgattcagcaatttttccagcattagcattgaatgagaaggatatagaagaatgggaggaggatactgatgagtatatgcaaagaatcttccttctgaacttgatgacatttctggatggactgaggatttgttcactgccagaaaaagt

SEQ ID NO: 36396 - DNA, 241 bp, Zea mays
  Clone ID: LIB3060-042-Q1-K1-G6
agcacgccgactccccatgaataggatcaaaccttattccatgctatttccataagattgcgtggtcttattcttaagcaagcccccgagagggcttagttgatcatgatttctgtcttctcttttttttcctttttatttgtttgcaaaaagatttcgttcgatgctacttctattgattctttatcgatcgatatgtatggatccatgtgtgtacatacctagataccgatcatggatt

SEQ ID NO: 36397 - DNA, 267 bp, Zea mays
  Clone ID: LIB3060-042-Q1-K1-G7
aacacaactcgtaggcagcgagcgtctctcctcttcctctcccacgcaccgcgccaaggaaggcagagagagatcgccgctcctcttctctccgtcggtggtgcggttgaccgccctcctcgagcgagatctcgctgcagtccctcgagatctggtcacagatctatccgacaagatggtgaagatctgctgcatcggtgctggctatgtcggtggcccaaccatggcggtcattgccctcaagtgcccagacattgaggttgtcgt

SEQ ID NO: 36398 - DNA, 267 bp, Zea mays
  Clone ID: LIB3060-042-Q1-K1-G8
agccaaaaggcatcaccgccgcgacgacgatggcagcctcgctccaagccgcggccaccctgatgcagccggccaagatcggcggccgggcgccctttgcctcgctgccgtcccgcccgtcgtcgcaactcgcctgcagggcgttcggcgtcgacgccggcgccgccaggatcacgtgctccctgcaggacgtcgccagcaggtgcgtcgacgccgcgaagctcgccggcttcgcgctcgccacctcggcgctcctcgtctcgggcg

SEQ ID NO: 36399 - DNA, 265 bp, Zea mays
  Clone ID: LIB3060-042-Q1-K1-H1
gcgacctccgcggcgctctacaccgccgccaatcccacccagctctaccggtcccgcgcttcgcgtgggcaagccggtgaaggggcttggcctgagcatgggccgcgagcgcgcccagcggagcattgtgtgccaggcggcgagcagcatgtccgtcgaccgcgtccccgacatggagaagcggaagctgatgaacctcctcctcctcggcgccatctcgttgcccaccgtcggcatggtcgtcccctacggcgccttcttcgtc

SEQ ID NO: 36400 - DNA, 408 bp, Zea mays
  unsure at all n locations
  Clone ID: LIB3060-042-Q1-K1-H10
atgtgatggagaaaaggaagctgcgctcactgagtttcaggctctggactttccctgttcttgtagacggcccctttggagttgtctctgcagttgagttcatcggaattgtcttgtttatagtttttgttgtctactcaatgacctattatgccgtggaagctgtgagccttgtctcgaaatttgacatcccatcaatgactgagagtgaattgatactggatgtcattggcctccgtttaggggcggttgggttgttctgcatgctcttcctcttcctgccagtcgcccgaggctcggttctcttacggcttatcgatattccatttgagcatgctacaagataccacgtctggttggggcatctcacgatggctctctntacattgcatggcttggtctatgtga

SEQ ID NO: 36401 - DNA, 295 bp, Zea mays
  Clone ID: LIB3060-042-Q1-K1-H11
cgccatcgcgtcgcgaacggcggccagaaataagaaaaagaaaaaaaaaaacagctcgccgcaccaatctcccctaccatatcgatcgaccctgcaaggtttaatccaacagaattccaccggaaatttggtgaagtgctaatcgcttgcggcttgcctgcccggtctcgtggctttgtgctgctcccgctgtggtgaggaaccctaggatggcgggggtttcgatggcggcggcgcctgaaggggtgctgcaccgccggattgagtttcatcttgcacggagaccgcatggctc

SEQ ID NO: 36402 - DNA, 128 bp, Zea mays
  unsure at all n locations
  Clone ID: LIB3060-042-Q1-K1-H12
ctgccatgcatggaagctagctaatggatggatgcagagccagaacgatgnaaggggaaagctttacatatatgtgggtagagaatatagatatatgggctatgtgttcaaaaaaaaaaataaaattt

SEQ ID NO: 36403 - DNA, 264 bp, Zea mays
  Clone ID: LIB3060-042-Q1-K1-H3
ggagcagtgggaaaataactactacatcagtgccatagctggtgcaatgaatgggagttccttggtggtcatgtcaaaaggaactccttacactcagcagtcttacaaagttagtgaatcattcccctacaagtggatcaacaagaaatggaaagaaggttttcatgttacatcaatgacaactgcaggaagccgctggggtgtagttatgtcaaggaactctggatactctgaacaggtagtggagttggattttctttatcc

SEQ ID NO: 36404 - DNA, 147 bp, Zea mays
  Clone ID: LIB3060-042-Q1-K1-H4
aattaccggtcggctaacaacactaacctagtgttacccagtgtaatacccaaaaatgtattcaaagaaagtagagttgatctgcttagatgttatgccatctactgattataacatggaacatcctaatcgaatgaaaaaaataat

SEQ ID NO: 36405 - DNA, 264 bp, Zea mays
  Clone ID: LIB3060-042-Q1-K1-H5
ggagcagtgggaaaataactactacatcagttccatagctggtgcaatgaatgggagttgctgggtggtcatgtcaaaaggaactccttacactcagcagtcttacaaagttagtgaatcattcccctacaagtggatcaacaagaaatggaaagaaggttttcatgttacatcaatgacaactgcaggaagccgctggggtgtagttatgtcaaggaactctggatactctgaacaggtagtggagttggattttctttatcc

SEQ ID NO: 36406 - DNA, 278 bp, Zea mays
  Clone ID: LIB3060-042-Q1-K1-H6
ccacgcgtccggcgatcagcgctacagcggcgggtactacggcggcggtggcatcgcgacgccggggtacgctccggcggtcccgtacgggatgtcgcaggtgaacatcgagggcaacgggtgcgggcgggcgctgccgccgcagccgaccgtgaaggtgtactgccgcgccaaccccaactacgccatgagcgtccgcgacgggaaggtggtgctggcgccggcgaaccccaaggacgagtaccagcactggatcaaggacatgcggtggagcacga

SEQ ID NO: 36407 - DNA, 260 bp, Zea mays
  Clone ID: LIB3060-042-Q1-K1-H7
ctgacgcgtgggggcttgcggtggatacctatgcacccagagacgaggaagggcgtagcaagcgacggaatgctacggggagttgaaaataagcatatatccggagattcccaaataggtcaaccttttgaactgcctgctgaatccatgaacaggcaagagacaacctgtcgaactgaaacatattagtagccagaggaaaagaaaaggcatatcgagagactgagcgtgatgagaacgagaagaagaaagagatagag

SEQ ID NO: 36408 - DNA, 265 bp, Zea mays
  Clone ID: LIB3060-042-Q1-K1-H8
cgctaacgcgatgtccactcaggcattcacgctcgatgcctaacccgcaaggcccggtgatccgaggcggcggcatccgatgtcatggagccctcatgcgtcatccacagtggctcggcagagcggtggcgcgcggaggcgtcgcgggcgttccagcactacctggaccgcgcggcgccgcacacggcaaaacgggcggccgtcacgctcgtggacgctgcggtgtacgcgcttgcggtctactacgtgcgcagcttgtacgtca

SEQ ID NO: 36409 - DNA, 406 bp, Zea mays
  Clone ID: LIB3060-042-Q1-K1-H9
cccgcacgacacgacaccaagtcgaggtagctcgagggcaccaatcatggccggcgtgaactccagcgtcgtcgggctcaagcccgccgcggcagtgccgcaggccgccgccgcctcatcgccggcgaagcgggtgcagctggccgcgcccgagggccgccgcgccgctctgctcggcctggcggccgtcttcgccgtcacggccaccaccgggtcggccaaggccacgatcttcgatgagtacctcgagaagagcaaggccaacaaggagctgaacgacaagaagaggctggccaccagtggcgccaactttgcgcgcgcctacaccgtggagttcggcagctgccagttcccctacaacttcactgggtgccaggacctcggcaagcagaagaaagtccccttc

SEQ ID NO: 36410 - DNA, 396 bp, Zea mays
  Clone ID: LIB3060-042-Q1-K1-G12
catcttacaagtcactcttgttggtgggtccatagctgaacgttcgggaaacaacttatacaatacatgctgcatctttggttcagatggcaaacttaagggtaaacatagaaagatccatctttttgacattgacattccaggaaagatcactttcaaggaatcgaagactcttactgctgggcagaatcctactgttgtagacacagatgttgggcgaattggtattggtatatgttatgacatccgtttccaggaattagcaatgttgtatgctgcaagaggtgctcatttgttatgctatcctggtgcattcaatatgactactggaccactgcattgggagttgctgcaaagggcaagggctacagacaaccagctgtttgttgcaacatg

SEQ ID NO: 36411 - DNA, 229 bp, Zea mays
  unsure at all n locations
  Clone ID: LIB3060-043-Q1-K1-A1
ccctgcttaaatcttgtggatagaggttgtcttttgcattaatgcctagctcaggggttgtccggtannaattatgacgttgtacctgcaagaatattttcattgngagcatggtgggatcttactgcaaagttccctataatgctcttttcatcctaaggaacacataacaatcctaagggtggaagtacttaactcgagacttgngttatgaacaggtgatgctcca

SEQ ID NO: 36412 - DNA, 253 bp, Zea mays
  Clone ID: LIB3060-008-Q1-K1-E5
cgcatcccttagcctgacgctggcgcttcagctttccatgtccgccgccccgccccggcgcgtggtcatctgctgcggcggcgtggtgggcgcgtgcacggcctactttcttgccacccacgccgtgttccccaccgttcagacgctcgttgagaggtgcgccccggcgtgcgccgactcagggaaagcctgctgcttcctggcgctggactggtgcgactccactccggctctttccaggctcgcgcgggcc

SEQ ID NO: 36413 - DNA, 387 bp, Zea mays
  Clone ID: LIB3060-008-Q1-K1-E6
aactccgcgtcctccccccctccctctaagcggtcaaggcggcggcagcagtgccggcatgggcgcaatgtcggcttcgatttcgtcggtgaattggctagtcgaggatgacatacttctcaagaacgccgtcgaggctggtgcttcgttagagtccttatccagaggagctgtatgtttttcccgtaaattcactcttcatgaaatacaggaccgctggaattcattgctatatgatccagatatctcaacacaagcagcttttcggatggctgagtatgagaatgaactttctacttgcgatccatccaaagcacattaacttttgaacttagaagctaaggattttttatttcagaaaccgaaaatttaccgtggaatagaatt

SEQ ID NO: 36414 - DNA, 421 bp, Zea mays
  Clone ID: LIB3060-008-Q1-K1-E7
agtagcagtcaccaaaccaaaccgctctcgagtctccatccattctctccgctcatccgcagctctctagtctccagctctagctagccttagcctcgtccaagggacgaaggggccaccatgagcgtggtgatcctggacggctccacggtgcgcggcttcgtggcggacgaggcggccttcgcgcgcagcctggacgcgcgcttcgccgcgctggacgccaacggcgacggcgtgctgtcccgcgccgagctccggcgcgcgctcgagtccttccgcctcctcgacggcggcggcttcgggtccgcccagccggcgccgctccccgccgaggtcgccgcgctctacgacgccgtcttcgagcagttcgacgccgaccacagcggggccgtcgaccgggccgagttccacgaccagatgc

SEQ ID NO: 36415 - DNA, 439 bp, Zea mays
  Clone ID: LIB3060-008-Q1-K1-F10
gagaagtcgagatagagacaaccggcacccgccgatcgctcgctggtgggatgaagaaatgctccggcgtgctcttcatcctcacactcgccgtcgtgctcttcctcctctcgccgtcgccctcccccactccaccccccaacaccgcacccaatggcccgatcaccgacctcctccccaccctccccggcctttcggacctctaccctcccgctcccaactccactgcacatctctcctggggcctcctccgcccgctcctctgccgctccgacgcgctcccgggaacctctgcaggcgtcctcgaggcagccgaagcctggcggaatctcaccctggctgtcaccgccgcggcaagcgaggaggaagcgcgtctccaaggactccgctgctcatcggccgtgggaggggatctacgcacgggacgtgccacacttcc

SEQ ID NO: 36416 - DNA, 439 bp, Zea mays
  Clone ID: LIB3060-008-Q1-K1-F11
caactaatcagcttactaggatgaagcctgcaacggtggcactgctcattttgttgaacatgatgtgcatagttgcatactttgatcatggaacgatggctgaagaaaccaccttgctggcaaattcgtatggaagaaatgaaggaaccaagggcatacatcatggaagaaagctgatggacaatagtattggttcaaaccgtgagtattcaatcgatgatatgtctcatccaaaggcaccacatactgagctcaagcaaccctcatacttagctcctggttgctcaagcaaccctctcaagcaaccctcatacttagctcctggttgcattccctaaagttcatgcatacatatatagccttccactcatcatatgctggtatccgatctatatatagacacatatgatatgttgcatatcgccaggttcttagatca

SEQ ID NO: 36417 - DNA, 363 bp, Zea mays
  Clone ID: LIB3060-008-Q1-K1-F12
gaaccaacaagattgtttgcttcgtgtttagccttttcatggtttgataaattctcgggcactcgagttagacaagacattactccgtattatttagaattaggggcttctgattggtcgtactcatggcaatgttggtgcctgatcttagtttctcggcatcgatctctagtgtgaaacttccaaagtacggggcatcaaagagtgagactttctttgttaaaagcccccaacattccgtgcaaaagctaggccagcggaatctggcaaatatggtactaataatggccggccaccaaaaatggtcccaacacttgagttaaggaggaccagtggtggtctttgaagatcagggacagttaa

SEQ ID NO: 36418 - DNA, 435 bp, Zea mays
  Clone ID: LIB3060-008-Q1-K1-F2
ggaaggcttgctgatggctcattggtatcagtgaaaagactaaaagaggagcgtacacctggtggtgagcttcagttccaaacagaggttgagatgattagcatggcggtgcacaagaaccttcttcgacttcgtggtttctgcatgacacctactgaaaggttgttagtctacccatacatggctaacgggagtgtggcatcacgtttacgagagcggcagccatctgagccacctcttagctgggaaccaagaagacggattgcactgggatctgcaagaggactttcttacttgcatgatcactgcgatcccaaaatcatccatcgggatgtcaaagctgcaaatattcttttggatgaagacttcgaggcagttgtgggtgatttcgggcttgccaagcttatgggctacaaagatacccatggtacaaca

SEQ ID NO: 36419 - DNA, 414 bp, Zea mays
  Clone ID: LIB3060-008-Q1-K1-F4
ggcacgttcatcgggtacgtgtgccgtgtccaccgacgaggagacggcgcggctcggccgccgggacatcgccgtggcgtggcgcggcaccatcacccgcctcgagtgggtggccgatctgacggccaaccagatccccctgcgcgagacgggcgtcccctgcccggaccccgacgtgaaggtggagcgagggttcgcggcgctgtacacggacaagggcaccagctgccgcttctgccggtactcggcgcgggagcaggtgctggccgaggtgcgcaagctggtggatctgtaccacgggcggtgcgagcaggtgagcgtgacggtcacgggccacagcctgggcagcgcgctggcgatgctgtgcgccttcgacgtcgcggatacgcgcgcgaacgtgtcgcctggcgacag

SEQ ID NO: 36420 - DNA, 269 bp, Zea mays
  unsure at all n locations
  Clone ID: LIB3060-008-Q1-K1-F5
atcttggcctcgtcaatccaccaccaccgtcgtcgctgagctcctcctccggcttcgcttcgctgtcttgcctcctcctcggtcgaagaagaagaagaagaaaacatgtgtccgggatccgtggagtcgtcgtcggcggcggcggcgggcaagagcgtgtgcgtgatggacgccgcggggccgctgggccacgcgctcgtggaccgccttctccggcgcgggtacaccgtccacgccgncacgtacgcccgcgacggggaggagggcgc

SEQ ID NO: 36421 - DNA, 357 bp, Zea mays
  Clone ID: LIB3060-008-Q1-K1-F6
ctcgtcctcgtgcccatctctgtcccaatcaaactgattgatccgtcgcccgcagggccacagcagccgcggcgaggtcgtccgtcggattcggaagctcagttattactgaaaagataatacagtacctatggcttctctggacgccgtgcgaggagacctcgccctgctgattctgtacctgaacaaggccgaggcgcgggacaagatctgccgagcgatccagtactggtccaagttcattagcaacggcgagccagggcctgtgcagaacgtgtacaagttcaccaatctgtcccggaaagtgttccggctttgtaaagttgtcaacgatctgcacgctttgatcagtccttc

SEQ ID NO: 36422 - DNA, 433 bp, Zea mays
  Clone ID: LIB3060-008-Q1-K1-F7
ctctgactaagactatagaatgttcctgcgtggcatagggacctgtgcagggtctgtgaaaacatccccattgtcctctgcggtaataaggttgatgtgaagaacaggcaggtcaaagccaagcaggttactttccacaggaagaagaatctgcagtactatgaaatttctgccaagagcaactacaactttgagaaacctttcctgtaccttgcaaggaagctggctggtgatccgaaccttcactttgttgaagctgttgctcttaagcctccggaagttaccatcgacatggctatgcagcagcagcatgaagctgagcttgctgcatcagctgcacaacctcttcctgatgacgatgatgatctgattgaatagaaaggatcatgagtcttggactggaacagaattgtgccttgcacgatttaaattt

SEQ ID NO: 36423 - DNA, 402 bp, Zea mays
  Clone ID: LIB3060-008-Q1-K1-F9
ggcatcggtgttggcagcatgaaaagctttgagcgtgcattgttgcatgttggttgggagctaggctatggcaaagaaggaagtttttcattcccaaatgtccctccaatggcagaccttgtttatgaagttgaactcattggatttgatgatgttaaagagggtaaattccgaagtgacatgacagatgaagagagtattgcagctgcagacaggagaaagattgagggcaatgcatatttcaaagaaatgaagcttgaggaggccatgcatcaatattaaatggccattgcatacatgggagatgatttcatgtttcaattatttggaaagtacagatacatggccttggctgtgaaaaatccatgccatcttaatatggcttcattgcttgatcaaact

SEQ ID NO: 36424 - DNA, 411 bp, Zea mays
  Clone ID: LIB3060-008-Q1-K1-G1
aggcagcacactcagctatccagcaaatgagatcgagaggcaggagtcatggccaccgtcagcgccgccgtggtgaccaccatcgttgcccgcgccgcgatcgccaggcccaatgctctagggctgcctgcgctgagggcgaggagcgagagggtgcggtgcagctacgccaaggacgcggccccagtcagcaccaagggcgcaggcgcgtcgctgctcgccgcagcgggcgcggtgaccgcgtcggcggggcccgcgctggcgctcgtggacgagcgcatgtccacggagggcaccgggctgagcctcgggctcagcaacaacctgctggggtggatcctcctgggggtcttcggcctcatctggtccctctacaccatctacacctctgacctcgacgaggacgaggag

SEQ ID NO: 36425 - DNA, 298 bp, Zea mays
  Clone ID: LIB3060-008-Q1-K1-E3
cctcgggtcaaaccctaagcagggagttgatttatccgctgcagccatgagtaagttgcagtctgagtctgtcaaggatgccatctcccagattgttggggatgccaaggagaagaataggaagttcactgagactgtggaacttcagattggtctgaagaattatgatccacataaggacaagcgtttcagtggctctgttaagttgtcccatattccttgttccaagatgtatgtgtgcatgcttggtgatgcccagcatgttgaggaggcctagaagatgggacttgactacatt

SEQ ID NO: 36426 - DNA, 312 bp, Zea mays
  Clone ID: LIB3060-008-Q1-K1-C8
ctagctctatagctcgagtattgcttgctctccacaagaaacaaagcagagcaccaacaatggccgccgcctcctcgtcctcggtcctcctgctgctcctggccgccgccttggctggcatgagcgccaacgccgccaccttcaccatcaccaacaactgcgggttcaccgtgtggcccgcggccaccccggtgggcgggggcacgcagctgaacccgggcgggacgtggaccgtcaacgtgccggccggcaccagctccggccgcgtgtggggccgcaccggctgcttcttcaacggcaacagcgggagct

SEQ ID NO: 36427 - DNA, 411 bp, Zea mays
  Clone ID: LIB3060-008-Q1-K1-C9
gctgatagacgatagaagcacgcagcagctgaaagggaggggaactaggaatgaaggggagcaaggtccacgagcacgaggcagacgtccccgcctccgacctctgggcgatctacggctccctccgcgccgcggaactcctgccggagctgctcccgcacgtgcttgccaaggtggagctcgtcagcggcgacggcggtgttggtaccatcttgcagctaatatttcctcccgggattcctgggctacagagttacaaggagaagttcatcaaagttgacaacgagaactatatcaaggaggcagaagccattgatggcgacattttgaagctggggttcgaggcatacatgatacggtttgagatcattccaaaaggggccaattcgtctgtcatcaggtcgactatcg

SEQ ID NO: 36428 - DNA, 396 bp, Zea mays
  Clone ID: LIB3060-008-Q1-K1-D1
aatttgcagaccttatcctttttacagctaggtttagaaggttatgctagacctttaggtgatcgaatagatgttcacaatagattcagacttcgtctctatcgcccatcaactgttaccacggaatacagagaacatgtgaaagatctttcttgcgtgtcaaaagatttcggcaggattgtcattgtcgacaacaatccgttcagtttcattcttcagcctttgaatggaataccttgtgttccattttcagctggacaacattctgatgaccagctcatgatggttatatttccactcctgaagcatctttctctccagaaagatgtcagacctgtattgcatgaaaggtttcatatgccagaatggttccaaaagcatgggatcccccaaact

SEQ ID NO: 36429 - DNA, 379 bp, Zea mays
  Clone ID: LIB3060-008-Q1-K1-D11
caagcaacacgttgctctgatggctaccgtgaatagtgggaagacgtacattgccggcgctaccgctccagaaatgaaatggggtgatgatggcgtgaagttacgttcggctgccgtatctctatcgatttcatgatttattgtgcaaaatataacaactaaaaaaatgtgatacaactctcggattcagcggttcgcatagagggatctattactggtctagtcattgaaagaaggttaatagttgggttagtcgacaaaagcgacaaaagcactggatgagactgcaaggtttcagtcaagtctgtaaacaattttggaagtggatatgtattgttatgaagactgcattatgattgaaatttataaatattattat

SEQ ID NO: 36430 - DNA, 355 bp, Zea mays
  Clone ID: LIB3060-008-Q1-K1-D12
ttggtggtggagacaacaacgttggttacaaaagccaagaccttttgaacactatggttggccaagggtttctggttaggcaaagacgcggttggcaaggccaaagcattcgatgagaaacatggcttcacattcacagccggtgctacagtggcctcaattgacaagaagattgggctgactgataagatcacgacaggcactttcttggttagcgggaaggtgaaagagatggaccagaagttccaggtcttcgacaagaccaagtctgcactcgctgccgccgagcagaaagtgagcagtgccgggtctgccatcatgaagaacaggtacgtcttcaccggcgcgtcatggg

SEQ ID NO: 36431 - DNA, 414 bp, Zea mays
  Clone ID: LIB3060-008-Q1-K1-D2
agcaaatgtaacttgaatacgataaaaacaaaagtatcattttcactggcctggacacctgatgactgactgaatttatttctgagtttagaaaaggacaagctctgcagtttaactggttgtatgagaaaggggcttttgtgttgcagtctgacggaaaattctcagttgattttacaatggttgaggatgctgtagaaagcctgagcagggagatactgacaatacaggcaaagggcgataagccttctgcccaatctcttctccagtcccgtgcaacattgacacaaccattgagaatggcattggagaggatagagcacatgcaggtacctgttgacatagccccggtattcagcacggcaaacaagctatttgcagacatttaactatttgggctcagaatcggtgtgc

SEQ ID NO: 36432 - DNA, 330 bp, Zea mays
  Clone ID: LIB3060-008-Q1-K1-D3
cagccgtgttactgattacaagggaagtatgcatgtgccctcctgcatcactataaatggaacatcagcaagttgagtgatgaatggtttgcagatgaagaaaaagtccgccatactgttggcttacttttgaatggaaatcatgagcccggctctaggaagctaacctgtggaatatgttgtgaagggtattcttctgatacgatgagctctgctggttgcgctcatttttattgccatgaatgttgggaaggctacattagcgctgctataggtgtgggtccaagatgtttgtctttgcgatgtcctgatacatcatgtagtgctatt

SEQ ID NO: 36433 - DNA, 405 bp, Zea mays
  Clone ID: LIB3060-008-Q1-K1-D4
gcgccgcgacgtccctcgccttcgccttcgaatccgagactccgatctcgggttcaccgcagcgcacagagcagccccgactcccggcccgatccgcgctctcctctccgtcgcttcagtcatggcaggaatggcacctgagggttctcagttcgatgctaagcactatgattctaagatgcaggagctgctgagcaccggtgagactgaggagttcttcacttcatatgatgaagtttttgagagttttgatgatatgggcctccaagagaatcttctgagaggcatttatgcttatggttttgagaagccatctgcaattcatcagagaggaattgttcccttctgcaagggtcttgatgtcattcagcaagcacaagtctggtacaggaaagacagctacct

SEQ ID NO: 36434 - DNA, 402 bp, Zea mays
  Clone ID: LIB3060-008-Q1-K1-D7
cagattttggtggggaggttgagcgtgttctgatcatggtggaaggagttcttctaggggttgattctgtagaggggcctatgccacagacaaggtttgttctgaagaaagctctagaatttggacatgctgttgttgtagttgtaaacaagatcgacagacctactgctcgtcctgagtttgtggtgaattcaacatttgaactatttattgaattaaatgcaactgatgaacagtgtgatttccaaacagtctatgcaagtggaattaaaggaaaggccagtctatcttctgacaatttagctgatgacctaggacccctttttgaggcaattcttagatgcataccagagccacgccttgagaaagatggtgccctgctaatgcttgtatctaatactg

SEQ ID NO: 36435 - DNA, 420 bp, Zea mays
  Clone ID: LIB3060-008-Q1-K1-D9
aaaaatatccccaaaccctagctcccgatctcgatggcgaaccctcgcgtcgtcttcgacatgaccgtcggcggcgccccggcgggccggatcgtgatggagctgtacgccaacgaggtgcccaagaccgcggagaacttccgcgcgctgtgcacgggcgagaagggcgtgggcaagtccgggaagccgctccactacaagggctccaccttccaccgcgtcattcccgagttcatgtgccagggcggcgacttcacccgcggcaacggcaccggcggcgagtccatctacggcgagaagttccccgacgagaagttcgtgcgcaagcacaccgaccccggtgtgctctccatggccaacgccgggcccaacaccaacggcttccaattcttttatctgcaccgtcgcgaaccccttggt

SEQ ID NO: 36436 - DNA, 379 bp, Zea mays
  Clone ID: LIB3060-008-Q1-K1-E11
gacgcgcgggcgataccgtatagtcgcttgaggacggccaaggaaggatctagcccaaggagccctccttggcggagagccgcttgaggaactcgtaggtggtcaccatggtggccgctgacagcgacatggacccccacctgggccccagcccacggtagcacgccgcccagccggcctacttgagcagcccgcgcacggtgctggccagcgtgggccgcgccgccgcgtcggcctccatcacctgcagccgcgtcttcacggtgtccagcggcatcgtcaccagcgccgcggtgcccccggccagggccgcgctcgcgccctgcacggtcatcaggcaagcgcagctctcggagcgctcggtccccacggcgcgcca

SEQ ID NO: 36437 - DNA, 306 bp, Zea mays
  Clone ID: LIB3060-008-Q1-K1-E12
taccgacgcgacccacgcgttcgggcctcgctaacgcgcccttgctagctccagcggtggcacccacgcacacggttatgggccactagtccggaccccggaggagccaagccatggcgtccacctcctgctgcctcctccaccagtcaaccgcccgcctcggcgcgtcgccgcgcctggccgacgccccgccgcgcagcgcccagctgctcgtctgcaaggcccggaagcatgaagccgtcgcggaccatatcgacgtttcgcgccgctccgcgctcgctctcctcgccggtgtatctgccggtg

SEQ ID NO: 36438 - DNA, 414 bp, Zea mays
  Clone ID: LIB3060-008-Q1-K1-E2
ggacggcatgaagattgctcatgaggagatatttgggcctgtgcagtcgatcctcaagttcaaagacctcaatgaggttatcaagagggcaaacgcgagccagtatggattggccgccggcgtgttcaccaacagcctggacacggccaacaccctgacgcgcgcgctcagggccgggaccgtctgggtgaactgcttcgacgtcttcgatgctgcgattccgtttggcgggtacaagatgagcggcatggggagggagaagggcgttgacagcctgaagaactacctgcaggtgaaggcggtcgtcaccccaatcaagaacgccgcgtggttgtagacgctgcaagtgtggccttgtgcacgagaaccacgtatattcatttcctgggcacattcccgaacaatgtgaagcgt

SEQ ID NO: 36439 - DNA, 337 bp, Zea mays
  Clone ID: LIB3060-008-Q1-K1-C6
ctctcgcgcgccggctccacgcagatctaggagatatgcctcgctatgatgaccgctatggaggcacgcgcttgtatgttggcagattggccactcgtactcgttcccgcgatttagaacatctgtttggcagatatggaagaatacgagaagtggagttgaagcgtgactatgcatttattgagttcagtgatcatcgcgatgctgatgaggctcgataccagctagatggcagggatgttgatgggagtcgtattgttgttgagtttgctaaaggggtcccacgtggttcatgtggctcacgtgaatatattgggagaggcccttcaccaggttc

SEQ ID NO: 36440 - DNA, 435 bp, Zea mays
  Clone ID: LIB3060-008-Q1-K1-B12
gcctcgcctcgcctcgcgtcgtctcacctcacctcacctcgccgactagggttttgtaccgccgtggatctcgccgtccccgccatggacgtctcgcacgcgggatcctccgtcgccggcgaggctccgaccaccggggagcaccggatggggactaccatcgtcggggtctgctacgagggcggcgtcgtcctgggcgccgattccaggaccagcactggaatgtatgtagccaaccgtgcttcagacaagattactcaactgacagacaatgtgtatgtctgtcgctctggatctgctgctgatacacaagtcatttcggattatgtacgctatttcctccaccaacacacaatccagcttggacaaccagctaccgttaaagttgcagccaacttgattaggttgctagcttatcagaacaagaacatgttg

SEQ ID NO: 36441 - DNA, 404 bp, Zea mays
  Clone ID: LIB3060-008-Q1-K1-B3
cccacgcgtccgcggacgcgtgggcaacacacacagagagaggacaactcctcacaactctcccttccctcctgtaggggccaaaagggttagagagtaagagaagtagttcattcccttgcccaacacacgaaaacaagctctcctcatcaccctaatccaagcaactgcttgtgtgttgggaaattcttgtgacccctgctatattattatccgtgtagctactagcttcattcccccctttgtacccatcagatggctggcatgtttctgcaacacccctgggcgttcgctttcggtctactagggaacgtcatctcattcatgaccttcctggccccgataccgacgttctaccgcatttacaagatcaagtcgacggaaggctgtcagtcggttaccta

SEQ ID NO: 36442 - DNA, 380 bp, Zea mays
  Clone ID: LIB3060-008-Q1-K1-B4
cggacgcgtgggcggacgcgtggggtgaacctgaaacttgcggtgtcactggctggtagcctgagtgtgagtgagtgatcgagctagctgagctccgatcctcgctagctaggataccgccataccacaagtcttcttcacaagtttaggagtgacagcaacaagagatcgatggcctctgccaccgtgctcaagtcctccttccttcccaagaagtccgaatggggcgccaccaggcaggccgccgcgcccaggccgcccaccgtctccatggtcgtccgcgcctccgcctacgccgatgagctcgtgaagaccgcgaaaacgatcgcgtcgccggggcggggcatcctggcgatggacgagtcgaacgcgacgtgcgg

SEQ ID NO: 36443 - DNA, 404 bp, Zea mays
  unsure at all n locations
  Clone ID: LIB3060-008-Q1-K1-B5
cagacaagcaaggaatcccccgatggctcatcgcgttctcctcctcctctctctcgcgtcggccgccgcggttgccgccgccgtcgacgcggaggacccgctgatccggcaggtggttcccggtggagatgacaacgatctggagctgaacgcggagtcccacttcctgagcttcgtgcagcggttcggcaagtcctacaaggacgccgacgagcacgcgtaccggctgtccgttttcaaggccaacctgcgccgcgcgcgccggcaccagctgctggacccgtcggcggagcacggcgtcactaagttctccgacctcacgccggcagagttccggcggacctacctcggactncgcaagtcccggcgcgctctcctcagagaactcggggagtcggcgcacg

SEQ ID NO: 36444 - DNA, 425 bp, Zea mays
  Clone ID: LIB3060-008-Q1-K1-B6
ggcgaccacggcgccgctgctctcgccccagcgcgcttgccctacccatctccggcgccgcctctcgcccctacatctcgtattccccctcgacgcgtcagcgaggcggctgcgccttcgccgggcgccgccaccttgttcggccaagttcggcaagttcgacgcctccgacgccccggcggaggccgaggaggcggggggcgcgacggatggtgggctggcgcagcccgtggaggaggacgacagttgcttgccatcggatttggagggcgcgattcggcagtcagggaaggcgagcgcagatttcgtaaactccggaggcatgcgagctatcgcagaactgctgatccctcagttggaattcctcaacgaggaatgagcacaggctgaactttgggcgttgtcaaagattttctggacacact

SEQ ID NO: 36445 - DNA, 405 bp, Zea mays
  Clone ID: LIB3060-008-Q1-K1-B8
gtcccggcgagcccgtcggagcggcggtagtggaaggtccggccgtactcgcgccggaccatggtgggcgtcgacagggtcaccgtgacgcggctggggtccccggatgacccggcggcgccgtgcgcggtggcgcacagcgtgccgggcgtgctgttcgcgctcggcgggctcacgggcaactactggcacgacttcagcgacgtgctgatgccgctgtacgccgcgtcgcggcggtacggcggggaggtcctgttcctggtcagcaacatgcagccgtggtggctgggcaagtacgaggccgtggtgcggcggctgttcaggtacgacgccgtggacctggaccgggacgcgcgggtgcgctgcttccgacgtcttaccgtgggcctgcgcctgcacaaggag

SEQ ID NO: 36446 - DNA, 433 bp, Zea mays
  Clone ID: LIB3060-008-Q1-K1-B9
catacagatacagaaagttgcttcggctctaagcatacagcttcaaaaagcagattcatgcttcgttgtgtacgaaaagaagggagggtgtttttcaccttcggctcaaaaaatacaagtttcgtccacatcaaagcatttcatacatcgatggaaaggtaaaaatatattacaaggtatggacaaagttacaatattctttataacggataatacaagaatttttcttagaatctttccacagttagatattcgagcttcatcatcatctgttgagcttcggattgtctgctaagcttcggctttgtgttcttcggcttcgtcatcttgtacatatcaaagcattataaggaaaattcaagtttcaaggaaaaggtaagcacaaggtatgattttattaccggcttaagatgacttcgagcttcatcaccag

SEQ ID NO: 36447 - DNA, 430 bp, Zea mays
  Clone ID: LIB3060-008-Q1-K1-C1
gtcggctcgttgagtcgttgacagccgtagcccccacccccagcacgccgtccccgctttcctctcgccatcttccccagaattccgacccgctagatccgcaccctgttctttcgcctcgctcctcggcacctgcccgtctcccatgggctcttgccgccgctgacactggggcccaacgctctcctccgcgtccgcacccgcctccgcctccgcctcctctccctccccttccacctcctcctattgcctccactaaacctagccgaccgcctccgcccgccgacatcggaagccctagttgctgcgggaaccgccctgccggcccgccgctcctccgccccaagtgtccctggtttcttggatgcaccgactgctccgatggatgcccctgcgcccgccgtggagatccgcgaagtctgggcgagca

SEQ ID NO: 36448 - DNA, 411 bp, Zea mays
  Clone ID: LIB3060-008-Q1-K1-C10
atcgcctccgccccctcccctactccggtcgcagtcgccgacgtcgtcacgcgcattgcgccgtgccaatcgggtacacgagcagggcgggggatgacgtcgtcggcgtccgcgccggcgtccaatggaccgcgctacgcgccgccggatccagcgctggccaagccgcggagggggctcatcgacggtaacacggggtacctctacttctggaaccctgagaccaaggttacgcagtacgagcgccccgtcgcggccgtgcccaactcctcgacgcagccgtctggctactccaggcccgaggagaggccgagaagcagcacaccttccgagcggagctcggaaaccacggtgagccgcccgcagtatgcacctgtcttggataacagggctagggatgaccactcggag

SEQ ID NO: 36449 - DNA, 420 bp, Zea mays
  Clone ID: LIB3060-008-Q1-K1-C11
cggacgcgtgggtggatgttctacgcaaaaatgctagtgttgcattgccagttattctaactaggctcaaacagaagcaggaggagtggtcaaggtgtcgatcagatttcaacaaagtttgggccgaaatatatgccaaaaattatcacaagtcacttgaccatcgtagtttctatttcaagcagcaagatacgaagaacctgagcacaaagtctctcctgacagagataaaagaaattaatgagaagaaaaggaaggaagatgatgtgctccttgccattgctgctggaaataggcggcctatagttcccaatatgtcattcgagtatatagactcggaaatccatgaagatctacataaaatcattaagtactcctgtgctgaagtctgcaactcttcagatcaattagattaagtga

SEQ ID NO: 36450 - DNA, 434 bp, Zea mays
  Clone ID: LIB3060-008-Q1-K1-C12
cagacaagcaaggaatcccccgatggctcatcgcgttctcctcctcctctctctcgcgtgggccgccgcggttgccgccgccgtcgacgcggaggacccgctgatccggcaggtggttcccggtggagatgacaacgatctggagctgaacgcggagtcccacttcctgagcttcgtgcagcggttcggcaagtcctacaaggacgccgacgagcacgcgtaccggctgtccgttttcaaggccaacctgcgccgcgcgcgccggcaccagctgctggacccgtcggcggagcacggcgtcactaagttctccgaccttacgccggcagagttccgccggacctacctcgggctccgcaagttccggcgcgctctcctcagagaactcggggagtctgctcacgaggcgcccgtgcttcccaacgatggtcttc

SEQ ID NO: 36451 - DNA, 216 bp, Zea mays
  Clone ID: LIB3060-008-Q1-K1-C2
aggtgtcgggcagcctttcggagcagatttagtggataggccgggcgatcttgagccgtgccaaggcacgcgcttgcatgttgaccgatacgccactcgtattcactgatgacatttataacacctgcgtggtggatatctgtgtgtacgacatgctgatttgactcggtagtatctcgggattgtacatgatacgacatcatcaacctgctgatg

SEQ ID NO: 36452 - DNA, 405 bp, Zea mays
  Clone ID: LIB3060-008-Q1-K1-C3
gcgcgcaaggttgttactatctgggttttagcctatccgcgaggaaggtaaattagttggagacttcgtgatggctgctgcgaagtcgggcgtagacgtggaaacgagggacggcggcggcggctccttcagcgaggagaggtttgttgataagctcaacaagctcaacaacacaacagcgagcattcagacactttcacattggtgcatttttcaccgcaagagggccagaaggattgtggacacatgggaaaagcatttcagtactgcaacaaatgataagaaaatatcattcctgtttctatcaaatgatatcttgcaaaacagttagcgcaagggaggagattatgtgcatgagttctggaaggttctacccagattattgaaacatttttacgaaaatgg

SEQ ID NO: 36453 - DNA, 408 bp, Zea mays
  Clone ID: LIB3060-008-Q1-K1-B11
gggaggcagctcagcatacccgcctcggtcttctccgctgggacggtcatggactcgggcacggtcatcacgcggctgccgccgaccgcctactcggcgctgtcgtcggcgttcaaggccgggatgaagcagtacccgccggcgcagccgagcggcatcctcgacacctgctttgacttcagcggccagtccagcgtcagcataccgtccgtcgcgctagtcttctccgggggcgccgttgtcagcctcgacgccagcggcatcatcctcagcaactgcctcgccttcgcgggcaacagcgacgacagctccttgggcatcatcggcaacgtgcagcagcggacgttcgaggtgctgtacgacgttggccggggcgtcgtggggttcaaggctggggcgtgctgatcg

SEQ ID NO: 36454 - DNA, 259 bp, Zea mays
  Clone ID: LIB3060-042-Q1-K1-E2
cctgatctggtcttaagaaccccggtggcggtttgacatatgcaagggttaagtgctagatatggcgtgtgattggagatcctcagctgagtataatcgattcggatcgccgtacctccgcggttatggagacttggccactgacttacacgtagcattccactaaagatgatgggtttttgctaagaaattggctagtgcaggaccagtgattgaactagggtagaaagaactctagttgcaggtaattgtacgtaac

SEQ ID NO: 36455 - DNA, 259 bp, Zea mays
  Clone ID: LIB3060-042-Q1-K1-E3
gcgatcctccacaccagcacccgccgtcgccttctattcccttgcgcacctgctgctgggcgggtcggtgaggcggaggagtaggatggcgagcgcagccggaggcggagcgtcagtggaaggggagtggcttaaggtatcccacttcacgcccatggtggaagcgcaggaccccaactccaaggcagtgtacaacctgacgctgcgtcggatactgcgcgcgcgcgaccacgacgtggacaaggcctgcgacatgttc

SEQ ID NO: 36456 - DNA, 259 bp, Zea mays
  Clone ID: LIB3060-042-Q1-K1-E6
cgccagcttcaccgttgaaatttctttccccaaggtcttaaaatgtgactatgcgatgggtttttaaattgtggtggatgctcagcgcctgcagcaacaactacaaacacaaccagagtctcttccttttgatgaaatcctctattgcaatattgggaatccccaatctcttggtcagcaacctgttacattcttcaaggaagttcttgctctttgtgattatccgtgcctcttggaaaaagaagaaaccaaatcattt

SEQ ID NO: 36457 - DNA, 408 bp, Zea mays
  unsure at all n locations
  Clone ID: LIB3060-042-Q1-K1-E9
ggcatcttcgtctgccagatctggcatgtgggcagggtctccaccaacgagctccagccggacggcgacgcgcgtatctcgagcacggacaagcagatctcccccgacgccaagtccggaacggcgtactcgaagccgcgccggctgcggaccgacgaggtccccgggatcgtcgacgacttcaggcgggccgcacggaacgcgatccaggctggtttcgacgccgtcgagatccacggcgcgcacgggtacctcctggagcagttcatgaaggacagctgcaacgaccgcacggaccagtacggcggcagcctggagaaccggtgccgtctcgccgtggaggtcgtggacgccgtcgtccgcgaggtgggcgcgcgccgcgtcggcatcaggctgtcngccttcgtc

SEQ ID NO: 36458 - DNA, 261 bp, Zea mays
  Clone ID: LIB3060-042-Q1-K1-F1
gccccgtactactatccccgctaccgctagccgccgcgctgctcatctggtggcggctcgcctggctccccccatccgccgccgccggctcctcctctagctccctccttaccccgagctttaagctcgtgctacctgcctacctatccgtagggagagagagagagaggggagaaggttcggtcggtcggtcgggggctctcggatctcgccgctgcctccccgtttcttcgttgggatctcgctcgcttcgcgccatgg

SEQ ID NO: 36459 - DNA, 407 bp, Zea mays
  Clone ID: LIB3060-042-Q1-K1-F10
ggaagatcagaatttcccagcaccggatgaactgtttcttctttatcttcagcttgtaacgaacagtctccatcaggtcagccggtggaaccattctcaaactttgggccctttttgacaggttggtctccttcagagacgagacaatagcaccaagtgcaggtttgatcggatcaaacatgagcaaacggaggcagtcaacggatgatctcacatactgcaggtcaagaagcggaaggcgcgggtgcctctcgacgtcgccgacgccgtgatggagccagtacggcggtccggccggctcgccaacctcccggataagcccgtgtaccgcgagaaggttcccgattttgggatgaagattaggaggacgtacggatcggtgagaagagatctgaccaaccgggtgt

SEQ ID NO: 36460 - DNA, 253 bp, Zea mays
  Clone ID: LIB3060-042-Q1-K1-F11
gatcacaatcttccagcaccgcttgatttgcctcctctctatcttcagctcctgacgttcattctccatggtggccggcccttgaaccattttcaaactttgggccctttttcacacgttggtcttcttcatagacgagacaatatcaccaactccatatttgatcggatcaaacatgatcacacggatgctgtcaacgtatcatctcacatacttcacgtcaagaagcttaaggcgcgattgcctctcgact

SEQ ID NO: 36461 - DNA, 263 bp, Zea mays
  Clone ID: LIB3060-042-Q1-K1-F2
gggcaggagtaggtaaaacagtactcatcatggaattaatcaataacattgctaaagctgatggaggcgtatccgtatttggcggagtaggggaacggactcgtgaaggaaatgatctttatatggaaatgaaggaatccggagtaattaatgaaaaaaatattgaggaatcaaaggtagctctagtctatggccaaatgaatgaaccgccgggagctcgtatgagagttggtttaactgccctaactatggcagaatatttc

SEQ ID NO: 36462 - DNA, 264 bp, Zea mays
  Clone ID: LIB3060-042-Q1-K1-F3
caaaaaaagcaggcgcaatggcgagcagcaccatggctttctcctccacggccttcgccggcaaggccagtaacgtgccgtcgtcgtgcgagttcggcgaggcccgcgtgacgatgcgcaagacggcggccaaggccaagccagcggcggcgtccgggagcccgtggtacggacccgaccgcgtgctgtacctgggcccactgtccggcgagccaccgagctacctgacgggcgagttcccgggcgactacggctgggacaccg

SEQ ID NO: 36463 - DNA, 262 bp, Zea mays
  Clone ID: LIB3060-042-Q1-K1-F4
cggacgcgtggggaagcagaagaagcacgctcacgcgaggtcaaggagcttcaccggcggcgggctggcctccttcctcaggtccaccgtctcctccttctcctccgccttcccgcccagcggcaggaggtcctccttcaaccaccgcaacgccttctcgggccccatcgtcgtctccatcgtcccgccggaggctcgcggcggcggcggcaggaggaagcgcccggggtacgtgactcccgagccgtcgtcgcccaaggtg

SEQ ID NO: 36464 - DNA, 268 bp, Zea mays
  Clone ID: LIB3060-042-Q1-K1-F5
aaaaaaagcagccgcaatggcgagcagcaccatggccctctcctccacggccttcgccggcaaggccgggaacgtgccgtcgtcgtccgccttcggcgaggcccgcgtgacgatgcgcaagacggcggcgaaggccaagccagcggcggcgtccgggagcccgtggtacggccccgaccgcgtgctgtacctgggcccactgtccggcgagccaccgagctacctgacgggcgagttcccgggcgactacggctgggacaccgcgggg

SEQ ID NO: 36465 - DNA, 267 bp, Zea mays
  Clone ID: LIB3060-042-Q1-K1-F6
ctatgtgacgatcaatgtggtgaccatgatccaaatcgaactgaacatgctactagaggtaaaggtgggcaacttcctttttctgtccttcacagggtaataatcaatgaaaacaagaagaccccggaacaagtttgtgggacgtcaagcagttctgacaccccagtgcttaaatggatggtatgctgtgaatacttcacacaacccagagagtgtgaagctgcaataccgctacttggcaaacgatgatcgattcaatcacccttc

SEQ ID NO: 36466 - DNA, 296 bp, Zea mays
  Clone ID: LIB3060-042-Q1-K1-F8
cggtcctgaagggtcggcccgcgcgtccgcagatcctgcggcgaattccttccaactccaggatcgagagcacacgccgatggcgaggcaccgccgtgcgccgctgctccggcgtctgctcctcctgacggccctcgcggcctcctgctcctactacctcctcttcctgcaggcgcaggcctccgtcccgccgcggtacgacgggttcgcctacggcggcggcgccgcgacggcctggaaggacgccgtcctcgtcgaggcctttctcgacccgctctgccccgacagccgcgacg

SEQ ID NO: 36467 - DNA, 410 bp, Zea mays
  Clone ID: LIB3060-042-Q1-K1-F9
ctgcgctcacattcatcccgcgtgctctctctctctctctctctcgggccgtggcgtcgagtgggcgaccgccgccacccccgtgccgtgcgctctctctctctctctcgtgtcgacgggtgggtgggcgaccgtaggccgccgccgccgcctaggccaggtgcccaggtcgaccttcaacagcgacgagcatccaccagatttctacatgagtgtgatcttcctattgtgaattcagacgcaatcaagtatggcttcaatggcaatcattaggagaaggaagtatttcttggatcatgttaacacacctaccatttcatcgtctgctttctttacattccaacatggaagactcggtttggaggttgagccaagaacagaacagcgatttctcgagcatagttctgggg

SEQ ID NO: 36468 - DNA, 402 bp, Zea mays
  Clone ID: LIB3060-042-Q1-K1-E12
agcaaggaagaattaacaataaaaaattgtaacaaaataaaaaatattagaaaagttacggcagggaaagaagaggaagatccgaagatccgcacaaaattagattagatcgtggtttggtgacttgataagaggggtggggtgaagcgtctatgtcctgcgtgttctgcagggtgttcgggaagttcaatgatcagagtcaggcgaccgcgctggcctcgctcgacaagctcaacgagacacttgaaatgttgtaaaagaaggataacttgctagtgaaaaaggccaatcttgatgttgagaaggctaagaattttaccaaagccaagaataaaagagccgcagtacagtgcttgaagaggaaaagactatacgagcaacatattgagcagtttggaaatt

SEQ ID NO: 36469 - DNA, 200 bp, Zea mays
  Clone ID: LIB3060-042-Q1-K1-G10
agcagcttctgcttgctctggggggaatgagagagagagagcgagagagatctagtagagaggctagctaggtggtcctcgaacgaagatgttggcggtgttcagcgggcaagtggtggaagtgccggcggagcttgtggcggcgggcaaccggacgccgtcgcccaagacgaaagcgtcgcaacttgtggggcgctttc

SEQ ID NO: 36470 - DNA, 431 bp, Zea mays
  Clone ID: LIB3060-042-Q1-K1-G11
cggaactcccggggtgctcgatctccatctcgaccgtcgctcaccgggaagctacgctacgacgaagcatggcgtccgtcaccgcgcgcgccccggtcgcagccctgcgcccgtcgtcgtcgtcggccttccttggccactctagccgcctcggccgcactgctaccgcgtcgccgacgaggcggagcctcaaggcggaggccaagggcgagtggctcccgggccttccctcccccgcctacctcgacggcagcctgccgggtgacaatggcttcgacccgttgggcctggcggaggacccggagaacctgaggtggtacgtgcaggcggagctggtgaacgggcggtgggcgatgctgggcgtggccgggatgctgatcccggaggtgctgaccaaggccgggctgatcaacgcgccgcagtggtacgac

SEQ ID NO: 36471 - DNA, 263 bp, Zea mays
  Clone ID: LIB3060-042-Q1-K1-C2
cccacgcgtccggcaaaagccaaaaggcatcaccgccgcgacgacgatggcagcctcgctgcagagccgcggccaccctgatgcagccggccaagatcggcggccgggcgccctttgcctcgctgccgtcccgcccgtcgtcgcaactcgcctgcagggcgttcggcgtcgacgccggcgccgccaggatcacgtgctccctgcaggacgtcgccagcaggtgcgtcgacgccgcgaagctcgccggcttcgcgctcgccacc

SEQ ID NO: 36472 - DNA, 260 bp, Zea mays
  Clone ID: LIB3060-042-Q1-K1-C4
cctgcgcgacggcatcttcgcctcccatccgtttccagcttcccctcccactccggcccgcgcgcaaattgcccctctgcttgtcctactctatacacgctgccgaccacggctgccgccaaccacccgccccacccgtccaccgctgccgagtgctagccatttggagctgccgcgccatggcctccgtggccgccaccaccacgctggcaccggcactcgcgccccggcgccaggcgcggccagggactgggctgctg

SEQ ID NO: 36473 - DNA, 174 bp, Zea mays
  Clone ID: LIB3060-042-Q1-K1-C5
tataataacaattatatacccataccctttacatcaaacatgataaatatcaccatacagaacagttatttatcaaaggtcctaacatattccactttgacatacgtcaactatactacactcataactaaaaatgaatcttaatatcctaaaaaacacaaatatatttctaac

SEQ ID NO: 36474 - DNA, 186 bp, Zea mays
  Clone ID: LIB3060-042-Q1-K1-C6
aaacttccactatcacttctaaccgaacgctatttaacacaattcttctactacactatacactcttcctacacacaaattacttcaatacacattcccatacactacaccactaccaatcactacccacttcaaactcactccccataccactatcatcctccaccaacaatatctcaccaccac

SEQ ID NO: 36475 - DNA, 264 bp, Zea mays
  Clone ID: LIB3060-042-Q1-K1-C7
ccggctacgacaacgccgtcgcgctccccgccgggtgcagaggtgacgaggaggagctccagggggagggcatcaagaacgccgcctcctccaccggcaacatcacgttgagcgtcaccaagagcaacccggagaccggcgaggtcatcggcgtcttccagagcgtgcagccgtccgacaccgacctcggggccaaggcgcccaaggatgtcaagatccagggggtctggtacgctcagctcgagtgattcgagtgtctaactg

SEQ ID NO: 36476 - DNA, 265 bp, Zea mays
  Clone ID: LIB3060-042-Q1-K1-C8
aaaaaacagaaggcctcaaaaaggaattctggcaagtctagtttgaggtccttgattctaacgaggttgtatggaaaggaaggccagaaagagaagatgcttccggttgcaccaaagctactccgcactatttcgatacactatctggaaagcaatgaatacgttcttgacagctaatccacttcgagcggcgatggttcttcaaacagtactaagccgccgatgcaaaatgctggcgatatgatgaatctgcaccatgctacat

SEQ ID NO: 36477 - DNA, 397 bp, Zea mays
  Clone ID: LIB3060-042-Q1-K1-C9
gccaaatgaattcaccaaccatgtcatcaaacctacctcctatgcaaacacctgcaagccgacctcaggaacctgagccaattgagtctcaaagctcggtccagaggatattgcaagacttgatgatgcaatcccatattaatggtgttgggccagttggcagcgatatgaggagagcaaacacaattactcctggtctgaatggtgtcaactccttagttggtaaccccatgacaaataaccctggaatcaatgggatgggatttgcggccatgggtggccttggtcaacaaatgagaacggcgatggggaacaacgcattggcaatgaatggaaggaccgtgatgaatcacagtgcgcatgacctgacacagttggcccaccagcagcaacagcg

SEQ ID NO: 36478 - DNA, 362 bp, Zea mays
  Clone ID: LIB3060-042-Q1-K1-D12
ggttcggaattaccgggctcccccactttctccttgtcaccgagtcacaaagccaaaccttaattcacggccgccggagatgggacaaggttcgcccggcgggatgggcaagcagcccggcctcccgggcgaccgcaagcagggagacggcaagaaagagaagaaatatgaaccacccgctgccccttcccgtgtcggccggaagcagaagcggcagaagggctccgaggcggcggcgcggctccccgccgtggcgccgctctcaaagtgccgccttcgcctactcaagctcgaacgcgtcaaggactaccttctcatggaaaaagagttcgttgccagccaagagcgcctgcgccccagcg

SEQ ID NO: 36479 - DNA, 155 bp, Zea mays
  Clone ID: LIB3060-042-Q1-K1-D2
accaaatctactccacactatttctatacactatctacaaagcaataaatacattctttacatctaatccactttgatctactatccttcttcaaacactactaaactcacaatccaaaattctttccatatgatgaatctacaccattctacat

SEQ ID NO: 36480 - DNA, 264 bp, Zea mays
  Clone ID: LIB3060-042-Q1-K1-D6
ggacgaaagcgttgatgacacagctgtgaaggtggttgatattgttgacacattccgtctacaggagcaacctccttttgacaagaaatcatttgtgtcttacatcaaaaaatacatcaagaatctcactgctgtgttggagccagagaaagcggatgagttcaaaaagggtgtcgagggtgcaaccaagtttctccttagcaagctgaaggacctacaattttttgttggtgagtccatgaaggatgatgcgtctgtggtatt

SEQ ID NO: 36481 - DNA, 254 bp, Zea mays
  Clone ID: LIB3060-042-Q1-K1-D7
cgtacgaaagcgttcatgacacagctgtgaaggtggtttatattgatgacacattccgtctacaggagcggcctccttatgacaagaaatcatttgtgtcttacatcaaaatatacatcaagaatctcactgctgtgttctagccagacaaagctgttgagttcaaaaccggtgttgagggtgcaaccaagattatccttagctagctgaacgacctgcaattttaatgcggccagtacatcaactatgattca

SEQ ID NO: 36482 - DNA, 289 bp, Zea mays
  unsure at all n locations
  Clone ID: LIB3060-042-Q1-K1-D9
taccaccntaccactccagcgaggtttcaattcaaagtagttctcctcactcacaatctcctcctcaatacccattcaccttaatgccacctccgacgacttcatatccgccatctccttcattacccactcagtcgtcactaacaacttttcatcacatacaccaactgacgctaagctgaatgtgtccatcaacttattctgccacattcatcacaacttcctactgtacttacactttctcagcaactcctctcccctcaacttcatcgccatcaactacaccttc

SEQ ID NO: 36483 - DNA, 261 bp, Zea mays
  Clone ID: LIB3060-042-Q1-K1-E1
ccaaagcaacatgtttaagtccctgtggattttgctcgagggtcaggagcgctttcaggaagaggctttagctgtaccaaatcacccaagctcagtgggcgatgattctcagcaagatgaaagtaaatcttcaagttccaattcttgcatctactcgataaatgcaaagctgaagaagttttccgataggctcctgtacatcataacgacaggagacctagatacattctgacctgcagctacccgtgaatatgctccagt

SEQ ID NO: 36484 - DNA, 365 bp, Zea mays
  unsure at all n locations
  Clone ID: LIB3060-042-Q1-K1-C11
caaggagtcatctggctgctgcgccttcatttagctctcaggccgtcgcacgttcagcgtcacctgcacccacgtgaccagtgacacgccacatcagcatcgcgagcgatcgtacatgtctactctcgcacgtcgaccaccacacgacacctgatatacagagctcggacgcatagacatgcatgtcgatctacaggtcacagaaggatgctgctgatatgtataaaccgaacttcaagtacgcatgggtgctatacacgctcaatgctgaactagagagaagtactaccattgatactgctatgaggaagtttgaaaccaccagattctactgcacggacattgatgtcantggacacagtgac

SEQ ID NO: 36485 - DNA, 414 bp, Zea mays
  Clone ID: LIB3060-042-Q1-K1-E11
cgcacggcggagttcacaatccccaccggccggcgtagcggatattgcgagttacgacggggaaggagaggaagatccgtcgatccgcgcagattcgtttcgatcgtggtttggtgacttggtaagaggggaggggagaagcggcgatgtcgggcgtgttcggcagggtgttcgggaagtccaaggagcagagccaggcgaccgcgctggcctcgctcgacaagctcaacgagacacttgaaatgttggaaaagaaggaaaacttgctagtgaaaaaggccaatcttgaggtcgagaaggctaagaattttaccaaagccaagaataaaagagccgcaatacagtgcttgaagaggaaaagactatacgagcaacagattgagcagcttggaaatttccagcttaggatacatg

SEQ ID NO: 36486 - DNA, 467 bp, Zea mays
  unsure at all n locations
  Clone ID: LIB3060-041-Q1-K1-H9
cgtcgagacccaaccataccagcggcgccgcatgctgacgaggaggcggagtagagtggccggactacctcgacacctccactgcaaccatgggtatctcacgtgattcgatgcacaagcgccgggccaccggtggaaagcagaagacgtggcgcaagaagcgaaagtatgagcttggccgccagcctgctaacaccaaactgtctagcaataagacagtgaggagggtccgtgtccgtggaggcaacgtgaagtggagggctctccgattggatacaggtaactactcgtggngaagtgaggctcttacccgcaggacccgcatcctggatgtggtctataatgcatcanacaatgagcttgtgaggactcagactcttgtgaagagcgccattgtacaagttgatgctgctccattcaagcagtggtacctnactcactatggagtggacatcggtaggaagaaa

SEQ ID NO: 36487 - DNA, 267 bp, Zea mays
  Clone ID: LIB3060-042-Q1-K1-A1
agagatatcacagggacctcttcaggcttcaaggcagatccgcagcagatggaggcgaagagcgggctgccggaggtgaccatcgtcccggcggcacggccgttggctggcgacggcacagtcgacgcggcaaaggcggcggcaggcaaggagcccgtaagcccgggcactccgtcctcggtggccgccggccgcagcagctgtgaggagaggcgcgcggtggacggcgtcgccctgcctgggtggaagctcgacgccctctgccag

SEQ ID NO: 36488 - DNA, 401 bp, Zea mays
  unsure at all n locations
  Clone ID: LIB3060-042-Q1-K1-A12
cccgcgtctcgccgcgtagcggcgtatgcgccacagaaactcgcacgccgctccccggcgtgcggcccgagtcgccgtcgctgccgaatccaatccatggctccgcccgccgcacccaccgcgctgcaccaccgcacgcccctcctcctcccccgccgcaccgtcgccttgggtgccaccgccaccgcgcgcgccgccagggccgcttctctcgccgtcagggcccagccggacaccaccgccgcagccgtctccacctccgcgcctgagccggcgcccgagttcaagcctncgccggggttcaaggcgcccgagcccaagaggtacgaggtcaagtccggccaggtgggcagcgtcctcggcgcctcgctcgccatcccccttcgcctcggcaccggcgt

SEQ ID NO: 36489 - DNA, 261 bp, Zea mays
  Clone ID: LIB3060-042-Q1-K1-A2
cataatgttcaaggactggtctgggcagagtttaagcagtattgcctctgatatttgtgggtgggttactgtgcttactggtactgatgtactgcattctacaacagaacatgatccaacccttacttcagatttgtatgctcatatgtctccaatatataggcatatgcattgtaacagtttatcagtaggaaggcgtgtacaggatgattcactctctcgcactcctatatatgaggtgctacatgactacttagtgta

SEQ ID NO: 36490 - DNA, 265 bp, Zea mays
  Clone ID: LIB3060-042-Q1-K1-A3
aaacgtcgtggccagccatcccggtgtcgtcccgcgttctacagccaccgctgtcgtcgccgtgctaggctcctagatccgtcagcttaacgagctccattccttcgaggccagccatcccggtgtctcagcagcggcagcagcaagcgtcgagctcttgctttctgtgggaggacgcatggcgatgtctgctgagcgtgggctcttggtcctcttattctatgccggcgtagtggctgaactcgcctttgtcagaaacggtcct

SEQ ID NO: 36491 - DNA, 264 bp, Zea mays
  Clone ID: LIB3060-042-Q1-K1-A4
cacgacttccgtccgagtctgagctcatctccacgcgccgccgccgccgctcgacgccggaccgggcagccatggcggaacagactgagaaggctttcctcaagcagcctaaggtgttcctcagctcaaagaaatctggcaagggtaagaagccaggcaagggtggcaatcgattttggaagagcattggccttggtttcaagactcccagggaagcaattgaagggacctacattgacaagaaatgtccattcactggaaccg

SEQ ID NO: 36492 - DNA, 267 bp, Zea mays
  Clone ID: LIB3060-042-Q1-K1-A6
cacgcagatatccaggagctggaaaacattgcattagggagaaatgatgaagatggaaaaagatgaaggaatttatttggcaatagtcaccaccaagttcacgcaataacaaatttggaaccacaggttctttttgcataccctccagagaagcctcttccactcaagtacaaggataccctctctttctgccttcccggaggtgtacaggttcatgctgtcgaacgtactccttcgttcagtgagctgaatgaaattctcctggga

SEQ ID NO: 36493 - DNA, 279 bp, Zea mays
  Clone ID: LIB3060-042-Q1-K1-A7
gtcggccacgcgtccgcaaacggccaatcaatggacatgacgaccccagtgataacaaaaaagtcagctggtacagatagatggaaaatgtcatttgtgatgccagcgaagtatggttccaatttgcctcgcccaaaagatccttctgtgattatcaaggaggtgcccagcaaaatagttgccgttgcagccttttcaggtccataatattgtacttctgtcatacccatttcatagctgtatgtgattaagaagctatatattcagagtcaagtacat

SEQ ID NO: 36494 - DNA, 267 bp, Zea mays
  Clone ID: LIB3060-042-Q1-K1-A8
ccgacgccacagcttgtgcgcgcgcaatggcactcgtgtccgcctcctcgtcctccaccaccggcgtggcggcgctccccaggaatgggcagcagcgggcgtcgtcgtcgttgttctcctcctcctcctcttcctccttcctcgtcggcaagacgctgctgaggcaggccgaggcagcccggccgtcgttcgccgtgcgcgccgcggcggattccgacaggccgatctggttccccggcagcacccctccgccgtggctcgacggcc

SEQ ID NO: 36495 - DNA, 266 bp, Zea mays
  Clone ID: LIB3060-042-Q1-K1-B1
acccacagagccgcagcagactcgcaagggaaaggagatggatcgtctgcccgagtcgacccggagcgtgaggaagtacgcgtcggaggccggcgggcttcgcgcggcgcggcagggcccccacgggcggtcgctgacggcgcgcacggcgcacagcatgtccacgacggcgctgcgcaccaagtccaagtcggccgcgtcgctgctgcgcagggtgcccttcgcgccgctccgccccgtcctcgccaacctgcaggaggtgttcc

SEQ ID NO: 36496 - DNA, 377 bp, Zea mays
  Clone ID: LIB3060-042-Q1-K1-B10
aaaagatttatgctggacagaaacagataggcgtattccagcactccagctttttggcaggaggtgcaactatagctgctgggagatttactgcagaaaatggagtgatcaagtccatctgggcatacagcggccactacaaacctagtgcagagaacctcctcaacttcatgaacttccttgaagggaatggagtcgatctcaaagaagtcgaggtacgctcatcgaccagagaagactacaacgaagatccagtgcctaatgactcgcagaagttcgcttcagctaccatggaaccaacaaatcttccacagctggtcccccctctaaacaccacgcaaggcaatgaaagcgacaatgctcctaagatcaagcta

SEQ ID NO: 36497 - DNA, 256 bp, Zea mays
  Clone ID: LIB3060-042-Q1-K1-B7
aagagcaattatatacccataccctttctatcaaacatgagaaatatcaacaaacagaacgattatttagcaagggtcctatcatattgtagtttgacatatgtagacgatactagaataagaacaaaaaatgtatgctactttcctaaaaaacacaaatatgttccgaacatgagagcgcaacagcatatgacatcttcagcttggccttcagatggtcgcctgaccactaaatgaacgggaagacatcatggtc

SEQ ID NO: 36498 - DNA, 255 bp, Zea mays
  Clone ID: LIB3060-041-Q1-K1-H7
cgcgcccgccgctccccactttgtcggccagctactgctccccgtgtccggggattacgagtgccggcgcggagcgcagccactgccaagcactcggatggtcagcgcagacgctaccggcggaggtaacatggccagcagtggtaggggacccacgttcgtgagccaagtgttcaccatgctcgacccatccgggaacgggctcatggccgttaccacacgcttcgagctaccgcgctttctatccaacaggac

SEQ ID NO: 36499 - DNA, 250 bp, Zea mays
  Clone ID: LIB3060-042-Q1-K1-C1
taacaattatatacccataccctttacatcaaagatgagaaatatcatcaaacagaacaattatttatcaaaggtcctatcatattgcagtttgacatacgtagactatactacaatcataacaaaaaatgaacgttactatcctaaaaaacacaaatatgttctgaacatgatagcgcaacaacatatgacatcttcagcttgacctatagatggtcacctgtccactaaatcaaagggaacacattat

SEQ ID NO: 36500 - DNA, 443 bp, Zea mays
  Clone ID: LIB3060-007-Q1-K1-H5
gatctaattatcccaagcacgcttcctcgacttcctatctcgactctcccaagtcacaaccctcgacctcccccctactctaactactggaagcgccgatccatcaggttctgatcgattcttctgccccgatccgcagcggcaagcggagatgaactgcgagacctgtcagctgaaagaactggagctggaactgacggagatcagggatgttctgcgctgtattttgcacaccatattcttccatagaaccctcagcctggttcgccccaaagatgttgactgtgatttcctcgatattacttatgtacaatgtggtctaccggaactagaaaaggaagttgacgaaaagatagaccagttcagtgcatgggtggagaaacacccaaaccgcagaagccagatctgcctctcctttttcgacgagaaacacagacaccctg

SEQ ID NO: 36501 - DNA, 245 bp, Zea mays
  Clone ID: LIB3060-007-Q1-K1-H6
acctacgcgttcagctttaattttaagttaccagatttgttttcacagaagcttgaatctcaatctgggtagaggattgaaatacatctgaaggacatgatatatgatgattaactcagttaatgatgaagggcccggatctgacccagagaaatgggaagagctattcagatctgctcggtcagactagtggcattctgcaaagcgtagtaacgtaatgtaagacattgcatcgtaatacaatg

SEQ ID NO: 36502 - DNA, 79 bp, Zea mays
  Clone ID: LIB3060-007-Q1-K1-H7
gctgaaaggattttttcaaaactttgtttaacatagcattaaacttttactaggggcggggccttatgttcccacatct

SEQ ID NO: 36503 - DNA, 401 bp, Zea mays
  Clone ID: LIB3060-007-Q1-K1-H8
gccatggcgaagaagccagtggaggaagcgctcctcgcagcggcggacgagcacgaggaggagagcctgagcgtgcgcgaggagctgaagaagcagctatggctggctgggcccatgatcgccggcgcgctcctgcagaacgtgatccagatgatctccgtcatgtacgtgggacaccttggagagctgcccctcgctggcgcatccatggccaactccttcgccaccgtcaccggcctcagcctgctgctaggcatggcaagcgctctagacacactgtgcggccaagcgttcggcgcgaggcagtactatctcctgggcatctacaagcagcgcgccatgttcctgctgaccctggtgagcgtccctctgtcagtggtgtggttctacaccggcgagat

SEQ ID NO: 36504 - DNA, 433 bp, Zea mays
  Clone ID: LIB3060-007-Q1-K1-H9
cccaaaaggccaaaacccgcgcacaccggcgacggcaggagaacctcccgccggccgccgccatgccgccgcctctacaggcccaccgcctactcatctcccaccgccgcctacccactccagctcgccgccggttcaccgccgcctcttccgtccaatccgctcccgccacaaccttggccccgggccccgccacatcctccatcctctccatccgcgagtcgctcctctcaggcgagaggaccgcggcggacatcacctccgagtacctctcccgcctccgccgtaccgagccgaccttgcgcagcttcatccacgtcgcggacgccgccgccgagcgggaggcggaggaactcgaccggaggattgcctccggggagaaggatgcggtgggtccgctcgctggagtgctggtgggagtgaaggacaatct

SEQ ID NO: 36505 - DNA, 425 bp, Zea mays
  Clone ID: LIB3060-008-Q1-K1-A10
gttggggtgctctccaagaccagccgcttcaacgagctcatcgagctgctcaaggaaatgaacgggacaaagctggaccggaggctgtacatgagtgtcctgagaagcctccgcgatgccgggctggaggttcatgtgaagtggctccagagtaacttcaccttcatggaagagaaaacttgatgccaggtgcaggtacttgttcctgtgcacgcatattcagcacccaagtatatcgggcgcctgaagaaaaccttgctctgtacatggaaaccgaaaaaaaaggtaaatatttgcttgcctcagtgctccattccgaagcttgtacgctattgctgcacaattccggcattcattggctcaagtgaatagcgatgtaaatgtattttaagggaagccaactttgtaccagttacgatctgatt

SEQ ID NO: 36506 - DNA, 358 bp, Zea mays
  Clone ID: LIB3060-008-Q1-K1-A11
cggacgcgtgggctttctcccccgtgtcccgttgctaaaagcttagagaaaaacctaatcggacagcactgtggccaagcagggcgcgggagatcgtacgccggcggcgaggtcctgcggtggcgggcctcggcagagtggtggtgctagcggagtgcaactgttgggttggtgggtaagagtgagaaggacatgaaagcgctgcggcgatccagcaccttgtgctcgccgacaggcgtgtcctatccttcgtactcatcgaggatccacattcggacgctcctcgccgacgtcgtgtactcgtgctcgtcctgcttcatagcagcggctgctgctgggagcgcggtggctgtggtgt

SEQ ID NO: 36507 - DNA, 423 bp, Zea mays
  Clone ID: LIB3060-008-Q1-K1-A12
agacgacttgtttcattgattcttgaagagatcgagcttcttttgcaccacaaggtcgaggatgtcttgcaactgcggatcaagctgcggctgcggctcaagctgcaagtgcggcaagaagtaccctgacctggaggagacgagcaccgccgcgcaggccaccgtcgtcctcggcgtggccccggagaagaaagccgcgcccgagttcgtcgaggccgcggcggagtccggcgaaggccgccacgcctgcagctgcggtagcagctgcaagtgcgacccctgcaactgctgatcacattgatcgacgaccatggatatgattattatctatctagcttgtggtggtggttgaacaataataagcgaggccgagctggctggcatacataggtattgtgtggtgtgtgagagagagagagaaac

SEQ ID NO: 36508 - DNA, 442 bp, Zea mays
  Clone ID: LIB3060-008-Q1-K1-A2
agataatcgaaatcgaaaagaactgtcttttctgtatactttccccgttctattgctgccgcgggtcttatgcaatcgatcggatcatatagatatcccttcaacacaacataggtcatcgaaaggatctcggacgactcaccaaagcacgaaagccagttagaaaatggattcctatttgaagagtgcctaaccgcatggataagctcacattaacccgtcaattttggatccaattcgggatttttcttgggaagtttcgggaagaaattggaataatatcgattcatacagaggaaaaagttctctattgatgcaaacgctgtacctagaggatagggatagaggaagagggaaaaatcgaaatgaaataaattaagaataaagccaaaaaaataagtcgaagattgaagaacccaaattcaaaatgaagaaatgggaa

SEQ ID NO: 36509 - DNA, 372 bp, Zea mays
  Clone ID: LIB3060-008-Q1-K1-A4
gcgaatatgaatcttgggattcaccctaaaatatcattacaaggtaataaaaaacacaattacaatacaacataaattacccccctcccgctcgccggttctactgcaacacgtgattcacccacatcacgttagcgaatgctatactgctgaggtcactaccaactccagcccaaccacgttgtcaaacttgcacattaggcttagtttgggtactctggtattgacctcaatccacttgcattgaggaggattgaggtgtaacttagactaatatacaccgcaatccaacttaacacatgaagataggggtcaatgctagagtacccaaacaaagtcttaagtggccattcaagtcacccaaaatacttt

SEQ ID NO: 36510 - DNA, 384 bp, Zea mays
  Clone ID: LIB3060-008-Q1-K1-A5
gctccattcaaacagtttcttgagattgtcacaaatatgaaatttgacgaagagccaaattatgccaagcttatctctctttttgatgggttgattgaagcacctgcttcgagacaaatcagaattgatggggctctcaaggttggacagaaacgtggaagattggttgcagatctagaagaagatgaacaacctaaaaagaaagttatattaaggagcctagcggctcaatggatttcagtttataatgcttggtggcccatgaagcataagtaccattacaatgtggcttgactcgaggctaagcatgatgggctttacattaacaacgtggcttccttggcaaacctttgggcactcatcatggacgcaggaactggtttc

SEQ ID NO: 36511 - DNA, 431 bp, Zea mays
  Clone ID: LIB3060-008-Q1-K1-A6
gtggagaggtctcacaattctacagtgacctcttcctattcaaccttgatggtaaagaagtgatgagaaagactatcaaagtgaacgatcccctgagatacggaggggtcaccatctatcagacagactggggattttcagcattgcaagtgaagaaaaatggtgaaggccctttcaatttggcgatggcccccttgaaactgaatggggataagaagctctttggaacattcttgccacttgaagattcagactcgtcgaatccaaatgtcaaaggaatatcaatgcttgctcgagatttgcagtctattgtgttgtatgatcaagatggtaagtttgtaggggtccgtcggccaagctcaaaactgcctattgagatcaatggcaatgaaatactcaatgaagatgctattggtagtactggactggat

SEQ ID NO: 36512 - DNA, 368 bp, Zea mays
  Clone ID: LIB3060-008-Q1-K1-A7
ctagccgccgccgccgccgccgccgccatggtcgccgtcaaccgccccctcgtctccgtgaaggccctagagggcgacatggtaaccgacgcccccggcatcgccttaccgcccgtcttcggggcgccgatccgtcccgacgtggtcaggttcacccacaagctgctgtcctgcaacaagcgccagccctacgcagtctcccgccgcgccggccaccagacgtcggccgagtcctggggtaccggccgcgccgagtctcgtatccaccgcgtccccggcgggcggacccaccgcgcccggccagggagcgtttggcaacatgtgccgcggcgggcgcatgttcgcgctcaccaagatctgtcgcaagt

SEQ ID NO: 36513 - DNA, 408 bp, Zea mays
  Clone ID: LIB3060-008-Q1-K1-A8
cctcccctccctctccgaaagctggaggggaaggagatccattgcttccgatggctgcctgccgtctctgacctccgacctctgcctccagcctccagccttctcccgccctacctgaaagcaactcctgatcggattcaggctaggtcctcacagcacagccctcctctgagactcagcaaggagacctgaacacgaattgatctctgcgccgctgcaaccccggcccgtcgaagccatggggtccggggactggttcaagacgatcatcagcaagaaaaaaatcgaagcggggaaagtcaaagcacgcaaagctctctggccaagtaacaaatggaggcaaccagacaaatcagaagttagacggcccttcttcaagtagtgaggaccacgaagacaatgcagcac

SEQ ID NO: 36514 - DNA, 416 bp, Zea mays
  Clone ID: LIB3060-008-Q1-K1-A9
ctcatctgcgtacacggtctccctctttctgtcagtaatagagtgagagtgaggcagcgagtaggagacaaggggaaatggggaagggagcgcaagggagcgatgcggcggcggcgggcggcgaggtggaggagaacatggcggcgtggctggttgccaagaacaccctcaagatcatgcccttcaagctcccgcccgtcggcccttatgatgtccgcgtgcgcatgaaagcagtggggatttgcggcagcgatgtgcactacctcagggagatgcgcatcgcgcacttcgtggtgaaggagccgatggtgatcgggcacgagtgcgcgggcgtggtcgaagaggtgggcgccggcgtgacgcacctgtccgtgggcgaccgcgtggcgctggagcccggcgtcagctgctggcgc

SEQ ID NO: 36515 - DNA, 424 bp, Zea mays
  Clone ID: LIB3060-008-Q1-K1-B1
ggagctcggacaaggcagagcgccatcgttcggtttccttgctgaattcccgatcgctcgctcgctcgaaaagaaagaagctagcttttagcatggcgtctctggcgttcggcagcaccgtagcggcggccgtggcggcgacatcggggaggacgcggccggcgcgccggtccgtgctggtcgtgccgcccgctgccagcaggggcggcccggcgccggccaaggaggagaagggcctcggcgagaccatcttcggcttcatcttcaagaaggaccagctggtggagacggacccgctcctcaacaaggtcggcgccgcgccggccgccgactcccgcgccaagacgaccgtcggcaagaaggctgccggcggcgacgacagcggcagcggctgtgggttcaaccttcgcggcctcggcgggct

SEQ ID NO: 36516 - DNA, 415 bp, Zea mays
  Clone ID: LIB3060-007-Q1-K1-H4
agcgatccgaggagcgcgcagcgatggcggcggcggccgtggcgactgtggcctccccatccctcacctccaggcggctgttcccctccgccggcccgtctcttctccggctcccaaggtcgaccgcgcggctcaggcgcgccctgcggttcgccgctgcgggggatgaagcggacgtgctgcctggcccgggggccgagggggaggccgtggtgcccgggaggctggaggagcagcgggacgagcagctgggcggaagccagctcgacatcggagggctcgcctttcagggcgacgtgggcgggggcttcaccggcggcggtgcgggctccggggcctccggcggtggctgcggcaacaagatgctggaccggggcatcaacacgggcatcgggctcggggccagcacctacgc

SEQ ID NO: 36517 - DNA, 419 bp, Zea mays
  Clone ID: LIB3060-007-Q1-K1-G1
cgaactcaaaaccaccgtagccatgcaagcaacgcacaccggggagggagctcagtgtcgccgtgggtatttcatgcttgtgcgtccgaccgaggtgattggagggtcgaggaggtgcatccgcgctcgcagaagcatacactacagaatcggggcacacagagttgagtcggtatggagatttttcaccagtggacggatcgtcgccgcgtttcgccctaccttggatcggagctgctatgcttcaatagctgaaatggaagaggaagaagaagagttgcagttggcgaggtacatggtcaataggaggcgacgtgcactcaatgagcgtcgtcatggaagttcgattcccgggcgtgttaggattcatcgtgatcacatgagcggcgatgcaagaatccgagcggactactttggag

SEQ ID NO: 36518 - DNA, 410 bp, Zea mays
  unsure at all n locations
  Clone ID: LIB3060-007-Q1-K1-G11
gcgtctcggttcgcatagcagagctgctcttgcaacaagccaaacaacccagtggctgctagccgagacaggggatagattgagagagaggcgcgcagatggcgacgccgtcgtcgtcgctttgctccagcttcgcctccctgcggaccgcctccatcggccacccccgtggcatcgccttctccacgcccaggaaggcattccatgtgagggcatcagctcgggttgacaaattctcaaagagtgacatcatcgtgtccccttcgattctgtctgcaaactntgcgaagcttggtgatcaggtaaaagctgtggaggtggcaggatgcgactggattcatgtcgatgtcatggaccgggcgccttgtgccaaacatcacaattggacccttggttgttgatgctctgcg

SEQ ID NO: 36519 - DNA, 441 bp, Zea mays
  Clone ID: LIB3060-007-Q1-K1-G4
ccatcatccagacgctgctccccatgtcgcccaagggcgagatctgcgacgtcaacggcgtctgcgtggacgccaccgaggacgagctcttccgcctcaccaccaaggaggggaagctcaccgtggagcgcgagaaggtgaagatcgagacgcagcccttctcccccgtggtgcagttcgagcaggaccccgtgcagatcctggacgcgctgctcccgctctacctcaacagccagatcctccgtgccctgcaggagtcgctcgccagcgagctcgccgcccggatgagcgccatgagcagcgccaccgacaacgccatcgagctccgcaagaacctcttcatcgcctacaaccgacagcgccaggccaagatcaccggggagatcctcgagatcgtcgccggtgccgacgccctcgctggctgagcctgagtccccttgg

SEQ ID NO: 36520 - DNA, 444 bp, Zea mays
  Clone ID: LIB3060-007-Q1-K1-G5
gccgcccagaccgcctccccttccccgtctccggtgcccaaggccaggccaacagttttgaggtggtaatggcggaccaggctaaccaacccactgtccttcataagctaggtggccagttccacctgagctccagcttctctgaaggtgtacgggcccgtaacatctgcccttctttctcaccttatgaaaggagatttgccacgaggaactacatgacccagagcctttggggcccttcaatgtctgttagcggtggcatcaatgttccagtgatgccgactccgctttttgccaatgctccagccgagaaaggtggcaaaaacttcatgattgatttcatgatgggcggtgtttcagctgctgtttcgaagactgcagctgctcccattgaacgagtgaagctgcttattcagaatcaggatgagatgatcaagtctggta

SEQ ID NO: 36521 - DNA, 431 bp, Zea mays
  Clone ID: LIB3060-007-Q1-K1-G6
ggagaaccgtgagcagagagacatggcgcgccaccaccagcagcgggcgctgctcctgttcccactcgtcttcctcctcctcctccttgccccgcccctcgccggcgcgtggggaaaggagggccacatcatggtctgcaagatcgccgagaagtacctgtcggagaaggcggcggcggcggtgaaggcgttgctgccggagtcggcgggcggggagctgtcggcggtgtgcccgtgggcggaccaggtgcgctggcactaccactgggccagcccgctccactacgccaacaccccccaagtctgcaacttcaagttttctcgggactgccacaattctcgtggccagcaagggatgtgcgtcgtcggggctatcaacaactacacggaccagctctacagctacggccagaagacttcgtataacctga

SEQ ID NO: 36522 - DNA, 441 bp, Zea mays
  Clone ID: LIB3060-007-Q1-K1-G7
cctcagtcctcagttcctcacctagcggtagcgtgcgcgcgggagacgtagatggcggcttcggaggcggcagcggcggcggcaacaccggtgacgccgacagaggggacggtgatcgcgatccacagcctggaggagtggagcatccagatcgaggaggccaacagcgccaagaagctggtggtgattgacttcactgcaacatggtgtcctccgtgccgcgccatggctccaatttttgctgatatggccaagaagtccccaaatgttgttttcctgaaagttgatgtggatgaaatgaagaccattgctgagcaattcagcgtagaggccatgccaacattcctgttcatgagggagggcgacgtcaaggacagggtcgttggcgcagcaaaggaagagctagcaaggaagcttgaactacacatggcctcgtagatc

SEQ ID NO: 36523 - DNA, 426 bp, Zea mays
  unsure at all n locations
  Clone ID: LIB3060-007-Q1-K1-G9
gccgtgcactccattgcgctgggcgcagtgtttgcgtccgtggcggggcaccacagacctgggcagcgtctagtgttcctcctcaccggtgctgccaagggcgctaagagactcacagggttcgcgttcctccggtgggccacgaaggacgccgttgtgcagatgctctgcctctggttctttgccgatgtgcacgaccaggcccagctgttcaggctctttgtggtcgccaaactcatgccattctccgcgtctgttaatccgtggcttggtgcagcggttgcaggcccagagctcggtggtttctttgttgcctgggctgtttttgatgcagttgtatcggttttgttcactgtggtgccttgngtggttgtcatggaccgtgatccacggccgcctgtgcgcaatgctgtgaaggaagggtgc

SEQ ID NO: 36524 - DNA, 428 bp, Zea mays
  unsure at all n locations
  Clone ID: LIB3060-007-Q1-K1-H1
agcaaaaacacaaagcgcttaaaccacactcaaaccaaccgccaacaaacaggcctcctagtcccgaccagaacttgctcgtagccccgcccccgagaacccgacagcgcgagatggctcccgagctgatgacagccaagatgaccgccaaggccgcggcggcggcggcggcggtgaagcctgccacgagggcgtacgtgacgttccttgcgggcgacggcgactactggaagggcgtggtggggctggccaagggcctgcgcaaggtccgctcggcctaccccctggtggtggcggtgctgcccgacgtgcccgagtcccaccgncgcatcctcgtctcgcagggctgcgtcgtccgcgagatcgagcccgtgtacccgcctgagaaccagacgcaggtcgccatggcgtactacgtcatcaactac

SEQ ID NO: 36525 - DNA, 429 bp, Zea mays
  Clone ID: LIB3060-007-Q1-K1-H12
ggggtacccttcagaaaacccggaagcagataatgctgtgcaagtcttcaggatgccagaatctaatgttcactcacaagttctcccttccacatctgaggctttaaatccacagattgtgagcaacagccctgtttcgatctcgtcacagcagcagcagcatatctcccagcaacaagccgcagcacagatgtaccctcaaatgcatgtgcagcattttccaaatttcatgccatatcgacaactctattctccagtttaccccatgcctatgccaaactattcgccaaatgtcccttatccatcaaatggaaataattatcttcagatgcccagtggaggttcacatttaactgcaggaagcgtgaagtatggagtttcacagtttaaaccactcccatctggtaacccttctggctatggaaatta

SEQ ID NO: 36526 - DNA, 431 bp, Zea mays
  Clone ID: LIB3060-007-Q1-K1-F9
gtgctctcatctgcgtacacggtctccctcttcctgtcagtaatagagtgagagtgaggcagcgagtaggagacaaggggaaatggggaagggagcgcaagggagcgatgcggcggcggcgggcggcgaggtggaggagaacatggcggcgtggctggttgccaagaacaccctcaagatcatgcccttcaagctcccgcccgtcggcccttatgatgtccgcgtgcgcatgaaagcagtggggatttgcggcagcgatgtgcactacctcagggagatgcgcatcgcgcacttcgtggtgaaggagccgatggtgatcgggcacgagtgcgcgggcgtggtcgaggaagtgggcgccggcgtgacgcacctgtccgtgggcgaccgcgtggcgctggagccgggcgtcagctgctggcgctgccggcact

SEQ ID NO: 36527 - DNA, 432 bp, Zea mays
  Clone ID: LIB3060-007-Q1-K1-E4
agcatgttgttctctgcgacgatgcctagctgggtgaagaaactgtccagacggtacttgaacaaccctttgacgattgacttggttggcgatcaagatgaaaagcttgctgaaggaatcaaactctatgctatcccactcacaacaacatcaaagcgtaccggtcttagtgatctaatcacgggttatgcaaagggtgggaaaaccatagttttcactcgtacaaagaaagatgcagatgaagtatcattggcactgacaaacagtattgcttctgaggcacttcatggtgatatttcacaggatcagcgtgagaggacactaaatggattccgtcaagggaaatttactgttctagtagcaacagatgttgctgcccgtggtcttgatataccaaatgtgatctgattatccattatgaattgccaaatg

SEQ ID NO: 36528 - DNA, 426 bp, Zea mays
  Clone ID: LIB3060-007-Q1-K1-E7
agacgacttgtttcattgattcttgaagagatcgagcttcttttgcaccacaaggtcgaggatgtcttgcaactgcggatcaagctgcggctgcggctcaagctgcaagtgcggcaagaagtaccctgacctggaggagacgagcaccgccgcgcaggccaccgtcgtcctcggcgtggccccggagaagaaggccgcgcccgagttcgtcgaggccgcggcggagtccggcgaggccgcccacgcctgcggctgcggtagcagctgcaagtgcgacccctgcaactgctgatcacatcgatcgacgaccatggatatgattattatctatctagcttgtggtggtggttgaacaataataagcgaggccgagctggctgccatacataggtattgtgtggtgtgtgagagagagagagaaacaga

SEQ ID NO: 36529 - DNA, 432 bp, Zea mays
  Clone ID: LIB3060-007-Q1-K1-E9
attacaccgtgcgatgcaggtacctggcgccggagtacttcatgtacgggaaggtgaccgacagggtggacgtgtacgcgttgggcgtcgtcctgctggagctcctgtccggccggaagtccatcagcagcgacgggtcgtcacccaagggccaggagagtctcgtcatgtgggcaactccggtgcttagcagcggcaacatctgtgacctgctggacccgaggctggacgtgaagcacgacgaggtggaggtcaggcggatggcctctgccgcgtcgctctgcctccggaggtcggctcgactcatgccgccgatatcgcagatactgagcatactacgaggagaaagcgcggcgagcatcgccgaccagggcgcgacggagccggactgcgtggacgacgaggcctaccccgccgcgaacgtgaggtcgc

SEQ ID NO: 36530 - DNA, 449 bp, Zea mays
  Clone ID: LIB3060-007-Q1-K1-F1
ggtcagagagatggtaacagtcttggacctagatgtattattttacccctgtcctcaaaaaggcccaacattccgacctaaagtcctcgaaatgggtggaaagaaacaattcccttacatggtagatccaaacacaggggtcgccatgtatgaatccgatgacatcataaaatatctagctgatacatatggcgatggaactgttccaattatgctatcacttggtctgttgacagcaattacagcagggcttgctactcttggtcgtattggaaagggaaattcctacattgcttcaaaagtcccaccgcagcccatagagatatgggcatgtgagggatctcccttctgtaaattagtacgagagacacttgtcgagttggaattgccacatctgctacacagctgcgcacgaggcaaccccaaacgacaagaaattttcaagaaaa

SEQ ID NO: 36531 - DNA, 427 bp, Zea mays
  Clone ID: LIB3060-007-Q1-K1-F10
cccacgcgtccgggatgtgtatgtaggcctgttgatcaaggactatcttaactagccacatgccctggaaatgggacagagtaagcttgaacccggctattccatacatgaaaagacaatcacgcactgggagtggagagatggcgagagtgtcacgtaccctcctggcaaaggaccgcctaaaaagggtggtgtgctctcgggtggcgcggacctgttcttgcagtggaggatccgtgggaatggtagacatgcaaggtttacgagaaacatatgtcgtgtggttagagatcctcagctgagtaaatcgattcggatcgctgttatatccccggagagtggagacttgatctccgacctacaacctaagtcaggatgtaaacattatgaataacaatgatgttgtattgatgagatggtgaaatta

SEQ ID NO: 36532 - DNA, 428 bp, Zea mays
  Clone ID: LIB3060-007-Q1-K1-F12
cttctgcattgcctgggattccaaaaggtagtgcaaggcaactgtttcagcgccttcaaggaccgtttgaggaagggactctcaagacacactttgagaaaataatattgcttggtcaaaaattgcatcaaactcgtagaaaggatgagatccatgagctgaggcaaaaaaatccacttcatacttctcatggttttgcactttctcaagcatgtccagggaacttatctggtgtcattttgacgccacttgacctttgcgatggaccttcgaactcggatgcactttctattggttatacaggatccaacacaagtgggttaggtcttccaaacaataactgctctgttggtgctactcttcctacatcaaatatgaacttaagattaccaggttctcctggtatggttttgggaagcaattcacca

SEQ ID NO: 36533 - DNA, 214 bp, Zea mays
  Clone ID: LIB3060-007-Q1-K1-F2
ggtcaaagagatggttacagtcttggtcttattatgcataattatacccctgtcctcagggaggctaaacattgcatatctaatgcacttacaatgattagcaagaaacatttacagtccatagcatatccaaacacaggcgctgtactgtgaaagaagcctactgcttgatgaaatctagatacagcatttctacaaatcacatttcacctgc

SEQ ID NO: 36534 - DNA, 387 bp, Zea mays
  Clone ID: LIB3060-007-Q1-K1-F3
cccacgcgtccgcgcaccgcactgattgggctccaagatcggccgctgccaactggggggcctcaccgccacccgttcttggaaaacagcacgctacttacttgaaagtaaagggagatacttgccgcgttgggattctccaactccaaccaagacgaacgatttcatcccactaatcctttttcttttcttttcgtttttatttttaatttcttggttcggttcttgatcacctgttcttccttatgaccttatccaggaaattagattatcaggtgcattttgtgtgaggatccagacgcaagaagatggctctcaagaagttgctgcagctcttttgtgtcggaaagaaggattccaagaagaaaggtaaattcatcgatccac

SEQ ID NO: 36535 - DNA, 417 bp, Zea mays
  Clone ID: LIB3060-007-Q1-K1-F5
agctcgtcatcataaaccgaacacagagctctcgattccattccaggatgctgctgaacccggcgtcagagacgtcggtgctagacaccatccggcagcacctcctcgaggagccagcggcggcggaggcgcggccggccgacgagagcttcgggagcctggtggcggaccagtggagcggctcgctcccgttccgcaccgacgacgccgacgacatggtggtgttcggggtgctgcaggacgccttcgcctacggctggctgcccgacggctcattcgtgcacgtgaagcccgagccagtgcggtcccccgactcgtcctcctaccacccctgctcctacgacggctcaccctgcttcggcctcctggacccggagccgccgctgacgcccggcaccaccacgcccgggagggggc

SEQ ID NO: 36536 - DNA, 279 bp, Zea mays
  Clone ID: LIB3060-007-Q1-K1-F8
gaattcccggcgctcgccagacggacgattgaggctgttgatttgacgcttttttttactcgcatgccgtagtttcaaaccaggtgagggcattttgccggacgcgcctgactaaatacgaccacgggagccacactccgcgcttgctttgctgccggggcatggacagagcgctagctcgcctacccatcgcgatcacacagccctattccgcagcgagtacaaattccctgctcgtctgcttgcacggtgcaggcggtcagatcttgaccgaattta

SEQ ID NO: 36537 - DNA, 345 bp, Zea mays
  Clone ID: LIB3060-041-Q1-K1-G12
gtataatcctcccagtgggcaggacatgtcctactacgatcatgtgcagaagcgccatgaggagaagggctgcctatatgcatgcctgttcactgcgtgctgctgcttctgctgcttcgagacctgtgagtgctgcctcgaggccatctgctgctgctgctagttctgcttggagggcatgggcgtccatcatcgtggagatgtggccatgcgggacacccaccgccgaataaaatgctgtacttatatgcacgcacgttagaaatgcattagtgtctggttgatgtgatcttgtgtgtgtgcgcccgcatcttcatttgcactggaaaatggcttaataattgg

SEQ ID NO: 36538 - DNA, 306 bp, Zea mays
  Clone ID: LIB3060-041-Q1-K1-G2
cagaaggtgagaagagagagagagagtgtgtgtgatcggtacaaggatcaccgctgggcctgcgcgtgctgctggaccgaatcgagtcagatcctgtccgaatccgagctaaaggatggcaaccggtagtgaagcctcgaaggcagctgaggctgtggttgactggcataaacacgacagcaagaggatgctccatgcggtttaccgtgttggggatctggaccgcacaatcaagtactacacggaatgctttgggatgaaactgctgtagaaaagggatgttcctgattagaagtacaccaatgc

SEQ ID NO: 36539 - DNA, 463 bp, Zea mays
  unsure at all n locations
  Clone ID: LIB3060-041-Q1-K1-G9
cacagcaatccacacaagcacttcgacgtcacacgggcgctgcacacagacacaccaagcgtgggcaccaatggcttactaccaggaggtggactactgctcggaggaggtgaggtcggtggccccggccggcttcggccgccacggcggcggcgtccagcagcacgtcgtcaaggagaagttcgaggaggtcgacacggtcgcacgcgccggcgccaaccaccaccaccaccatggtcaccacggcggccacggcttcgtggtgcgcgagaccagngtcgaggaggacatcaacacctgcaccggcgaggtccacgagcgcagggagagcttcctcgccagggctaactgagcagcccgggcggccggcatccacgcccgttcgtgcctgcctgcgtgccttatgtatgtctgtgattgtgcagggtcatcgtacttggctagcgtacgtacgtgcacgcac

SEQ ID NO: 36540 - DNA, 371 bp, Zea mays
  Clone ID: LIB3060-041-Q1-K1-H1
gaatttccggtgttaactggatagtggatatcatcctccatatgttgtgttgttcccttattaggttgaccagttgttaactgggtgtgggtactctaggatagattagccagccgatgtccaactgagcaaggaatatgcttggacacactgatatctctgatgttacaactcaccctccaatcatatggtatggatcactttcttacctaaatatatcttccaaagtcttttatatgcggcatttgattttttataccaaattaagatgagtatactactgcttactgtaagaccacctttttgaaaataatctaattaactatctctaatactattggaatatcattgtctatagatgttactgatgt

SEQ ID NO: 36541 - DNA, 393 bp, Zea mays
  Clone ID: LIB3060-041-Q1-K1-H10
gggacttccattgacatgcaggtacaattgtttatgtttttccaagtgaacaaatgggggaatgtcaatcacactttttattcaagagtagttcatgtatttccatggctaagatatataggcttacatgtcttcatttccatttccatttccatttgctggattcttactaagtaatatttaaaggggcattgctgtgttttttcgttagttaacaaaagattgtttatatgctcattgatccatcttgaccttttgcatgatatgtagcttctcatccgggagtggcctaatgttctgtcactgttggggggtcttattgtaatcaagacactgataatcaccgcaattgggcctagagtcgggttaactcttaaagaaagtgtaaggata

SEQ ID NO: 36542 - DNA, 384 bp, Zea mays
  unsure at all n locations
  Clone ID: LIB3060-041-Q1-K1-H11
cagattcttgccaagatcgtggtcggctgcgtcggagtgaactcgccgatcgcgaggtggatgggtttctcggagccccggtacgtcgggcacatggcgttccggggcctcgcggagtacgccgacggccagccgttcgagcccaaggtgaactacatctacggccgaggcgtccgtgccggctttgtccccgtctccgcaaccaaagtctactggttcatctgcttcaacagacaagatccagggcctaagatcaccgaccccacggcgctcaagaccgaggcgctggagctcgttcgcggctggccaatcgacctnctggcggtgatgcgcatcacgctccgatggcgccgtggtgaggacgccgctggtggaccggtggct

SEQ ID NO: 36543 - DNA, 296 bp, Zea mays
  Clone ID: LIB3060-041-Q1-K1-H12
gcttggttacaaaggaattaaggtagcacttccccgggaaacaacaactggaaaatgtttcatgcaacattatatagagtctatcctggttttacaagaggccagctgcaaaacggttgatgatgggtgccaaaaaaagattccatttgtcattatgacttctgatgatacaaatgcactaactatcaagcttttggagtcaaactcttactttggaatggaaccatctcaagtgaaattgctaaagcaggaaaaagtagcttgtctagctgacaatgatgcaaggcttgcattag

SEQ ID NO: 36544 - DNA, 389 bp, Zea mays
  Clone ID: LIB3060-041-Q1-K1-H3
acccgcctcgcccgcgcccgccgctccccacctcgccgtcccgctcctcctccccgtgtcctcggcttccgagtcccgccgcggggcgcagccgctgccgggcacgcggatggtcggcgcgggcgcgaccggcgggggtaacatggccagcggtggtggggggcccgcgttcgtgggccaggtgttcaccatgctcgacccatccgggaacgggctcatggccgttaccacacgcttcgagctcccgcgcttcctcaccaacaggactcctatgtggttcaaaaggatgctatcaccgtcgaagaagactgaaaatagtccagtatttaagttttttatggatctgaatgatgcagtatcctatgtaaagcgactaaatgtgccaagcg

SEQ ID NO: 36545 - DNA, 351 bp, Zea mays
  Clone ID: LIB3060-041-Q1-K1-F7
agtgcacgtacgcacgcactgggacactagcaacccataacagcgccactggccagggcgcgcgtcaagcttgcttagctagccgccatggccttcctctacgtcgtctgcgtgaagcccgtggtcatcaagggtctcgcctgctgctccatcttcggaaggaagctcgacgtcgccaggccgtagggccgcttcatgctcaagccacacacatccgtagtattggacaagtactgcgacaagagcgtctactttgacctcgaccacatcggcaacaccaacggacagtgcgacctctacggctttgacgcgctctagccctacgatccactacagagcaagttcttcgag

SEQ ID NO: 36546 - DNA, 261 bp, Zea mays
  Clone ID: LIB3060-041-Q1-K1-D3
ctggctttcggcaacgccctttaccacatctgaatctcacccacccacccaccccggggtggggcacctaatggcgccggcgatgctgctgaagcggcctgcggcgggagcaggggcggcagcagcgcataccgacacgctgtccgcgcctgccgtgcggaacgcggtgcgcaccgacgtaagggaggccgaggccacggcgaaagctaccgtcccggccgacagggtcccggcgacggcggcagtgccggcggagatcgc

SEQ ID NO: 36547 - DNA, 403 bp, Zea mays
  Clone ID: LIB3060-041-Q1-K1-D4
agaaaatcctaccgtgctcgattcttccctgcgcgtctcctccgcttggagcttccggcgcgccctgcgtccctctgtggccggaactcccttcatggccggagctcggacggcgctcggtcctgccgcctgccccaacgtcgactatctccagctcgcccccgacctcttctctccctgtcgcgtcgctctctctctgctcgctctcctccatggccgccgtgggctcgccggcgtggtccttgtcctggccgccgtggtgccgcgtgcccatgtgccagcgcatgcccagctcctctccgtctgctcggtcttcttcctggagcgagctctcttctctcccatagcgtccggcatttctccctgtcgctccttccatgccgcgctcggactgaagctttcc

SEQ ID NO: 36548 - DNA, 426 bp, Zea mays
  Clone ID: LIB3060-041-Q1-K1-D5
ctcgtggttccgcgcacggcaccgaatccttcgtattggtcggcccggcgagcatgggaggaagttgtggccgcggatccgtcggcttgcttcgtggagcggccaccccgccgatccgtgcgaaggcgccgccgccggtcgtctctatccgccggtgctgcgtctgctgggaggaggtcaacgggagttcgtcgattcgccgagagatctacgctcacccgatctgcgtcatttgagcttcaaggtccaagtgcgggtattagaagaacgggtacttaaatcacaattcatactacaattaagtgaattcttcttggagataaaaactcttacgatcttgccaaaacagtaaaggattttagatcccaacgacctgggatgtccagacagaggtaagttgggctttattttaattttatgatgtac

SEQ ID NO: 36549 - DNA, 193 bp, Zea mays
  Clone ID: LIB3060-041-Q1-K1-D6
gcgcgaggcggagcggagaaggggcggcacttagtgcttcggaacacagaagctgcgagcacttgtaggaggaccagcgcctccacgaacgccccccagtcgttgcgcttgcaccgcctgacacctcagaccaactacgcgcgcaggacggcacttcgagacacagctcagcgaccacgggagacatcgagaa

SEQ ID NO: 36550 - DNA, 464 bp, Zea mays
  Clone ID: LIB3060-041-Q1-K1-D9
ggaagatctttaggaggtgctgttggagcagttcttgccaaaaacaatcctgacaaggtggccggtctaatactggaaaatacatttacatccatactggatatggctggtattatgcttcccttcttaagatggttcataggcgggagctcttctaaaggtccaaaacttttaaactgtgttgttcgctctccatggaatacacttgatattgttggagaggtcaaacaacccattctcttcctttctggattgcaagatgaactagtcccccctccacacatgaagatgttatatgacaaagcttctgatcataacagaaattgcagatttgttgattttcctagtggtatgcatatggatacctggatgtctggaggggaccgctactggaggacaatccaattgttcttggatcaatacgctcctggagtgcagaatcatgatgccagcttcaaaagtga

SEQ ID NO: 36551 - DNA, 359 bp, Zea mays
  Clone ID: LIB3060-041-Q1-K1-E2
gcatccgcagagagtttgttccgtccaggcaactcaaaaagcgttgccccgccgcgcggagggggaagagagcagaggaggatggctcgtacgaagcagaccgcccgcaagtccacgggaggcaaggccccccgcaagcagctcgccaccaaggcggcgaggaagtcggcgccgacgaccggcggcgtgaagaagccccacaggtacaggcccggaaccgtggcgctgcgcgagatccgcaagtaccagaagagcacggagctgctgatccgcaagctgcccttccagcgcctggtgcgcgagatcgcgcaggacttcaagacagaccttcggttccagagccacgccgtgctggcgct

SEQ ID NO: 36552 - DNA, 239 bp, Zea mays
  Clone ID: LIB3060-041-Q1-K1-E5
aaaaaaaaaaaaaaaaaaataaaaaaattaaaaaaaaaaaaaaaaaaaaaagggaagggaaaaaaaaaaggaaggaaaaaaaaaaaaaaaaataaaaaaaaaaaaaaaaaaaaaaaaacaaaaagaacaaaagaaaatgaagcaaaagagaaaaaaaacacataaaaaaaaaatactaagtactcaaataagacactcaaaaacaaaacaatagaaaacgaaggtaagaggtgaataca

SEQ ID NO: 36553 - DNA, 377 bp, Zea mays
  Clone ID: LIB3060-041-Q1-K1-E6
agcgactcagcgagcgagagcagcacacacgcagctagctaggagcagcagcggaggagcggcgatggcggcctgcatgatctcctcgtcagctctggcggtggcgcctcagggcctgccgcccctcggccgccgcgcctcctccttcgccgtcgtctgctccaagaagaagatcaagaccgacaagccctacgggattgggggtggcctgaccgtcgacgtcgacgccaacgggagaaagggcaagggcaagggcgtgtaccagttcgtcgacaagtacggcgcgaacgtcgacggatacagcccaatctacaacgaggatgactggtctaccaccggcgacgtctacgtcggaggaaccactgggcttctgatct

SEQ ID NO: 36554 - DNA, 384 bp, Zea mays
  Clone ID: LIB3060-041-Q1-K1-E7
cgcctccactacaccacacagagccgcagcagactcgcaagggaaaggagatggatcgtctgcccgagtcgacccggagcatgaggaagtacgcgtcggaggccggcgggcttcgcgcggcgcggcagggcccccacgggcggtcgctgacggcgcgcacggcgcacagcatgtccacgacggcgctgcgcaccaagtccaagtcggccgcgtcgctgctgcgcagggtgcccttcgagccgctccgccccgtcctcgccaacctgcaagaggtgttcctcggcaccaagctcgccgtgctattccccgccgtgccgctcgccatcggcgcccagtgcgcgcactttggccaggtgtgggtgtttacgctcagcctactcggcc

SEQ ID NO: 36555 - DNA, 413 bp, Zea mays
  Clone ID: LIB3060-041-Q1-K1-E9
ctcaattaggggaatcacgtctggttttcattaatggagcatcgtttgggtctgaactgtgtagaacatcatctccttaggcggagaaacctgtttgtgtggtgacaggacttccagccaagtatggttttctgacccctgtttatgatatcccttcctgttccttgcattcacacacgagtttcaacccctcccccctgttttgttgttcatatatgtttcattttaatacaagtaatagattagatagacacaaatccttcaatgtttagtagctgcattatctttgaatgtggtttttatatgttctggatcactcagatcgtaccactaccagtgtgtgtatgatctggaaaccccgagacatcttgtggctttaattcttagatattttaccacgaaccatggaaaca

SEQ ID NO: 36556 - DNA, 214 bp, Zea mays
  Clone ID: LIB3060-041-Q1-K1-F11
tccgttcaggccgagcggcgtctcctctctccatcggctccagccaatccggcaatcccggtcccgcagctctctgatcgcccgctcgcctccgccctccgccctccgccatggcggctttcccctccgcctccccgtcgccggcgatctccgcctcgacctggagcatggcttccctccatacgtccctccccgcactccgtccctccccctc

SEQ ID NO: 36557 - DNA, 268 bp, Zea mays
  Clone ID: LIB3060-041-Q1-K1-F12
gaattcaccgggtacgagcccagcgcgtcacgcgaaaaagtcccgcttcgagccttccactcgtctcctctccgctttccccgtgccggcggtgccgtggtacgggccgaaccatgaacgcccggcttgctcagtctaatgcgcgcccggatcctcgcgcccgctggccgacagccccggccccagcgtcgtcgtcgtcgcctactcccaacttctcgcgtcgtcacggagcaacaaacgcaggatagcaccaggcctcgcgctcgcc

SEQ ID NO: 36558 - DNA, 394 bp, Zea mays
  Clone ID: LIB3060-041-Q1-K1-F2
cgcgtcagttcgttccctcctctgtgtaccggccagtaaaatccgaacccacagcgggaaagggcggcggcagcgctccgtccggcgatcctccgccgcatccgcctctccccctcccctttgctcgccctcgccgccgctgggacaggtgcatcccacccgcacgcgctggggcggtggctcgcgcggcccatgtcctcccacgacgcgcacctcacccgcgacgaagtcatcgaccggatcctcgacgtcatcaagagccaccccaagatcgacccctccaaggtgaccccggaggcgcacttcgagaaggatctggggctcgacagcctggacaccgtcgaggtggtcatggccatcgaggaggagttcaagctcgagatcccagacatgg

SEQ ID NO: 36559 - DNA, 406 bp, Zea mays
  Clone ID: LIB3060-041-Q1-K1-F3
cccacgcgtccgcagaatgtttcatcctgttgttgctgtggtattgtcagtgacatgtgttcgtgcctttggagaggttataccgcaagcaatctgtaccagatatggcctagcagtgggtgctaactttgtatggctcgtacgcattctcatggtcatttgctatccaatttcttaccctattgggaaggtcctggactgtgctcttgggcacaatgagtctgcactttttaggcgagctcagttgaaagctctagtttcaatccatggcaaagaggctggcaagggcggagagcttacccatgatgagactacaatcataagtggagccttggacctgaccgaaaagactgctgcagaagctatgacacctattgagtcaactttctcactagatggggattct

SEQ ID NO: 36560 - DNA, 320 bp, Zea mays
  Clone ID: LIB3060-041-Q1-K1-F5
agcggacgtgctgcctggcccgggggccgagggggaggccgtggtgcccgggaggcgggaggagcagacggacgagcagctgggcggaagccagctcgacatcggaaggctcgccttccaaggcgacgtgggcgggggcttcaccggcggcggagcgggctccggggccttcggctgtggcggcggcaacaagatgctggaccggggcatcaacactgtcatcgtgctcggcgccagcacctacgctctcaccaagctgctcatcgtcgaccaggactactggcatgggtggacgatcatcgagatcctgcgctatatgc

SEQ ID NO: 36561 - DNA, 356 bp, Zea mays
  Clone ID: LIB3060-041-Q1-K1-B4
caccgtcactcaacacagcacaggcagctcgagagagagagagagagaaagatgtcggggttcgggcaccaccacgacaaccagccggctcccccggcgtcgggccccaaccaggtgttcaagatcttctgccgcgccaacgagaactactgcctggccgtccgcgacggcgccgtcgtgctggccccggtcaaccccaaggacgaccaccagcactggtacaaggacatgcgcttcagcacccgggtcaaggacgaggaatgcatgccggcgttcgcgctcgtcaacaaggccacggggctcgccatcaagcactccctcggccagtcccacccggtcaagctcgcgccttttaa

SEQ ID NO: 36562 - DNA, 357 bp, Zea mays
  Clone ID: LIB3060-041-Q1-K1-B8
gctcgatccgcttcccccgcggcgccggcggtggcagggcggccgtctccctgcgcgcccccgcgcctccagcggcggcggcggcaacatctggtagcattgctccagcgatttcattgaccgaaaaggccttgaaacatctgaacaaaatgagggctgaacggaacgaagatttgtgcttgagaattggagtgaaacagggtggatgctcaggcatgtcttacaccatggagtttgaaaatcgagcagatgccagccctgatgattctgttgtagagtatgatggttttgccatagtctgtgaccccaaaagccttctcttcatgtttggaatggacctggactacagcaacgcac

SEQ ID NO: 36563 - DNA, 461 bp, Zea mays
  Clone ID: LIB3060-041-Q1-K1-B9
gccatctccgttgcccgacagttggaagctgaaggagatctttgctacgggcatcgtgcttggaagctaccttgctctgatgactgtcattttcttctgggctatgcacaagaccgacttcttctcggacaaattcggtgtgaggtcgatcagggacagcgagcatgagatgatgtccgccctgtacctccaagtcagtatcgtgagccaggctctgatcttcgtcacccgttcccgtagctggtccttcctggagcgccctggtctgctcctggtcaccgcgttcctgctcgctcaacttgttgccaccttcctcgctgtctacgccaactggggcttcgccaggatcaagggtatcggctggggctgggcaagtgtggtctggctctacagcatcgtcttctacttccccctggacctgctcaagttcttcatccgcttcgtgctcagcggcagggcat

SEQ ID NO: 36564 - DNA, 248 bp, Zea mays
  Clone ID: LIB3060-041-Q1-K1-C1
acaccaccaccttgtgcacctttcctttccatgctttccttctctcgtctggaatgtcaatatatatagtgcgggctcttctgtgctgcagtcatcgtcttcttatataatactccaactactcatgtcctcagagcctgcctattccatgatatataagcgtcgccgttccggtccactgcacggtctgcggatattgctgtcgaagcgcacagcctactcttatcaagaaggcacaaacaacttac

SEQ ID NO: 36565 - DNA, 446 bp, Zea mays
  Clone ID: LIB3060-041-Q1-K1-C11
gtccacccattccattccactacccacgcgcataattcacgcgaacgcacacgcacccgcacggcacatccagatgatgctgagggtttccccgtccccggccgccgcggtgccaacccagctctccggtgcgcccgcgacccctgctcccgtcgtcagggtggcggcgccgcgcggcgtcgcctcgccggccgctggcgccgcgtgcagggccgcgggcaaggggaaggaggtgctcagcggggtcgtgttccagcccttcgaggagatcaagggggagctcgccctcgtgccccagtccccagacaagtcgctcgcgcgccacaagttcgtcgatgactgcgaggccgccctcaacgagcagatcaacgtggagtacaacgcctcgtatgcataccactccctcttcgcctacttcgaccgcgacaacgtggctctcaaaggat

SEQ ID NO: 36566 - DNA, 428 bp, Zea mays
  Clone ID: LIB3060-041-Q1-K1-C2
aatgtgaggaaaaaagtagaaaccattgtgggcatcataaatgacaaggagaaaatggaggccgtgagagataaagcagccagtaatcgtgataagtacattggactatcatccacaggcataacatataaatcaagctcagcctcatttggtagcaactacagttcaggcgaacgttatgggagtttcagtggtacaaaggaagctgactcatacggtgatagttacagggacaaagaatctgttaaaacttccacaagcaatagcggcagtcggaaatttggcagcaagctgaggaaggatgcgaagcctgataggaggaatgaggattatagttcacccagctctttgagacccccatctaatacaaataacactgaggacgactttgatgacttcgatcctcgtggatcaaatgggaaaacaac

SEQ ID NO: 36567 - DNA, 411 bp, Zea mays
  Clone ID: LIB3060-041-Q1-K1-C4
cggattccgggtcgacgacgcgtccggcagcgcatgcaggtagcaatggcggtggagacgaagaagggcctggtgctgctggagttgtgggtgagcccgggcgggcagcgctgccgcatcgcgctggcggagaagggcatcgcctacgagtactcggagcaggagctgctgggcggcgccaagagcgacatcctcctccgctccaacccggtgcacaagaagatccccgtgctcctccacgacggccgccccgtctgcgagtccctcgtcatcctcgagtacctcgaggaggccttcccggaggcctcccccaggctgctccccgacgccgcctacgcgcgcgcgcaggcccgcttctgggcggcctactccgacaaggtctacgaggccggcacgcggctgtggaagctc

SEQ ID NO: 36568 - DNA, 369 bp, Zea mays
  Clone ID: LIB3060-041-Q1-K1-C6
agctagttgctaccactgtcgtcatcataaatcacaacgagaaaatgggggcggtaacagatcaagcaggcagtaatcctgataagtacattggactatcatccacaggcataacatataaatcaagctcaacctcattcggtagcaactacagttcatgcgaacgttatgggagtttcactggtacaaaggaagctgactcatacagtgatagttacagggacaaagaatctgttaaaacttccacaagcaatagctgcaatcggaaatttgacagcaagctgaggaaggatgcgaagcctgctacgaggaatgaagattatagtttacccatctctttgagacccccatctaatacaaattacactg

SEQ ID NO: 36569 - DNA, 463 bp, Zea mays
  Clone ID: LIB3060-041-Q1-K1-C9
cgcacgggcgctgcacacagacacaccaagcgtcggcaccaatggcttactaccaggaggtgggctactgctcggaggaggtgaggtcggtggccccggccggcttcggccgccacggaggcggcgtccagcagcacgtcgtcaaggagaagttcgaggaggtcgacacggtctcacgcgccggcgccaaccaccaccaccaccaccatggtcaccacggcggccacggcttcgtggtgcgcgagaccagggtcgaggaggacatcaacacctgcaccggcgaggtccacgagcgcagggagagcttcctcgccagggctaactgagccgcccggcggccggcatccacgcccgttcgtgcctgcctgcgtgccttatgtatgtctgtggttgactggttgtgcagggtcatcgtacttggctatcgtacgtgcacgcactcaactcctgtacgaattacgac

SEQ ID NO: 36570 - DNA, 427 bp, Zea mays
  Clone ID: LIB3060-041-Q1-K1-D10
gttgtgctgtgctgcgagaagaaggagaagaggaggaagaagagcaggtgctgagaagcctgccggcgcgcgttacgacaagcatatatgggggagatcaccaatgtcatggagtaccaggccatcgcgaagcagaagcttccgaagatggcctacgactactacgcgtccggcgccgaggacgagtggacgctgcaggagaacagggaggccttctccaggatcttgttccgtccgcgcatactgatcgacgtgtccaagatcgacatgaccaccaccgtgctggggttcaagatctccatgcccatcatggtcgcccccactgctatgcagaagatggctcacccagatggggagaacgccactgcgcgcgcggcggctgcggcaggcaccataatgacactgtcgtcctgggcaacttcaagcg

SEQ ID NO: 36571 - DNA, 449 bp, Zea mays
  Clone ID: LIB3060-041-Q1-K1-D11
gtcaaagaactaggagcacatacgcttgtatgtactgctttatataatgatggtgatggagagcgtaaatatcttccccagttctttaagttctctgtttcaaacccattatctgttaggacaaaggttcgcaccatcaaggacatcacatatctggaagcctgcatagagaaccatacaaaatctaatctttacatggatcaagttgattttgagcctgcccaacaatggagtgctacaagactggaagctgatgaacatccctcaacagtgaagtctgcaataggggatctctgtaaacaaccgatcctcatcagagctgggggaggaatatacaattacctttatcagctaagatcatcatctgatgaagctggtcaaacaaagtctgagggaagcagtatacttggtaaatttcagataacatggcgtacgaacctgggtgaacc

SEQ ID NO: 36572 - DNA, 51 bp, Zea mays
  Clone ID: LIB3060-041-Q1-K1-D12
ttcaaggccctctacctgtgaatttcctttatctccttggttttttgacct

SEQ ID NO: 36573 - DNA, 407 bp, Zea mays
  unsure at all n locations
  Clone ID: LIB3060-041-Q1-K1-B3
gcagcaacgccccggagctctgactctgaggcctcggcccggcgacgacgacgagtgcgcggtgacgcgagcgcaagagagaacaaagctttgacgcgcacccactcctgccgcctccctcagtcccgactcccgaacacgcgcgcgcaggcccagcacagcacggacgacgacgcagcgagaggctcggaaggaggaaagagtcgccggcggagaccccaatcgatcgaaggcccccggtcgcttcgcccgcgaggcatatcagtgcccccttggccaccgggtaaaagctttcctgggggatacgatcggctctgcggcctgccacggatcggagggcttttgctggtgactccttggggattttcggtcggngtttggagctttcctgggtttgggagctagct

SEQ ID NO: 36574 - DNA, 365 bp, Zea mays
  unsure at all n locations
  Clone ID: LIB3060-007-Q1-K1-C11
agggctgctaccacgatcacctggcgcccgcgcgccatggatggcgccgttgagctgctcccgaccccggcgcggcggcgctgcacgggataaacccctacggcttcgcccctaaccctttcttcaataacttcctcccccagaactccgctgccctagctgcctaccaactgcagcagcagcaggctcatcacttcgactcccatgcctaccaccaaagcccctaccggtaacaccatgcaccgctctaccaaacccgncgacgctgtcaaacctgcgccgacaccgggcaaccagcaagccgtgctggaccgggctcaaaaggccgcgagggacgctctggaagagctcgtgaaaggtgggga

SEQ ID NO: 36575 - DNA, 184 bp, Zea mays
  Clone ID: LIB3060-007-Q1-K1-C2
gtccacttatgatgtatccatccatggtttgattgaattgcaaccgctacagcaacccggtgggaaccatgggcccctttttcttgaagcagggggaccggcggaagctggggaccaccgaaaagcgggcgctggccaaactgatggcctcctccggctacacgttccctgggttggtgcaccc

SEQ ID NO: 36576 - DNA, 255 bp, Zea mays
  Clone ID: LIB3060-007-Q1-K1-C3
cattacttatgaggtttcaatccatgatttgtttgaattacatgactacaatccacagggaggcccatcataccgacataatgttcaagcagtcggaccaacgaaagctttaactcacattgaagaaaccgatacacacgctgttatccatgaatcccttcacatgatataatttttaagcttatacatatggtgattgaactgtttcaattatgctattacttgatctgttgacagcatttactgaaggtcttg

SEQ ID NO: 36577 - DNA, 444 bp, Zea mays
  Clone ID: LIB3060-007-Q1-K1-C4
gaaacagcagtagcggaggcaagacgaaatggtggccgccgtcgcgtcgccttcgtcggcggcaccctccgccggccgtccccatccgacatacaaggagatgatcatgcaggcgctgacggagctgcgggacccgagcgggtcgagccgcagcgccatcgccagctacatcgccgaccacttctccggcctccactcgcgccacgatgccctcctctccgtccatctccgcagcctcaagtcccatggccaacttcgcctcgtctctggcaactacttcgtctccaccgccgctcagcggcaggggcgaggctccaacatcccgcccaaccccaaccctgctccggggcagaagcgtggtcgggggcggcctcgcaagtacgcagattcagcccctttcgctttgaccccggcgtttcaaggcgccaagcgagggcgtggacc

SEQ ID NO: 36578 - DNA, 440 bp, Zea mays
  Clone ID: LIB3060-007-Q1-K1-C7
ccgtcgccgcctcctctccccagcacccggagctcgaccgaacgccgctcaccatgatcatccccaagaagaaccgcaatgagatctgcaagtacctcttcaaggagggcgtgctgtatgccaagaaggactacaacctggcgaagcacccgcagatcgatgtgcccaacctccaggtgatcaagctcatgcagagctttaagtccaaggagtatgttagggagaccttctcctggcagtactactactggtatctcaccaacgatggcattgagcacctacgcaactacctgaacctcccgtctgagatcgtgcctgccacgctcaagaagtctgccaagccacctggccgcccatttggctctggccctcctggtgaccgtccaaggggcccaggccgttttgacggcgacaggccaaggtttggtgacagggattgg

SEQ ID NO: 36579 - DNA, 429 bp, Zea mays
  Clone ID: LIB3060-007-Q1-K1-C9
gctccagaacaggaaccggaacaagagcctgagccagaacccgaaccagtgaaagaggaagcaccagaagccgagccggacttgctgggtctgaacgaaccgagccctgctgcgaccgcgatagaagagcagaatgctttggcgctagcaattgtcccgatagatgatgttccgggagctgctcctacttttgagaacggagtcacaggctgggaactggccctggtgacagcaccgagttcgaccgagaccgccgttgccccaagcaagaaactggccggtggtctggacttgctgacccttgatagcctgtacgacgaggcgaaccggagagcgagccagccggcgagctacaacccctgggatgcaaccgcgtctgccccgatgatgaccaccatggcgccggcgatgcacgatccgttctacgcc

SEQ ID NO: 36580 - DNA, 425 bp, Zea mays
  Clone ID: LIB3060-007-Q1-K1-D10
gagacgcaagcaggggagaatcgcggaggtctgggaaacaccatcctgcagagatgacagtgctgctctccccgagctcctccctgttcctcgccaaaccttctgccgtcgccaagggcagggcggcggctgcggctgtgacgtgcttcagcgggccctccctgtcagtggggcgtgaagaggagggtgtagcagtggtggtggggaggcgtgcgttggcttccgcagcagctgtcgcctcagtgcttgggtttgcaggccgtggtctggcggccaaccagggcctgctcgccgggagggtccccggcttgtctgaacctgacgaaaatgacaggttggagaacgtaccgcatgccagacgacaaggtccggggccacggaattggctggagccccatcattccgtacagcttcaaagttccaga

SEQ ID NO: 36581 - DNA, 370 bp, Zea mays
  Clone ID: LIB3060-007-Q1-K1-D11
ggcatgcaaaatgggcagaagatcacattccctggtgaagctgatgaagcgcctgacactgtcactggagatatcatctttgatctccagcagacggagcatcccaagttcaagagaaagggtgatgacctgttctacgagcacaccctgaccttgactgaatctctgtgtggcttccagattgttgtgactcacttggataacaggcagctgctgatcaaatcaaatccggtcgaagttgagaagcctgattctttcaaggcgatcaacgacgaatgcatgcccatgtaccagaagccgttcatgaaaggcaagctgtacattcacttgtcggtggagttaccagactcgctaaacccggagcagtgca

SEQ ID NO: 36582 - DNA, 424 bp, Zea mays
  Clone ID: LIB3060-007-Q1-K1-D12
gccacgggaccttcaggatgaacgcgctggcgtacttcacgctcctgtcggggttctacatggcgtggaacatcggggcgaacgatgtcgcgaacgccatggggacgtcggttgggtccggagctctgacgctccggcaggcggtgctgaccgccgcggtgctcgagttctccggcgcattcctcatggggacccatgtcaccagcaccatgcagaagggaatcctggttgcgtctgcgttccaagggaaggactctctgctcttcgctggactcatatcctcccttgctgctgccggtacatggctgcaggttgcttcgtcatatggctggcctgtctcaactacacattgtatcgttggggccatggttggtttcgggctggtgtatggaagggtggatgcagttttctggagttctttggc

SEQ ID NO: 36583 - DNA, 140 bp, Zea mays
  Clone ID: LIB3060-007-Q1-K1-D3
atctgtggaacctgaataataataatacagatggtttttatccatgtcagtggaacctgaataataataatacagacatctgtgaaatagtttgctcttgtgctgtactacaactcaaacgtaagaaatggattcgatct

SEQ ID NO: 36584 - DNA, 140 bp, Zea mays
  Clone ID: LIB3060-007-Q1-K1-D4
atctgtggaacctgaataataataatacagatggttattatccatgtcagtggaacctgaataataataatacagacatctgtgaaatagtttgctcttgtgctgtactacaactcaaacgtaagaaatggattcgatct

SEQ ID NO: 36585 - DNA, 424 bp, Zea mays
  Clone ID: LIB3060-007-Q1-K1-D8
gtcatccttctaggggtatgctcccacagtcctgaggtttgttcactttccatgaaggaaggcgtcatcccagcccttgtagacttatcagtgagtggaaccaaggtggcaagggattgctcggtcaagttgcttcagcttctgaggaacttcaggcgatgtgaccagttcagcagttcatgctcaagagagcttgctgtcgatcatgtttcagagaacactcgcaatggttcaatttgcatgcagccgatatcaaagtcagcccggtatatttcaagaaagctcaaccttttctcaaaacctcggtcgctgaccctggcttgagaaatggaaggggtcggttggatcgagccctattccgcagcgctaactgccagatgtacagatagtagcaggtagcgttcgtcgagatgaaatgtttgtg

SEQ ID NO: 36586 - DNA, 433 bp, Zea mays
  unsure at all n locations
  Clone ID: LIB3060-007-Q1-K1-D9
caagtgcgcgaccaanaagctcggacatcctgcgcgactcaagttcaattcgtcgaaattattcaatcgaagaaaagatcttcagcaattaattaccgaagaaaagaaggctcctgtatgacatcaaccggaacccgtagtcgtgcttgcgactatcgcgtcgaattagtcagggtaagttggttcgtattcccattaactaggtctataaatagattaaatagaattgttggtcacaataaatattattaatttagcatgcgtatattgtgatgattgatttagataactcgctaaatcaactaattaagttacacagtttagagagttaataaaaagcttagaataaaaatagattttctagtgtaatatgtcaatttgattaatggatatagtcgatgtcctgctgtgatatccatggtgcttaatgctt

SEQ ID NO: 36587 - DNA, 417 bp, Zea mays
  unsure at all n locations
  Clone ID: LIB3060-007-Q1-K1-E1
ccgncttccctcccctcctctcctgtgttcctccataccccactccccccgcaggagcggcgcggcggcggcaaaggcaaaggcaaaggcaagatgttcgggcgcgcgccgaagaagagcgacaacaccaagtactatgagatcctcggggtgcccaagtcggcgtcccaggacgacctcaagaaggcctaccgcaaggccgctatcaagaaccaccccgacaagggcggtgaccccgagaagttcaaggagctcgcacaagcctatgaggttttgagtgatccagagaaacgtgagatttatgatcagtatggtgaagatgcccttaaggaaggaatgggtggtggtggatcccatgctgatccatttgacattntctcatcattctttggaccctcttttggaggaagtggtgga

SEQ ID NO: 36588 - DNA, 440 bp, Zea mays
  Clone ID: LIB3060-007-Q1-K1-A2
acgaaagatatttgtcagcaatgttggtgcagatatcgatccgcagaaattgcttcaggtctttgcgaggtttggtgagatcgaggaaggcccgcttggtcttgacaaggtcactgggaaacccaagggatttgctctttttgtctacaagaccattgaaagtgccaagaaggctcttgaggagccacataagcattttgagggagtgatgctgcactgccagaaggcgattgatggaccaaagccgaacaaattaggaggagctggaggttttttcggtgctggagcttcaagtgggggcaaggggtttgctggttatggagctactagtcattctctgcccggaactgttggtattgtccagccaatgtcacctctggcacctggattggcttcattgcctggtggtatttctgctgccccaggtgtggatcctgctc

SEQ ID NO: 36589 - DNA, 408 bp, Zea mays
  Clone ID: LIB3060-007-Q1-K1-A3
ggggcttggccgtgtcgatcgctgatcccaccggctgatagagttggcggccgggggagtgagtcgtcagggatggcgtcggagccggtggcgcgggcggtggcggaggaggtgggccgctggggcagcatgaagcagacgggggtgaccctgcggtacatgatggagttcggctcccggcccacccagcgcaacctgctgctcttcgggcagatcctgcacaaggagcttcccatccggtttgcacgccgcgcgctcgagctcgactcggtgccctttggcctcttcaacaagcccgccatcctcaaggtgcgggactggtacatggactcattccgggacatcagatactttcctgaagtgaggagcaagaacgacgagctcgctttcacgcagatgatcaacatg

SEQ ID NO: 36590 - DNA, 437 bp, Zea mays
  unsure at all n locations
  Clone ID: LIB3060-007-Q1-K1-A8
agaggatttagcaccctccccagagattaatggggaaaaggagaaagaaactgaagttgcagagaagagatggaaagtacttgtgtggaagactgctgtttatcttatcactctcggtatgctcattgcacttctaatgggactgaacatgtcctggactgcaatcactgcagctcttgttcttctggcactcgattttacggacgcacaagcttgtcttgagaaggtgtcatattcactgctgatctttttctgcgggatgtttatcactgttgatggcttcaacaaaacgggcataccgaacacactatgggagttagtggaaccatattcacgaatcgatagtgcgaaaggtgttgcacttcttgccgtggtgattcttatcctttcaaacgtggcctctaatgttcctacaggtaattnttcttacgcatatg

SEQ ID NO: 36591 - DNA, 413 bp, Zea mays
  Clone ID: LIB3060-007-Q1-K1-B10
gcctctgaggtttcccagtagcggcgcctagcatcttctccgcgcgcagcttgcttcctccctctgccgctcgtctccatctctccatctcccaaaagaccgcgcctagctccagccatgagcgccgacgtcctctctctgtgcttgatctcccagtcctccgctccctgaaaccttcacccacatgtttgtgaaggtccggtagtggagatcttggcaaggtccctggtctgcgctcctattccacctgtctcatccccttatcatgctcgacacttgctccctggcagcatgtcgtagcagcatctgtgcttactgtgccgtgctgtttctctgcacgcgtcaagctctcgcgctgaatccagccccatgttgacgcgttcatgttccagcttgtcgtgccgcgtcgtcat

SEQ ID NO: 36592 - DNA, 378 bp, Zea mays
  Clone ID: LIB3060-007-Q1-K1-B11
gtgcaggggtgagaaatgcagcccagcgcaaactatttgatgagctgggaatagtggctgacgaattacctgtcgaccagttcattccgcttgggaggatgctttacaaggctccttcagatggaaaatggggcgaacacgagttggattacctcttgttcatggttcgtgacgtgaagctcgacccgaatcctgaagaggtggccgatgtcaagtacatgaaccggcatcagctgaaggagctgctcaggaaagccgatgccggggaagatggcgttaagctctccccttggttcaggctggtggtggacaactttctcatgggctggtgggatcatgtccagcaagggactctgcaaggggcaacagacatgaaaa

SEQ ID NO: 36593 - DNA, 431 bp, Zea mays
  Clone ID: LIB3060-007-Q1-K1-B12
cacacaagcacttcgacgtcacacgggcgctgcacacagacacaccaagcgtcggcaccaatggcttactaccaggaggtggactactgctcggaggaggtgaggtcggtggccccggccggcttcggccgccacggcggcggcgtccagcagcacgtcgtcaaggagaagttcgaggaggtcgacacggtcgcacgcgccggcgccaaccaccaccaccaccatggtcaccacggcggccacggcttcgtggtgcgcgagaccagggtcgaggaggacatcaacacctgcaccggcgaagtccacgagcgcagggagagcttcctcgccagggctaactgagcagcccgggcggccggcatccacgcccgttcgtgcctgcctgcgtgccttatgtatgtctgtgattgtgcagggtcatcgtacttggc

SEQ ID NO: 36594 - DNA, 162 bp, Zea mays
  Clone ID: LIB3060-007-Q1-K1-B3
cacacacacacactctacagcaacagcttagcctctcccacaagacagcaacatggctgaggaggaggccaagaaggtggaggtggaggtcaccaaggagcccgaggcggcggcgaaggaggacgtatccgatgacaaggccgtcatccccgcgaccgaccc

SEQ ID NO: 36595 - DNA, 439 bp, Zea mays
  unsure at all n locations
  Clone ID: LIB3060-007-Q1-K1-B4
aagaatccagtgtaaaatatcaagggttaaacaccatggtatattttgcaagattccctatgtatcatgtcaagaagaaatagtggactctgcgtcttaaccgtctgtttccttgtcatttttggttcatggtaaccattttctagtttattttatgagtctgctttcgtggtaaggtttaaattaaggtcagtagtgatgtgtaaataattgttgccctagcaacatcacttgctgaatcagcctgttttgcttttcttctaacagtggaaagctgcaaaagaggaacttcgcgacgaagacgaagaggagcctgaaagtgctctggaggcattagaaaggaagcggcaaaaggaaatagaggaatggcggaaacaacagatagctagtggagaagctcanganaatgccaattttgttcctgttcgtggtgattggt

SEQ ID NO: 36596 - DNA, 441 bp, Zea mays
  Clone ID: LIB3060-007-Q1-K1-B5
gttcatctcaggcagggcattgcaggctagctagtactgttcaagttctgtcatatatgtagtcttctgtaggattgctgcatcccttgaaacttgcattctgtatcacattgcatcctgctgactcgcctcccttcataacatctccctgtgttatgcaaagcgcacaaggatctcccctctggcacttctgttttttggaatgaagatgctcagaggcgttgttatgaagtcccgatccaatgttctttgtcctccatgtctgtactgactttagctatgcatctcctttgtcaccccagtccattgcatgtgccatccaatccgtttcgaaccattcatctcaaagttgcatttagtggtggttttcccttcgtcttaatatcttttgtgcctcatgaacctggagcatgccccatattcttagctcctccatgtatt

SEQ ID NO: 36597 - DNA, 440 bp, Zea mays
  Clone ID: LIB3060-007-Q1-K1-B6
ccactcaccagcttcatggggtatttgaggctgccagtttcggtgggtctaatatcgatcccactgcatgggaggataagaagtgtaaaggtgaatctagattcccagcgcaggtgaggatccgcgttaggaagctctgcaagccgttggaagaggattccttcaggccagttttgcaccactatgatggtccaaagtttcgcctcgagctctccatcgcggagaccctgtccctgctagacctatgcgagaaggaaggcatctgagctgttggctgcctcgtgaggttctagtaaatatcaatcatccttgtatgttctgtggatggtggttggcaatgttgtttatttttcaagcgcaagctgctgccggtctcgttttccctgtcctggatggaagcaaagggacctggtactttgaaggccccccctcaaacataa

SEQ ID NO: 36598 - DNA, 431 bp, Zea mays
  Clone ID: LIB3060-007-Q1-K1-B7
gcgagccccgagagcgggtttagttagaggctacgggcggtcgggcgcggcggcggcggcggccatgagcagcgggagcgagagcactaccgccagcaggtggcccgagctggccacgctgcgcgccctggcgcgcgacgccgcggagcagctgcggctgccgcgggccggcacgtcggcgtcggcgtcggcgtcgtcgtcgccgtggcgcgggcgcgaggaccacctccacggccacggcaagacggccaaggtgatgcacctgctgctctggggacccaagtgaagcggcgagaggccaccgtaccgccggcgttgctcgttttgctctgcctgcaatccgccccgcacggactgtactgtactgtacctatacacctatatactacgacgtgcacatgtacgagtctacgacgtgctgctgtaccata

SEQ ID NO: 36599 - DNA, 418 bp, Zea mays
  Clone ID: LIB3060-007-Q1-K1-B8
cctcggtcctctcctctccgcatttcgggcggccacttgtggcggcgtagctagcgtactacagctccctgcatggtgatggaggggcgcacaggctcactctacggccgcctcaacaagagcagcacgcgggggttcctcgcctacaccgccgccggggctgcctgcgcggctgtcctcgcctgcttcgtgctctccgccgcggactcgccggcatctgcggcgcgcaacgatggcgcgcgcctccgcctgtcctcgcgctcaccgcgcgtctggcccgacctcgcgttcaactggcgggtggtggtcgccaccgtcgtcgggttcctcggttccgcgtttggcaccgtcggcggcgtcggcggaggcgggatcttcgtgcccatgctcaacctcgtcgtcggcttcgacaccaaat

SEQ ID NO: 36600 - DNA, 378 bp, Zea mays
  unsure at all n locations
  Clone ID: LIB3060-007-Q1-K1-B9
ccgcacccaacccaaggcgccactgccatggacgcgggcggtccgccgccgctgttcctcctgggcgccgtgctggccgcggcgctggggtggctgctcgtggtctggcgggcggcggcggggcggcggcggtccgcgtcggcgcggctgccgccggggagcacggggctgccgctcatcggggagacgctgcggctcatcgcggcgtacaagtcgccgaacccggagccgttcatcgacgagcgcgtggcgcggcacggcagcggggtgttcacgacgcacgtgttcggcgagcgcaccgtgttctccgncgacccggccttcaaccgcctgctgctggccgcggagggccgcgccgtgagctgcaactacccgtcg

SEQ ID NO: 36601 - DNA, 333 bp, Zea mays
  Clone ID: LIB3060-007-Q1-K1-C1
cagatattctgcagatgaaggcccttcgttgactgaactgagtggatacaatgcaaagagacacgagtttgacccagagtatgataatgatgccgaacaagcgcttgctgagatggaatttaaagaaactgattcagaaactgatcgtgaactgaaactccgtgtgctgcgtatttatctgtccaggcttgatgaaagaaaaaggagaaaagagttcatattggaaaggaatttattgtttcctaatcccttggagaaggatcttacaaatgaagacagggaagtttaccatcggtataaggtcttcatgcgttttctttccaaggaggaaca

SEQ ID NO: 36602 - DNA, 433 bp, Zea mays
  Clone ID: LIB3060-007-Q1-K1-A12
gcaaacctctgcaatttagttgacatttagcttctctcgacccctctcaacttcttgtttatgcaggtggaagtcaagaggacagttccgagggaagagatgaataccaaagatggccctaagacaagaaagatcttcatcggtgggctacctgcatctcttactgaaggttggtgtttgctatcaacaaacaaatgttgaattcattttgtttatgatactgagaaggcacaaaatttcagatgagttgaaggatcacttttcattgtatggtaaggtgctcgaacatcagataatgcttgatcatagcactgggcgttctagagggtttggttttgtcacttttgaaagtgaagattctgttgaaagagtcatatcagaggggagaatgcgtgatcttggtgggaaacaggttagattgttaatttttttg

SEQ ID NO: 36603 - DNA, 334 bp, Zea mays
  Clone ID: LIB3060-006-Q1-K1-G6
atcctgctctgctagtgccaggattcctccctatccatcccatcaacctcagctaaggtccccagcggcggcgaggcgatggcggcgcctgtgacggtgtacggaccgatgctctcaccagctgtggcccgcgtggcggcctgcctcctggagaaggacgtgccgttccagatcgagccggtggacatgtccaagggcgagcacaagtcgccgtccttcctcaagctccagcccttcggacaggtccctgccttcaaggaccacctcacaaccgtctttgagtcaagggctatttgccgttacatatgcgaccagtatgcggactctggtaatc

SEQ ID NO: 36604 - DNA, 461 bp, Zea mays
  unsure at all n locations
  Clone ID: LIB3060-006-Q1-K1-G7
tccggtttcggattccgggccgaccacgcgtccgcccgcgtccgcgccggggccgttcgcgttccggcgcccgtggaacacgccacagccggaagcgctgcgcctgcgcctcgcctgcgcgcgcggggcgtccggcgtgaggacggcggcggcgtgtcacggaggagcaggagcagcagcaccgcggacgttctcgacctgctcgggatctcagcggatgggagccccgatgatgttcgggcgtcctacaggcggctggcgctaaagtaccacccagacgtgtcccctccgggcgccgcggccgagaacacgcgccgcttcatcgaggtgcaggaagcctacgagacgctctccgacccaagccgccgggccagctacgaccgtgcactcgcccgcggcgtctgccgnctcgccttctccgggcgccgtttccaatcccaccacgcctactaccattacca

SEQ ID NO: 36605 - DNA, 325 bp, Zea mays
  Clone ID: LIB3060-006-Q1-K1-H10
gtaacaaacgcgttcgcaggatccgacccttatgcacagttggaccgtatcccgaggcttgtgcgccataaaattaccagcctatcgatggcgatgaagataattgtgaccacgcatggtgaaaactacattatggtctggaaggtccgcatgaacagttaggaaaaagggcgagatgatggtaatctagttatctggtgtaacctgtactgtactctactgaataagatggcttggtaccgtggcgtgtcacctgatcttgtaagaacaggctgtaaatatgtcatttgtgcacttgcagtcctctttaagatactattagcat

SEQ ID NO: 36606 - DNA, 425 bp, Zea mays
  Clone ID: LIB3060-006-Q1-K1-H11
ctcggcccttcttcaagggtcattcgatgcattgtacctgaacgctggacatgtgctgtactcgaatcatcgcatcacttacgattcatcctcgaattgacatgtgatctgaaaagaaagggtgcattgaacaatccatgacgtgcgtgggtcactttcatagcacgagggcgatcgacgcaagcgctgtgccacctggatcttgagctaccgttgagcacatacctgcccaacttaagcgccaggcagcgcatgtcgaactgaagatcaagatagcaccgcgtctccgctagtaagacagtgcactatctcgattaccaagtcttgattcacgatactctcaaggtaaaaggtggagacaagaccaacacaatccacattttgctgcgactcgctggatgcgcagtgctgtattcactaattgc

SEQ ID NO: 36607 - DNA, 98 bp, Zea mays
  Clone ID: LIB3060-006-Q1-K1-H2
ctcgtgaacaatggcaagaacaagcgacacggatacgcgctacaaggcgaaggacgcagacctgttccacaaagcgcgggcacggctgcagcggtcca

SEQ ID NO: 36608 - DNA, 452 bp, Zea mays
  unsure at all n locations
  Clone ID: LIB3060-006-Q1-K1-H3
ggtcgaccagcgttcgaaaaactactgncattagcagttgagcaaagctggcgcattacatactgaattttgtcagtttgatagttgttcgaaaaggttatttcagaaacctgtctgaacattgtaatgcatatgaacaacaatcacaattgtagctgcgtttctttggaagcacccctttaattccattctgttgtttgaaagttgaaactatggcttatgtatctgccaaggatgaaccaggacggatgcatttactggagatcacacttgccatgggctattccaaaagtcctccttcaatctctacagttagtctctatcctaatatttccataaactaagtctngttttattatactttgctataattgaacttgtctcattaacaggacgtaccatatcttccaaaaatacattggtcaaaaaactcaagactgaaagatgttatt

SEQ ID NO: 36609 - DNA, 153 bp, Zea mays
  Clone ID: LIB3060-006-Q1-K1-H4
tttcggatgatttaacgggatttgaaatcacatatcttatagagttgacggagcctgtcagattcatgttcacatgggtcgccgcactgactttaatatttcgggtagcgcatgcgatcactaatgtcatagtgaaggactttctgatcttga

SEQ ID NO: 36610 - DNA, 441 bp, Zea mays
  Clone ID: LIB3060-006-Q1-K1-H5
caaattcagacaagcatatttctggcctcaaaatgcttcaaaatgacaattttaaccatggtggtagcagagaaaagaacaaaagtggaaccaaaactggtactgttatggacaaattgcacaatgacaaaaagttctcgcctggacatcattattccaaggccagccatgagtctcataatccagtggaagaacatcaaccacatggatcagatgataattccaatgaaacaagagatggtgttggtggcaatgaagctcctgttgtgtcaacatccagaatggatgcgatgaataaaattgacaaggataaggtaaaagcagctttggagaagcgaaggaaatcgaaaggtggttttgccacgaaggtaaatgtgattgatgatgatgatctacttgagagagagctagaacaaggtgttgagttggctgttgagtttg

SEQ ID NO: 36611 - DNA, 201 bp, Zea mays
  Clone ID: LIB3060-006-Q1-K1-H6
accgcactgagaaaccaaaccagcaagcgaagcccagcaagaaaaccacatgccccacctcgccgccactccccccacttcctccgccgccgtcgtccccgccgcgggccgcatcgcgttccggcgcccgtggaacacgccacagccggaagcgctgcgcctgcgcctccggctgcgcgcgcggggcgtccggcgtgagga

SEQ ID NO: 36612 - DNA, 438 bp, Zea mays
  Clone ID: LIB3060-006-Q1-K1-H7
gccgaaagggtttctccaaaaccctctccaacaaaatcgcaaccgccggcgaggatcggcgccgccatgtcccagatcctccgccaccgcctgtcggctcactaccacggagtctgcggccactgctgccgccgcctcagctcctccgtctacggcggcggcgggagtcgccgcgccgtcgccgcgccgccgcaggacggcgagggcagccgagcggtgagggtgtctgtgtggtgggacttcgagaactgccacatccccaacggcgtcaacgtccaccgcgtcgccccgcgcgtttccgccgccctccgcgccgccggcattcgtgggccgctctccatcaccgccttcggggacgtgctgcagctcgcgcgctccttccaggaagcgctcgccgccacgggcgtctgcattttccacgtcccaagcagtgggaag

SEQ ID NO: 36613 - DNA, 434 bp, Zea mays
  unsure at all n locations
  Clone ID: LIB3060-007-Q1-K1-A10
caacctcctactgcccgccccctcgctcgccggcggatcccgcgccgggctgcgaccgtggtttccccgcgcgcgttcagccgcgcggacttcgatggcttcgtgcggcgcgcgtggcagggcgccaacgcgggggccgagcgcttcgccttcgaggcacggcaggccgcgcagcggctggacagcaggttctcgatctcccggaggctcgcagacgcttcccgtgccgcccgcgcccgcgcagttgagatcgacgccgagttcgggattcggcggcgngggcgctccttctctgtcgacttctcccgcaactggcccaggtatcggagggacatcaatgacttcatgggaactcccatcgggagagcattagctacaatatttttcctgtggttagcactgtcaaggtggttgttcagaattntcatttttgg

SEQ ID NO: 36614 - DNA, 439 bp, Zea mays
  Clone ID: LIB3060-006-Q1-K1-G5
cggacgcgtgggcggacgcgtgggcagttaccctatgaaggtggagttttcaagcttgagctattcttgcctgaggaatatccaatggctgccccgaaagttaggtttctcaccaaaatttaccatccgaacattgacaagcttggtaggatatgcctcgacattcttaaggacaaatggagtcccgctcttcagatacgtacagttctgctcagcattcaggcacttctgagtgccccaaatccagatgatcctctctcagacaacattgcgaaacactggaaatcaaatgaagctgaagcttttgagacagcgaaggagtggactcgcctgtatgcaagtggggcattgtaaccaagtgttgtttcagatgtgatgttataacatttccatagtttggggccgactgaatacccctcttgcttgatgagagcaaatt

SEQ ID NO: 36615 - DNA, 436 bp, Zea mays
  Clone ID: LIB3060-007-Q1-K1-A11
cccacgcgtccgagcccgccagagagacaagcagccaaatcaggcctttatttacgatccggccggccggaatctagaccacctctctctctctctcctcgtacgtagtcgttgagtctttgaggtcgaatggcgcccgtctacgctgccgcggaccacggcaccaacggcggctccggcctgaccctgaacccggtggcggcgcgccgggcgctcagcctcgtcggcgcgcccacgccgtcgtcgtccacgccgccggcgtacgggagcatcgtcaccgtgctcagcatcgacggcggtggcgtgcgcgggatcatcccgggcaccatcctcgccttcctcgaggagaagctgcaggagtacgacgagcggccggacgcgcggctcgccgactacttcgacgtgatcgccgggaccagcaccggcgggctggtca

SEQ ID NO: 36616 - DNA, 449 bp, Zea mays
  Clone ID: LIB3060-040-Q1-K1-E7
tcccgctcgacccacgcagtccgagccgcctagtgcctcccacctcccgttcgccctccgcctcgcgtctgacggtgccgatggaatgtaacactttgaggtgctagaatttctttttcttctcctttactatttacccttaccatttatttcactttttccgtatcgactcctatttttttttttttttccttctttttattttttttcttttttttcttttttttcttttttattttttttttttttttttttttttttttttcttattttttctatttattttttatatttttttatttttttttttttttttttttttttttttttctttttattattttttttttttttttttatttttttttctttatttttttttttttttattatttttttttttttttttttttttattcttttttttttttttattatttttctttttt

SEQ ID NO: 36617 - DNA, 220 bp, Zea mays
  unsure at all n locations
  Clone ID: LIB3060-040-Q1-K1-E8
gagatccttgttgatggccctcatgtcattgatcgctgcgcttacgtcacgganagcgtccttgctgcgtgctacaaggcgctcaacgagcaccatgtcctcctggagggtaccctcctgaagcccaacatggtgactccaggctccgactccaataatgttacccctgatgtgattgctgagttacaccttccgtaccctccataggaccgttcatgct

SEQ ID NO: 36618 - DNA, 230 bp, Zea mays
  Clone ID: LIB3060-040-Q1-K1-E9
acggctgcctccatccacgcctaaacatacccttttccatctacctctcgctccaatcgatttgatgtaccgcgtcaatatcttcctcagctctttaacttctctgtttcaaacccattatctgttatgacaaatgttcgcaccatcaatgacatcacatatcttgaagcctgcatatataaccatacaaaatctaatctttacatgcatcaagttgattttgaaccttc

SEQ ID NO: 36619 - DNA, 56 bp, Zea mays
  Clone ID: LIB3060-040-Q1-K1-F12
acaacaatccacacaatcacttctacctctttccttttctgcacacatacacacca

SEQ ID NO: 36620 - DNA, 186 bp, Zea mays
  Clone ID: LIB3060-040-Q1-K1-F2
tttttttattttattttttatttttttattttttttatttttatttttatttttttatttttatatctttttttttttatttttttttttatttcttttttattttttttttttatttttttattatttatttttcttattttttttttttttttttttattattttattataattttttttcttt

SEQ ID NO: 36621 - DNA, 133 bp, Zea mays
  Clone ID: LIB3060-040-Q1-K1-F5
cggattcccgcgcgagccacgcatccgcgctctcctccctttctttcttatcttttactactagactactagtaactccgcttgtcttattccaaagctgggcgggcaaaaactaggacagctcacaccacct

SEQ ID NO: 36622 - DNA, 311 bp, Zea mays
  Clone ID: LIB3060-040-Q1-K1-F7
ggcctcccatccacaagttcttagcttttgcgagattgagatccggctgtggacatgccgacagaggaaggaggacagaaaaatggggattggagatggatcttcaaatgggaaccagcaactggtgcataatgaaatactagatgagaccacaccacttcttccagtcaaggttgatgaatactatgttttttattattaatatttatcttattcttttttttatttataattttattttattttattttttaatattttatttaaaatattattttttaattttatattatttattttatatattttat

SEQ ID NO: 36623 - DNA, 222 bp, Zea mays
  Clone ID: LIB3060-040-Q1-K1-G11
cactacacacacacacaccagggcattgttaccaatgactaactaccaggaggctgactactcgctcgaatgacgtcatgtacgacttcatgtccggcttctgcctccacacccacgccgtccagcatcacgtcgtcaacgagaagttccaggaggtcgacacagttcaacgctctcattaccaaccaccaccaccaccatggtcaccactgtggccacctc

SEQ ID NO: 36624 - DNA, 485 bp, Zea mays
  Clone ID: LIB3060-040-Q1-K1-G2
cgcatggccacgcccttcctcgggcttcgctcaagaaggaggtcaagtacgacaaggtccggtccatctataaggtccagcgcctgcacttccacgacgacatcaccgtcgtcgtgctctttctttacaagtgcattttagctttcagttcctgtttttttttacttttatctttacttattttctctttgtattttttttattttttttctttttttttttttatatttatttatttattttttcttttttattttatttttttttatctattattttattttttttatatctatttttctatatttgttgtgtggttttttcttttttttattttttttattctttattttttattcttatatttattttttttttttttattttattatttattttttttatttattttattattattattcttttctatttattattttatttttttattttaatattttattttttttttcttctttttt

SEQ ID NO: 36625 - DNA, 182 bp, Zea mays
  unsure at all n locations
  Clone ID: LIB3060-040-Q1-K1-G7
caccggtcggaatacccgccgcgacgccacgcgtccgggccaaccttcgtcacccctcgtagccttcttntaaccctggggcccaaaagccgcccgaggagnaaggcctgagtacgcacaagcggccgcagcgtcgcagtttattcctctcatacttccagccaccgttccccatgtcgctc

SEQ ID NO: 36626 - DNA, 197 bp, Zea mays
  Clone ID: LIB3060-040-Q1-K1-H10
aacacacaagatactcaacacctacccatgtatttccatggctaatatatataagctcacatgtcttcacttccatttccatttccattagctgcatacttactaagtaatatttaaaggcccatatctgaataatttacccatccaacaaaacatccttcaaattctcatctatccatctttacctttctcattat

SEQ ID NO: 36627 - DNA, 149 bp, Zea mays
  Clone ID: LIB3060-040-Q1-K1-H11
ggtcgacgccacgcgtccggataaaggcttggtctcctattcaattctatttagattttgctctccctaagctgatcgaagaggcgcggataaagatataacctgggtcaaaccatctattatttgatgcatcttcagctattcaacct

SEQ ID NO: 36628 - DNA, 119 bp, Zea mays
  Clone ID: LIB3060-040-Q1-K1-H2
tcccgccggacttccataggaactatttgatttcattgctgctgcattttctattatttttccctactgaattttaacagttccgtttcccagaaaggttgcccacccaaccccccttc

SEQ ID NO: 36629 - DNA, 287 bp, Zea mays
  Clone ID: LIB3060-040-Q1-K1-H9
attcccgggtctggtccgtggccagggcgtggtccatgctctccgctactaccgtgttactccagcaggggggcggcctgtcggacttgtccggtctcaagagctccgcgtcgctgcccatgcgccggaatgccacctccgacgacttcatgtccgccgtctacttcaggacccacgcggtcggcacgagcggctggccgtggcgggcgccgacggacgcgaagctgaaggtggccatcaatgggttcggccgcatcgggcgcaacttgctgcggtgctggcacggg

SEQ ID NO: 36630 - DNA, 441 bp, Zea mays
  Clone ID: LIB3060-041-Q1-K1-A11
caggtcagggatgaaatagaacatcttctagatgataatgaagacatggaacatctgtgtctagagcaaggaagcaagtacaaaaccaacaggttgaggctttaatgtcatctgctgcttccaacagcattgttcttgccggaacaggtgtgcccaggctgaactctagcttccggcgtagcctgagcattgctactagcatgcatttggataatgatgtggaggacctagagatgttacttgaggcctacttcatgcagctggatggaattcgcaacagaattttgtcggttcgggagtatattgatgacacagaagactacgtcaacattcaactcgacaaccagcgtaacgaactcattcaactccagcttacacttacgattgcatcctttggcataactgccaacactttcattgctggagcttttgcgatgaaca

SEQ ID NO: 36631 - DNA, 310 bp, Zea mays
  Clone ID: LIB3060-041-Q1-K1-A3
ctctgcccaaaggacgtaagcttttggcacgctatcttcgacttcttttctctggaagtgagctgacccgaatagtctgcatggctgttttccgacaccttaggagcttgtttggtggcttaccgtcagactatagtgctgcagaaacaaccatcgttcttgccaaggctgtttcctcttgtgtgcgccatatggaactcagtgctctcagtgcctgtctcgcagctgttgtctgttcttcgcagcagccacctcttcggccactcggtagtgcctctggtgatggggcctctctgataattaaatctgt

SEQ ID NO: 36632 - DNA, 379 bp, Zea mays
  Clone ID: LIB3060-041-Q1-K1-A4
cggacgcgtgggcgtcgccagcacgtgcgtcgacgccgcgaagctcgccggcttcgggctcgccacctcggcgctcctcgtctcgggcgcgagcgcggagggcacgcccaacaggctgacctacgacgagatccagagcaaaacgtacatggaggtgaagggcacgggcacggcgaaccactgcccgaccatcgacggcggcgtggagtcgttcccgagcaaggccggcaagtaccacatgaagaagctgtgcctggagcccacgtccttgaccggcaaggcagatggcatcgtcaagaacgccccgcccgagttccagaagaccaagctcatgacccgcctcacgtacacgctggacgagatcgagggcccgctcgag

SEQ ID NO: 36633 - DNA, 297 bp, Zea mays
  Clone ID: LIB3060-041-Q1-K1-A5
gcgcgggttgcgagttgcaggccgcatgagctcgcgctctgcaaaccttcagggccggcgaggcggtcgtcgttcacaccggcggttgccactgccggcgcttgcggtggcaggtcgaggcccccgcgagcgtagtggcgtggatctgcaactgctccgactgttccatgcgcgcgaacacccacttcatcgtccccgtcgtcaagttcaagcttgcagccggcgctgacgagttcatcaccacctacaccttcggcacgcacacggccaatcacaccttttgcaagacctgcggca

SEQ ID NO: 36634 - DNA, 401 bp, Zea mays
  Clone ID: LIB3060-041-Q1-K1-A7
caccactcttggcgaagcgaaatccaccgtacaccgctgcctccctctccctgtctcgtctcgtcgaaccagccgaggaagccaacgcagacccagcgatcctcgtcgcgcgtcctcctcccccacggagggaaggatggcggagcccaaagcggcggcggcggcgaggaagacgcgggtgggcccgtacgaggtcggcaagaccatcggcgagggcagcttcgccaaggtcaagcacgcgcgcgactcccgcaccggcgccgtccgcgccatcaaggtgctagaccgaacccacgttctgcgccacaggatggtcgagcatatcaagcgggagatttcgactatgaagctgatcaaacatcccaatgtggtacagctgcatgagggtattgcgagcaaaa

SEQ ID NO: 36635 - DNA, 446 bp, Zea mays
  Clone ID: LIB3060-040-Q1-K1-E5
cgacgagcagagggccccccttagctttcggagcaatggcggcgggatacgtggcgtatgacaactagcggactacctttttaatgttgttctttatctgctactccggctgtctcatgttcaatctgctctcacgcttcacgcgcaactagttcatcctttagtccaagtccaccatcatcgtttagttttccaccctctttctccagtttttctgcattttatataagtttcttattttttatctttctttttcttttatctatatttttctaattttttattttatattttttaggtgttttttttatttatttatattttttttttatatttatatattttattttctattatatttatattattttttttattttttttctcttatattattttttatgttatattattttattttattttattttatatttttatttttt

SEQ ID NO: 36636 - DNA, 365 bp, Zea mays
  Clone ID: LIB3060-040-Q1-K1-A3
cggaattcccgctggacgcacgcatccgcagtacgacgtctctcctctgggtctttggcctagacaccgagcacgtactaccatgaggagtgtgacgtctcggagagtcaagcccatcgaggagtgctgctcggaggggcggtcggagcatacggtggccgacgacctggacggcacgctgctcattttcaggagcgcttttctctactaccttcttgtggctctttagtgcctcagctttcttttctccgtgcttttgctactgtctttgctctgttgttttttgttattatatttttcttatttcttattatttttttttttttttgttttttatttttttattttttttttttttatttttt

SEQ ID NO: 36637 - DNA, 193 bp, Zea mays
  Clone ID: LIB3060-040-Q1-K1-B11
gagatctatgctacagacattatgcattgggttctaattgtaatgtgggggcgggcaatatcttctgggctatgcacaagaccgacttcttctcggacaaattcggagttaggtctatcagggacagcgagcatgatatgatgtccgccctgtacctacaagtcagtatcgtgagccatgctctaatctttat

SEQ ID NO: 36638 - DNA, 161 bp, Zea mays
  Clone ID: LIB3060-040-Q1-K1-B2
tcccggccgccgcggcaagactctctgaattgtgggtctccggcgatggcttctctagctccatccaagattctgggcacgaaggtttacaatcgccggctcgtcccgctactccacggcagctcccaccgccttgtctcataatatcgtctccctcttct

SEQ ID NO: 36639 - DNA, 469 bp, Zea mays
  unsure at all n locations
  Clone ID: LIB3060-040-Q1-K1-B4
ccactcatcctgaccatatatttgttttctacagtgtttanttttgtcctgacgtcctnggaataccgtctgttttaaattttggttgtccttaccttactttatttctttttttattttcttttttcttttcctattttttctcttttttattttttttatttttttttttttttttatttatttatttaaattttctttttttttttttttttttttttatttttttttcttatttttattatttatttatttttttttttttttttttctttttatttttttttatttttatttatttttttttttttttttctattctttatttttttatttttttttatttttatttatttattttatcatttttattttcttttttcttttttttttttttatattttttttttctattttttttttttttttatttcatttttttatatttatattttttttttattttatt

SEQ ID NO: 36640 - DNA, 77 bp, Zea mays
  unsure at all n locations
  Clone ID: LIB3060-040-Q1-K1-B6
attcccacagcgaacataaaccaatccattttatatatacatacgatttctttcngctaaacaacttattataaatg

SEQ ID NO: 36641 - DNA, 277 bp, Zea mays
  Clone ID: LIB3060-040-Q1-K1-B8
ccttcattattattcaagtcgtttaattttataccatcaaatgatccactcatgaaggtttaaaacatatggttcccaaaccaatccaacctttttattatttttattattatttatttttatttttatatcttttattatttatttttaattattttttttttttcatttttttattatattaattttttttttttttttttttctatttttctatttttttatcttattttattttatatttataatattatttattctttttttattatttttt

SEQ ID NO: 36642 - DNA, 336 bp, Zea mays
  Clone ID: LIB3060-040-Q1-K1-B9
gctgcgccattctcagccgccgccaatcccttcccgtgctccgcaacctctgagttagaagaagagatgtccggcaagggcgatgggccggctatcaggcatcgagctcggcacgacgtactcttgcgtcggcgtgtggcagcaccaccgtttctagatcattgccaactaccagcataaccgaatctcgctttcgtactaccctgagaattactactagcgtgcattcggatattcatgcggaagacctatagatgttacttgaagcctacttcatgcagatgcatggcatttgattcacaattgggtcagtttggctctatatggatgacacat

SEQ ID NO: 36643 - DNA, 60 bp, Zea mays
  Clone ID: LIB3060-040-Q1-K1-C10
gaataatatccaccggcgacgggaacgggagtctgctttgccggagattcgaagcgattg

SEQ ID NO: 36644 - DNA, 461 bp, Zea mays
  Clone ID: LIB3060-040-Q1-K1-C3
tcccgctcgacccacgcatccgggcaccaccacacgttcacggtagcttttagcttatcgtcgtcggcggctaagatgggatcgcttaaactgcagaatcggctggcctttatctttctcaattttgatattgttttattctttctttacctttttttaatcattttttcttcatttttttattttttctttactttttcatttttttttttttttttttttttttattttttctttttttttttttttttatttttttttctattttttcttttttttttttatttttttatattttttttattttttttatattattgtattttttatttattttttactttttatttttttttttttatcttatttttattttttttttttatcttttttttcttttttttatttaattttttttttattttttattttttatttcttaatttttttttttttttttt

SEQ ID NO: 36645 - DNA, 394 bp, Zea mays
  unsure at all n locations
  Clone ID: LIB3060-040-Q1-K1-C5
ccgactccctcgctcaccagatgtaacttgcggaccaggcaaagccgagccggagcncgaccactaagatcttgcgtgggctccttaacccagctcgtcactgtaccgctcgtgccctacactctcggtccgactaaccaataattcatccatccatctatttatcatctctctttttttatttatttacttactctcttattttttttttttattttttattttcttttatttaatttttttttttattttatttttttatttatttttctttttttattttatttttttttttttatttcttttttatttttttttttattttttttatttttttattttttttttttatttttttttttattttatttttttctttttatattttttttat

SEQ ID NO: 36646 - DNA, 385 bp, Zea mays
  Clone ID: LIB3060-040-Q1-K1-D11
aaagaactatgagcacatacgtttgcatttactgccatatataatgatggcgatggatagggtaaaaatcttccccaggcctttaaattcactgtttcaaacccattttttattcttacaatcgttagatcttttattgacagcacctattctaaagcttcaatacataaccacacagaatctaaccctcacatgaatccacttgatattgatccagaccaacaacggaccactacaagactggaagcagatcaacatccattaacactgaattctgacatatggaatctctataaacaacctattcatatcagaacatattgaagaatatacaattaccttaatcatctactaacatcatcttatgaaactggacaaacaaaat

SEQ ID NO: 36647 - DNA, 346 bp, Zea mays
  Clone ID: LIB3060-040-Q1-K1-D3
acaaccaaaaaaaaaacaacattaaaaaaaaaaaaaaaaaaaacaaaaaaaaaaaaacaaaataataaacaaaaaaaaaaaaaaaaaaaaaaaaaaaacaaaaaacaaaaaaataaaacacaaaaaaaacaaaaaaattaaaacacaaaaaataaaaacaaacattaacacaaaaaaacaaaaaaaatataacaaaaacaaattaaacaaataaaaaaataaaacaaaataaaaataaaacaaaacacatataaaaacaaaaaaaaaataaaataaaacaaaaaaaaaacaaaaaaaaaaactaaaaaaaaaaaaaaacaaaaaaacaaaataaaaaaaaataaaa

SEQ ID NO: 36648 - DNA, 444 bp, Zea mays
  Clone ID: LIB3060-040-Q1-K1-D4
cgccatggcctccctctcctctgccgtcgttaccgccccttccttcgccgcaccatgtccgtctccgcaccgtggtcagaaggaggtccttcaccgtgcgcgcctctctccgcaaggccacctgcaccgtcgtcttgtcaatggctgccagctctccttttttttttctgttttttttttctatgatgtttttttttttttattttttatattttttttttttttttttattatcttatttttattttttttttttttttttttatttattttttcttattttattttttttgtttttgtttttttttatctctttcaaatttattttttttttttttttatttttttattttattttatttttttttttttttattttttatttttttttttttttttttttttttattttttttttttttttattttttttttatatttttt

SEQ ID NO: 36649 - DNA, 125 bp, Zea mays
  Clone ID: LIB3060-040-Q1-K1-D7
aaaaaacaacagacaaaaaaaaacaaaggaacaaaaaaaaaaaaaaataaaataaaaacaaaaaaaaaaaaaaaaaagaaagaaaaaaaaaaatgtataacacccaaccaataaatacatcaacc

SEQ ID NO: 36650 - DNA, 431 bp, Zea mays
  Clone ID: LIB3060-040-Q1-K1-A11
atgaaatagaacattttctacttgataatgaagacatggaacatctgggtctagcaaggaagcaagtacagaaccaacacgttgaggctttaatgtcatctgctgcttccaacagcattgttcttgccggaacaggtgtgcccaggctgaactctagcttccggcgtagcctgagcattgctactagcatgcatttggataatgatgtggaggacctatagatgttacttgaggcctacttcatgcagctggatggaattcgcaacagaattttgtcggttcgggagtatattgatgacacataagactacgtcaacattcaactcgacaaccagcgtaacgaactcattcaacttcagcttacacttacgattgcatcctttggcatagctgccaacactttcattgcttgaacttttgctattaacatt

SEQ ID NO: 36651 - DNA, 294 bp, Zea mays
  Clone ID: LIB3060-040-Q1-K1-D9
acgggaagtgcctggacaggctaaggcagctggtttaaggtttactggaggggcatctccaaacactgttaccgttctaatactgcgacagcaagttacatgcataccccataattactgtattaatctaaccttcctaagaatgtacatacgctggagctcttttaaagatccaaaacttttaaactgtgttgttctctctccattgaatacacttgatattgttggagaggtcaaacaacccattatcttcctttttttaaagcactatgaactaatcaaactctaactcat

SEQ ID NO: 36652 - DNA, 461 bp, Zea mays
  Clone ID: LIB3060-040-Q1-K1-E2
gcgcattcaccgacaccgccaattccataccttcctccgccacctctgctgagagcggcaagttatatacactcaggggtgatggtccatcaatcttcatcgatctcgtcacgacttactctcgcttcttcttttttcatcacttaccgtgtctatatttttttttttttctattttttttaattttatattttttttactttttctttattttatttatttcattttattttttttttattttatatatttttttcttatttttattattttttttttttttattattatatctttatttttttttttatttttatatatatttttaattatttttttattttttttttattttttttttatatatttttatttttttctttttatttttacaatttattttattttttctcttctttttattattttttttattttttatattttctttcttttttttt

SEQ ID NO: 36653 - DNA, 180 bp, Zea mays
  Clone ID: LIB3060-039-Q1-K1-G10
tcccgcctcgacccacttcttcctctcttccctctccgttcgccaaccactttattcacccactaccgctcccactcccttagactttattcaaaactttggtggcctatcacctccccctcactctgctactctcctcgttcctctcctcctcgtctactctcccacacatctatccta

SEQ ID NO: 36654 - DNA, 216 bp, Zea mays
  Clone ID: LIB3060-039-Q1-K1-G11
ttatcttgccatgtcaaagttcaattaaaccctcaacgattttcatcataagaagattttctaaccaaatgatccacattctacaataaagttcaaagatttctaaaaatctatccaaaacatccttttttaataaacaatatcttctatatattattataatctctccctatcaaactctatacactaccatattattataaattatccacatta

SEQ ID NO: 36655 - DNA, 185 bp, Zea mays
  Clone ID: LIB3060-039-Q1-K1-G4
ctactgctcctctgttccctacaccttctccaccgtccactgttccagccatgttcttcgattccgactaggcttattaccacacaaccctattagtctccctcaaatcgtgttaacaggcgtatcttcttagattaattggctccaattcttcatattcaccaatttatcccttctctataatc

SEQ ID NO: 36656 - DNA, 396 bp, Zea mays
  Clone ID: LIB3060-039-Q1-K1-G5
aattccctcggtacgccactcttccttcgtcatcttgcaagttgcatcctattttaatcgatcgtgatctccacatttcgacagtttttctttataaactagctacactaaaaattctaggattcaagagaaaactatgtttcagatcaatcctgtccttgatgaggccacaagatcagtatacacatctctccaccctcaaaccatggttgttgctgacttatgctgctcatctgttcctaacacattactcttcgtatcctaggtgattgtcatcatatctcgccatttcaaataacatgtcctacaacattaccactcacatcttcaattcttcctgaatgaccttcccttaaactacttcaacaatctctttcagcttatccatcatttcaa

SEQ ID NO: 36657 - DNA, 172 bp, Zea mays
  Clone ID: LIB3060-039-Q1-K1-H2
atattactccaatattcccattgttgttccaaaactaccttacctcattcccttacattaataatctacttcattttacttatacaatgctatctatctagaaatgacactttttttacatcaatatattcctttctatatcacaaatcatattacacatcttatactatat

SEQ ID NO: 36658 - DNA, 239 bp, Zea mays
  Clone ID: LIB3060-039-Q1-K1-H3
cctccgctcctctctccttctcctcgtcttctcctgtacaggtaccccttttcccttttgctgtccttcttactaccttctggggtccccgttccgttcttgcctcccgtggaatggtttgctcgtatgatcctggttctcgatcgactgcttatccgttggctgcgatgctcccgcggatcttgcttctctactgctctggattcctgatcggttgcttatcactgatcgtagtctgt

SEQ ID NO: 36659 - DNA, 221 bp, Zea mays
  Clone ID: LIB3060-039-Q1-K1-H7
cccactcatcctaagacaaaaaacaaacccaaaaacaaattaaaaaaaaaaaaaaaaaaaaaaataaaagaattttttaaaaaactcaaaagcccccaaacttacctacccatccatcctacatcatacctctacaataacaccacctaaaataaatccacaacccacaaaacaacaactacataactaaaaaaccccttactaaacccaacttaaacaca

SEQ ID NO: 36660 - DNA, 306 bp, Zea mays
  Clone ID: LIB3060-039-Q1-K1-F6
attcccgtgctctacccactcttcctaggaagaacatccaaataaaccctaatttccttatcatccatcaatatcaatctctgatcttttttcaaaattgtatgtccctaacaagcataaaatcaagcaccatcgcttaccacgctcacaatactctacctaacatagccataacattctagctaatacatcaccaatatcaaaatatttccatactcatcttaaaacactaacaataactcaaaaaactcccatatatcacaacaccatctatgtatacccatatcatcttcttaactttacttt

SEQ ID NO: 36661 - DNA, 334 bp, Zea mays
  Clone ID: LIB3060-039-Q1-K1-H8
gttcaagcccaacccgcggtctcacgtgcaggagtactgtctcgtggtcagctttctttctcacctggccgagagcctgcacaccttcttcttcctcttcgactacttggtcgtgccgtccgactaccgccacatggaagggttcggcgtgaacacgtacacgttcgtgagctctgctgtgaaggctcattacttcaagttccactggaatctctacttctgtattcggttcatcctgactttctatttttcttttcttttttcttattcttttctctcttttttttttctcttttattttttctatttttatttatctttttatttttttttt

SEQ ID NO: 36662 - DNA, 369 bp, Zea mays
  Clone ID: LIB3060-006-Q1-K1-E7
gaaaagaattctatatagaatgggttgggaattatgcctagatcccgtataaatggaaatttcattgataagaccttctcgattgtagccaatattttattgcaaataattccgacaacctccggggaaaaaagggcatttacttattatagagatggtgcgatttgactctttttttttttagccctacctatatctcattcttacgagaaagagagagggttcgcatagagagaacaaaattagtaaaggaaacccgcgcttggggaaggtgaggtgaactaacaattccttctgtagtgtatcctcgattgatgtggcctaagatgcttcaattgtagatttgagtattgagcgaatggtttcacc

SEQ ID NO: 36663 - DNA, 394 bp, Zea mays
  Clone ID: LIB3060-006-Q1-K1-E8
ccgcctccgccgacaccgactgcctacctcagctgccgtcgccatgggcagaaggcctgctagatgctatcgccagatcaagaacaagccgtaccctaagtccaggtactgccgtggtgtccctgaccccaagatcaggatctacgatgtcgggatgaagaggaagggtgttgatgagttcccctactgtgtgcaccttgtctcttgggagaaggagaatgtctccagtgaggcgctcgaggctgcccgcattgcctgcaacaagtacatgaccaagtctgcaggaaaggatgccttccaccttagggtccgggttcacccgttccatgtccttcgtatcaacaagatgcttttctgtgccggggctgataggctccagactggaatgaagggt

SEQ ID NO: 36664 - DNA, 236 bp, Zea mays
  Clone ID: LIB3060-006-Q1-K1-E9
ctgccgccggttccctcgtatgggaggttcgcggttcaaattgaagcgctcgcgcactgatgtccgcgtggggctttcccgccggaaacccaatgaattcaaggcggccttctaactacccgtggcactttccgccgtcgtcggtgccggggcgggctgggactctgagggcaacgtattgaagaactactccttgttctgggtggtggcctacccaaacctacttggtgctgcac

SEQ ID NO: 36665 - DNA, 428 bp, Zea mays
  Clone ID: LIB3060-006-Q1-K1-F10
gttggccttacagcgtgctaaacttatgccagattcagctcttacatcctcaaaggaaaagaaactcacaggacggcagtattttgaaagtggaaggcatgcagtgaaaggagcaagcacagttgctgatgaagatgaagaaaaggaggaggatattgaattcgatgatgattttgaagacgatgaacaggacatgcttgagcattatctagctcaacaatcagagaactcagcagcttaaccttctaggccaaacaaagtaccttttcgggcgcagctttaccttaggaagccaaatgttgttatatgttgcaactgtagctctagtgcgcactattttttttttatgtctctcatcatttggttgtatttgtggatgctttctagttttatcaagggggcttggggttctcattaatatatacgct

SEQ ID NO: 36666 - DNA, 426 bp, Zea mays
  Clone ID: LIB3060-006-Q1-K1-F12
gaagagtgcaatggatataatgtgtgtttcaaccaacggggatactgcgattacacaggcatgatgtcatacaactttaagttaaaccagctgcgtagctattttagtgtatgaatcatctaccttgttcatacatctttagtgaatagagtgtatctgttgcccttatcgatagatgaattaacaagaagccccttcgggagttggagagtctctacgagattttggtgtttcagtggagctgtggcgactacttcaagatgtggcatataccgttacacccaattacctgtagccatgcacggatgttagaggacaaccatggtttgaggtatgtatgcatattacagaacgtgctagaagccatggtggtcacattggatgtttcatgctgaaggaattaactgcttggaaggtgctcaagta

SEQ ID NO: 36667 - DNA, 303 bp, Zea mays
  Clone ID: LIB3060-006-Q1-K1-F4
ccggcgttccaccgcttaatttgcaggaccgccaccccccgcggcgcctacgatcacctcaggcgtgcgcggatatggggcgccgcggctcctccgaccgcctcgaggcgctctccctcgagatcgagcgcaagctgcacaaggccctgatgtccaactcacagcgtcttcagatacttcagcaattgtttgctgacatcgcattgaaagtggatgaccgcgctcgagatgcaattatgagtgagaatgatgatggcattgctccagcagatgaacgggaagatgggtggctatgcttctatg

SEQ ID NO: 36668 - DNA, 536 bp, Zea mays
  unsure at all n locations
  Clone ID: LIB3060-006-Q1-K1-F5
tcgcagtcgactcagtcgagtcgagagccagcactactactgcacgtcagctaangctaggagcccagcagtcagtncggcgggcgaatgggcggctctcccaatgatccctcctcgtnncagctcttggnncggtggcngcnnctcaggnnngcctgctcgccnnncctcggctnnngccgtcgcctccnnntccttcgctcgnntcgtctggctccccaagaagaaagaatcaagtacccgtnacaagccctaccgggnnattgggggggtggcctgactcgtcngtnacgtcgactgccaacctgggagaaaggggcaanggggcatagggggcgtgtacccagtnnntcgtcgaccaaagtacgntngcgctaacccgtcgaccgggatacccagctccaatcttaccaaccgagtgatgaaactggggtctccctaaccggcgaaacgtctaccgtnncggtgganacccactnnngggcttctgggatccctgggcccccgtcacccttncgcttgggaatcccctcggc

SEQ ID NO: 36669 - DNA, 428 bp, Zea mays
  Clone ID: LIB3060-006-Q1-K1-F7
gacacgaggaactcatcattaatccactaattgctgctgcttccgttattgctgctggattggccgtagggcttgcttctattgggcccggagttggtcaaggtactgctgcaggacaagctgtagaaggtattgcgagacagccagaagcagaaggtaaaataagaggtactttattgcttagtctagcttttatggaagctttaacaatttatggactggttgtggcactagcgcttttatttgcgaacccttttgtttaatcctaaaaaagaaaatgagtcctttagattagatacttttttctttttttagtacattggcatttgcttatgtaattctaagtatatcaatactttactttactactatttattatattatttcttttttatattattccggaaattttgtatctatcgggacag

SEQ ID NO: 36670 - DNA, 62 bp, Zea mays
  Clone ID: LIB3060-006-Q1-K1-F8
gtctccttcaccgttcgtccattccttcgatccgcaggaggattaggaacttaggatcgggg

SEQ ID NO: 36671 - DNA, 271 bp, Zea mays
  Clone ID: LIB3060-006-Q1-K1-G1
accacgcgttcgcgtttagcaaaagggtttaaactcaactctcaagcaccttcaagaagggatcgagcgagcgagcagtgtccggcccccatggccatggtcgcgtacacctccttcgcgtaccacaagccgcgtatcgtggaggtgtgcatgaagaacagggtctgccgggacagggagcgggacggtatggagcacaagcacccccttaaggtctttgagatcacgccgtctcctaggtgccttagtgttcgctgctttctcaccaaca

SEQ ID NO: 36672 - DNA, 171 bp, Zea mays
  Clone ID: LIB3060-006-Q1-K1-G10
atggcccttccctcatcgccccgcggctttgaatctggaggtcatgcccaagcccaagcgagcgggtgctggaggcgcatcatagggaggaggccatggagatgagcgacctggacctgtggaagcacgagaagccgtcaaggatctgccctttgcccccgtttctcccgt

SEQ ID NO: 36673 - DNA, 190 bp, Zea mays
  Clone ID: LIB3060-006-Q1-K1-G3
aggagggggcgtcgatgtggcacgaggcgctattgctggagctgaaggtccacgtgctcatggacgcggttccgcttaggacgcagcttcgtatgcgtatacctgaccaggagccgacgatacccttaacattctatgaactgctccggatctcagtggatggtagacctgatcatcttcctgtattata

SEQ ID NO: 36674 - DNA, 228 bp, Zea mays
  Clone ID: LIB3060-006-Q1-K1-E6
ggattcggagaggaccctccttcctttcgcttggttattttaacgtcccatgggtgactcgcattgctctgattctgatcacaatttggtggggagtaggtgagatagtgagattgagcttcttgaagaaaatgttgttcttcagcttaacatggcatatgaacatatgtgacgtgtacatactttataacctaaggtttgtagatccagggatcttatttgcgttcg

SEQ ID NO: 36675 - DNA, 414 bp, Zea mays
  Clone ID: LIB3060-006-Q1-K1-C9
gcgctttgcaacgcctccgctgtaatctgcccccgcggcgagattgccctgggcctgagtgctagttctcgccgttacgtaaggcttcttggccttgcgtcctccgtctttcgttgctgatacatcgaggtattaaagaagctgcctggttccgggcagcagatgtcgccgccgtctgcaacaatggccgacttctcctggctcacggtgcttggcttcctattgcttaccttcaactcaggcatggcgatttatcggtccgacggtgactcctgctccgtcggtttcgtcgtggtatcttatctagacctggtggacctgttcgcctgcctgcgctactacgaacagatggatcatcagtactcccaaaagcgctcgtaggtcaaggctggtagtttggaaccttacgaccct

SEQ ID NO: 36676 - DNA, 311 bp, Zea mays
  Clone ID: LIB3060-006-Q1-K1-D1
cccacgcgttcgaatggctgcaatacctgcagcgatcccgggctgctgctcttcgtctcgcctgcctcagcttgctggcctccctgccttcacaagcagaaggcgcttcaaggtcacggccatggcgcccaaaaagaaggtgaaccgctacgacgagagctggtcgaagcagtggttcggcgcgggcatcttcgcggagggcagcgaggaggtgtccgtggacgtgttcaagaagctggagcggcgcaaggtgctgagcaccgtggagaaggccggcctgctgttcaaagccgaggagctgggcctgacgc

SEQ ID NO: 36677 - DNA, 407 bp, Zea mays
  Clone ID: LIB3060-006-Q1-K1-D11
cttcgcttgaacacatacgtggcgaatgtaacataccgagaacactatcttcggtgtcgaaaggctttatgctcaatgcaaggaatagggaaatgttgaagacttgtgcaataagaaagaaagagaaaaggcaatgttgcccctgtagtacttaagattcatatgtgcaagcttcatgggcattcttgtaatttcatacataggtatatctcgcccctataaatagagaaacagttctatgcataaattcaccttttccagggttaacaacttcatttaactcagtattcgaagtaccttcgcgctgtttcttgtgtcaagacgaaggctgatgcaccactggctaacacatccatatacgtagagtatatccatagggcgatgcatggaagtgacacgggtgcata

SEQ ID NO: 36678 - DNA, 252 bp, Zea mays
  Clone ID: LIB3060-006-Q1-K1-D12
gttagcttgaacacattcgtggcgaatttcataccgagaacactagcttacgtgtcggaaggctttatgcacaatgcacggaagagggaaatgttgaagacttgtgctataagaaagaaagagaaaaagcaatgttacccctgtagtactcaagactcatatgggcaagcttcatgggcattctcgtcattgcatacaaagctatatctcgcccctataaatcgagaatcagtactatgcataaattcacct

SEQ ID NO: 36679 - DNA, 382 bp, Zea mays
  Clone ID: LIB3060-006-Q1-K1-D2
cccacgcgttcgaatggctgcaatacctgcagcgatcccgggctgctgctcttcgtctcgcctgcctcagcttgctggcctccctgcctccacaagcagaaggcgcttcaaggtcacggccatggcgcccaaaaagaaggtgaaccgctacgacgagagctggtcgaagcagtggttcggcgcgggcatcttcgcggagggcagcgaggaggtgtccgtggacgtgttcaagaagctggagcggcgcaaggtgctgagcaccgtggagaaagccggcctgctgtccaaggcctaagagctgggcctgacgctcttctcgctggagaaactgggcccgctcttcaaggccgaagacctgggcctgctcagactcttcgagacc

SEQ ID NO: 36680 - DNA, 433 bp, Zea mays
  Clone ID: LIB3060-006-Q1-K1-D5
cagaaatgcacacaatcactttgacgtttcacgggcgctgcacacagacacaccaagcgtctgcaccaatggcttactaccaggaggtggactactgctcggaggaggtgaggtcggtggccccggccggcttcggtcgtcacggaagctgcgtgcatcagcacgtcgtcaaggagaagatcgaggaggtcgacacggtctgacgcgctggctccaaccaccaccaccaccaccatggtcaccacggcggccacggcttcgtggtgcgcgagaccagggtcgaggaggacattaacacctgcaccggcgaggttcacgagcgcaaggagagctatctcgacagggctaactgagccgcccggctgtcggcatccacgctcgttcgtgcctgcctgcgtgccttatgtatgtctgtagttgactggttgtgcaa

SEQ ID NO: 36681 - DNA, 228 bp, Zea mays
  Clone ID: LIB3060-006-Q1-K1-D6
ctggaccgaatcgtttgccgtgcgtgctctagggaacactaacacgccatgaaaaaactggcagagctcatgctcatcctaggtggagctttgcgcgtgtgccatgtgttgctggtggtgctgctgccgctgcctggagtgcatccataacatcgtccctcccctcagcagccttcccttcctccgcttctccggcccagctctaccaggtggaggtggaggtggagc

SEQ ID NO: 36682 - DNA, 459 bp, Zea mays
  Clone ID: LIB3060-006-Q1-K1-D7
tcgatcttaaactcaatccattttatatatactatactgacatggccaacgtgttaaacaacgttattgagaaatgcaagtacagctcaatacgtaaatgcttagaaaatcggctcgtcgcttaagggtatgtctctcagtcgtcgaggaacatgtgctagggtgtatacctatcaactcccaaaaaacccaactctgccttacgtaaagttgccagagtacgattaacctctggatttgaaatcactgcttatatacctggtattggccataatttacaagaacattctgtagtattagtaagaggaggaagggttaaggatttacccggtgtgagatatcgcattattcgaggaaccctagatgctgtcgcagtaaagaatcgtcaacaagggcgttctaaatatggggccaaaaagccaaaaaaataagtgattcgtttttagcccttataaaaag

SEQ ID NO: 36683 - DNA, 414 bp, Zea mays
  Clone ID: LIB3060-006-Q1-K1-E10
ctcctcctactcctccgcccctggtagtttcggcaatcagcttggtgccgacggcttacaacagcagcagatgcagctggatgcaccacacgattcacaaaatcaacagcagcagcaacagcaaatgccaatgacatataatcagcagcatatgatgccacaaactcagcagcagcagcagcctgcagtgaagctggagaatggaggcgtcctgggtggggtcaaactggagcagcagatggggcagccggatcagagtgtttccacacagatgcaacgcagttcgagtggcggtgtgaagcttgagccgcagttgcaagcgctgaggagcttgggtgctgtcaagatggagcaccaaagctccgatccatctgtggtcctgcagcaacagcagcatcaacagcaacgacatat

SEQ ID NO: 36684 - DNA, 422 bp, Zea mays
  Clone ID: LIB3060-006-Q1-K1-E11
gtcaaggttttgcatatggacagaaacttctactatggaagagattccacctagatcgagcttaatcagctctggaagaggtgtagaggggaagacaagccctcatgacatctagatgcaagcagagactacaatgtggacatggtgccaaagtttatgatggcacatgggacattggttcgagaccctcattcacactgatgtgacaaagtacttgtcattcaaagctgatgatgggagctatgttttcagcaaagggaagatttacaagggtcctgccactgatatggaggcgtctgaaatcccctttgatgggtctattcctgaagcgcatagcaaggaacttcttcatttatgtccaagattacaatgaagctgatccaaggacacatcaacgtatagaccttactagggggacaact

SEQ ID NO: 36685 - DNA, 407 bp, Zea mays
  Clone ID: LIB3060-006-Q1-K1-E12
ggctgggactttttggtcaccaagaagtccaacccggcctccatcaaagcccacaaccgtcgtaatcgctacttcccctccgatcgtcgtcgacgacgcattcaccccaacccttctccgcgaaatagccgtcgccgcagctccggctatgtcaatcttcgagtacaacgggtccgccgtggtggcgatggtggggaagaactgcttcgcgattgccagcgaccggcggctcggcgtgcagcttcagaccatcgcaacagacttccagcgggtgttcaagatccacgacaagctctacatcggcctctcagggctcgccaccgacgcccagacgctgtaccagcggttggtcttcaggcacaagctgtatcagctgcgcgaggagagggacatgaagcccgagacat

SEQ ID NO: 36686 - DNA, 415 bp, Zea mays
  Clone ID: LIB3060-006-Q1-K1-C8
gttcctaccttcctccccgtcctatcctctccctcgccatcctcgtctccgcctccgccgctccccctcggtccccgccccacctcccgttctctccctccttggatagggttagagactgagttcacccgcacgcgcgcgagccatggtctccttcacctgttcccaggtcggcgcgacggcagcgggcggagcctcgcccttcatcggctaccggtggcggagcggccccgggggagccactccgtcgagctccctcttcgttggccggcggctggcagcggtgcagatgcgcgcgccatctcgcggggcccgcgggggctccgcgctgcgggtcacgtgcgagaaggtggtggggatcgacctgggcaccaccaactccgcggtcgccgccatggagggcggcaagccgacc

SEQ ID NO: 36687 - DNA, 423 bp, Zea mays
  Clone ID: LIB3060-006-Q1-K1-A8
gcactcgaatccatccatccatcgatcgccttcctctctttttatatcgcacccccccgcttccgctcgctcgatcgtcggagtaggcgggcggcatgctgcaggccagctcggagaggccggcgggcctgctgtgggtgcccgggacgagcccgtggccgacgatggacgcggggccgtcggcgagggcgcaggagatcgcgcggcggcgggaggagatgctggggatgctgcgcgacctcccggagtccgagtacgagctctcgctcaccgacctcgtcgagaaggccggggccgaagccgaagccgaagccgaagccgcgcccgcgaccgtccccaccaaggcagaggacgggaaggacccgggcgccgcgcggtcggcggcagctgcggtgaggcacgagcggagggcgtcagcgcggc

SEQ ID NO: 36688 - DNA, 341 bp, Zea mays
  Clone ID: LIB3060-006-Q1-K1-A9
atcgctcatcaatcgccagaggtagtagttgatcgaggtgagtgaagttgaaaagcacaccatcgccatggacggcggatactacggcggtcgcgatcagcgctacagcggcgggtactacggcggcggtggcatcgcaacgccggggtacgctccggcggtcccggacgggatgtcgcaggtgaacatcgaaggcaacgggtgcaggcggtcgctgcctccgcagccgaccgtgaaggtgtactgccgcgccaaccccaactactccatgagcgtccgctacaggaaggtcgtgctgtgcccggagaaccccatggacgagtactatttactggatcaag

SEQ ID NO: 36689 - DNA, 366 bp, Zea mays
  Clone ID: LIB3060-006-Q1-K1-B2
agctttgccctcgtgcgagactctggttctcaatgtctgaaggtcgaggcgtgaaagaaaaactccggaggtcgaaatggctgcgggcgtgccgcgagcccaggagctggcggagagggagatgggcggccgacatggacttcacgacggcgcgcacgcactacatgtacggctgactcggcctttgctcgccgacccagagggccatgacgactccgcccatctcacgaccttcgactcggcgctcatcagacaaatttctgcactagcatccctcgatcgttggatagggacctaccatggtggagacggttgaccgagaagtaggattcgattacggccagatagcctgagtaacggctacca

SEQ ID NO: 36690 - DNA, 150 bp, Zea mays
  Clone ID: LIB3060-006-Q1-K1-B3
agctttgccctagtgcgagactctggttctcaatttctgaaggtcgaggcgtgaaagagaaactgcggaggtcgaaatggcggcggccgtgcggcgagcggaggagctggcggagagggagacgggcggccgccatggcatccatggcgc

SEQ ID NO: 36691 - DNA, 391 bp, Zea mays
  Clone ID: LIB3060-006-Q1-K1-B4
gactatcacacacgcagaagaatcgagttcgttcgatcgtgaccgtgacgcatgaagctataagctagccaagacaggaataataatggcggagtcgacggtggcgagcctttctgtcccggtgacgacgacgaccttcgcgggggcgggcggcggcgacgtgctgatcggcgttccgaggagggcgggcgccaagcgcgtcgtctggttccccgcgggggcgcgccgcggcggcgggcggttggtcgccgtgcggtccagcgggccggccacgccgtcggagatcttcgacaaggtgtcggagagcatcaagcaagcggaggagacgtgcgcggacgaccagaaaggcgacgccgagtgcgcggcggtgtgggaagaggtggaggagctt

SEQ ID NO: 36692 - DNA, 410 bp, Zea mays
  Clone ID: LIB3060-006-Q1-K1-B5
cacagctcccacgctcaccgtcgccacatcttgtgcgcgcgcaatggcactcgtgtccgcctcctcgtcctccaccaccgccgtcgcggcgctccccaggaatgggcagcagcgggcgtcgtcgtcgttgttctcctcctgctgctcttcctccttcctcgtcggcaagacgctgctgaggcaggccgaggcagcccggccgtcgttcgccgtgcgcgccgcggcggattccgacaggccgatctggttccccggcagcacccctccgtcgtggctcgacggcagcctttccggcgacttcggctttgatccctggggcctcggatctgacccggagagcctgcggtggaacgtgcatgcggagctggtgcactgccggtgggcgatgctcggcgcggcgggtatcttca

SEQ ID NO: 36693 - DNA, 425 bp, Zea mays
  Clone ID: LIB3060-006-Q1-K1-B6
cgaagaaacagataataactcgttgactaggatggcagttcgaactacgtgtttgggtggtaacagggtcccttctccaaccttcttttagattcggtctcatcttcgttcctgccattggttggaggaactgccctatcaccattctcattggaggagagtgttgatgagacatccataacgggcctgtcagcaatctcagttgtagtaagagagccagacagttttgtttcaagagctttcctatgcacatcttggaactggccatctggagcaattccctgtgattgtgaagctgctgagtgataggcaggcccaggcttggagctcaagttttccagaccatcagattgtgaaccacacttgagctgcgtgggagggacgctcgaccggtggctgggcagcggcagtggttgtatccattc

SEQ ID NO: 36694 - DNA, 407 bp, Zea mays
  Clone ID: LIB3060-006-Q1-K1-B7
ctcgaatctcgatcacctccctccggaatgtacggaagacatggcgccgccgctcgtcacagtcgccgatgaggacgggtacgacgcggcgtaggagtcgaagccctgattctgcatgatggccagcgcggtgaagctctggtacgacgccggcggctcgggcagcggcgcgtcgccgtcgaggtactgcaccacctgccgcatcgacggccgcgcggcgggcaccgggtgggagcacagcaggcccagcttcagcaccagctcggcctcgtctgcggggtactcgccgcagagccgcgcgttcgcggcgtcagcgagcgcgcccgtgtgccagagctccagcacccagtccaccagcacgaaccggccgtcgtcgtcgtctccgcggtgttcgcgctcgattggcc

SEQ ID NO: 36695 - DNA, 347 bp, Zea mays
  Clone ID: LIB3060-006-Q1-K1-B9
cccacgcgttcgcacaaacagtcactcctcacctcccccgtcctccggttcatgtcctgctgctccccatgtcgcccccactcgacctcgactacataggcctctcgccggcggcggctgccgccgctgcccacgacgacctgaagggtaccgagctccgtcttggtctgccggggtccggttcgccggaccgccgtgttgcggctgacaccgcaaccaccctggacctgcttccggctaaaggcgccaagcgcggattttctgactaggcgccgacgccatcgcccggtgcacattccgggaagggaaagaaggtaccagaagaggaggacgacaagaaggttgca

SEQ ID NO: 36696 - DNA, 172 bp, Zea mays
  Clone ID: LIB3060-006-Q1-K1-C12
aagctagagagtacagcaactagggagccgcgcagcaccacaggacacgcagcagagcagctggggaggtcggcggaaggacacacgacaagccctgacaagagagacagcctgtcgctcatagggcacggagggagtggcctcgtgcgaggcgtgaccctcgtgcgcagag

SEQ ID NO: 36697 - DNA, 411 bp, Zea mays
  Clone ID: LIB3060-006-Q1-K1-C2
gaattccggctcaccactgcaccactgctcgcttcgtactgctggccgggctgctccagcaccaggaacgctcgctcctgctcgtcgacgttagattttcccagacgcgcgagctccccagcaactccaacacgttgctcgcctcgctcagtcttcaagccatcgtgccgctggttctagccaaagtcgggcgcgttctttccttcgccaggcagcacctccagtcgtcgtttcttttccacggctgcacgctcaccgactcaagcgcttggccatggagctcggtttcgtgtgtgcctgtgctgggtcgccgggtcacatgctcgtccgttttgatgttgtgcacgtttcggcttgtggaactcgccggcgttgtcagctactactagacctcacagtggtactgtgatg

SEQ ID NO: 36698 - DNA, 258 bp, Zea mays
  Clone ID: LIB3060-006-Q1-K1-C3
ccgggctgaccactgcaccactgctcacttcgtactgttgaccgggcttttccatatgcaggaacgctagctcctgatcgtaaacgctagatagtcacagacacgcgagctaaaaagcgactccaacacgggatgcgcttagcgcagtcgaaaatctatcatgccgtttgctctagacaacgaaagacgcgaaatttccttacgcagagttgacctacagctattaaaaatttgggtacggaatgactgttaacatac

SEQ ID NO: 36699 - DNA, 112 bp, Zea mays
  Clone ID: LIB3060-006-Q1-K1-C4
taccctgcccactgctcgcttagacttttggcgagctttgcatcaccaggaacgtcgctctgctggtgaggaagatatcccagacgcgcgagcttcctagcaactccacacg

SEQ ID NO: 36700 - DNA, 97 bp, Zea mays
  Clone ID: LIB3060-006-Q1-K1-C5
ggattctgtacttgtaccattttacgtgggtcctcatgtaaaacacgctatcagaatacttgcatcacaagaggaaagagtagtttagttccgtggg

SEQ ID NO: 36701 - DNA, 288 bp, Zea mays
  Clone ID: LIB3060-006-Q1-K1-C6
ctcctgcccctctgcgctggcgggccgtagcgccgcgagcgagctgggccgtgggcggaggaggagtcgaggctgaccgaccccgtggtcggcggcgacgagcggacgcagattcggcagccgtgcgcggaatgcccgtggaaggaggggagagagggagggcgcatgctcagctgagctgagctgagccctgataggctagctgtctgcggtgctgtagaagaggtttcgtatgcgtgatggtcattggatgttactccaggtacagttcgtacaatgtgcttgggc

SEQ ID NO: 36702 - DNA, 248 bp, Zea mays
  Clone ID: LIB3060-006-Q1-K1-C7
gtctgctcattgatggaaggtttccagtattctggtccagtcagagcagagccttataccatgtgtgcaaactcttgccatccgtcacgagcttgcagatgttgacacttgccggcggggtgtccaggacatgggcattgctttgcactatgagctgcgtgtggcgaaatctgatcgtagccgttttatcgcaaagcgctcaagagaaggtcgccctcggcgtgtgcacattggtacgtgccctggtg

SEQ ID NO: 36703 - DNA, 426 bp, Zea mays
  Clone ID: LIB3060-006-Q1-K1-A5
ctcgggtcaaaccctaagcagggagttgatttatccgctgcagccatgagtaagttgcagtctgagtctgtcaaggatgccatctcccagattgttggggatgccaaggagaagaataggaagttcactgagactgtggaacttcagattggtctgaagaattatgatccacagaaggacaagcgtttcagtggctctgttaagttgccccatatccctcgtcccaagatgaaggtgtgcatgcttggtgatgcccagcatgttgaggaggccgagaagatgggacttgactacatggatgttgaggctctcaagaaaatgaacaagaacaagaagcttgttaagaggcttgccaagaagtaccatgctttcttggcatcagaggccatcatcaagcagattccccgtctccttggtcctggtctc

SEQ ID NO: 36704 - DNA, 353 bp, Zea mays
  Clone ID: LIB3060-039-Q1-K1-D2
tcccatctgtacgccactcttcctctcaccacaatctatctagctacccttttcttaataacagatacaatacatttctcagctgtcttcatacaatttccacaacctctcatctacttcctcacttccttccttcctccaaaaactatcattccatatcatctaatcacatcctaaattatctcaaataccttcataaacaccccaccacatcatacaatacaactacacctaatcattacatatttaattaacaaacaacaattataccaccacataacaatccctataccttttatataactcttaataaacattcatacacttctcataataccccttcaaaccttcaa

SEQ ID NO: 36705 - DNA, 205 bp, Zea mays
  Clone ID: LIB3060-039-Q1-K1-D6
cacacacacacaccaaactccatctaccaacttctcactaccattatttaaagaacttcttaaaaaagttgacggccctcacccccaccatcttaatcctccacacacacaaccttcaccatcacataataaatgaaaatatctatcacctctactcaaactcacactcctacaccaactaccaacaccaacaacatatacacca

SEQ ID NO: 36706 - DNA, 285 bp, Zea mays
  Clone ID: LIB3060-039-Q1-K1-D7
tcgaagagaatttgtgcagatcacaccagattgatgaggtgatatgggagcacatcaccgataagagttagcggctatctagttatggattgactcgcttacagcagaatgaaaaagagttagggacactacgccctggtaggttaatttagtatgcacatgatctcaggctctcagctttcgcctccgtaaatattattttatacaaatgtacatcctagatatgtatacaaagatcgttcatggcttaatgaataatattattttatacaaataccttataat

SEQ ID NO: 36707 - DNA, 213 bp, Zea mays
  Clone ID: LIB3060-039-Q1-K1-E10
tcccgcctctacccacttcttccatcattctctcactcccatcaccccacctttcccccccacaccaccccccaccaaacgaatcttcttcaaaatttccccccccctataaccccctcccacaacccacaccccaacccccacccccaaattcccaacctccatcaaacacttcatcccatctacatctaatccacccccaaaacacacccc

SEQ ID NO: 36708 - DNA, 361 bp, Zea mays
  Clone ID: LIB3060-039-Q1-K1-E12
caacacacacacacatccctccccccacttttaccaccacacacatacccaatccaaagaagattttaaaaaattttcgacaccccaacaaacaccacaatctcacctctacaccacacctactcatccaccccaacctcacttcaaacaacatcacctccttcctctccatctccttcatctacatctctacctatcacaaaccttaccaccaacatccatcatatttctatccattctttcactcattacaataattatctttacactttctactatatctttacttactatctcccataccactatccctacctacaactttaactatcttatcaattctcacatatttttcaccaac

SEQ ID NO: 36709 - DNA, 136 bp, Zea mays
  Clone ID: LIB3060-039-Q1-K1-E4
tcccggtctgctccgtggccatggcgtcgtccattctctccgctaccacctttccactccatcaaggtgtcttcctgtcgtaggtctccttgctcatgagctcctcgtcactgcccatgctcctgaatgccacctt

SEQ ID NO: 36710 - DNA, 214 bp, Zea mays
  Clone ID: LIB3060-039-Q1-K1-F10
ttcccgctcgacccacttcttcctactcccttctatctctacctatctctatctagccttcctgtatctcttcagatatgacttctcttgcctccaccacggcggctacctctacagctcttctgctactactactactgtcactcacctattcatcaaacatctctatctctttatacacttatattcacatcatattaacacttttaattct

SEQ ID NO: 36711 - DNA, 438 bp, Zea mays
  Clone ID: LIB3060-039-Q1-K1-F11
ggaattcccggtctcgtctcgagcgccgcccgaaacccccaacccccaaccaaactctctccgccgtcagcagccatggatcttctcgtcccgcctcgctcctcgtcgggcggcgtggagcccaagatccgccaggtcggcttcttcaccccggatgcctccgcgccgtccgagcccctgccccccgccgcggtggtccaggcaccatcggctcagcataggccggtcacggcgtcgcctccggcgtcagacgacttctcccaggggcgcctttcccctgtcatgatccctcccccgcgccatgccgaccacctcgccctgggcccacaccccccggctgctgccgacgtcgtcctcgccacttctgcgcccgtgcgttcgtccccgctccttgacatcgtgtccgagatcggcgactactactcctggtcacgcgct

SEQ ID NO: 36712 - DNA, 186 bp, Zea mays
  Clone ID: LIB3060-039-Q1-K1-F12
gattcccgctctacccacttcttcctgagacccctccactaggctaggtatttaagcctcggtccctcttcatcatccatgacttctttcctgactcctgcctgcacttccttctatcgctcgtcctcattccttaccccctgttcctcgaatctccttagtacagctctaacgtcttctgccttt

SEQ ID NO: 36713 - DNA, 275 bp, Zea mays
  Clone ID: LIB3060-039-Q1-K1-F2
tcccttctctacccactcttcctacaacccaaaactgacttctctcccattcatttcccaccaacacgtcatccacgtctagctggtcttctcttactcctcctccctttccttccccttccatcacctacttcaattccaccacttctttccattctttctccatcctatcttgaccatctgcctctatctccctcgatctcttcattatccattctcaaattaccaattcctttatcatcactccaatcattctacttcatcctatcctcccc

SEQ ID NO: 36714 - DNA, 169 bp, Zea mays
  Clone ID: LIB3060-038-Q1-K1-H9
ttcccggctctacccacttcttcctccattccttcaatcccaaacaccagtttctcatcctgaatccactaatcactgctagaaccttttataacttttgattgaccttaacactttcttctatctctcccacaacttatccattccctcctactaccctcacattaaa

SEQ ID NO: 36715 - DNA, 261 bp, Zea mays
  Clone ID: LIB3060-039-Q1-K1-A1
ggccacagctgctgcggtggcatcaggtcgctcctctccctcaaggacttctctcgggacgacttccacttcgtggaggactgcgtcaggatcggcagccctgccaagaacaaggtgaagaaagagcacgcatcggtgccgttcgatgaccagtgctccatcctggagaaggaggccgtaaacgtttcactccataaccataagagctaccccttcttcaaggaaggtctttcactctgaactctcattctgtttttctcc

SEQ ID NO: 36716 - DNA, 191 bp, Zea mays
  Clone ID: LIB3060-039-Q1-K1-A2
attcccatctcgacccactcaatccatcctcatcactccctctccactctctctccctatctccttccctccacactcactacagtacctcttaaaacatcttaccccctactcaatcctttcacaccccactccattctcccactaccaaccccaaacctaacccttaaacattcaacccccctttctta

SEQ ID NO: 36717 - DNA, 405 bp, Zea mays
  Clone ID: LIB3060-039-Q1-K1-A5
tgaattccctcgtgtacccactcttcctagctgatgtttgtcaccttaaccttctcaagacattttgcattccacattggggaggcttttttatcatgtgtcctattcgtgttaagaagcatttgtcaccatttttaccatctcacccagtgattcccactgttgtctttcctctccctgagaaaactgaccctcttgtcaccatttctgctgctccatgtggatctgctttgattctgccaatttcctacacatatatatccatgattgtctcacattggctcactgattcttctaatatcgctatctttaatgcaaactacatttctaaacatctagagaaacattacccatttctttttcttttattcaactttatcatttattttattatttattatttta

SEQ ID NO: 36718 - DNA, 198 bp, Zea mays
  Clone ID: LIB3060-039-Q1-K1-A6
cccactcaaccaccgcaccaaccacaccacccaaatcattaaccactacccacaccaaatcatcagaagtttcttaaaaaaattcacaaccccaacaaacccaaccccacaaaacacacacatcacaccaaactcccaattcatcaccccacaaaacccaaacacaactcttcccaaacccccacaaacaaaaccacc

SEQ ID NO: 36719 - DNA, 214 bp, Zea mays
  Clone ID: LIB3060-039-Q1-K1-B11
tcccttctgtacgcactcttcctcgacttatttcattgattctttaatatttctatctcctctttcaccacaacctctaagatggttttcaacttcggatcgacctgcatctacttctcaaacttcaaattctttacaatccattttctactcttcaccttcatcaacacttacactgacctttattatactcacaccctctctcactccacca

SEQ ID NO: 36720 - DNA, 75 bp, Zea mays
  Clone ID: LIB3060-039-Q1-K1-B2
tccctctctacccactcttcctaatctcaccaagtctgtctctttggattcctttggtgacaccataaccactcc

SEQ ID NO: 36721 - DNA, 102 bp, Zea mays
  Clone ID: LIB3060-039-Q1-K1-B4
tcacttacctccctttcctaggcttgctagtccttcaacttcaatgcttcctaaaccgcctccttcaccatctcctacattcttgacacctcaaccttctta

SEQ ID NO: 36722 - DNA, 241 bp, Zea mays
  Clone ID: LIB3060-039-Q1-K1-B7
attcccgtgctctacccacttcttcctagttcccttctactcccactcctcattttattcaactccaacatcttcttcacagaactctataaaaagttcaccgcccattcaaaatcaccatcctcacataaaacaccaacataatatacaataacctcaatcacaaactacacaacctaattaaataacacatacactcacaacaattcatccaacaaatcaaatatacacaaacatccac

SEQ ID NO: 36723 - DNA, 163 bp, Zea mays
  Clone ID: LIB3060-039-Q1-K1-C10
ataaatccttatatttccaaatataccaaccttcttaactacctactaaatccattaacactcatcatacaacctatctaactcaaacatcttattaaccaaactaaaataaatcaaaagccattcccataataacctctaactaattataatcaacctatac

SEQ ID NO: 36724 - DNA, 426 bp, Zea mays
  unsure at all n locations
  Clone ID: LIB3060-039-Q1-K1-C4
cactcttcctcgacttctttcattgattcttgaagatatctatcttcttttgcaccacaatgtctacagtntctttcaacttcggatcaagcttccgctgctgctcaagctgcaagttctcttcaatccattttctctctgtccttttcagcaagaagtaccctgacctttatgagactagcaccgcctctcattccaccttcatcctcttcgtttcccctgataatatattccctcccttattctttttattcctctttattattttttttatctttttattctacttttatttttttttcttgttttctactcttttaacttcttttcttatttatcttcttttttatatttttttattattttttatttttttttatttattttttttttttttatatctttataattttaattatttttttt

SEQ ID NO: 36725 - DNA, 303 bp, Zea mays
  Clone ID: LIB3060-038-Q1-K1-H8
ctctctgataccatctcaaggttccccatagacattcagccattcagggacaggagggaaggtatgaggagtgatcttaggaagacaaggtataacaacttcgacgagctctacatgtactgctactatgttgctggaactgtcgggttaatgagcgtacctgtgatgggcatcgcaaccgagtctaaagcaacaactgaaagcgtatacagtgctgccttggctctgggaattgcgaaccaactcacgaacatactccgggatgttggagaggatgctagaagaggaaggatatattttttt

SEQ ID NO: 36726 - DNA, 439 bp, Zea mays
  Clone ID: LIB3060-039-Q1-K1-C6
ccactcttcctcagaagagagcagaggtccagagtctcttaaggcagtctcggactggatgaagatgaatattattctcagctagcgaggatgccgttcctgaacgtgtcgaccaacgtgaacctgtatggcgtggactccttctccatcctagtctcgaactactatattatcttaatttatctataaataccatatattacttttttacgctttttcatcttctttttttttactatttacatttgttcttttttttttttttctttacctcaacttttttattttttttattcttttttattttttctcttttttatttattttttctttattatttttttttatttttaatttattttaatttttttatcatttttttttttttattttttattattttattatttttaatatttattttttttatttttttttt

SEQ ID NO: 36727 - DNA, 179 bp, Zea mays
  Clone ID: LIB3060-039-Q1-K1-C7
aacaaaaactaccaaccacacaaaaccacaacaaacaacccaaacaaaaaacacacaacaaacacacaaacaaccaaaaaaacccaaaaacccacctcaccacacaacaacaaaaaaaaacaacaaaaaaccaaaaacaaacacaaaacccacaaaccccaaaaaaaaacacacacaaa

SEQ ID NO: 36728 - DNA, 289 bp, Zea mays
  Clone ID: LIB3060-038-Q1-K1-F6
acctagaccgaagctcgtgttacactggcaacctgagcgtgaatggccgctattttataaagtcggccagccattcggagggtgatgcggccacgacacctgctcctgccacagagaaaccgtacatcactttgctctaccgtcctggccactactatattctctacccaaagtgaattttgcgcatggttagtttcacgacttcggttgagaaagcacactgcccagaaaactcgtcatgtttcgcctgtgtgctgccaaaggtggcaaacttgcttttgagtgcttt

SEQ ID NO: 36729 - DNA, 381 bp, Zea mays
  Clone ID: LIB3060-038-Q1-K1-F9
tcccgctcgacccacttcttcctatcctgctgcactttagaatatttttagtattttttttgataaataagaaaagttgcacgatctcgactaattacttctgaataacttcagaaatcatatggaagaaccatagcatttcgcgattcattggtaaatttactttgattctctatagaccaataatgtgagaccattaacactgttaaagctaaactgcttgaagtccggtcaaaaaggggtactctttctacaactacattagtattagtctcgaaattctttaaactgtaaatatctagtgtagaatttatctgatatataactctcatatcgatataatagtttgaactatttactataatgtcacgcatccctttt

SEQ ID NO: 36730 - DNA, 241 bp, Zea mays
  Clone ID: LIB3060-038-Q1-K1-G1
cttcagagcgtgagcgctacacgctctcactggcagcaaggacaggctcctcaacgacattctacaggtgctgccgtcgaatcagacgctcacgccgctacccgacctcctcctccccacgcgcacacccacatcacgtctgccatacccaacaacgcaactacacaaatctctacccaaagacaataatacccatgactagtttcacaacttctgttgataaagcacactgcccataaaa

SEQ ID NO: 36731 - DNA, 361 bp, Zea mays
  Clone ID: LIB3060-038-Q1-K1-G11
catggatctacacacatacatagtttcttctactacacgacgactaacatgggtaagcctgcgaagatcggagagtggggtggatacgccggctatcgtcgggatctgagggctactccggaccggctgatcgaggtgaaggtcacggcggacaacagcagctgcatccgctccatctccttcatctacatcggagccgatggcaaaccgtacgaggaggggccatggggtttcggccatgctggctcggagtacaagattgatctgcgcaggttcgactagagcttgacggagatctccaggtccactgcctcatccttcaacatcgacaatctggtctagcctcttatacttttcacca

SEQ ID NO: 36732 - DNA, 402 bp, Zea mays
  Clone ID: LIB3060-038-Q1-K1-G12
taactcacaactaattcaacttctattctttgaattaatccccacccctttttgactttcttactccaaatacacgattttagtttgattaattcccaccccacaaccccccaccacaataactttttcaatctaattcttcttcaactaccctcctctttaacccaattaatgattcaaatcaaattcttctctcatattttccctttatcttcttcttcttctatctccattaacatcatcaatcattctcttatttacatcttcgtatccataatctccttctttctgtcttatcacacttccttctccttcaacttcatcaccttttccttccatttccttcataatcttccccccaacatcaccatatccacctactccttttacttccacaccttc

SEQ ID NO: 36733 - DNA, 309 bp, Zea mays
  Clone ID: LIB3060-038-Q1-K1-G2
ccacgcgtccgcgttcccagctgcacattgaggaactttgtcatgccaacttgtcaaaagacgagccgatggatatatcaaaaatatgtctcaatactctctctgctcaaacactgccagaggaagcaaggcatgaggaaagagttatttgcattcctaatggtgcaaatttggttagaagtgtccgcgtgaaaaatgatcttgaagaaaattctgtggttgaggtttatttcccaattgaacaagacgttggaaaggaggcaacaaggctcagagctattacagatctttttagcaacattattgaag

SEQ ID NO: 36734 - DNA, 284 bp, Zea mays
  Clone ID: LIB3060-038-Q1-K1-G5
aagagccaaaaggcatcaccgccgcgactacgatggcagcctcgctccaagccgctgtcaccctgatgcagccggccaagatcggcggccgggcgccctttgcctcgctgccgtcccgcccgtcgtcgcaactcgcctgcagggcgttcggcgctaccccctgcgccaacagaatcacgtactcaatgcacaaccttttcggaaggttgccccgtgagcggctacttcggctgcctccatgaacagtatcttgcactcgctgatttacagctttgtggctatat

SEQ ID NO: 36735 - DNA, 277 bp, Zea mays
  Clone ID: LIB3060-038-Q1-K1-G6
cacgcgtccggcagcttctgcttgctctggggggaaggagagagagagagcgagtagagagacacgcatctactagagaggctagtaggtggtcctcgaacgaagatgttggccgtgttcaccggccaggtggtggaggtgccggcctacctgctggcggcgggcagccggacgccgtcgcccaagacgaatgcgtcgcagctcgtggggcgcttcctggccgcgtccgatccggccgtgttcgtgcagctcgtctaccacggcctcctcgcctact

SEQ ID NO: 36736 - DNA, 288 bp, Zea mays
  Clone ID: LIB3060-038-Q1-K1-G7
aacacacacagagagaggacaactcctcacaactctcccttccctcctgtaggggccgaaaggtttagagagtaagagaagtagttcattcccttgcccaacacaagaaaacaagctctcctcatcaccctaatccaagcaactgcttgtgtgttgggaaattcttgtgacccctgttatattattatccgtgtagctactagcttcattcccccctttgtacccatcaaatggctggcatgtctctgcaacacccctgggcgtttgctttcggtctactaggtaacg

SEQ ID NO: 36737 - DNA, 297 bp, Zea mays
  Clone ID: LIB3060-038-Q1-K1-G8
gcctcagcttgcaggttgcagccgattagaatcgagcgtgatctccacatggggacgtgtgactgagaaactagctacacgaaaaattctaggattcaagagaaaactatgtttcagatcaagcctgtccttgaggaggccacaagagcagtatacacagctctccaccctcaaaccatggttgttgctgacttaggctgctcatctgggcctaacacattacgcttcgtatccgaggtgattggcatcatagctcgccattgcaaagaacatggccgacaacatgaccacccacag

SEQ ID NO: 36738 - DNA, 291 bp, Zea mays
  Clone ID: LIB3060-038-Q1-K1-H1
ctgaaagaagccagagactgttctatattgtctttgtggcactgtacactgtaccaggtcggtatgagaaatatgaggacaaggttgatgcttttggtgagaaggctatgactgaactgaagaagtattatgccattttcgatgagaagtgcctatcgaagattccaaagggcccccttaaggataagaagcactagattggtagtaaggtatttgctatgaatcaacatctacattatgtcactagctgtcacctctttctctgaaggatggtgcttggtcctggtctct

SEQ ID NO: 36739 - DNA, 148 bp, Zea mays
  Clone ID: LIB3060-038-Q1-K1-H11
aaaatccaaaaatcatcacctcctttactactaaacaacactaatacaaaaagaaactacttaaaaacatccacccaccatcaaaatccatactcacaccaaaacaataacacaaatccaaactacaacatacaaaataaactaaaaa

SEQ ID NO: 36740 - DNA, 366 bp, Zea mays
  Clone ID: LIB3060-038-Q1-K1-H12
tctctcgtggttctcccgtactctatgtccttaccgccgacaactggtctatcgccgcccggcttaatccagatgctcaagtctgccacttgtcacttcacctgctactagcacctaacagagagatgtctgctaatcttcgagtctgcatcttgctaggccatttctagctttcttgccataattacacagtgctctttggaaaataccattcagatagcatgtactctacaccatcatctgtctccatatttttctgttatactaccatatatcactctatcacatacattctactactgtctcttaccctttctactgcatacatgccaccatcgcatcaaacccactcactaatatacatct

SEQ ID NO: 36741 - DNA, 251 bp, Zea mays
  unsure at all n locations
  Clone ID: LIB3060-038-Q1-K1-H2
aaagaaaccagacactnttctattttttctttatgacactgtacactataccagtcggttattaaaaatattagcccacctataatacttttactcaaaaagctatcactaaacttaataaatattataccattttctattagaatttcctatccaatattccaaaattccctattaatgataaaaatcactaaatctttaataaagtattttctattaatcaacatctacattatatcactagctatcac

SEQ ID NO: 36742 - DNA, 305 bp, Zea mays
  Clone ID: LIB3060-038-Q1-K1-H4
cagatccctctcccgtcccagctcgatcctgcccgatggccaccggatcgtacgcgggtggcgtccgacgctgagcaaccaggacaacgacctgcgacgaccctccgagcacccacgagatggtcgcggaggctgcgccgttctcctcatcggcgatctggtcgtgtcaccgcgacgagatcaccttcgaccgcctccacaagttttggagtgccctgtcacctcatgcacgacatgagctgctaagacttgataaacagacccttattgagcatgctcgcaagaatttgcactgttcaaggggg

SEQ ID NO: 36743 - DNA, 287 bp, Zea mays
  Clone ID: LIB3060-038-Q1-K1-H5
cttttactcctgccattaagcacacagcaggattgaccttatgcggtagcaaggctgttcctaacatgggccagattgcctctgaacataactaccagatcactggtggtatggatagtgatcaaagaatcatcttttcagaacagatccgtggtgcagtagaacaatcagctgcacaagctaaaagtgcaagcattgactcagtggaggcagttaagcacaaggagggcatatggagccatctatctacaatctcaaggaataagttacctccaaaagttgaagag

SEQ ID NO: 36744 - DNA, 270 bp, Zea mays
  Clone ID: LIB3060-038-Q1-K1-F5
gaggcatcgcttgggctttcttgatgcgatttcagatattgggagaatactaccctggagttactgatgcttggatggaagtagtggcttctcaagggcagtccttgctatctgttgacctctcttgctcggatgtcactgatagtggattcaatcttcttaaagattgctcaagcatgcaaagtttgtcatgtgattattgtgatcaaatctcagaacatggacttaagacattatcaggcttttcaaacttgacatcactgagcatta

SEQ ID NO: 36745 - DNA, 280 bp, Zea mays
  Clone ID: LIB3060-038-Q1-K1-H6
cagaaactaatctcattacactctacttattattcgaccttatgctttactacgccagatactaacatgtatcagacagcctatcaacatctctactaaattactggtcccttcgatcgagctctaacaataatttcttcataacatatccatcctacaatcaaacattcagctccacacgacacaagtacaatcatagcctcagtaaatacaattaaacacaaggagggcatatagacccatctatatacaatcttacgtactcaattaccttcaaaat

SEQ ID NO: 36746 - DNA, 387 bp, Zea mays
  Clone ID: LIB3060-005-Q1-K1-G7
ctcatcttccccggcgtttcctcccagctccctccaccatgccgctgccatggaactcactgctcggccgcgccctggccatgctccctgcgctcgccagccgtgcgcatctccctctgcgcgcgcgcgcctgcgtcctgcgccgcgaaccccgccgtggagcttccccgagctcgccccatggcgcccggccgagctcctccctgccgtgttcttgctcggcgtccggttttcctgtgcgccacggtcttcctccccgagctcgccccagccccttgtattccccatggccggagcttcttccagctccagctcggatccctctcccatggctctctgcgtgctagccgctgcgcgcccatctatctctcgcggatcttccttccc

SEQ ID NO: 36747 - DNA, 415 bp, Zea mays
  Clone ID: LIB3060-005-Q1-K1-G8
attattgtgcttatcctagttgttggtttagtttatgcatggcgaaaaggagccttggaatggtcttaactgaatattcagaaaaaaaaaaaaaaagaaggaaaagattccattgagacaattatgactccgattgagtttccgttactcgaccaaacaagttccaattccgctatttcaactacactaaacgatctttcaaattggtcaagactctcaagtttatggccccttctatatggtaccagttgtcgtttcattgaatttgcttcattaataggctcacgattcgactttgatcgttatggattggtaccaagatcaagtcctagacaagcggacctaattttaacagctggtacggtaacaatgaaaatggctccatctttagtgcgactatatgagcaaatgcctg

SEQ ID NO: 36748 - DNA, 309 bp, Zea mays
  Clone ID: LIB3060-005-Q1-K1-G9
cacctcagcccaagtaagtctgcatggttagactttcatgttcaatctgaagtggaagaatatccttgtgttaatatctgtatggtcattgttcttggtgctgcaagttctcaagaataattcaaaatcatgcagctctttctactgggtgataaacgttctgcaggttccagttgcggtaagtgtgttcttgtgggacgccatgcagttatgtagggagagtcatgcactacgtatgaatgggaacctgtaatgtgtgtgtgaggcctctattgagtggtcaccatcacaactgatcttttgctcctt

SEQ ID NO: 36749 - DNA, 397 bp, Zea mays
  Clone ID: LIB3060-005-Q1-K1-H1
ggcgtccatctccccttccctccatcacccttgcaattctagaactggcttccttggaaagacacacgggactcgtcctcgtcttttctctgctggaagagttggatttgtcagaacactagtggagtgcaaggaatctagaattggaaagcagcccattgaagtcccaccgaatgttactctcacattagaagagcagtttgtcaaagctaagggcccactaggggaattatctctcagcttcccaggtgatgtgaagattgtgaaagaagaatccggtaacctgagagtttataagactgcagagaccaagcgggcgaaccagatgcacggtcttttcagaacattgacagacaacatcatcgttggtgtgtcgaaagggttcgattagaagctt

SEQ ID NO: 36750 - DNA, 425 bp, Zea mays
  unsure at all n locations
  Clone ID: LIB3060-005-Q1-K1-H4
tggttctcttttgcagggcgagtnncatcgtcgttggccttcccctttggtcctcttcccaagcgcccagagatnntagtcgcctctttnttcttggtgtaacctcgaaaattttgggggtagaagaaggggcgcgtttagttttcttcagacccagtatgacccagtggattgggggtggtttgggcttctcttttgtcaagtagccaattgggagggcgaaccaggaaagaccactgtagaaggcacctcttcgcgccgccttgttcaacgtaagtggcaagcaagagggtgggcatcaaaggggcacccgatgggcggcaaccatgctatcgcaagcgtgtgtgcgggagagaccagaggtcaagacctggcaaacaaggacaggggaaaggggacccgtgatctccatgcaaggagaacat

SEQ ID NO: 36751 - DNA, 329 bp, Zea mays
  Clone ID: LIB3060-005-Q1-K1-H5
ctcggcccttcttcataggtttttcgattcattgcacctgaacgctggacatgtgctggtctataatcatcgcatcacttacgattcatcctcgaattgacatgtgatctgaaaagaaagggtgcttagaacaatccatgacgtgcatgagttactttcatatcactagggcgatctactcaagcactatgccatctgtatctcgatcttccgctgatcacatactatgccctaatttaaacgcctagcatcatcatgtctaactgaagatcaagatatcactctacttctatctatattaatatcatttcatatatcatcctattacc

SEQ ID NO: 36752 - DNA, 335 bp, Zea mays
  Clone ID: LIB3060-005-Q1-K1-H6
gcggccttggcagcagacaggttatggaaacacctatggagggtatggtggatccaacatgtatagttcatatggtggatttggcaacacttatggtaccggtggactcggaaatagcatgtactcgagttacggaggaggttatggtggtggcatgtacggtggtggcatgtatggaggcggcatgtatggtgggatgggaggttatggtggttatggcatgggcggaatgggtggtatgggcatgggtccatacggtaatcaggatccaaattcgatgggctcctcctgcattcttgtcaggcttatgggtgttcttacttcctgtgatgcat

SEQ ID NO: 36753 - DNA, 422 bp, Zea mays
  unsure at all n locations
  Clone ID: LIB3060-005-Q1-K1-H8
gcgttcgagaataagcagtgacaacaataatctagcctgcctgtccttagcgtagccatgccatggccggcgatgcgctcatcgtcatcgtcactagcttcctcctcgcgctgccgtcagcgacggcaataggcaaggtctgtggcaacgccggcaactacacgggcaacggcaggtaccggtccaacctcgactccctcgccgcggcactcccagccagcacgtcctcgtcccctcagctcttggccaacaccaccgccggcgaggcccccgacgccgtgtacgcgctcgcgctctgccgcggcgacctgaccggcaacctcaccgggtgcagcgcctgcgtgaacggctcgttgcagtacgcgcggagggcgtgcccctacgccaaggccgncagcgtctacgacgaccactgcctcgtc

SEQ ID NO: 36754 - DNA, 412 bp, Zea mays
  Clone ID: LIB3060-006-Q1-K1-A1
agtcagccgagtctgctctgctgctccatcggatctcccgcgcgccaaaccatgccgacgcagcaagcatgttctgctgcggcagcattgagatcgcggcggccttcccctgcatccacgacgacgacctcccggcagctgcggctgcgtccgcctcgtgccgccaccgcgggcgtgcggctgacggtgtcggacgcggagctggagtcccgcgggttcgctgtgcggcgcacggcggaaggcatcgacgtggcggcgctgaacgaggtgttcgtgcgcgtgggcttcccgcggcgtcaggaggagcggctgctgcgcgcgctggagcacagccgtgtggtgtggctgtcggccggggaggaggaaaggcggcccgtggcgttcgcgcgcgcggccggggacggcgtgttca

SEQ ID NO: 36755 - DNA, 404 bp, Zea mays
  Clone ID: LIB3060-006-Q1-K1-A10
gcacagaacacttagctttctggaaggctggaacagaaagaaccctaaaccctagcaatggcggcggcgaacctgctgtcgcgctcccttctccccaccccaaacactatccggacgagccaccccaccccgcggagcccagccgtcgactccttcccccgccgccgtgcccgtctgtacctgtgcgccttcgtcttcatggtctacccgtaccgaccgccacagcccgcggtggtcggcgtgccgaagcactgcttccggcgcggcgccgacggatacctgtactgcgagggagtgaggctggcagacgcgatggcggctgccgagcgcagtcgctgatatgcctacaggcagcttcacatactacgcaacttcgccgcttaccgcgacgctctccaggggct

SEQ ID NO: 36756 - DNA, 427 bp, Zea mays
  Clone ID: LIB3060-006-Q1-K1-A12
tcaaccgaatgatcgtagcctacacttatccttctaatgctatctatatatgcttgattgtgtgtagggttgtctccagaaagcttgcttgttacttatatcccacacacttgcgcgcacgcaacccggcctttgtccctctcttgcctctcactgctgctgcccctcgctattcttctctgatcgatttctgtcatggcttcattctggttcagctgccgctgtagcgggatgacccaggtttgccgcagatgacccaggtgggactatgcggtggccggcagccccagatttggtgggggatgagataggaggtggctgcatggcctttcttgttggttttctatcgatttcctatgttgtgctctctaatcctctcagctctctacttttggctaggcgtcaaggacgcccacgcgatgcctta

SEQ ID NO: 36757 - DNA, 289 bp, Zea mays
  Clone ID: LIB3060-006-Q1-K1-A3
gccgtcattcggaggccgggaccaaaagaaccatgtaatcatggttgttccacataacgcgcatactgcttcctattcagcagtgtggatcttccggtcaatacaaatggagaggaaccaaaatgattcgtagctggttaccatactttcgtgttatccgatggcagcttattgcagcattgtagttcacaaggctacccgagctgcagattatggtggattctgcattctgaccactgattgctctttacctgaacgttatacatattggatgatatgatcttgtgtt

SEQ ID NO: 36758 - DNA, 421 bp, Zea mays
  Clone ID: LIB3060-005-Q1-K1-G6
actctctcttcgtttactcttcttcccacccccagcgttcgcttccatccaagctcatatcatcatagatcgacggactaggccacgcgccccaatactcagaactagtcttgagtaaagcatggcgtcgtcttctccgtcctgccgtggcagcggcggcaagtcggacgtggaccggatcaagggcccctggagccccgaggaggacgaggccctgcagcgcctggtggcccgccacggcgcccgcaactggtccctcatcagccggtccatcccgggccgctccggcaagtcgtgccgcctccggtggtgcaaccagctgtcgccgcaggtggagcaccggcccttcacggccgaggaggacgacaccatcctccgcgcgcacgccaggttcggcaacaagtgggccaccatcgcgcgc

SEQ ID NO: 36759 - DNA, 439 bp, Zea mays
  Clone ID: LIB3060-005-Q1-K1-F1
gggcattcttatatcaaagccaggaggaactcatatttcctgaagaagtttgctattgatgttggttactctttcctccggaagaactgcagaggcccatcagtcacgctgcacattccacacattagtctgatagaagtcggcatgatctactatgtttagcttaaggcccattgccgaagctcacatgtggatacccggtcggggcaatgcttgtgctgtctgcggattgtggtgtggaaggagttcaggcttgttcgttctgggccaagtttcagcttgtagagaagaaggcagacttctttgttaatattatttttagcctaaataaaccagcacaatgttagacggtgatggttctcatttggcatatttgcatgcatgctctgtaatttttcttgcagctatgtgatggaaatatatccattatctttaaaaa

SEQ ID NO: 36760 - DNA, 399 bp, Zea mays
  Clone ID: LIB3060-005-Q1-K1-F10
cgtgcccctgtcgcgatagatggctcgtggcccccaacgacgacgaccgcgccgccatgaccaccaccaccacgcccacggcggtggcggtcgtgaacgtggtcgcagttgcgcagctctacgtcgggcctccacctgcgcgcgtccctccacctcgcccgtggccacgaaatcctcttccatggaatcgtcgcgcatcctcctccacctcgaccgccgcggccgattcccaccgccaccacgccgcgcacgccccgtccctcggtcccccgttcgcctcttccctgcccctaccccccgcgtctaccgcgctcctcgcccctcctaacatcgtcgtcttcatctagcgcgacagccgatgcacggcttctagctcagtccgtgccacgcccgtgggga

SEQ ID NO: 36761 - DNA, 321 bp, Zea mays
  Clone ID: LIB3060-005-Q1-K1-F2
gggcgatgcgcgagggccacaactacgtgccctgagacgaggaggtattggacgagaagcaggggacgctcggggccaccacggtgcggtacaggctgaacacgctggtggcggatctcagaccgctgcttattaacaagaaggatctgcgattacggcactttcacggcatagacgaactgtacagagacggcatcccggtggcggcgcagaccgggttcgacgccatatcgaccgtggaaccgggcatggccaagctggtggaggacaccaccgaccacgtcctacgcttcgaggtgccggaaatgatagagagggacc

SEQ ID NO: 36762 - DNA, 194 bp, Zea mays
  Clone ID: LIB3060-005-Q1-K1-F3
gagccatcgacacgatcgcgagcgcaagcacgtacgttgtcggaagctcaagttagaagaagcaccagtgcctgatcgatggcggcccatgctctcctctccggccggcagctgctgggccgccccgtgcagtcggccgtctctaggtcgtcggccaggaaagcgcccttcgtcgtcagggccagctccagccc

SEQ ID NO: 36763 - DNA, 386 bp, Zea mays
  Clone ID: LIB3060-005-Q1-K1-F5
ggcagcacactcagctatccagcaaaagagatcgagaggcaggagtcatggccaccgtcagcgccgccgtggtgaccaccatcgttgcccgcgccgcgatcgccaggcccaatgctctagggctgcctgcgctgagggcgaggagcgagagggtgcggtgcagctacgccaaggacgcggccccagtcagcaccaagggcgcaggcgcgtcgctgctcgccgcagcgggcgcggtgaccgcgtcggcggggcccgcgctggcgctcgtggacgagcgcatgtccacggagggcaccgggctgagcctcgggctcagcaacaacctgctggggtggatcctcctgggggtcttcggcctcatctggtccctctacaccatctacacc

SEQ ID NO: 36764 - DNA, 428 bp, Zea mays
  Clone ID: LIB3060-005-Q1-K1-F6
gttacctacaggctacagctcccgtctctccgccgcttgcttggaaaacgaagaaaccctcctccaccaacccaatccagctacatccgtctgggtgaactccagggccaggagcagttcgccgccttcgttcgcatcacctacgcggttcgatccaactggcaggaaggaacgtgatggccaagacgagctcgttcaagctggagcacccccttgagaagaggcagtctgaggctaatcggatcagagagaagtaccctgacagaattccagtgattgttgagaaggctgagaggagtgacattcctgacatcgacaagaaaaagtacctcgtccctgctgatcttacggttggacaattcgtgtatgttgttaggaagagaatcaagctcagtgctgagaaagctatcttcatctttgggaagaac

SEQ ID NO: 36765 - DNA, 426 bp, Zea mays
  unsure at all n locations
  Clone ID: LIB3060-005-Q1-K1-F7
gttgtccactgccaccaggcaaaccagccgcgccgccgccggcgatgaccaccgcgcggctcgtctcaacatcccccgcccgcctatcctccacgtcggcttccccgattcacagaacctcgctgtgtgttgtcggtcgtgcccctgctttctccgccaggccgctcggattctcgcttcgtctcaagccgtcgcctgccatggccgccgccggcgtcggcggcaacggcccccctaccgcgcatggagactcaataggtggttcatgtgtttgatactggaattttttgctctctgtgcagcttcgcgtttgatttgttcctcagctgtgcccatcacttcatagttcatatntgctcttctttacggtagctatttcgactgactgtatttattccaagcacattttttttttatgatcgcgtt

SEQ ID NO: 36766 - DNA, 284 bp, Zea mays
  Clone ID: LIB3060-005-Q1-K1-F8
gttgtagactggcacgaggctttccagtacgcgccgccgacggggaagaccagcgtgcggctggtgttaacataccgcgaccagctatgctccacgtgagctttccggagtcacagaacctgacctgtggagtgtctgacgggccactgctttcacggccagggctgtaggattctggttcagagtcaagacgtacgcctgtcatggcggccgccggcgtacggagaacgggccgactacagcacatggagactaagtcggtggttcatgtgatagatgctgga

SEQ ID NO: 36767 - DNA, 392 bp, Zea mays
  unsure at all n locations
  Clone ID: LIB3060-005-Q1-K1-G1
ctcacgctggtgctcctgctctcgtgcgtcggccacctcctcatcgccttcggcgtgccgcagtcgctgtacgtggcctccgtggtgatcggcttctgcttcggcgcgcagtggccactgctgttcgccatcatctccgaggtgtttgggctcaagtactactcaacgctctacaacttcgggtccgtggccagccccatcggcgcctacgtgctcaacgtccgcgtcgcgggggcgctctacgacgtggaggccgccaagcagcacggcggctccctggcgggcggcgcagacaagacctgcatcggcgtgcagtgcttccgcaaggcgttcctcatcatcacggcccgncacggtcgccggcgcgctcgtgtcgctggtgctggtgtggc

SEQ ID NO: 36768 - DNA, 259 bp, Zea mays
  Clone ID: LIB3060-005-Q1-K1-G12
ctcagctcctaccatgagtgcacggattcacccttcgtcttcggacgctgccggccgtgcccatcgtcgtcgtcgggctgctgctgctgaacgggaacgccggccgccggcggtgtacacggtgtggaagaggtccagcatgggcttgcagggcaccgacggcttctgcgtctacgacgacgccggcaggctcgcgttccgcgtatacaactactcccgccgctcaaaagctctgcgcctgcgacctgctgctcatgga

SEQ ID NO: 36769 - DNA, 409 bp, Zea mays
  Clone ID: LIB3060-005-Q1-K1-G2
ccgagctccaggtctccacacctgacgtctataaataataaattaggcgcccgcggtgcccatcaattcgtgtcaccgtgtcccgagagcgcaaatcattccgcgcgacgcaaaaaccctagcccagccaccgatccctctcatggcaaccaccaccacccaggcgagccttctactccagaagcagctaagagatctcgcgaagcacccggtggatgggttctctgctgggctggtcgacgacagcaatgtcttcgagtggcaggtcaccatcatcggaccggctgacactctatatgatggaggttacttcaatgcaataatgagctttccacaaaattacccaaacagcccggcattagtcagatttacctctgaaatgtggcattcaaatgtctatcctgatggg

SEQ ID NO: 36770 - DNA, 427 bp, Zea mays
  Clone ID: LIB3060-005-Q1-K1-G5
ggcagtcgcggacaggaggaagaggaagaagaagcggcagcgagcgaggatgccgtgcctgaacgtgtcgaccaacgtgaacctggagggggtggacacctccgccatcctcgccgaagcctccaagtccgtcgccaacatcatcggcaagcccgaggcctacgtgatggttgttctcaagggttcggtgcctatggcatttggaggtacccaggagccagcagcttacggtgagctggtttccatcggaggcctgaaccctgatgtgaacaagaagcttagtgctggcatcgcttctatcctggagtcaaagctgtctgttcccaagtcgcgcttctacctcaagttctatgactcgaagcgctcggacttcggttggaacggctccaccttctagacttgaggtctgcagctgaaattaaagaaa

SEQ ID NO: 36771 - DNA, 401 bp, Zea mays
  Clone ID: LIB3060-005-Q1-K1-E8
gcgccagctgcggtggcagatctaacgagccgcgtcgaagtggcgaagcaagtctctgcctgcagctacgagacgggcacgagctggggtcaggaggttggctgggtgtacgggtccatgaccgaggacgtcctgacggggcagcgcatccacgccgccggctggaggtcggcgctcctgagcccggacccaccggcgttcctcggcggcgcgcccaccggcgggcccgccagcctcacccagtacaagagatgggcgacgggcctgctggagatcgtcctcagccgtcacaacccgttcctcctatccgcgtccaagcgcctccgtttccggcagtgcctcgcctaccttgtcatcgacgtgtggcccgtcagggcgcccttcgagctctgctacgcgct

SEQ ID NO: 36772 - DNA, 233 bp, Zea mays
  Clone ID: LIB3060-005-Q1-K1-D1
gacccccccttcacactcacctctccacacccccccgccaatggccgattcgccgaaccctagctccggggacctccccgccggccccgggggctcgccggagaagccggtcctggcggatcgacgcgtggccgcgctcgccggcgccggcgcgaggtacaaggccatgtcccccgcgcggctgccgatctcgcgggagccatgcctcactattcccggcgggttcagccccg

SEQ ID NO: 36773 - DNA, 413 bp, Zea mays
  Clone ID: LIB3060-005-Q1-K1-D11
cttcgcttgaacacatacgtggcgaatgtaacataccgagaacactatcttcggtgtcgaaaggctttatgctcaatgcaaggaatagggaaatgttgaagacttgcgcactaagaaagaaagagaaaaggcaatgttgcccctgtagtacttaagattcatatttgcaagcttcatgggcattcttgtaatttcatacatagttatatctcgcccctataaatagagaaacagttctatgcataaattcaccttttccagggttaacaacttcatttaactcagtattcgaagtaccttcgcgctgtttcttgtgtcaagactaaggctgatgcaccactggctaacacattcatatacgtagagtatatccatagggcgatgcatggaagtgacacgggtgcatactacgc

SEQ ID NO: 36774 - DNA, 389 bp, Zea mays
  Clone ID: LIB3060-005-Q1-K1-D4
agctagcatacatcgctagctcactttagcatatatattacataaatattggcatatataaactaaactgaattgaggacgatatggcccgcttggtctcttccggaatcattggtaaggggcacaacatctttgacgatggcggattcggtgaagtccatgctgacccaattaaagtcgagcgtccgcacaagcgtccgccgcagaagcagaatgcggagaatggaacgacgacgaaggttgatgagccaaaggaattgcctaagcacgtgtgcttcaagggagacaacgggctatacctgagcgctcggatggtggaaggctacccctacctgcagtttgcgtcggacgacataggcgatccaagtgtgaggttcaccacgtacaac

SEQ ID NO: 36775 - DNA, 298 bp, Zea mays
  Clone ID: LIB3060-005-Q1-K1-D5
cacagctcccacgctcaccgacgccacagcttgtgcgcgcgcaatggcactcgtgtccgcctcctcgtcctccaccaccgccgtcgcggcgctccccaggaatgggcagcagcgggcgtcgtcgtcgttgttctcctcctcctcctcttcctccttcctcgtcggcaagacgctgctgaggcaggccgaggcagcccggccgtcgttcgccgtgcgcgccgcggcggattccgacaggccgatctggttccccggcagcacccctccgccgtggctcgacggcagccttccccgcgac

SEQ ID NO: 36776 - DNA, 407 bp, Zea mays
  Clone ID: LIB3060-005-Q1-K1-D8
cccacgcgtccgacaagaagctgacatatgcacaacgttctggtctcaatcaaatccccaatcgaagatttaccctgtggtggtcaccaaccatcaatcgtgcaaacgtgtatgttggtttccaggtccagctagatcttacggggatattcatgcatgggaaaatcccgacgttgaagatttctctgatccagatcttccgtgcacatctgtggcaaaagatccatgaaagtgttgttatggatctttgccaagttttggaccaggagttggatgcacttgagattgagactgtgcagaaggagacaatacatcccaggaagagttacaagatgaacagctcctgtgctgatatccttctctttgctgcacacagatggacgatgtccaaaccaagcttagtttct

SEQ ID NO: 36777 - DNA, 420 bp, Zea mays
  Clone ID: LIB3060-005-Q1-K1-D9
ggcaaggggagccactccggcgtcgagaaacctagggcgagcgcctcgacgactcctatcaccccatggcggccttcgctacgggcagcaccacagcgcgcgcgacgctggcatcgccgacttcgtgccagccggccgcgcgccgggcgccggcccgatggatgccgctgcgctgctcgccgccggccctgggcctcaggggaggagcgcgttctcggcggagcgccacgctacgggtggaagctaagaagcaaactttttcttcatttgatgagttgctggagaagtctgagaagccattgttagttgacttctatgcaacttggtgtggtccatgccaatacatggttcccatacttcaagaagtgagtgagaagttaggcgacaaaattcaagttgtgaaaattgatactgagaagt

SEQ ID NO: 36778 - DNA, 412 bp, Zea mays
  Clone ID: LIB3060-005-Q1-K1-E11
cccacgcgtccgccacacaagcacttttacgtcacacgggcgctgcacacagacacaccaagcgtcggcaccaatggcttactaccaggaggtggactactgctcggaggaggtgaggtcggtggccccggccggcttcggccgtcacggctgcggcgttcagcagcacgtcgtcaaggagaagttcgaggaggtcgacacggtcgaacgcgccggagccaaccaccaccaccaccatggtcaccacggtggtcacgggttcgtggctcgcgagaccagggttgaggaggacatcaacacctgcaccggcgaggttcacaagcgcagggagagctttcctcgcaggggtaactgagcagtctgggctggcggcatccacgcccgttcgagcctggctgcgtgccttatgtat

SEQ ID NO: 36779 - DNA, 343 bp, Zea mays
  Clone ID: LIB3060-005-Q1-K1-E12
gatcgatcgaccaataattgcctgatcacgcaggtggacgcaagacggcaagagaagctcgccggtggcggccaccgggaagagaagttagatacctcaccagcctgcgcgcacggaacaatggcgcacgcgaaggccgtcgccgtcctcggcgtggtgatcgcgtcgctcctcctcgcggctgagagccgccacattgcccgaaaagacctgggcgtctgccttggtgggggcggcagcggcggcggtggcggcagcctcggtgtcggcacgggtggtggcgtcggggttggtacaggcggcggacttggggttggcacgggtggcggtctgggtgtcggct

SEQ ID NO: 36780 - DNA, 328 bp, Zea mays
  Clone ID: LIB3060-005-Q1-K1-E3
gaatccgggttcgaccacgcgtcacgcatgagagtcgtggagagagcagtcatggttcttctgtggactcactgctagcacattaatgggtacccgtctggttgaccctgtgacacacaactggcgcatcatgggacggatagagatctggttgccccacaagtcgaattctgcatgcaataaagtgacgaagacatggacgctactatgaccggccgatgtggttccccggcaccgtagctcccgactacctgtactgatcaatggtcggggactactggtaatacccgttcggtgtcagaaagtccttagagttccatcagtttga

SEQ ID NO: 36781 - DNA, 326 bp, Zea mays
  Clone ID: LIB3060-005-Q1-K1-E4
ctttccccaccccgcatcgttggacactctcctaagtccaaaccctctccccgccgcatcggcgccgccggaagcgcctccctcgatccagatccaggagatatgcctcgcaatgatgatcgctatgggaatacacgcttgtatgttggaagattgtctccccgcacccgttctcgtgacctagaataccttttcagcaaatatgggagaattcgagaagtggagttgaagcgtgactatgcattcattgaattcagtgacccccgtgatgctgatgatgcacagtacaacctaaatggcagggacgtcgatggaagccggattat

SEQ ID NO: 36782 - DNA, 351 bp, Zea mays
  Clone ID: LIB3060-005-Q1-K1-E5
gaatcccgttcgaggcacgcgtcacgcgtgcgagatggttcaaatggctgtccttgctcctactggagatatgactgctggcagaagaaccggtaaattgttgcttaatagctgtcacgaacaactagcacatcaaaggaaggatagagaaatggcaaccccacaacttgaattcagatagcaataaactaacgaggacatgttcgaaatgaggaagcacagacttgctgcactgggacaggatctttcgactaccgctactgatcaaccatttggctctactggcacatccacatttgtcgtcagagcattctcagagtatagaggggattgagaaaggctcttgatcct

SEQ ID NO: 36783 - DNA, 427 bp, Zea mays
  Clone ID: LIB3060-005-Q1-K1-E6
acaagtttgggttcattgttatggatggtaatggtactctttttggcacactaagtggcaatacccgtgaagtgcttcacaaattcactgttgacctcccaaagaagcatggtagaggagggcagtctgctctgcgttttgctcggcttcggatggagaaacgccataactatgtccgcaaaacagctgaacttgctacccagtttttcatcaatccagctactagtcagcctaatgttgcaggattgattcttgccggttctgcagattttaagactgagctgagccaatctgacatgtttgatcagcgactccaagccaagatacttaatgtggttgatgtttcgtatggtggcgagaacggtttcaaccaagctattgaattatctgctgagattctagcaaatgtgaaattcattcaagaaaa

SEQ ID NO: 36784 - DNA, 258 bp, Zea mays
  Clone ID: LIB3060-005-Q1-K1-C8
ctggtttcaggctgttcaagagcggagtttacactagcgaccattgtggaactacaccgatggatgtgaaccacgctgttctggctgttggctacggtgtcgaagatggtgtaccctactggctcatcaagaactcatggagcgctgactgaggcgatgagggttacttcaagatggaaatgggcaagaacatgtgcggtgttgttacgtgtgcatcctaccttatggtcgaatgaggccttaacaaagggtaacatg

SEQ ID NO: 36785 - DNA, 432 bp, Zea mays
  Clone ID: LIB3060-005-Q1-K1-E7
acatggttgagatgattgttatggattgtaatggtactctttttggcacactaagtggcaatacccgtgaagtgcttcacaaattcactgttgacctcccaaagaagcatggtagaggagggcagtctgctctgcgttttgctcggcttcggatggagaaacgccataactatgtccgcaaaacagctgaacttgctacccagtttttcatcaatccagctactagtcagcctaatgttgcaggattgattcttgccggttctgcagattttaagactgagctgagccaatctgacatgtttgatcagcgactccaagccaagatacttaatgtggttgatgtttcgtatggaggcgagaacggtttcaaccaagcttttgaattattctgctgagaatttagcaatgtgaaattcattcaagaaaagaaat

SEQ ID NO: 36786 - DNA, 339 bp, Zea mays
  Clone ID: LIB3060-038-Q1-K1-D12
gtcgccatgtacgaccagaacacgcagcgcagacgtggcttcggattcatcacctgtgactgctaggacgctcttgaccacgtgctgcacaagaccttacatgatctcggaggcaagctggttgaggtgaagcgcgcattgccccgtgaggcgaaccactgaggctctggtagtgaccgtatcagagcgagtggcagtaaccagaacagcaatggccgttacaccagctcagatagctacgatggaagaagcgatcgaggctggtaccgacatgctcagcaagttattgaactcgcatcatgactacagtgctgaggcagactcatatggatatgatgc

SEQ ID NO: 36787 - DNA, 281 bp, Zea mays
  Clone ID: LIB3060-038-Q1-K1-D3
gctcgaggaagcggggttccacaccttcgaatactacaagatccttgccgtcgggagcgatcttcatgttcgcttcgcccaggttcccgaagctactgatttccgcaacacggatgctgcacgtgagattatgagaggtatataaatgaaacctatttctgtcttgttaggatgacaattgttgtccaattgaagggattcgagccaagattggcaattgttgtccaattgaaaggatttgagccaaatcttgggtttaatactggaaatgaatagctttt

SEQ ID NO: 36788 - DNA, 209 bp, Zea mays
  Clone ID: LIB3060-038-Q1-K1-D9
tcttcctctgcagagttattagaatgccacttctcagggttgaaggctctggagaatgaatagacttctgttgaaattgttaagcacggaacagaaatagttcatagagctgtcaccaaatcattccagtccctacatgaaccttacaaagggaaaattgtcggtctgttaatatccacatttgaggctccataatccttaggacccat

SEQ ID NO: 36789 - DNA, 296 bp, Zea mays
  Clone ID: LIB3060-038-Q1-K1-E9
aaaaaacaaaaacaaacaaacaacaacaaaccaaccaacacaaaaccaaactttaccaccaaacccaaaccaaccccaaaaaaaaatcaaaaaaacccaaaaccacccaacaaaaccaacacacaccccacacaacaaacacacaaccaacaccaaccccaccatcaaaacccccaaacccaccaacaaacaccacaacccacccaaacacaaaacaaccacacactaacacccacaccaaacaccccaaaccaaacccccccaaaacaccaacacacccaaacccaccaaaaaca

SEQ ID NO: 36790 - DNA, 306 bp, Zea mays
  Clone ID: LIB3060-038-Q1-K1-F4
cacgcgtccgctgctacactcgcacgcagcccaactgacaacagtcaatagcccaagtgccctgtcgtcgtgtccacgccctcagcgaaaccctagcactcggtcgcgcacaggcacaacgcagcgcactcgcgccgtcggcattcagccgtcgcggactcgccgcccacccaggtcccaggctgggagagtggcagacacccactccgccactcgtcctcagccaccgaccaccgtccgtggttccccgttcgccaccggccaccgccagtccaccaccctcccggcgcgccgtgcccctacttc

SEQ ID NO: 36791 - DNA, 196 bp, Zea mays
  Clone ID: LIB3060-038-Q1-K1-A11
taaaaaaaagctagaccccccaacaaacaacaccaaccacccaaccacactacaccacaacaccaccccaaaaaaacaccaacaccccaacccaaactaaccaaaacaaccacaaaaaaaccccccacaccaccaaacaccaaccccaacaccccaaaccccaatccaacccacatacacaacacaacctacccaa

SEQ ID NO: 36792 - DNA, 280 bp, Zea mays
  Clone ID: LIB3060-038-Q1-K1-A3
ggccaagatccaggacaaggatggcatcccttcagaccagcagcggctcatgtttgctgggaagcagcttgaggacgggcgcacgcttgccgactacaacatccagaaggagagcaccctccacttggtgctgcgcctcaggggaggcatgcagatcttcgtgaagaccctgaccggcaagactatcaccctcgaggtggagtcttcagacaccatcgacaacgtcaaggccaagatccaggacaaggagggcattcccccagaccagcagcggctcatc

SEQ ID NO: 36793 - DNA, 290 bp, Zea mays
  Clone ID: LIB3060-038-Q1-K1-A6
cggacgcgtgggcgcgtggctgctcttccagtactgctcacgccagcacaacaggggtcagccaacacttatcctcaactccagctcgcccagcccctctctgtttgtggcgtgctccagtttcccatggcgtcggtcctcaacctctaggcaccagtcgcccctactccctgctcctgttcctcccatggtgtcccagtcaagtttgccctagccctctccctcttggttctttgctggtcacgctcctctccatgggcgcccaggtctcttccccgtggtggcagacc

SEQ ID NO: 36794 - DNA, 290 bp, Zea mays
  Clone ID: LIB3060-038-Q1-K1-A8
gcacaccaaggagagtacgtggaggagcagccatggcttcatcggtggccgccgcggggagcacattcctgggcacccgcctggcggacccggcgccacagaacgggcgcatcgtggcccggttcgggttcgggttgggcggcaaggcgaagcctgctccgaagaaggtggcgaagacatcgacctcctctgaccggccgctgtggttccccggcgccgtggcgcccgactacctggacggctcgctggtcggcgactacgggttcgacccgttcggtctcgggaagccc

SEQ ID NO: 36795 - DNA, 199 bp, Zea mays
  Clone ID: LIB3060-038-Q1-K1-A9
acccacccaaaaaagatttcaaacaaaaccccccccccccaccaacaccaccacaccacccaccccaccaccaccccacccccccccccccccccatacaacccccaacccccccctccccacaccacccccaaacccaccaccacaccacccccccccacccccaaacccaaaaaccacacacacacccccccccaac

SEQ ID NO: 36796 - DNA, 450 bp, Zea mays
  Clone ID: LIB3060-038-Q1-K1-B11
tcccgcgtctactccacttcttcctctaggactaactgctaccccctctcctttccctcgccgcctactcctctccaattctactttaccaaccgcatcagcgagagctagactgataatgaccacttcaccttcctcactcataacctaccatctctactacctttacaactctcaaacacattttttctataatcaatctatataatatcatttccattttaatactattataatatccatatcattctttcttcttttaccatatttcttttttttattcttttattttttttttatttttttctatttattatatttttattctgtttttttttatttttttcttttattatattttattatatattcttttttctatttattttttcttcattattatatatttatatttattttaatatttttttataattttttatatttttt

SEQ ID NO: 36797 - DNA, 319 bp, Zea mays
  Clone ID: LIB3060-038-Q1-K1-B2
attcccgtgtgttgttggtgttggagcgtccagagttcgtgaccttttcaagtaaggccaaggagaatgctccttgcatagtgttggttgatgaaattgatgctgttggaaggcaaagaggtacaggtattggtggtggaaatgatgaaagggagcagactctcaatcaactactaactgagatggatggtttcgagggcaacactggaattattgttattgctgccactaaccgggctgacatattggattccgctttacttagacctgggcgttttgatagacaggtgtctgtcgacgttcctgatgtacgtggaag

SEQ ID NO: 36798 - DNA, 282 bp, Zea mays
  Clone ID: LIB3060-038-Q1-K1-B3
gcgcggcggctggtggtggtgaggataacctggagctgataccaggtgtcatggagcttctgtccatggggatatctgtcttctccggcgaggttatatccctctgccgcaggcttggttctagggtagcagcgctaggcgcttgagagtcattgcaagagagagagattggtttaataatatattcctccttcctttgcctcctgcgtacaggcctatatataggccaccggttgaccaactaggcaaccactaattaggcaagtgactaattggaattat

SEQ ID NO: 36799 - DNA, 111 bp, Zea mays
  Clone ID: LIB3060-038-Q1-K1-B4
actgaaaaccccttcattacccaacttaatcccttcaccacatcccactcaccccatcatccatataactaaaccacccacaatcccctacccaacaatcctcactcacaa

SEQ ID NO: 36800 - DNA, 293 bp, Zea mays
  Clone ID: LIB3060-038-Q1-K1-B6
gtgtaacaacattgctcattgcaagacttgaccatcgagaagctattgcccgcggggctctgctgaaactcataaaggttgtctatgagcaccatcctcgaccaaaacagctcatagtagagaatgacctccctcagaagctacagaacctcattgaagagcgcagggatggacaacggggcggccaacaagtgttggtcaaacaaatggccacctcattgctgaaagcgctgcacatcaatacagtattgtgatattggtggatcatatgttttcctctcaagttgtatatg

SEQ ID NO: 36801 - DNA, 289 bp, Zea mays
  Clone ID: LIB3060-038-Q1-K1-C1
gtagaaggccaactgatcatgtgtttgttgacgaactaaacattgtcaaattcggcgatattatcttccctaataaagtattacatgtcattgatgcttccttatgtgatgactttaacagtgcccaaattaacattgttacctagcctgagacctacccatgcttgatttctctactgcaagtttcactttcttgcacacgtgagattcctggttaaccaacgaccattgaagaagcagctcgcagaattggttcaatccagaccacatatgctagaagaattgaaaa

SEQ ID NO: 36802 - DNA, 431 bp, Zea mays
  Clone ID: LIB3060-037-Q1-K1-H9
aattcccggcgggacgcactcgtccgctgccttccgcggactagttttttctgtatatattcggcgatggcggcgactatcgaaggcgtgaaggcgcgccagatctttgacagcctcggcaaccctacagtcgaggtcgacgtgttttgctcagatggaacctttgcaagggcagctgttcccagtggagcatcaactggtgtatatgaagctctggagttgagggatggtggctctgactatttggggaagggtgtctccaaggctgtgaacaatgtgaattctgttattggacctgctctgattggcaaggaccctacagcacagactgagattgataacttcatggttcaacaacttgatgggaccaaaaatgagtggggatggtgcaagcaaaagcttggtgctaatgcgattctggctgtgtcatt

SEQ ID NO: 36803 - DNA, 277 bp, Zea mays
  Clone ID: LIB3060-038-Q1-K1-C4
caccagccagcaccatggtcacttatactaccacatccaacgtactgtcccagtcggtttttaaccaatcttagcctggcacctactccccaatcgcacatgaagttcctaacggcacacactcggccaaccgagacgacacacgcggatattagaacgtctcatactataaacctaaacacaggcatcactaacttactatgccaaaaattcttctataacttcaaacaagagaacttatcaaagcatgtacacaaacaaaatatcaatacacaat

SEQ ID NO: 36804 - DNA, 294 bp, Zea mays
  Clone ID: LIB3060-038-Q1-K1-C8
atcctcggcgtcgtctcctgtcctctccacgccaagcaacctccccaccccgcgccgccctccatgctcgcctcgagatcttagcgggcagctccggagagcgccgacgagccccctgatccctcctcgccgccgccgccaaccgaccgggggaggagaggaggggaggggagcgatggagaccgccgactactccgggaagctcttcgtcggcggcatctcatgggagacggacgaggaccgcctccgcgagtacttcggccgcttcggtgaggtcactgaggccgtcatcat

SEQ ID NO: 36805 - DNA, 263 bp, Zea mays
  Clone ID: LIB3060-037-Q1-K1-F11
ctagcctatagcttctatgaacctctcgtgtctgcccgcacaagcatagccaccagtctccatagctctgccggtggcgtcatgaacttccgctgcccctgccgctcagactatgccgctgtaagtatccatacaatgccatggatgcccgaacaaggttcggaatgcgctcaaccccatctcatgcctgcacgacgtctctacctacgcctagtatcacacgatgactgtaactatctcactggacacctactcgctcatta

SEQ ID NO: 36806 - DNA, 240 bp, Zea mays
  Clone ID: LIB3060-037-Q1-K1-F4
tccatctttccatctatctcagtcgctttcaaaactcagcacgcatcactataatctatatatcattactcaaatacttaatctatacatctatcttcatcccctttcttattcttcctctttatatatattttcacctaatctatttttgcaaaatatccttcatctcttacctctattcttatctcctcttccttcctttcacctccaccttcatatctatactatctatatattaaa

SEQ ID NO: 36807 - DNA, 329 bp, Zea mays
  Clone ID: LIB3060-037-Q1-K1-G10
tcccgctggacccactcatccggttcctaatggtggtttcttggcttgtctgactacaattcactcaaattgaagatagaacttattcacacatatggcaggcacagcaatcaaagcacgaatctgacgtagactacgaccaccacgctcataacaaccaaacctcccaaataccatccactaactaaagggaaggtcaatactctaataacatcatcgcctagtaccatgctatcaaccccaactgccgccaccatcaccatactccacgatctcttacttcacctcttctactccatcattcagaatccttcctcctctatccgact

SEQ ID NO: 36808 - DNA, 368 bp, Zea mays
  Clone ID: LIB3060-037-Q1-K1-G9
caaccacatctatatgccactaccctaacacttttcctccacagctctacctttcctcgggggtccacttactacctcagctcacccctccaccttccgtcttcttccgcctttaatcacgccctcctcaccattcacatgactcactctaaatcctacccatccaacacgtcctctaccactacataccacccctaccgcactcccttcctcggcccactcttccactaaccacccatctacctcactaactatttaaccatctactacatactattcacctaccttctttcatccaacccacaaactctcacacacaacctacatctccatgtaatccactcccactcagacattcttgtcactct

SEQ ID NO: 36809 - DNA, 369 bp, Zea mays
  Clone ID: LIB3060-037-Q1-K1-H10
cctcttccttctctcatctatctccttagtattattcgatcaaggcgactacgatggaagagctcttataaagcctggtcgtcaacaactacttcaaccttactcatcacttcaacttcttttactaatattgaaccttcacaacaacacctttttacacttcatcattaactgacgtatattaacctctgaacttcaaggataacatctccgactattctcttaaacctgtctccaacgttataaacaacttcaattctattattaaacctgctctaattttcaattaccctacttcacatacttacatttataacttcatgtttcaacatctttattttaccataaattactttatatttttcattc

SEQ ID NO: 36810 - DNA, 255 bp, Zea mays
  Clone ID: LIB3060-037-Q1-K1-H12
tttccatatacacatatcatctctctgctgggagtcttaaaaaatctcgaccactaccataatctttatctctttcatctaccctattctcttctcctacctcttccttctcttaatctaccaaatattcatttaatttataaattacatttataccttcttctaataccttttatccaaatttcaattctttcttcaatcttttttccaaaaatatcttatacttttcttcctcatattgatataaaaactttc

SEQ ID NO: 36811 - DNA, 393 bp, Zea mays
  unsure at all n locations
  Clone ID: LIB3060-037-Q1-K1-H2
cttcctcagctcgctcccggccggagctccctgctgctctctcctgctcagccgcctgccatggagctcgccgagccctcccgagtcgaggcccctgctcccagcgtcacgatccccagctcctctgctcactcggctgctcgcgccgtcgccttgctgctcgcccgtccgcgcggcacttcgtctatggccgctgtccgccgtcgagttcctgtacgcgcgcctctggttcgccattgctctctgcgcgcgcgctctgctcggcgtctccatctcctcctgtgctccagctcgctgtcgggacggtttttcccatggccggcgatgctccagtcctctgcgcggcggtactccctgccgagcacctnccagccgaggcccttgtcttccatg

SEQ ID NO: 36812 - DNA, 187 bp, Zea mays
  Clone ID: LIB3060-037-Q1-K1-H7
gctagttctgactcatcggctccctttatctttttttttattctttttttttttttttgttggtttttttttatgttgggttttttttttttttttttttttttttttttttttttttttttttttttttttttttttttttttttttttttttttttttttttttagatctttaatcatttttttt

SEQ ID NO: 36813 - DNA, 313 bp, Zea mays
  Clone ID: LIB3060-037-Q1-K1-H8
ctcccacgctcaccgactccacagcttgtgctctcgcaatggcactcgtgtccgcctgctcggcctccaccaccgccgtcgcggcgctccccaggaatgggcagcagcgggcgtcgtcgtcgttgttctcctcctcctcctcttcctccttcctcgtcggcaagacgctgctgaggcaggccgaggcagcccggccgtcgttcgccgtgcgcgccgcggcggattccgacaggccgatctggttccccggcagcaccccttcgtcgtggctcgaccgcaggccttccggcgacttcggctttgatccctgggg

SEQ ID NO: 36814 - DNA, 128 bp, Zea mays
  Clone ID: LIB3060-005-Q1-K1-B1
aatttccggctctccttctcccacacgcacgtctcctcccacgcgcacggccttgccgtcccgaccgcgccgcccccggcgggccccggcccgaccgccgcccgccccagctcttccgaccgcgcccc

SEQ ID NO: 36815 - DNA, 353 bp, Zea mays
  Clone ID: LIB3060-005-Q1-K1-B2
catctccttcccttgacgtgctcgcccaggtcgcgcgcgtccagctcgccggccgaactccctcagcttcgtcttcaaccaccgccgaccccatggtgagctcgcacaaactccatctccctgtgcgccctttgttctgctccaaccgttctccacgccgtgttccccccccatggctccccttgcctctccggtcagcactagcccgaacggtatagcagcataccggtgccaaacccgtgttcgcgacgcttgccaagtgctcgatgaaataccgcagtgagctccacctcgagttgtgcagccccaacccgcgacgttgcaacacccttgccctccgtcgatgttgcgct

SEQ ID NO: 36816 - DNA, 117 bp, Zea mays
  Clone ID: LIB3060-005-Q1-K1-B4
cattctccttcccttgtcgtgctcgtccttgtcttttcgcgtccagctcgcctgccgtaggccctgtacttcttcttcaaccaccggcgaccccatggtgagctctcacaaactcca

SEQ ID NO: 36817 - DNA, 366 bp, Zea mays
  Clone ID: LIB3060-005-Q1-K1-B5
ggccaagaataacagaccaagagctgcaacaaatatctggagattcaaattccacaatcgttccattgttcgagaaggtcctgagtgcgagtgatgcatgccgcatagggcgccttgttcttccaaaagcttgtgccgaggcatattttcccccaatttctcaaccagaaggacgccccttgacaattcaagatgcaagaggaaaagaatggcattttcagtttaggttttggccaaataataacagcagaatgtatgtcttggagggtgttacaccatgcatacaatcattgcaattacaagctggcgatacagtgacctttagtcgtatagatcctggagggaaacttgttatgggctttcgga

SEQ ID NO: 36818 - DNA, 419 bp, Zea mays
  Clone ID: LIB3060-005-Q1-K1-B7
ctccaatctccatccttccatcttccgctcccttccctgcttgcgctcggcacgcaggcgacctcggcggcgcttgggctcggcctctcagcgacggcgtcagcagattcccctcctgcctctcgccagtcccctcgcctctggtcctctgcgaaccggccggtgactctgcgaaactattccagcacaggtacccaagtatggcggcaagacgcaatgttcggtactcgcctcttccttcagaggacggggatgacagcaattttattaaagaagatgttgacctccgatacacttacactccgaaatcgtacagaaggatcccatggaagtcaattgccctggcattgttcctgctcctcctaggaacttcacttctctttctttcttacttcatattcacaggtcacatggaaggt

SEQ ID NO: 36819 - DNA, 340 bp, Zea mays
  Clone ID: LIB3060-005-Q1-K1-B8
ctgaacccaaactcataccgtaagcagagtacactagctgttcgtgatcagggcgtacgtgacagtcagccatggtgatggtgtacatgatggcgacggaggggatgaacgtgaatgatgagtgtcagcactggtttatggtgatgaagtgtaagaaggtgcaccggtctgtggtgtacaatatcgacgagcggtcgcacgcattgctggtggacacagtgggcggtcctggggatgggttcgaggagatcgtgatcacactgatctgcttcaactgcatgtacaccttctttgaattcaacttcgtaactgttgacaactgatacaagagcaagaaatt

SEQ ID NO: 36820 - DNA, 428 bp, Zea mays
  Clone ID: LIB3060-005-Q1-K1-B9
caagatgtttgtttccattccatcggtggcacgagacaggagacgccaaggccatagctagagcctagagcagcagcagaggcttgacctgaagctccacccgccatggcattcacgcccgctacggcctgctgcaaggcttccctggcgctggcaccgcgggcgtcgccccgcggcccggcggcctgcgcgcaggcggcgctcctctgcacgccctccacctccgtgttccgcggcctccgggcgcccgcatccgccgcgccggccccgcgccggcgccgctcggcggcgtccacgggcatagtctgcggcaaggtacgtggcctcgggaatggcgtgcgtgcgtgcgggaatccgtgttccacacatggcggtgattggtttggtagccgtggtcgtctcctcgttgcaggtcgccaagggcagcg

SEQ ID NO: 36821 - DNA, 337 bp, Zea mays
  Clone ID: LIB3060-005-Q1-K1-C11
cggattccgggtcgcccacgcgttctgtgagcctgctgcgcttcttcgccgtcccgtcgtgtcttcgtccgtagatcagatagcggggaggaagaaaaagcgatcgatggcgtccaactacgtggacacgacgggcgaggagggacggttccacggccctcacagccacagcaccagcacgaccccgacgggcggcgcggcggcggcggcggcatcgccgcgcaacttccggcgcagcttctcctccgcgtcctccgcgggccacagccacggcggcggcggcggcaggaggcggcagcaggcgccctcggccgcgtcggtcgtcgcggggattccg

SEQ ID NO: 36822 - DNA, 379 bp, Zea mays
  Clone ID: LIB3060-005-Q1-K1-C12
cggcgcgtgggttctagtccttttcattgcaccgtgcgaagaaggacccggcgaacgcgcagaggctcaagatcgaggccggcgtggcaacggcggcggcgctgggcgccggcggctacgcgtaccacgagcaccgcgagcagaaggaggcccactacgagagcaggcagcaggagcacagggtgccgcacgggcacgggcacggctactcctactactgcgactgaaacgactgatcatcccatcgatcgagatatgcatgcagaactcgatatatatacggtccctagcgccgtacacgtgcgtgcgtggtagtaaataagagcaaacgttgtcacgtgttgtgttgctcgatcactacttcatcgatctacttatt

SEQ ID NO: 36823 - DNA, 400 bp, Zea mays
  Clone ID: LIB3060-005-Q1-K1-C2
ctgatgaatcgctggtgaattacttcaacggtgctgctagcattgggagcgtaccaagtgcacaaatggctggcagagcacatccatcgaatgatacggtcacaccttcccatgtgccactgattgttccatctgctactccaacacatcaaatgtctcatcctttagggggttcatctgctccaccacttcctctccatgacacaaatccgcatgccagtcagtctgcaaatcttctaacaccagctttctttgcaccaccaccaccctcttcaacatctgtgacaccacctgcttcatccatgatgcctacagcaccacctcttcatccgacttcaacagctgctcaacatccttcatatggcacttccttacttcaacctttttccgcaccgttttc

SEQ ID NO: 36824 - DNA, 306 bp, Zea mays
  Clone ID: LIB3060-005-Q1-K1-C4
ttctatctcaagatgaagggtgctactacaaataccttgcttgagtcaagactggagctgagagaaaggacgctgttgaaaacaccatggtggcatacaaggctgcccaggacattgctttggctgagcttgctccaactcaccctattaggcttggactggcactcaacttctcaatgttctactatgagattctcaacttacccgatcgcgcctgcaatcttgcaaagcatgcttttgacgaggccatcttggaactggacaccctgagcgaggagtcctacaaggacagcactttgatcatgc

SEQ ID NO: 36825 - DNA, 392 bp, Zea mays
  Clone ID: LIB3060-005-Q1-K1-C5
gcgaataggaacattgagaaagaaagacgtgccgacttctataaccaaccatgggttgaagacgccgttataagatacttgaaccgcaaaccggctaacgagggcctaggtggtggtgctggtggttcttgaggcgtggatttctcctagctattttagtgtataaacaaattatctgttctgtattggcagtaaatttcaggcgtattagtgaagataattgttcagtgttgtgaaatgatgttcaggctagtcattgtatgtttatggtgtgttctatattgtcaagtgctgaactgaaccgtaatgttgcttggtgtggccctgaaaatagtaagcctaaatcacattctaaaaaactggaatgcaggatttgatagtagcctttccat

SEQ ID NO: 36826 - DNA, 374 bp, Zea mays
  unsure at all n locations
  Clone ID: LIB3060-005-Q1-K1-C6
ggaagaagggcctcctgtatcctctcacttccctcagtcctcgtccgtctgctccctgctctctctacctagctctagctagccttcctgtagcgcggcagagatggctgcccctgcctccaccacggcggcggcggcggcagcgctgctgctgctgctcctcctgtcgctcgccgcggcggcggacatgtcgatcgtgtcctacggggagcgcagcgacgaggaggcgcggcggatgtacgcggagtggatggcggcgcacggccggacctacaacgccgtcggcgaggaggagcggcggtaccaggtgttccgggacaacctccgctacatcgacgcgcacaacgccgncgtcgacgcgggcgtncactcct

SEQ ID NO: 36827 - DNA, 306 bp, Zea mays
  Clone ID: LIB3060-005-Q1-K1-C7
aggagacgtacgctctctgctagcacccatcttgcagcaggcggagccgcccgacccgatccgtgcgtgtgtgttggtagagatggctacagcagcttacgctcccatggcgagccaggtgatgaagagcagcccggtgcactcgaggccgaggggcctgtcaggcgctgcgctcacgcggccccggccccggttcagcgtcgtcaaggccgccatccagcccgagaaggcaacgtaccaggtggtgcagcccatcaacggcgacccgttcatcggcagcctggagacgcccgtcacctccagccc

SEQ ID NO: 36828 - DNA, 372 bp, Zea mays
  Clone ID: LIB3060-004-Q1-K1-G9
caaggagtgcaataagatcgtaggtcacgtccagcagtgcaagaggctggttctgcaagacattcccctcatcttggtgaacggtgagaagttcctcgagaagaacgatgtctgcgcgctcgcacaggcttgtccagcgagcagtaggaagacgttcagctcgatgttgaagggagcgttgtggagtgacgcctggcttgaaggttgaagaagaacacacggagcggtttagcagtggtcagaaatagtgtgaacaagtgctgtgctgtacatataataatgtcgtgtataaacgcatgaaggacgtgtgccctgcatacttttcgtcttgtatcataaattcattaacacgtctacttaagttattgttta

SEQ ID NO: 36829 - DNA, 212 bp, Zea mays
  Clone ID: LIB3060-004-Q1-K1-H1
atttctctcgaggtctgcacactcgtctgctaccgagaccgttggcggccatcgtcgcacacgctgggctgatgctaagtagcgagggtcacacgtgctactactacccggacgttgggacgagacggaagctatgcgccgggagaaacgtcttgcgagagaccgccccgcgtgacgcataggctgattcctgccgtcacggcaagaggaag

SEQ ID NO: 36830 - DNA, 282 bp, Zea mays
  Clone ID: LIB3060-004-Q1-K1-H10
gctatttggtgcttgaatgtgactgttctttttactttttgctaagccttatttaaagtttgtataccatggaatatgtaggatttgtccagtcattttagtgctgagggggtctttgtgtttttgttgcagttttcctggtggctcgttttgtattgtaagagggcactcactgacataagtactaaggcactaagagaaaatacacacagataagtatttataagatgcttgtgatccatagcatgatttttgtttcgttttgtaagagaaaaaaattac

SEQ ID NO: 36831 - DNA, 400 bp, Zea mays
  Clone ID: LIB3060-004-Q1-K1-H12
atttcagaatctctctaggggcacaaggactcaaggggttcagcctccattttcaaggaaaggcagtatggtctcagttctgagtggcaggaccaccctgagcttggagtgttgagaagcaagtggtggcaccttctggtgtcattaagacttaatgagcccatcacaggtcagggaatggaactaggagtcgggtggaggtaatcgagtggggtgaataatgcctgctgttcaacagcagctgcccagcgtcccaggggactcccatgggccactttaacctaaaggggaactgcctttatgggcctgtcgtgtctcatcacagcacatttctaagttggaagagcctcaacttccacggctaaatctgaacttactgtttgctcagtgcttggttcca

SEQ ID NO: 36832 - DNA, 356 bp, Zea mays
  Clone ID: LIB3060-004-Q1-K1-H2
gtgggattaggtattggtgccacaccttttattagcatactgaaagacctgctcaataacatcatcaaaatgggggaagaggaagaagcttcaagcatacgaaacaaccaataaagcgttaccaaaacttttgattgacggaccatatggttcttctgcacaagactacagcgagtatgacgttttactacttgtgggattaggtattggtgccacaccttttattagcatactgaaagacctgctcaataacatcatcaaaatggaggaagaggaagaagctttatgcgatctttacccaccaattggtcgcagcaaggcacatgttaatcatgacacccttatgaggattacct

SEQ ID NO: 36833 - DNA, 105 bp, Zea mays
  Clone ID: LIB3060-004-Q1-K1-H3
gcttaacattggatgtctgacatacggtgagaaagctatgaacttatcagaatctgtagatcaagcggatgagatcacaaaggcactgtctacgagttcagaaca

SEQ ID NO: 36834 - DNA, 101 bp, Zea mays
  Clone ID: LIB3060-004-Q1-K1-H5
cgtgaggcggttatcaaaggcatggaccataagggtttgcctataatgttattcagcaccgattatgcatcatacgaagccagtttcgatgctggtgtgcc

SEQ ID NO: 36835 - DNA, 443 bp, Zea mays
  Clone ID: LIB3060-004-Q1-K1-H7
agccataccaacaagtcctatattattgttcgctaatactggaggaccaaacatggccatgggatgaggaattttctgcactttctcaccttgaagctagtgatctgggaatttttttgccccatttgctatcaaaaaccttcatcgagtgttattttgcaggtaatattgaacccaatgaatcaaacaatatcgttcaacatgttgaagatgtcttattcaatgcaccaattagtgcttgcaagccactatccccatcgcagcatcttgccaagaggattgtaaagcttgagaagggtttgagatactattatccagcaatgtgctcaaatcaccaagatgaaaattctgctcttctgcactatattcagactcatcaagataatgttaatcaaaatgatctacttcaactacttgctcttggtggcaagcatccagctttt

SEQ ID NO: 36836 - DNA, 128 bp, Zea mays
  Clone ID: LIB3060-004-Q1-K1-H8
gcagtcggcagcaaactgaatggcgcttctcgctgtggagcttcggagattccttcttcggcaaattgtctgctgctaggcggtcctgccttctatcgcgtggcgcggtcgttctgctagctcatccg

SEQ ID NO: 36837 - DNA, 95 bp, Zea mays
  Clone ID: LIB3060-004-Q1-K1-H9
atcgctagcggacaccttgaccttcattttcccttttgatcacacccttccagcatgtgggcatgggcaacattccactgactctaggcactatc

SEQ ID NO: 36838 - DNA, 334 bp, Zea mays
  Clone ID: LIB3060-005-Q1-K1-A1
atgagcaagcactggcgtcatgtgatgctatgcatcgtgagaggagaactcttcttaagcaggaaattggaaggatggatttatttttcactgatcaacctagcctgctagcacctaatattcagatggttgtttctgctcttgctttgtctcaatgcgaggcgatttggcactttcaacatgtgcggattgcatcatcaaaatctactcgattgaaaactggtgacattgattcgacagacccaactattggtttcttactagatggaataagcaaactttgttgactggttcgtaaatacataacagtgctggaagaataccgttcttactt

SEQ ID NO: 36839 - DNA, 424 bp, Zea mays
  Clone ID: LIB3060-005-Q1-K1-A10
gtcacttagcttcactcggcaaagaaaagaggcaacgacgatggctgctgcggcggcgatgatggtctccggaggacgggcggcgctggtggtggcgggcgtgctctgcgcggtggcggccatggcggcggcgcagcaggcgtcgaacgtgcgggcgacgtaccacctgtacaacccggcgcagaacgggtgggacctgaaccgcgtgagcgcgtactgcgccacgtgggacgccgacaagccgctgtcgtggcggcagaagcacggctggacggccttctgcgggcccgccgggcagaagggccaggccgcctgcggcaagtgcataagggtgaagaaccgtgcgacgggcgcgttcatcgtggcgaggatcgtggaccagtgcagcaacggcggcctggacctggactacgagacggtgttc

SEQ ID NO: 36840 - DNA, 378 bp, Zea mays
  Clone ID: LIB3060-005-Q1-K1-A11
gtaggcgcgcagatgatgggcgccgaggtatttctccttctacgcggagaagtttgcaggggcgttcttcatgatcggagtccgcaacaagagcatggaggaggcaatgcatcctctccactccccgtacttcgtgatagatgaggacgttctgcctgtaggagctgccttccactctgcagtagcgatggagtacctgaacaaatactcaacgacccggcaaactgagctgctgcgcattgagctgtgatagattattgcttgtaataagggttaccatgccgaggtcatgttgcacaaaagaaagtctgcattgtgcccatggaataaatacagtttctccaaaaaaaaaaacataaaaaaaagaatatataatat

SEQ ID NO: 36841 - DNA, 421 bp, Zea mays
  Clone ID: LIB3060-005-Q1-K1-A12
cttagaaaaaaattggaatttatctattcctggtttctcacggggggataagaatcctcaaagaaattctgcaaagcaactggtagatccccaacattcagaaagtgatgttactggtatcagaggcacaagcaataaacttggtgctaatatctcggttggaaatcatcaaatacgacctacgatggcagaaccttcatcaatgccaacaatgggccctctatcaaaagcccctcgcttctagtggttatgcttctcttccctatcgaaggaaaaattccttttcaggacaatctacctggaaaacaacccgtatgctctaactcaaggattgctagcaagtggaagcacaataaatccacgagcatctgtggcaaactgcagatgcttgtcttacagttacaggaaagcagttgctgac

SEQ ID NO: 36842 - DNA, 390 bp, Zea mays
  Clone ID: LIB3060-005-Q1-K1-A2
ctgcagtccatttgctactactccgcgcccaaaaccaagcccaagctcaatagcctcgacgaggtcgacccggagctgctcaagaccttcgaccgcctcggcatcccgctcaccgagcagaagcgcctctccaacgtcgccgttgacgccgtcatcgactccacctccatcgccaccacccaccgcgaagcgctcatggccaagggcgtcatcttctgctccatctccgaggccatccgcgagtacccggaccttatcaggcgttacctgggcagcgtcgtaccgccaggcgacaactactatgccgctctcaactcagcggtgttcagcgacgggtccttctgcttcgtgcccaaagacacagtctgccccatggaaatctcgacctac

SEQ ID NO: 36843 - DNA, 311 bp, Zea mays
  Clone ID: LIB3060-004-Q1-K1-G6
gattcctctcccctcgcctcctcgtctccccctaggggatcgtcggagaggaatcgcagagagggccgtctcatccgagttaaggaagccatggagcacaaggaggctgggtgccaggcccccgagggacccatcctctgcatcaataactgtggcttcttcggcagcgcggcgaccatgaacatgtgctccaagtgccacaaggagatgataacgaagcaggatcaggccaagctggctgcctgctctatcgacagcatcgtgaacggcagcgacgccgtcatggagccggttgttgctggcagcaacac

SEQ ID NO: 36844 - DNA, 225 bp, Zea mays
  Clone ID: LIB3060-005-Q1-K1-A4
agaagctgtgtttccgtccctaccgtgagcttctgctagcggggtgcctgcggaggagagactgggatgccatagacagtggtggcattgtgaacacgggcggagtcaatgactaccccgggaagcttaccctcttcatggagatcacctgcatcgtcgacgacaccgggggtctcattttcggatatgacatcggtatcttaagcggtgtgacgtgcatgaacc

SEQ ID NO: 36845 - DNA, 157 bp, Zea mays
  Clone ID: LIB3060-005-Q1-K1-A5
cgttaaactaatgatcgtagcctacacttttccttctaatgctatctatatatgcttgagtttgagtagggttgtctccagaaagctagattgttacttatatcccacacacttgcgcgcacgcaacccggcctttgtccctttattgcctctcact

SEQ ID NO: 36846 - DNA, 423 bp, Zea mays
  Clone ID: LIB3060-005-Q1-K1-A6
ctcagctccgccgcttgcccgcttttgctctctccctcccggctctcggcttcttctagacgctaccgtctcacagccgtaaacgcccctcccggatcccgctagttcgccaccgccgcccgcccgcccgccgttcgcctcatcatggccgcctcgtcgaccgccacctccgtccacgacttcatcgtcaaggatgcgagcggcaaagacgttgacctcagcacctacaaggggaaggttcttctcattgttaacgtcgcatcccagtgtggcttaactaactccaactacactgagctggcccagctctacgagaagtacaaggaccaaggctttgaaatcctggctttcccatgcaaccagttcggtgggcaggagcctggtaccaatgaggagattggccagtttggctgcacaacttta

SEQ ID NO: 36847 - DNA, 464 bp, Zea mays
  unsure at all n locations
  Clone ID: LIB3060-005-Q1-K1-A7
cgcggcagagatcttctttgctccacgctgcttggagtcgactgtgtcgggtcggcattcgtgcgaagagagggtagcagcagtacccgttgttctatccgttatttgcttaggnngctgactgtcctgcatcggactccannaactgaagaggctcaacgtctttaccaatgaacgcggctgaagcattatcaaaggttcttattttcagatggccatcgcctcggattggaacaagnnccaggcagcggcggcccgaaaggggtctggacgatgacgatgcctcgtccgtggactctgccaagacctggagccatgaggagaccccgacaccgctgaggcagaggtattccaggatcggctcgctgttcaacaagcggacctacgcagcaggcaaggcttcacctagcgaagcagtgaagaagggtggagtggtacaaccagctggttctactttactttcg

SEQ ID NO: 36848 - DNA, 151 bp, Zea mays
  Clone ID: LIB3060-004-Q1-K1-E2
atcagcggttgccgcctcatcttccttctctctcgttttggcgcaacttccttgccccgccgccgggcgtctctccaatgtagcggccgggaaagaagagactaccaccagttgggactcgctggtacctggatgtctgcgacatgtgctt

SEQ ID NO: 36849 - DNA, 297 bp, Zea mays
  Clone ID: LIB3060-004-Q1-K1-E3
ggcagcttgaggcacttgctcgggtcatgcaccagaatgtgttgtcgttgaaggcatacgttcgcgaggcggaccgcctctcgctcgagtacgacttcgtccatgggggcagcctcgttgatctgatgaagagggtgaggtgctagcaagtcagcctcggttgggatgcgaggagcaggattgctgttgggattgccaagggactgaggcacttgcattttgagtgcgatccgatgatagtccactgcaacctcaagccgtccaatgtgatgctagacgaaagtttggagccattat

SEQ ID NO: 36850 - DNA, 277 bp, Zea mays
  Clone ID: LIB3060-004-Q1-K1-E7
acagctccgctcgtcgatcagctctcggctgaccactcatcgccagtgggtgcctgccgaccaggtctcgccgtcgtcaccgtcgcggtagagaggggagggagagggggagaaaactggcccagatcgagaggtacagcacgaaaaagagaggcaagagagataggggaccggagggcggagggccggtgcccaagaccgaggggctcgtgcgcatgaagctgatgaggctcctgtctctcgtacccttcggctgccgtgctggacccatcgacga

SEQ ID NO: 36851 - DNA, 78 bp, Zea mays
  Clone ID: LIB3060-004-Q1-K1-F1
gggtagacgagctgagggagcgtgaggtggcggtttaagaagttacggaagcgttgaggctcgaggaggatagattgc

SEQ ID NO: 36852 - DNA, 383 bp, Zea mays
  Clone ID: LIB3060-004-Q1-K1-F10
cggacgcgtgggcggacgcgtggggcatgggcagcaatggccttggcttcaggcagggtgtgtggtcaccgcaggcccagggtcgaggcttgtcagggcttgaatggatgatccctgtgaggggtcaatattaaagcaaaggtcaggttcggcttggagggcttggtggaacacctcaggtcactctagaagcttttaagtggtcagtgcattgtttgtaggccggaaggacagctgatatgctccttggtgatgtcctcggtgggcaccagccagtgaggagctctgtggtggggactgagggagttgtttagaggcgtttggaccagtgcggcagtcaagctgtctttctgcagtgaggaggactcaccaaacaacaaaga

SEQ ID NO: 36853 - DNA, 401 bp, Zea mays
  Clone ID: LIB3060-004-Q1-K1-F12
cggacgcgtgggggagctgggaatttttgataactgttaaggacatcaactatatttttaaactgaagtgcagttgatttacattcctgtatttgttttggggtgtacaacacagtgattcaatatttttatgaaataaactctatttaaaggtatcacacacacaaaaaaagatgaaaatacacagattcaacaattctcacaaatcctaggaagagaaaaaataaatgtgcatctgggcacatcacagtgaaacttcaggacatgaacaacaaagagaaatctgaagagggtacatttaccagaaggtaaaatatatgttacatttaaagaacaacagaaagttgagtttttcagaagaaataatagaaacccagaatcagatcttcagggtgctgagg

SEQ ID NO: 36854 - DNA, 267 bp, Zea mays
  Clone ID: LIB3060-004-Q1-K1-F3
gcagtgcgactgctgcttcccgccgcacagcctcataccctggccgaacgagcaagacatggccaccgccatcggccaggttcgacatcagtagtgaagctgcacctgtacctgtacgtacggaggaagagcctttgccggatctaataatacactactagcgcgttgtttggtttgctattgctagatgcaagcgtgtgcgtgcaccgtgcagtgcatgtgtggatgggcgtcaacaccttgcatgcacgcgctattctttaattg

SEQ ID NO: 36855 - DNA, 272 bp, Zea mays
  Clone ID: LIB3060-004-Q1-K1-F4
ggccgtgctgcccgccaagggcaggccttcggcgaggagcagggtggtggcccgtgtccccgccacaaggaggagcgtacgtgtagctgccgtcgacgcgaccgaggccgcgcagatcgactacagctcaagcgtctcggtgttcccgatggaggcctgcgacctgctaggtggctacgcgtgcaacgtgcccatgtttccggaggccaagcccgccttggcaagctgcgacagctagcaggagtgtggacatagtggacagggactacctg

SEQ ID NO: 36856 - DNA, 220 bp, Zea mays
  Clone ID: LIB3060-004-Q1-K1-F5
cccacgcgttcggctagccgtacgatggttgacaccggtgacgtcgccgccgccgccgaggcctaggtgcgaccggcgggcagcagcagcacccagccgctggcggtgcgcgtgacgatcgtgacgggcgcgtctcggggcatcggctcggccatcgtcacgcacctgttctgcctcggctcgagcctggtgctgggctacgcggcgcgcgccgactagg

SEQ ID NO: 36857 - DNA, 292 bp, Zea mays
  Clone ID: LIB3060-004-Q1-K1-F6
tccgttcggattcccggcttggatttttgagaaaagagagaagaaactccctattacagcccttgcattttctcaaaagctgtggggcttgctccggagacagtgttccagccattgctcaaggataatctggttgccaaagggatagtactttcattcataactgagtttttcaaggagtacctgaaggaaaacaccttggatgatgtgattgcgcttttgtaataaaggaaaaatggaggacaatctgtgggacttttttgcatcagctaatagatcctctgaggcttta

SEQ ID NO: 36858 - DNA, 287 bp, Zea mays
  Clone ID: LIB3060-004-Q1-K1-G1
cggcttggtcctctgatcggcgtgtttgcccctgcaaagcccgcccagtctccatttttgtttcccagcccggatctccctgctcgccttgctcctccggcgccgcggatttctgctcgcttggccggccatggtggctgttcatgcctactggcggtggacggttctggtcccggccaccgtcgcgcccagggaaatggtgcgcattcctgtgcccggtcttcttttccgtcgcgtcggtctgtgctctgtcctggccgtcttctctgcctacgatctgtggcgct

SEQ ID NO: 36859 - DNA, 385 bp, Zea mays
  Clone ID: LIB3060-004-Q1-K1-G10
cttaggctgttcatccacagtcttcagtgtaaaggggtgagttcgtgctctggcagcaggctgtgtggagccgcgtcaccgtgggactgggcggccatcacacagcctggggccaggtggctgcacctgcacatggggactgggtttggatcgtcagttcccagggtttctgtctgaaacagctgtttgaaggtgcactgtgcagatcgttgtcgacagcgcacttggatggctttcagttgatccatggagccatgcgtccatccctacgacccatttcagagcatttacatcaccccccaaagaagcccccatcagcagtaccctcccatcttcctgggcaccactaacccactttctctctctctggattggtctgatctag

SEQ ID NO: 36860 - DNA, 409 bp, Zea mays
  Clone ID: LIB3060-004-Q1-K1-E11
ggacatcatcatcaactcactctacagcaacaaggatatcttcctgagggagctcatatctaatgcctctgatgctggataagattaggttcctttcccttactgataaggaagttctgggtgaaggggacactgcaaagcttgagattcagattaagttggacaaagagaagaaaatcctctccattcgggataggggtattggtatgaccaaggaagatcttattaagaaccttggaacgattgctaaatctggcacttcaggaacaggagctgctcgagtctcttgtcgaagctgatacgagaaggcaggaaagagctaaaaagatggaagaaaagaaagtgtatctgcaactatacgaagcaatggaagcgttggtcaagatcaatctggagaccaacaagatca

SEQ ID NO: 36861 - DNA, 183 bp, Zea mays
  Clone ID: LIB3060-004-Q1-K1-G3
gtcagcagcttctgcttgctctggggggtaggagagagagagagcgagagagagagagagatctagtagagaggctagtatgtggtactcgaactaagatgttggctgagttcagcgggcgagtggtggaggtgccggcggagctggtggcggcgtgcagccggactccgtcttccaagacga

SEQ ID NO: 36862 - DNA, 389 bp, Zea mays
  Clone ID: LIB3060-004-Q1-K1-G4
agccaccatcgaccttcaagtctcgctacgtagcagtgcaataaaaaaagcagccgcaatggcgagcagcaccatggccctctcctccacggccttcgccggcaaggccgtgaacgtgccgtcgtcgtccgccttcggcgaggcccgcgtgacgatgcgcaagacggcggcgaaggccaagccagcgggtgcgtccgggagcccagggtacggccccgaccgcgtgctgtacctgggcccactgtgcggcgagccaccgagctacctgacgggcgagttcccgggcgactactgctgggacaccgcagggctgtcggctgacccgtggacgtgcggcaagaaccgggagctggaggtgatccactcccgctgggccatgctgggcgcgc

SEQ ID NO: 36863 - DNA, 296 bp, Zea mays
  Clone ID: LIB3060-037-Q1-K1-C1
attcccgtctggagccactcttccttgattcatcactcctcccgttgggaatttatcttctagtctgccctcctcttctcatcgtcctttcttactaagccagtggcactttcccttgttgctctaactccctaacgtgtgtcggttctgtcttctagcatattctcctgttgctatcttggattcttacttatattctttcattcataattcctcacactttatcttctctccactgtctttttaaccaatctctattaccaattgtttgaatcaacagttccttttcttactat

SEQ ID NO: 36864 - DNA, 408 bp, Zea mays
  Clone ID: LIB3060-037-Q1-K1-C10
cgaccttcaagtctcgctacgtagcagtgcaataaaaaaagcagccgcaatggcgagcagcaccatggccctctcctccacggccttcgccggcaaggccgtgaacgtgccgtcgtcgtccgccttcggcgaggcccgcgtgacgatgcgcaagacggcggcgaaggccaagccagcggcggcgtccgggagcccgtggtacggccccgaccgcgtgctgtacctgggcccactgtccggcgagccaccgagctacctgacgggcgagttcccgggcgactactgctgggacaccgcggggctgtcggcggacccggagacgttcgccaagaaccgggagctggaggtgatccactcccgctgggccatgctgggcgcgctcggctgcgtcttccccgagctgctcgc

SEQ ID NO: 36865 - DNA, 410 bp, Zea mays
  Clone ID: LIB3060-037-Q1-K1-C6
aattcccggctggactccacttcttcctccagtttttcttggtccctaaacttaattccttttttctcttttttgttccttggctgtattaaaattacatgtggttgaagtcatcaatagaaccccacaattttttgggtcctacttattttcattgtcttcggaatagtataataatttaatttggaatatctgccaatatcttgggaaaatctaagttaatgattaataagataaagaatttatgaaggatattctcatattgactcaatacaaagataagtatattcaaaatctatccctttttagttaaaggatatctacatctgagcatcccataatatctaataaatacaaaatcgaatatctgataatcccttatgaaagaaactgaatacattcttttaata

SEQ ID NO: 36866 - DNA, 399 bp, Zea mays
  Clone ID: LIB3060-037-Q1-K1-D10
catcaatctcctcgatttggatgtccacgagcttattgagctgttgctcctgcgtcgtgagatcctctggctgctgcgcaacagtttgttcatcctcatccccaatctcatgtgtccaatacacagcaaaagatgcctccttattgaaactggttggcatctgcaacagacgcttcctgttagttccagaggcactgccaaggatctcccccttcatgaggtcatatatgcaggccctgaagttgtccatgctcttatgatcctgagagtcgaggcttatgaagatcagaatttcccagctccggatgaactgtttcttctttatcttcagcttctaacgaacagtctccatcaggtcagccggtggaaccattctcaaactttgggccctttttgaca

SEQ ID NO: 36867 - DNA, 299 bp, Zea mays
  Clone ID: LIB3060-037-Q1-K1-D4
attcccggatggacgcactcatccgcaagctgtccccctacacactcctttcttctctccaatcactgctccctccatctccgcattctttaatacgaggggggccgatctccccactgctccgataacggtctccccaggaggtgcaaggcttcttctggcaggacattaaacacctcacaaattccgcttgtctcgagccatccacatgtgtatgacccatgtgatgattcctttacccttgttagattcactactctcaaacaaggcacaactcttgacactacatctcaaggtta

SEQ ID NO: 36868 - DNA, 341 bp, Zea mays
  Clone ID: LIB3060-037-Q1-K1-D7
gccacggccaaagcagagcaggagcaggccgcgcggaacgagggaagcagcatgccggtggactagggagcggtcggcggcctcggcggcggagggatggggcgtgggggtgcggtgatggaggacggcgacagggaggagggaagctatccgacgctgctgcagcggtggtcctcgtcggtgtgggccgtcagcggcagcgggcgcctgctgtgggcgggcaacgaggcgtggcggacgcacgtcgggatggccctcgttcaggtcgcctacggcggctaccacgttctcaccaagtccgtactcaacgtcggcatgaaccagatcgtcttctgcgtcta

SEQ ID NO: 36869 - DNA, 311 bp, Zea mays
  Clone ID: LIB3060-037-Q1-K1-D9
cacaccacccaaacatcctctaaacctttccatcattaatcactctactctatcagaggaatcttaccaatatttggcaggcagataaaacatttactaaccaattcacatatcaatcaaccacttctgaaaacattcctaactttactcaagaaaaaccttatcatactgataagatacaaaatttcataaacatacctcacaattcatgaataaatcattgatcaaatagacctcctgcaaaagaaactcaaacaactccaaatagataaccttaatcactactataatatctcttcacctatacaaat

SEQ ID NO: 36870 - DNA, 172 bp, Zea mays
  Clone ID: LIB3060-037-Q1-K1-E10
acaccatcccttcttcccaacccagaagtctttttaataattatcgaggcccataaactctcaactcacttctctctctccttcatctcattaatcttcccattcactcaatctaccacacctcaatttttacatccatacactcattaaaaaactcaatctccatccatcc

SEQ ID NO: 36871 - DNA, 352 bp, Zea mays
  Clone ID: LIB3060-037-Q1-K1-E11
tctctccactctatcatctcctacttttttccatcatccaactatttcaatcccaggtgcccttttaacccaactcctcatatccaatcctttttcataaactactcatccttttttccaacttccctttcctacattaatccatttaccataatctgttcaccttttacacctaattctttataaatactacctatcttttactgaattctatcctccttattttcaatctccctctctttctcacctaacacctctcaatctcactactcttccaacactttttccctacctcctgcttaaccaattacaacattttctatcccttaatcatataatataactcttacct

SEQ ID NO: 36872 - DNA, 286 bp, Zea mays
  Clone ID: LIB3060-037-Q1-K1-E5
attcccggccgtgagatttggtaccccggtaccaaaggtggagcaagtgcgctgtactattagctttgggataccaactaagcgatcagcattcaggaacacgggggtgatctttcgtcgttaaccccccatgtacatggcttttttgaggtgggataggaatggcggttgtgtttcccatgaccattctttgtacgtcatgaagctcatcttcaggatgctcttatatatagagaaatgttattcacatcacatctcgttttcatactgtatagcgaatcttaac

SEQ ID NO: 36873 - DNA, 241 bp, Zea mays
  Clone ID: LIB3060-037-Q1-K1-E9
ttctctcccctcctttttattcatatcctcaattctacagagtagcttttcaaaattagcgtatccaaactacgtcatctcatgttaactaccacttcttattccacaacctcacacttaccacataccaccactccctccacaacaccttcatcacctaccaccaactcctccaatccaatatcattctccatcataatactcactaatccctcctcttctactctcatcaccttctcca

SEQ ID NO: 36874 - DNA, 405 bp, Zea mays
  Clone ID: LIB3060-036-Q1-K1-H5
gatgagattgtgaaggaagtctcttcctacctgaagaaggttggatacaaccctgggaagatccacttcgttccaatctctggttttgaaggtgacaacatgattgagaggtccaccaaccttgactggtacaagggcccaaccctacttgaggctctggacttgatcaatgagccaaagaggccttcagacaagcccctgcgtctcccccttcaggatgtgtacaagattggtggtattggaactgtccctgttggacgtgttgagactggtgtcattaagcctggtatggttgttacttttgggcctactggtcttactactgaggttaagtccgttgagatgcaccatgaggctctacaggaggccctttccggtgacaatgttggcttcaacgtgaagaat

SEQ ID NO: 36875 - DNA, 375 bp, Zea mays
  Clone ID: LIB3060-036-Q1-K1-H7
aagaggatcaataaccttcatctgcagatgcagctgcagtgcagtcataagcgtactacttagtgtcatgtcatctcatcaggactctgattgatcaaatcaccgtacatgcacccggcccgcagtgggcgtgcaccacgagcgtggacttctcgctggcgcatctgatccaggtgatcatcctgctgagcaccgtcggggccaacggcggcggctacctcgcctccaagtacgtcgtgcttgccatctacaccgccatcctcgtcgtgcacggcctcatcaacagcctgcacatccagtggctctcctggttcggacagctcggagccttgtggaacgtcgcgggcgtgttcgtgctcgtcatcctggtcccgt

SEQ ID NO: 36876 - DNA, 424 bp, Zea mays
  unsure at all n locations
  Clone ID: LIB3060-036-Q1-K1-H8
cttccttccgcggactagttttttctgaagattcggcgatggcggcgacgatccagtccgtgaaggcgcgccagatctttgacagccgcggcaaccctacagtcgaggtcgacgtgttttgctcagatggaacctttgcaagggcagctgttcccagtggagcatcaactggtgtatatgaagctctggagttgagggatggtggctctgactatttggggaagggtgtctccaaggctgtgaacaatgtgaattctgttattggacctgctctgattggcaaggaccctacagcacagactgagattgataacttcatggttcaacaacttgatgggaccaaaaatgagtggggatggtgcaagcaaaagcttggtgctaatgcgattctggctgtgtcattagnctgttgcaaagctggggc

SEQ ID NO: 36877 - DNA, 413 bp, Zea mays
  Clone ID: LIB3060-036-Q1-K1-H9
ggccgaagaagaggagaagcgaagcaagcaggcttcgagaacaagggggagggggaggaccgggcgaaagggggaactagagcaagatgggcggcgaactgctgcttgcgctcctcctcgtctctgctgctgccgcccctcaggtacttggagttggcaatggagacaatcacatgagaatcatccaggaggacatcattgagacagtcaacaaccatcccagtgctgggtggacagcctcacgtaatccttacttttcaaactataccattgcgcaatttaagcacatacttggagtgaaaccagcaccacagaatgcactaagcaatgttcctgtcaaaacttattcaagatcactggaacttccaaaagagtttgacgctagatctgcatggtcccgttgcagcacaatt

SEQ ID NO: 36878 - DNA, 406 bp, Zea mays
  Clone ID: LIB3060-037-Q1-K1-A10
ctttaggggaacaattagatatgcgagtgtccatgctcatttggggtgcactggtaggaggagggatgatttagagtcactggcatacacccttattttcctgataagaggaagattaccttggcaaggctaccagggagataccaagagtttccttgtttgcaagaagaaaatggctacttctccggagatgctttgttgttattgtccagctccattcaaacagtttcttgagattgtcacaaatatgaaatttgacgaagagccaaattatgccaagcttatctctctttttgatgggttgattgaagcacctgcttcgagacaaatcagaattgatggggctctcaaggttggacagaaacgtggaagattggttgcagatctagaagaagatgaacaacct

SEQ ID NO: 36879 - DNA, 398 bp, Zea mays
  Clone ID: LIB3060-037-Q1-K1-A11
tccatcctcaagccattctctttctccttcagctctgccgctctcgaggcggccttctacaacgtcctgggctctcagctcgtcgccaatgccaccggtgagaactccattaagtcgcccgcacacgcaaagctaaacgtggcgatcaacggcttcagccgcatcggccggaacttcctccgatgctggcacggccgctaggactcaccgatcgacatcgtcgtcgtgaacgacatccgatgcgtcatgaactcgtcccaccttctcaagtactactcgatgctcgtcaccttcaatgccgacgtcaagatcgttgacgacactaccatcatcgtcgacggcaatcccatcacggtcgtcttcatcatggaccccctcaagcttccatggtgtgatct

SEQ ID NO: 36880 - DNA, 83 bp, Zea mays
  Clone ID: LIB3060-037-Q1-K1-A7
cttaaaaaatctgccccacaactccaaccaacatcccaccaccccccccatctaaaatactcccttcacaaaacctccaaacc

SEQ ID NO: 36881 - DNA, 367 bp, Zea mays
  Clone ID: LIB3060-037-Q1-K1-A9
cccactcttctcatttaactccttcactctcatcttttttcttacctcttcaacctatccctcagacaggctttcttctactcacggactcctctactactactactcatatattcattctcatacataatccattctcacaactaatctccataattaaccctaacttttcaccatgatctatacctattaatactacctattcatatctcactttacactcacataatcatacatactcctatctatcatattcatctacataatacatctaactattcttacctcaaagacactttatatcataactcctaattatataccatacctaatcaactcccattaacaatacatttaaactaaaatt

SEQ ID NO: 36882 - DNA, 407 bp, Zea mays
  Clone ID: LIB3060-037-Q1-K1-B1
ttccctctgtacgcactcgtcctgtgtccccccgtcttatctcttcgtcttcgttcccgcagcctcctcccaaaccctatcgtagctttcctcctccgtgggcgactaccactactcgtccaagctgaagtactactacccctctcctccgcctcggctcacggtgttctcttctggcccgccttctgcctctccgtccgctgtcttttcatttatttttttttattcttcttcttttattttatttttattttattatttttatttttttttcataattattttattttttattttttatttttatcttattttattatatttatctttatttgtttcctttttatatttttattttttcttatccctctatatattatatttttttttatattttatttttttta

SEQ ID NO: 36883 - DNA, 386 bp, Zea mays
  Clone ID: LIB3060-037-Q1-K1-B11
cgatctggtccaaagccccaactcaaatttacatccaggccattcgccggagatgtgttcggatctgacgtaccgcggctgcagcgtggcgccaggctccgcctccaacggtggggaatactccccgaagtcctccaagccgctctcctggctcgtccgctcctcgcgctacgccggcgcctatcaccgccccgtcttcgccctcgccggcatgctcttcgctgccactatcttcaccttctcttccccctacactttatctccgtccgaacccgtcgcgtctgtcggcttcaaccaccttgccgtcagctgacacccgtccttccgcgagtccgtcggcgggaaggttcccctgtggctgcttcggctctcgctgcgggtgctcg

SEQ ID NO: 36884 - DNA, 272 bp, Zea mays
  Clone ID: LIB3060-036-Q1-K1-H11
acttcttcttacactcctcctcttctctactactacctcccctcaattacttttaattttcaatatatacaatcacataataatcatccattattacatcatttatacattcaacaaccatcccattacttattttacatcctcacataatccttacttttcaaactataccatttctcaatttaatcacatacttataattaaaccaacaccacataatacactaatcaattttcctttcaaaacttattcaatatcactttaactttcaa

SEQ ID NO: 36885 - DNA, 410 bp, Zea mays
  Clone ID: LIB3060-036-Q1-K1-E7
gattgaagcctcatccaggctgtttgcttgcacgttacaatgatcccaggacaaagagcttcttaatgaggaacgaggtgcttatacggctaattgacttcacactggagttgtaatcgtcaatactggcatcagatcgatgtaacacactgggcttggagcttccagtgagtcattagaaaggtaaatctgattctatttgtgtactttacctgaaaagaagtcgaagggttggctacagtagtgagagttatctcaccaagttacaaggtttaaacaatccctaaggcctggtttggtgaccagggaccacgagagaattcctcctcatggatccctccgtcatcctagtcaccaaacctatcctaagtatttgtaaggaaaaaacttgcctctgaccctactgatgc

SEQ ID NO: 36886 - DNA, 266 bp, Zea mays
  Clone ID: LIB3060-036-Q1-K1-E8
aattccctcgtctacccacacatcctgattcaaacacactctacccttttttcttacaccttccaatcatcccacgagaaagatcttttaaataattagccaggttcttatacccttaattcacttctcactctactttaaatcataaatcttcccattaacatcgatctaatacactcctattttaacatccacacactcattataaaactcaatctacatctatccatacactttacctcaaaacaatctaattccttacctac

SEQ ID NO: 36887 - DNA, 386 bp, Zea mays
  Clone ID: LIB3060-036-Q1-K1-E9
ggtgggttggcttctcctccccctccggttcgggttcgggttcgtgaggttctccggggtgcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggctgcggcggcggcgggtacggtggt

SEQ ID NO: 36888 - DNA, 423 bp, Zea mays
  unsure at all n locations
  Clone ID: LIB3060-036-Q1-K1-F3
caaaacacaagtagggttaggaaggcggcggccagcggcgagagcgcgagaggagggggggtcggccatgacggggaaggcgaagccgaagaagcacacagcgaaggagatcgccgcgaagatcgacgcggcgacgacgaaccggggcggcggcaaggccgggcaggcggaccggctggggcaggacaagggcgggcacgcgaagctggcgtgccccctctgccgcaccccggcgcccgacatcaagtccatgcagatccaccacgaggcgcgccaccccaagctccccttcgagccggagaagctcctcaacctgcactcctccgcccccgctgctgctgccgccgtcgccgncactgccgaggccaccaacttcaagcccaagcccggcgtncgcggcagcctcaagaagtaagcttgctg

SEQ ID NO: 36889 - DNA, 418 bp, Zea mays
  Clone ID: LIB3060-036-Q1-K1-F4
ggatgtcgctcttgagcttgcgtggatgaacaacatgttggactttgccttcccagaccggttgcagttcatccgtgaatacactagcaaggtggatgatttagtgaaggacagaattgagtcacagaatgaagaaagagtcaaagagaaggaggagaaagatcttgttgctcagcagaacatgtatgcgcaattgcttcctcttgctttgcctgctccgtcaatgcctggcatgggtggccctccaccttcgatgggtgggatgggcatgcctacaatgggtggaatgggtatgccgccgatgggccctggtccgatgccagcattcgggatgccagcaatgggaagctactgagatgtttttgcagagagcttagacgatgatctgaatcgtccctgtgtaagcgaaagtggaaac

SEQ ID NO: 36890 - DNA, 411 bp, Zea mays
  Clone ID: LIB3060-036-Q1-K1-F6
cgatggttttgccggagtcttccctgaacacaagtacgagatcgtgaagagactgcgggagaagaagcacatcgttggtatgactggagatggtgtcaacgatgccccggctcttaagaaggctgacatcggtattgctgttgcggacgctactgacgctgcgaggagtgcttccgatattgtccttactgagccaggtcttagcgtcattatcagcgccgtcctcaccagcagatgcatcttccagaggatgaagaactacaccatctatgcagtttccatcacaatccgtatagtgcttggatttatgctcattgctttgatctggcaatacgatttctctcccttcatggttcttatcattgccattctcaatgacggtactatcatgaccatctctaaggacagagt

SEQ ID NO: 36891 - DNA, 418 bp, Zea mays
  Clone ID: LIB3060-036-Q1-K1-G1
gtcggcgaaggagtctctaccaccaaatgttagagatctgttgagctcgtctgaggagaaagctagtctagtcttgagaccaatcggaaatgctctgcaacaggtctatgtagttgttgaaggtgttgagaagaatgttggtttggatccaagtgatcctattgttcaattggcagttgtgcttggaggttcagtgacaatagggacaacgtactggctcttcacatacagtggctattctggagacttgtcacctgaatcagcgtttgacttattgaaaaacgatgacaaagccgtactcattgatgttcggcctgaggatttgagggaaaaagatggtgttcctgatctacgcctcggggctaggtctaaatatgcaagtgtagcttcgcctgagatcaaagatccagtaaagagt

SEQ ID NO: 36892 - DNA, 381 bp, Zea mays
  Clone ID: LIB3060-036-Q1-K1-G10
tcgtatcaatgcaataaaaaaatcattcgcaatggcgagcagcaccatggccagaaggcttcacaaacttcgcgggcgaggccgtgaacgtgccgtcgtcgtccgccttcggcgaggcccgcgtgacgatgcgcaagacggcggcgaaggccaagccagcggcggcgtccgggagcccgtggtacggcccctaccgcgtgctgtacctgggcccactgtccggcgagccaccgagctacctgacgggcgagttcccgggcgactacggctgggacaccgcggggctgtcggcggaccctgagacgttcgccaagaaccgtgagctggaggtgatccactcccgctgggccatgctggtctcgctcggctgcgtctttcccg

SEQ ID NO: 36893 - DNA, 380 bp, Zea mays
  Clone ID: LIB3060-036-Q1-K1-G6
acagccagtacgtgctccaccggggcatccctacgctcggcgacggcggcaaggggacggcgacggctgccgcgtcggcattggggacggcagaccggttagcggtcaggcagcggtcctacaccgagctgcagctgttcaacaggaggtggaagaaggccgtggcggaggacgggtgctggaccgacccttacccgaacccggcgacgaccaccggctgaccgttggacggagcgaggcagcgcagggaagtacagtagttggtagctgtcagattgaccttgcctagaagatggtagtagatcatacactcgcattaatttacaggttcacagagagctatacatataatgtacagaactacagattgttttttttcc

SEQ ID NO: 36894 - DNA, 382 bp, Zea mays
  Clone ID: LIB3060-036-Q1-K1-G7
gatcgttgtcgtgattcgtgaacggcggcgacaagaagccgggagagatgccgctggccacaactgctccgccgccctgtcctccgccgagtccagcagcggcaccagtccggacgcagctcctctcctccgtcgcgaagctcgcgctcacggccgcgctcgtctgcggctctggcggtcccgctgccgtcgtcgtcgtcgttccggccgccgctcaggccgtcccgttcgtccgtcctcctcctcctcccctgcaaggaaggcccttagcgtcctccactccttacgcgcagtcccagaagctgcagcttggcctcgacaagctcggaaagatcaggccatgcccgtccaccaacccggggtgcgtgtccagcaacccgct

SEQ ID NO: 36895 - DNA, 419 bp, Zea mays
  Clone ID: LIB3060-036-Q1-K1-G8
ctccccatctcgcccgccgttttcgtccttatcgatctcctcgcacctcgtggcgggacctctccccttcgatccaccaagggtttaggatcggcggcgatggcggcgaggctggcacagctgcgcgctcaggcggtgcaggcggcggagttcgcctcgaagcacggcggctcctactacaaggagctcatggagaagaacaagcagtacgtcgtgcagccccccaccatcgagaaatgccaggagctctccaagcagctcttctacacccgcctcgcaagcctaccaggtcggtatgagtcattctggaaggagcttgatggtgtcaagcaggtatggaagaacaagaaggacctcaaggttgaggaccttgggattgcgactttatttggagttgagctttatgcatggttctgcgt

SEQ ID NO: 36896 - DNA, 414 bp, Zea mays
  Clone ID: LIB3060-036-Q1-K1-E6
ggaccaaatacacgctcccgtctcatccgatggctcctctcctttccccggggctggtcgcggacagcgtcaccaagttccatgcggcctcaacgccagtctcgtgctccggtagcccacaacgctacgtcatcacagggttggctggggccggaaggggagagcacgactggcgtcggaggacgtggggaagaacgaacctgagggtgaaagcggtggcggcagagtcccgcagctcggaggggggaatcgctgaagattattacgctgttcttggcgttatgccagatgcaacgccgaagcagatcaagaaagcatactacaactgcatgaaatcgtgccatcctgatctcagtgggaatgaccctgacgtgacaaatttctgcatgttcatcaatgaagtttacacggtgc

SEQ ID NO: 36897 - DNA, 243 bp, Zea mays
  Clone ID: LIB3060-036-Q1-K1-H10
cttgctctcctcctcgtctctactgcttcctcccctcaaatacttctaattcacaatgtacacaatcacatgataatcatccactattacatcattgatacaatcaacaaccattccattacttattatacatccttacataattccttacttttcaaactataccattacacaatttaaacacatacttccatttaaaccattactccaaaattcactaaacaattttcactcaaaacttat

SEQ ID NO: 36898 - DNA, 382 bp, Zea mays
  Clone ID: LIB3060-004-Q1-K1-B7
gccatcgacacgatcgcgagcgcaagctcgttcgttgtcggaagctcaagttagaagaagcaccagtgcctgatcgatggcggcccaggctctcctctccggccggcagctgctgggccgccccgtgcagtcggacgtctctaggtcgtcggcgaggaaggcgcccttcgtcgtcagggccagctgcagcccttcagccaagcaaggtgccgacaggcagctgtggttcgcgtccaagcagtacctctcctacctcgatggcacgctggccgacgactatggcttcgacccgctgggcctctcggacccggagggcaccgggggcttcatcgagcccaagtggctggcctatggcgaggtgatcaacggtcgctacgccatg

SEQ ID NO: 36899 - DNA, 378 bp, Zea mays
  Clone ID: LIB3060-004-Q1-K1-B8
gaaggaagcgagagcagcagcaagcctcatcgggaggtggagagatggaggcggcgggtcgcctacccctcatcatcgtctcctccctcctgctgctcctctcgcctgagcggccggctgaggccgcgccgccgcgaatccagccgctcgccaccgtcgcgctgagccgtctctacgacacctccaactacggcaggctgcagctcaacaacggcctcgcgctcactccgcagatggggtggaacagctggaatttcttcgcctgcaacatttacgatacggtcatccgcgagacagctgatgcgctggtgtccacgggactgactgcgctgggctacatcttcgtaaatatcgatgattgctggtcatacgtgaaac

SEQ ID NO: 36900 - DNA, 376 bp, Zea mays
  Clone ID: LIB3060-004-Q1-K1-C1
caacgctctatctctttcgccgagctcctcgaaaccctaggagcgtgcttgaccggcggcggcgaggtgatggcgatggaccctgacgcggtagctaaggccttcgtggagcattactaccgaacgttcgacaccaaccgcgcggcgctggttgggctgtaccaggagacctccatgctcaccttctagggccagaagttccagggccccttcgccattgccggcaagctcggatctctccctttccaggcctgcgagcatcagatcgtcaccgtagactgccagccatcgggtccccagggaggcatgctcgtcttcgtctgcggtttcatacgcactcgccccgaggagcaccccatcaagttcttccaggcat

SEQ ID NO: 36901 - DNA, 362 bp, Zea mays
  Clone ID: LIB3060-004-Q1-K1-C10
agcccacatagcccttccagcaacgcgctatcgaagggttgagagctattggaagcaagtacgtgcatggcgaggtttgcgctcgtggcgtgcgcaaatgtcaccatgcacctactggtcggcgtgagcgcagaagacgtggcgtgcacgatgacgcatgacctgtacaaccagatgctcgtcaatcgacacgacactcactgaccggtccacggtgtctacacctactacgcctatatgcaggccgtcaacatcttcccggtgtttggcaccggctacagcacctgactaactttacaagcgcgagcttgtcgacttcttctgtcataccttccactagactaccggtggcacgacaggtg

SEQ ID NO: 36902 - DNA, 348 bp, Zea mays
  Clone ID: LIB3060-004-Q1-K1-C11
gcgccatccacaggatgagagggaggttatggtggagcagcagcagccgaggagggccccgaagctgaggtacctggacttcgtccaggtggcggctgcccaggccgcggtgtgcctcgctgggctctacggcctcgccaaggaccacgccggcccgctccgccccagcgttgacaccgtcgagtctgccgtcaagggcgtcgttagccccgtctacgaccgcttctgcggcctgccgctcgacgtcctcgccttcgtcgaccgcaaggtgagttgcgtcacgcgccctatggaccgatctcccccttctcctgctctttggtggccgggtagcgtctcgtggtaaca

SEQ ID NO: 36903 - DNA, 77 bp, Zea mays
  Clone ID: LIB3060-004-Q1-K1-C12
taccggtctcggattgacgggacgactccagcgtccgctagatagctcgagatgtctttgtgatttatgcgtatgat

SEQ ID NO: 36904 - DNA, 162 bp, Zea mays
  Clone ID: LIB3060-004-Q1-K1-C2
ggacagtgaggcgccgcttgccctgcacatacggccgcggctaggaacccaaaaggccaagaccctgccaaaagctactacacagtacacacacggtacggaatccgggcatgcgagaaagcaggcctaatctcaaggccgatggtgcgagcgctggtttgc

SEQ ID NO: 36905 - DNA, 265 bp, Zea mays
  Clone ID: LIB3060-004-Q1-K1-C5
ctctcctcttgcgattcgctcgctcgatcctagcttcccttccaagaagcgcagcgcccatggccatgtacacgcaagccttcgccgccacgcgccacctgctggccgccgtctgggcgccggcggcgaagccgaggcagctgagctcgcagctcgcgctgacggcgtcgtactcccgcgggccggccccgctccgcgcgtccaccgaggaggcggtggaggcgcccaaggggttcgtgggcacgcagctggaccccagcacgcc

SEQ ID NO: 36906 - DNA, 80 bp, Zea mays
  Clone ID: LIB3060-004-Q1-K1-C6
gtcgtttctctctctccggcggctgcgctgcggcttggatcacatactcgtcggagctaccatgattgggaagctaattg

SEQ ID NO: 36907 - DNA, 287 bp, Zea mays
  Clone ID: LIB3060-004-Q1-K1-C7
gggataccaccttacaatgtgtctgacttctgcaagtttggttagggcttttgatggcaaaacaaacgaacaatattatgaattaaagattaaagtgcgctgtgaaggcaatgaagtgtacaagggttttttggctgaatatgatttagatcataactacgctgttgtcaacattgatgccttcattggtgttcatgtgggaagttcccaatgtgtgctggaatctgtgctccgtggttaggcatatgtagttgggcgtagtgtctatggtgacctaataattcagg

SEQ ID NO: 36908 - DNA, 407 bp, Zea mays
  Clone ID: LIB3060-004-Q1-K1-D10
atgagagtgagcctggaacttgcaaagatagagaaatcatgcgccatgacccccacaagcttctggaaggatgccttattgctggagttggaatgagggcatcagctgcttacatctacattagaggtgaatacgtgaatgagcgtctcaaccttgagaaagctcggcaggaagcgtatgcagctggacttctgggtaagaatgcttgtggctctggttatgattttgatgtgcatattcattttggtgctggtgcgtacatctgtggtgaagagaccgccctactagagagccttgaagggaagcagggcaaacctaggctgaagccacctttcccagccaatgctgggctctactgctgcctcacaactgtgactaatgtataaactgtggctgtatccccaaca

SEQ ID NO: 36909 - DNA, 385 bp, Zea mays
  Clone ID: LIB3060-004-Q1-K1-D2
ggcctatatgaagcttgttccgtaatcatctcagatttttcttcttcttctttgtttattcgaccatggtgcgcttccagacccgttgcctcactgttttgcaaagagtagaagaaaagtcattactcacatcagtgcagctagcaacgaaggccatgcactgccacaggggccgacaagaccatgtgataccttgtgccagcttgttctgggtggaacaccattgcttcgaagcctttctgtacgcctcaaggattttctccatctggttcatcatcaagatcaatgttgttactcacataagtgtgctaaggcatgattaacaacacataacagacctgcgtaaaaaccataggaaacaagatgccacgaacaaaaggaaaaa

SEQ ID NO: 36910 - DNA, 271 bp, Zea mays
  Clone ID: LIB3060-004-Q1-K1-D3
ctctcctctagcgcgcagccactcctttctctctctctggtctgcttccagccgagcagtgccatggcgttactctctccctctgcgcacggcgctcgcttctccctggctcccggccagaatttcttgcggcgcgaagcttgctccctgcgcccgtcccacatggcgctcggccgcccagctgtatcttgctccttgcgctcggatttcctctgctacctggcgaactcgccccagccccagcttaaatgtcttctctgccgtgcgcgct

SEQ ID NO: 36911 - DNA, 263 bp, Zea mays
  Clone ID: LIB3060-004-Q1-K1-D8
caggatgaagaagactctgatggaagaagggccttacattttgcatgtgggtacggtgagttgaagtgtgcccagatccttcttgaagctggtgctgcagtggacgctcttgacaagaacaagaacaccccgttgcattacgctgctggctacgggcgcaaggagtgtgtggatcttctatagaagcacggtgctgctgtaactctccaaaacctggacgggaagacacctatcgatgtcgacaagctgaataaccaggacga

SEQ ID NO: 36912 - DNA, 448 bp, Zea mays
  unsure at all n locations
  Clone ID: LIB3060-004-Q1-K1-E1
gctagnatcactactcacgttcgtccaccagagacaacaatggccatggagacgtgcttcagagcgtgggcgctgcacgcccccgctggcagcaaggacaggctcctcgtcggcaacctgcaggtgctgccgtcgaagcgggcgctcgcgccgctgtccgtcggccgcgtcgccacgcgccggccgcggcacgtctgccagtccaataacgcagtggacgaagttgtggtggcggacgagaagaactgggacgggttggtgatggcgtgcgagacgccggtgctggtggagttctgggcgccgtggtgcgggccgtgccggatgatcgggccggtgatcgactagctggccaaggactacgccggcaagatcacgtgctggaaggtgaacacggacgacagtcccaacgtggcgttcaccttcggcattcgcagcatccccaccgtgc

SEQ ID NO: 36913 - DNA, 131 bp, Zea mays
  Clone ID: LIB3060-004-Q1-K1-E10
cgaccaagtctcccgtccctttcgagtttcaccacttcatcgacgcgcaactccctgagcttattccagtctaggtctacgatgactacaagctcatggtgtgatatactctttacacctaccgattgatc

SEQ ID NO: 36914 - DNA, 441 bp, Zea mays
  Clone ID: LIB3060-003-Q1-K1-H9
gtgagctatatgcacctccaagtgcttatgttttcctgtttggcctaactgttcagcagacatttctcagaggtgtccttgagaaagttggaattgaaccggaaattcaacgaattggtaaatacaaaagtgccggagatcaacttgcacgcaagagcatgtcaaatgaagttagggagatgctggcagcactgcttgacaatatttatggaaactggctggaaacaatatcttctacacatgggaagaaaaaagaagaaattgagggatttattaattcaggggtgtaccaggttgccagactcaaggaagaaggttgggtaacagatttactgtatgatgatgaggtaatgacattactaaaggagagagtagggcagaaagacaagaaaagtctgcgtatggttgactacagttaatactcgcgtgttatgtaaaaga

SEQ ID NO: 36915 - DNA, 350 bp, Zea mays
  Clone ID: LIB3060-004-Q1-K1-A11
gaaggatatgcccttcctcatgccattcttcgtttggatcttgctggtcgggacctcacagactccctcatgaaaattctcactgagaggggttactccttcacaacctcagccgagcgagaaattgtaagggacatcaaggagaagctagcatatatagcccttgactatgagcaagagttggaaactgccaagaacagctcttcagttgaaaagagctatgagctacctgatggacaagtaatcaccattggtgcagagagattcaggtgccctgaggtcctctttcagccgtcgatgattggtatggaggctgctggaatccatgagacaacattacaattcaatca

SEQ ID NO: 36916 - DNA, 231 bp, Zea mays
  Clone ID: LIB3060-004-Q1-K1-A12
acataacttcaagttgttggaaattattttcggaggtcccagtgaacaccatctactgggcaccgtgaaatttcacaaacatgcatatatatatgaaaaccactaacatgagcttccttctccacccacacccctttctcacgcacttcacataccatctatagttggcaggacacgccacctctgggctcgtccctggtccccacatcagggccgttctccgtcacatac

SEQ ID NO: 36917 - DNA, 317 bp, Zea mays
  Clone ID: LIB3060-004-Q1-K1-A2
gtgatgaggtgattgttgaactcgatgcttcattagaggacttgtacatgggcggttcagtaaaggtttggagagagaaaaacgtcataaagccagcaccaggaaagaggcgctgcaactgtaggaacgaagtttaccatcgacaaataggtcctggaatgtatcaacagatgactgatcaggtctgtgaccaatgtccaaatgtgaaattcgtacgagaaggtgaattcttgactgttgatattgagaagggaatgaaagatgcacaggaggttttgtttttcgaggaaagagagcctaagattgatggtgaacct

SEQ ID NO: 36918 - DNA, 371 bp, Zea mays
  Clone ID: LIB3060-004-Q1-K1-A4
gtgcttcagagcgtgggcgctgcacgcccccgctggcagcaaggacaggctcctcgtcggcaacctgcaggtgctgccgtcgaagcgggcgctcgcgccgctgtccgtcggccgcgtcgccacgcgccggccgcggcacgtctgccagtccaagaacgcagtggacgaagttgtggtggcggacgagaagaactgggacgggttggtgatggcgtgcgagacgccggtgctggtggagttctgggcaccgaggtgcgggccgtgccggatgatcgggccggagatcgacgagctggccaaggactacgccggcaagatcacgtactggaaggtgaacactgacgacagccccaacgtggcgttcacctacg

SEQ ID NO: 36919 - DNA, 439 bp, Zea mays
  Clone ID: LIB3060-004-Q1-K1-B1
cagcactttcctctttggatgtgatggcatcaccgtcagatgaggaccacgaggaagtggtactgcattttccgccctctagctctctaagagatgtcaccttcaaagggtgtaagaatctgatcctacccatggaggaagaagctggattctgtggcctcttgtcgctcgagtcagtgaccatacgcaaatgtgacaagttgttctctcggtggtccatcagaggacgagcagctcagactcagactcagagcatcatcaaccctctccccccctgcctgaggaaactctccctttattatatggaaactctgcctcagaaagctctgctcgcaaatttgacatctcttgaagaactcacactacgtaattgtcttggctgtgagcaaagcaccgagccgatggctctgcccgcgaatctaacatctcttaccattct

SEQ ID NO: 36920 - DNA, 416 bp, Zea mays
  Clone ID: LIB3060-004-Q1-K1-B10
ctctctccgtgcagtgcgtcctccgtgcccagtccgagctccccatggcgcgcccagctgaagctccctcttcctcctcggcgctgctctatctctctctggtgctcagctccctccgcgcgtccttggctccaagcccccgcgtggagctcgcccagctgtgaccctgccgagctccgccccgactccacgtctcctggtcgggctctcgttctatgcttgatgccgctgttccctggtgctccctgctcggtccctgcccagcgcctgactacagctccagctcgcggcgtcccctctgcttagccaggattgtcgtgcctctgctccctgatttctccagcccgtggagcttttgctatgcgctccctccctgctccggtcttctccatagccgagcgcccgacgttctccct

SEQ ID NO: 36921 - DNA, 372 bp, Zea mays
  Clone ID: LIB3060-004-Q1-K1-B11
aaatcccgtccccttcacccgcactccattggcgccgttcccctcccctcgccgccggcggagatctgatccgatccgatccgatccgtttgtgcttgtgctgcagcaggagtgagaagtaaaaaaatatggctgccctgccactggccaccgccgaagtatgcgacgctaaccctcacctgatcatgaacggcgagctccgcgcgctccagccaatcttccagatctacggacggcgccaggtcttcgccggccccatcgtcacgctcaaggtctacgaggacaacgtcctggtccgcgagttcctcgaggagaaaggccacggtagggtcctcgtggtcgactgcggctgcagcatgcgctgggccatcc

SEQ ID NO: 36922 - DNA, 270 bp, Zea mays
  Clone ID: LIB3060-004-Q1-K1-B2
cccacgacacgactcgattcccagacccatatccatccatcaatccatccgcagcgggcaggcacacacacaggcttttgcgttggcagggatggacgcgttctactcgaccaccgacttctcctgcacgtcgtcagcgccgtacggcggctacggcggcggttgcgaaggctggggctacgactcggtgaagaacttccgccagatcagccccgtcgttccagacccagcttaagctcgtttaccttaccctatgcgtggcgctggcct

SEQ ID NO: 36923 - DNA, 319 bp, Zea mays
  Clone ID: LIB3060-004-Q1-K1-B3
ggagggggcacaacatctcagacctacagtcttcgagtcctcgttgtgcctctcttgatctcctcgcgtccatggctcctgtgcgaggtgccaagaagagaaagcggccagagaagcccgtcccggcgcctactccagggttgccgctgccgccgctgccggacggtagcgattggtggggcgtctactaccgaagggttgcatgacattccccttttccaagagaacaccagaacatggagtctggcctgaagatgtcaagaagaaccttctactgcttctgctcacttgttaagaatggcctgacaaccgaggcata

SEQ ID NO: 36924 - DNA, 226 bp, Zea mays
  Clone ID: LIB3060-004-Q1-K1-B4
ggctgcgaaggccaagctcagcggcggggttcgggagcccgtggtacggccccgaccgcgtgctgtacctgtgcccactgtgcggcgagccaccgagctacctgacgggcgagttcccgggcgactacggctgggacaccgtgaggctgtcgggggacccggagacgttcgccaagaaccgggagctggaggtgatccactcgtcgtgggccatgctgggcgcgct

SEQ ID NO: 36925 - DNA, 315 bp, Zea mays
  Clone ID: LIB3060-004-Q1-K1-B5
gtggactgaaaaactgaggagcatcatctccgatgtacaggagaagaacgggggtgactctgagctgcaatgcgggcgcatgacagcctgcgtggaaggcccatatgggcatgaatcaccctaccacttgatgtacgagaatctcgtcttggtcgcaggaggcattggaatatcgccattcttggcgatcttgagcgacataatccacaggatcgaagaggggcagcaatgcatgcccaagaacgtgctggtactttggttagttaagaaggacaaggagctttctctggtgttcgacggtgaagcccagaccat

SEQ ID NO: 36926 - DNA, 323 bp, Zea mays
  Clone ID: LIB3060-003-Q1-K1-F7
cccacgcgtccgcgagcggcgccgctcgttttcgacgagcagcagttgcggcggaggctgggggaagcggcgctccttctccgcaggatcaaagggcttgtgcgctggatcgtcgaagaggttgccgccggccgctccccgtctatagtgctccaccgtgcctgcagctacgacatccccgtcggcacggacgtcctctctctgctccacaaggactaccacacctaccgtctcaatgtgctcctgaaggtgctgtttgtggtgcattcagtttctgtagcagaacaagcactgcttcaagagggacatttactacatgtacc

SEQ ID NO: 36927 - DNA, 436 bp, Zea mays
  Clone ID: LIB3060-003-Q1-K1-F8
caagaacgaaggcagcctctgtttccttccgaccggcgatgaggaacccgccgggcaggcacctcctctgtctcagcagccgcgccgtgcgctcttcctcctcctcatcggcgctcggccccggacccggcgctgctacctccgccgcgtccccacgcccgcgcgccatcgcgcccgggcggcccctgcgcgccagttccccacccccgccttacgcagtcgccgccgccgcgtacgtggaggacggggactgggaggaggtcgtcgctggggggcctggtactggggagatggaggaagaacaggactacagggtggtgttctggtccccgccgaccatagacgaggttaccggcgcagtcaccagcatccagcaagtatttgagaatcctcttggactggattcagatacaactgacagacagacaacactact

SEQ ID NO: 36928 - DNA, 429 bp, Zea mays
  unsure at all n locations
  Clone ID: LIB3060-003-Q1-K1-F9
ccccatcgcccagatccaattcgcgagttctttctcctctgccgccatggcgctctctgtggagaagacctcgtctggacgggagtacaaggtcaaggatctctcgcaggcggacttcggccgcctcgagattgagctggccgaggtcgaaatgcccggcctcatggcgtgccgcgccgagttcggcccgtccaagcccttcgccggcgctaggatctcggggtctctccacatgaccatccagaccgccgtcctcatcgagaccctcaccgcgctcggcgccgaggtccgctggtgctcctgcaacatcttctccacgcaggaccacgccgccgccgccatcgcgcgcgactcggccgccgtgttcgcctggaagggggagaccctcgaggagtactggtggtgcaccgagcgctgnctcgactgggg

SEQ ID NO: 36929 - DNA, 407 bp, Zea mays
  unsure at all n locations
  Clone ID: LIB3060-003-Q1-K1-G10
gggacctcataatttccatcatatcttttattgcgactcatctgancgatcctggaagcaggaatttttttttcttgatgtcttttgagatttattgttgtttttttttaaaaaaagatcattatatctttctcaaattaccaagtgtttgcatagaattagggaaagacatgtagttcacatgcatctgtctttttttctggatgtctctccttacactctctgtattttctccttctttgaagaagggaaaaaattgaaataatcttctatcttggaatggaaatgagggaaagggtggacattgttgaattaaaacttacaaaggctggcttagaactccatttccctttgattcgggccccgctatcttcccaggccccatcaccctgcacccaccccttctg

SEQ ID NO: 36930 - DNA, 315 bp, Zea mays
  Clone ID: LIB3060-003-Q1-K1-G12
atggcgcgggaggctgaggccgccacctgggttcagaagcgccacatgtacgcgccggcaggtccaaagacgacgacgacgacggacgccgacaggccgccgtgggtggtgccgacgaccatcgggtttccgtcgccgcgcttatgacgtccgctgcacgtgtggggccacccgacgtcgcacgccggcgtggctgaagcagcagcggcgactcccatgctgctcgtgtggccgcgtcacctggcgccgacccggcacctggcgccgagggcgcactcgacgcctgtggacccggcgttctggcaccagcagtac

SEQ ID NO: 36931 - DNA, 446 bp, Zea mays
  Clone ID: LIB3060-003-Q1-K1-G2
gccaactttgcatagtcaaggtaaaagagaattgcgatgaggaaatggaatcgccaacaaagaacaatttgaatagcaacaatagcatcaaagatatttctcaagagcacaagaaattagcaaatggattcaaccttttccagaaggagctggaaagactgaaagatgagaatctgtctcctcttcttcccctagacgtcaatctaactgacccatcactcagtggtttggaaaggacattgtcacaactcgatatggcaaatgagcatttgcaaagtatttttccatcatttaaagagcttcctggttctggcaatgctttggaaagattactcgccttggaactcgagcttgcagaggctctccaagcaaagaagaaaacaaacatccttttccagaagtcattcttgaagcaacacaatgatgaagcggcgatcttccaaagc

SEQ ID NO: 36932 - DNA, 378 bp, Zea mays
  Clone ID: LIB3060-003-Q1-K1-H1
ggcattagagcttccatggaaggaagcatcacactagcaagccgagtgactgcacctgtggtcatggaaatggaattggaaaccagtagcgttttgtatttgcctgttgattcttatatttatttttaggaagtgggggaatgtgtagcaactaggaagcgagggaacaacatccagttgatgtgaagcattcatggcacagtaggcaatagtggcaaaggggtactatacatacacacttacgggacgcacaacataaataaagaatggttgattaaataactatttattttggggacacacccctaggatcaacccctacttggttcgagtttgaatactgatttggatcaacaagccaataataatgcgctttgt

SEQ ID NO: 36933 - DNA, 379 bp, Zea mays
  Clone ID: LIB3060-003-Q1-K1-H10
cgtcggggttgttaagctctcgctaaacctatacgccgggagcacaacacaagtgctcggcgaaatgactagcgccggggcggcgacaggcgccgcgctaggcgcgcggacggcgcggtcctgcgacggctgcatgaggcggatggcgcagtggcactgccccgccgacgacgccttcttgagccagacctgcgacgtctccgtgcactcggcgaacgcctatcgcgcgccgacaccacacgggtccgcgtaccctctgcatcctgctcctgacaccgcgcgacccggacgcgctaacgtggctccacggcctcaagcgacggccacgcacgccactgaccaagccaggggggagcacgagcaacatgcatgaggcgac

SEQ ID NO: 36934 - DNA, 426 bp, Zea mays
  Clone ID: LIB3060-003-Q1-K1-H3
gaaatccccgtgcagccttcttccagctcttcctactctttgctactcgtcttcgctgatttctgccttaattccatcccttccctgcctagaacttgctttgcttcaccccatcacagcttttggtgcctcgtcatcggcgacctaaccgccggcgaccagataaactaagccaggcccttcgctccgaaagtcgtctctcgtagagagcacttgctcacctgctcctcgccctcctctgctggcagtggacttgcgcggagtggagatccatccggacctggttcgatttcttcatctcggttgcttctcttgccaatgggtggatcactggattgtgggttgtgctaactgcatgctggcttgtcagcctattcataaggaaagtgaaaaagagacaacatagccaatttgtgtctcattctt

SEQ ID NO: 36935 - DNA, 383 bp, Zea mays
  Clone ID: LIB3060-003-Q1-K1-H4
gctagctgacctccaatccacgataaggtcatgataagctagctaggaaggcaagggatccgatggacaagtacgagcccgttcgcgagatcggagcgggcaacttcggggtggccaagctgatgaggaacaaggacacgagggagctggtggccatgaagttcatagagcgaggaaacaggatcgacgagaacgtgttccgcgagatcgtgaaccaccgctccctccgccaccccaacatcatccggttcaaggaggtggtgctgactcccacgcaccttgcgatcgtgatggagtacgctgcgggcggggagctgttcgagcgcatctgcgacgccgggcggtttcacgaggacgaagcgcgctacttttttcagcagctg

SEQ ID NO: 36936 - DNA, 230 bp, Zea mays
  Clone ID: LIB3060-003-Q1-K1-H5
gaaatccccgttcagccttcttccagctttttctactctttgctactcgtcttctctgggggcagccttaaggccatcccttccctgcctagaacttgctttgcttcaccctatcacagcttttggtgcctcgtcatcggctacctaaccgccagcgaccagataaactaagccaggcccatttctccgaaagtcgtctctcgtagagagcacttgctcacctgcttctt

SEQ ID NO: 36937 - DNA, 85 bp, Zea mays
  Clone ID: LIB3060-003-Q1-K1-H7
tcttgctactcatcttctctgagttctgccttaattccatcccttccctgcctagaacttgctttagctttaccccatcacagct

SEQ ID NO: 36938 - DNA, 260 bp, Zea mays
  Clone ID: LIB3060-003-Q1-K1-F6
attgccgtttcaccggcggcggggaggtttcgtgctagaggtgtgccggcagctggccggtgccggctgccaccgtcgacgtcttaacagcctaggactatacgaggggtgcagtcgctgcacatgagctcagagaatttgggctctcctgatgtcatctttcatcagctggacattatcgacgcttgtagcgtcatgcgtcttggcttgagatcctcaaggcttcgttttggaatgcctatatatcctgttaaataatg

SEQ ID NO: 36939 - DNA, 392 bp, Zea mays
  Clone ID: LIB3060-036-Q1-K1-D12
attcaagtcatgtacccctgatactaggttccccaagggagtgggtagaggatgctggtggtgcatcatttgccaggctatcatcacctacaccaagacattcaagggcatctttcgattctttagtaccttttacatcgagaaggcgcacatttgacagtcccaagagtcctggaaggcaattctcggatagccccagaagacaaactattgctgctgcagtatctttgtttggagctgatgatagatccaatcctagacttgatgaactcaataagaccatgcagtcactttgcatcatggctcataatgtatggataacatgggtgtccaccgaattatctcacattctttcatatgatatcagcaaagatgattcactatcctcttcg

SEQ ID NO: 36940 - DNA, 265 bp, Zea mays
  Clone ID: LIB3060-036-Q1-K1-D3
cgtgctcataggcgaccgcccgtgctaatctgatctacactatagcgttatttgcgggcgggcttgattcaggcatacccatcacgacactgacgccgttctccatgctgtaatccatctcctccagcttgtgcttgctgcaccagaccaccatgcacgtgctctcgccgtatacgagcctctccgagacctcgctcatagctcaactgttccagagctatgtccagatgcagcaggcctctactcctttaaacgacatgttgcg

SEQ ID NO: 36941 - DNA, 397 bp, Zea mays
  Clone ID: LIB3060-036-Q1-K1-D4
aacctatattggatgtggttttatttgtccgcatattgttaattgttctacacttggtggtgccataatatcgtggggtattctttggccatatatctccacaaaagctggggactggtatccagctgaccttggaagcaatgacttcaaaggactctatggatacaaggtttttatatctgtatctgtgatacttggggatggtctttataacctcatcaagatcatttatgctactatcaaggaaataatgaatgcacgggctaagcaaggaagactgccactagcccaagttcaggatggcgatgaaggttcaaatttatcagctgaggaaaagcatctgaatgagacattcataaaggacagtatccctccctggttggcaggatctggttac

SEQ ID NO: 36942 - DNA, 377 bp, Zea mays
  Clone ID: LIB3060-036-Q1-K1-D5
cggacgcgtgggcggacgcgtgggttactgcacaggggaacttggtacaaccatccgtggtatcagaatatgacctgggaggagaaggggacctgttcaaagctccagaagccatcatcgaggaaccgctgctcctgaactgtctgtctgattctgttcatttgttgttgtgtaggctgggcttgtgccaagcttgaatcctcttgtgaaggagtttctcaatgctgctgatgacaagcggaaggaagtcctctctaaaatagaagaggatgttgctaagctcagcggttctgcagccaactaagaagctacaagtgaatgccgaggagagcagcgatgacttggctaacccaccgaaagtagaggagaagcttggt

SEQ ID NO: 36943 - DNA, 419 bp, Zea mays
  Clone ID: LIB3060-036-Q1-K1-D6
aagaaattctcaccggacacatggacattttctttactcccttccaggatatgaagcgctacaaacttccgaacacagatgaaagtatcatacagcaagcagtacgctatctttcccagacaaaaagcgacagcacgtgacgaccagctcgtgggcaaaatgggcgtccgagacagcaggacgcagatcccactgcacaagtgaaagaaggcctgaccaaggcagcgtcgctctcccttcagttcagcgccaggtaagtaagctgcccgccctcatttgttccgaactgtctgttccggtggtcttggaggagccatgccagcagcatcagagcctctcatgatcctaagtttccggcaaaatgtggtgaacaagtcccaaggcagatcaccaacgagcatccagtcagcatctttatc

SEQ ID NO: 36944 - DNA, 179 bp, Zea mays
  Clone ID: LIB3060-036-Q1-K1-D8
gggaacagacactataacgcatcctctcactctctgttctctgaccttaccgggagcgtattagctaatgcggctcatattatgctctgttcaacatgtcatgatgccataccattaacatatcaccttccctacaaacaacacctccaagccaaactggcattcgagtagtcatgtct

SEQ ID NO: 36945 - DNA, 411 bp, Zea mays
  Clone ID: LIB3060-036-Q1-K1-D9
gcagggtcatcccaagatcctcttgaccttctatttatcaggcaaggtaatctatccgagggaaagtgctcttatgttgtaattggaagggttattttcagcattttggggatattcatggctgcggttgtcacatatactgtcatcactgatggactaccttttaggaaggaattgttgacaccgtggatggcggcaaccttaattgatttctacataaatgtctttgcgatatcggtctgggttgctcacaaggaatcatcatggatatcaactaccatttggattgtcttgctgatatgctttggaagcatcacaacatgcggctacattgtcatccaacttttcaaagtatcatatcaagatccaatctaccacgtgctattgaactcccacagcaggtaccacaat

SEQ ID NO: 36946 - DNA, 401 bp, Zea mays
  Clone ID: LIB3060-036-Q1-K1-E11
caagaaccgcgagctggaggtgatccactcccgctgggccatgctcggcgcgctcggctgcgtcttccccgagctgctctcccgcaacggcgtcaagttcggcgaggccgtctggttcaaggccggctcccagatcttcagcgagggcgggctggactaccttggcaaccccagcctgatccacgcgcagagcatcctcgccatctgggcctgccaggtcgtgctcatgggcgccgtcgagggctaccgtattgccggcgggccgctcggcgaggtcgtcgacccgctgtaccctggcggcagcttcgaccccctcggcctggccgacgaccccgaggccttcgccgagctcaaggtgaaggagctcaagaacggccgtctcgccatgttttccatgttcg

SEQ ID NO: 36947 - DNA, 419 bp, Zea mays
  unsure at all n locations
  Clone ID: LIB3060-036-Q1-K1-E12
ccagctttgaccgccgnctgccttcccctccgctactgctcctccccaccccactgggccgcatgatcggcggcggcggcggcgaggtcgtaccccacatcggcgagcggcggcggcaccgccggaggcaaaggcaagatgttcgggcgcgcgccgaagaagagcgacaacaccaagtactacgagatcctcggggtgcccaagtcggcgtcccaggacgatctcaagaaggcctaccgcaaggctgctatcaagaaccaccccgacatgggcggtgaccccgagaagttcaaggagctcgcacaagcctatgaggttttgagtgatccagagaaacgtgagatttatgatcagtatggtgaagatgcccttaaggaaggaatgggcggtggaggatcccatgttgatccatttgacat

SEQ ID NO: 36948 - DNA, 425 bp, Zea mays
  Clone ID: LIB3060-036-Q1-K1-E2
agaggcgactccaggtttgttggcgatgctgcgagcgggaggcaggcggctcctggccccggggctccgtcggctcggcctgggcacaggcgcctccggcgaggcgggccctgccgcggcggcggcgggggtgagggcgtaccacgagcgggtggtggaccactacaacaacccgcggaacgtaggttccttcgacaaggacgaccccaacgtcggcactgggttggtcggcgcgccggcctgcggcgacgtcatgaagctgcagatccgcgtcgacgagaactccggcaagatcgtcgacgcctgcttcaagacttttggctgcggctccgccatagcgtcctcgtccgtggctactgaatgggtgaagggaaaaccaatggatgaagttttgacaatcaagaacacggagatcgcgaagcact

SEQ ID NO: 36949 - DNA, 424 bp, Zea mays
  Clone ID: LIB3060-036-Q1-K1-E3
gttcgctcactcctagcttgcctcgctggctggtctttgagcttctcgtgctacgagccagagggaggccatcttttcctgctcggttctgtcgtgcagacgggaaagattgagctgatctgctgctagctggggatcctgcagaggctaccgcgttcttcttgtctggggtgcacagtgcatgggcagtgggtgaactggtagagagcaagatggggaattgcatcgacaccacggcgcgggtggatcacagcatgaacaatgctgcctacccatcaaaagtgaccagcaagacaagtttgtcgtcaatcccttccacaattaagagcaactcaagtcgttcaacactgactcttccatcaatgagagatcgaaatgagcttcctactcctcggacagaaggtgaaaatctggcatcttctaa

SEQ ID NO: 36950 - DNA, 430 bp, Zea mays
  Clone ID: LIB3060-036-Q1-K1-E4
cgcgagacgaacgcaaacgaagtgcggaaaataggcctattttttcttcttcctcggagagatatttcggaagagggagtgcgtgccttcctctcagctgattcgccgaggacacgagatcctctagagggttgtgctgtttggcgtgaggctttgggggcgatttgctttgctcgcatgggggatcatgtcgctgtggatgttggggagctcgttgcgtcccgagtcggtgaggcagcggggctattgtccggcggcaaggaggaaatgaaggcgctggctgggatggtggagtgccgcatttgccaggaggaggacctcgcaaagaacctcgagagcccctgtgcttgcagcggcagcctcaagtatgctcacagggaatgtgtgcaacgttggtgcaatgagaaaggagatataatctgtgaaatct

SEQ ID NO: 36951 - DNA, 399 bp, Zea mays
  Clone ID: LIB3060-036-Q1-K1-E5
gaggcagcgacacgatcgcgagcgcacgcacgtaagcacgttgtcggaagctgaaggtagaagaagcaccagtgcctgatcgatggcggcccaggctctcctctccggccggcagctgctgggccgccccgtgcagtcggccgtctctaggtcgtcggcgaggaaggcgcccttcgtcgtcagggccagctccagccctccagccaagcaaggtgccgacaggcagctgtggttcgcgtccaagcagtccctctcctacctcgatggcacgctgcccggcgactatggcttcgacccgctgggcctctcggacccggagggcaccgggggcttcatcgagcccaagtggctggcctacggcgaggtgatcaacggccgctacgccatgctgggcgcggt

SEQ ID NO: 36952 - DNA, 395 bp, Zea mays
  Clone ID: LIB3060-036-Q1-K1-D10
aagaaattgttagattaaatggtgtgtatcagaggatccttaccagtgccggtgtgagaatgattgaaggggcatgcagtctagttgatgctcatactgttgaagttagccagcctgatggttcaaagcaaaggtatacagcgaagcacattttgatcgcgactggtagccgtgctcaacgtgtcaacatacctggaaaggatctggctattacttctgatgaggccttgagcttggaggagcttccaaagcgcgctgtaatcctgggtggcggatatattgctgatgaatttgcttctatctggagggggatgggtgctgaagtagatctgttttatcgaagagatcttcctctaagaggttttgatgatgagatgagagctattgttgcaagc

SEQ ID NO: 36953 - DNA, 406 bp, Zea mays
  unsure at all n locations
  Clone ID: LIB3060-036-Q1-K1-B4
cacaacatcatcaggatgtctttggttgattggaacttctcatccttgatgcaactgttgggcaagcttttattgcacataaattgcctctacctgttatggtcattagtggaaaactggctgttgtagttgcttcgtagactgaatatttaaaaagaagctaagatattagtcttcattttttttccaacgaagttacccatgtaggttggactgttgttgctgctggaaatttcacggttagatgatgactgagtgactgacgccatttcagttctcattgtaatatgtattatggcccaattaagcatcaagttgaaacatgattgaatcttatactcacattttgtgttgtacctctattctggtcagtggtatgctntctaatggacaactgacattcagc

SEQ ID NO: 36954 - DNA, 385 bp, Zea mays
  Clone ID: LIB3060-036-Q1-K1-B6
ggcgccggcgaaccccaaggacgagtaccagcactggatcaaggacatgcgggggggcacgagcatcaaggacgaggaaggttacccggcgttcgcgctggtgaacaaggcgaccggggaggccatcaagcactcgctggggcagtcccacccggtgcgcctggtgccctacaacccggacttcctggacgagtcggtgctgtggacggagagccgcgacgtcggcaacggcttccgctgcgtccgcatggtcaacaacatctacctcaacttcgatgccctccacggcgacaagtggcacggcggcgtccgtgacggcaccaacgtcgtgctctggaagtggtgcgagggcgacaaccagcgctggaagatccagccctactac

SEQ ID NO: 36955 - DNA, 400 bp, Zea mays
  Clone ID: LIB3060-036-Q1-K1-B7
gtcgttgtgagaattcttaattcatgagttgtagggagggacttatgtcacggacagcagaaactaaagcaagtgttggatttaaagctggtgttaaggattataaattgacttactacaccccggagtacgaaaccaaggatactgatatcttggcagcattccgagtaactcctcagctcggggttccgcctgaagaagcaggagctgcagtagctgcggaatcttctactggtacatggacaactgtttggactgatggacttaccagtcttgatcgttacaaaggacgatgctatcacatcgagcccgttcctggggacccagatcaatatatctgttatgtagcttatccattagacctatttgaagaaggttctgttactaacatgtttacttt

SEQ ID NO: 36956 - DNA, 415 bp, Zea mays
  Clone ID: LIB3060-036-Q1-K1-B8
ccaatccaaaccagacaagcaaggaatcccccgatggctcatcgcgttctgcgccggctctctctcgcgtcgggcgccgcggttgccgccgccgtcgacgcggaggacccgctgatccggcaggtggttcccggtggagatgacaacgatctggagctgaacgcggagtcccacttcctgagcttcgtgcagcggttcggcaagtcctacaaggacgccgacgagcacgcgtaccggctgtccgttttcaaggccaacctgcgccgcgcgcgccggcaccagctgctggacccgtcggcggagcacggcgtcactaagttctccgacctcacgccggcagagttccgccggacctacctcggcctccgcaagtcccggcgcgctctcctcagagaactcggggagtcggcgcacg

SEQ ID NO: 36957 - DNA, 393 bp, Zea mays
  Clone ID: LIB3060-036-Q1-K1-C1
caaagatccaagctccccacccttcctcatggtcatggcggcacctcgtgttctaggtctggcttaccccgcccagggccatgtcatccctatgatggagctctcccactgcctcatcgagcacggcgtcaaggtcaccttcgtcaacaccgaggtaaaccaccgtctcattcttggtgccttggcgaccggagacaaagaactcggcggggtcgacatggtgtccataccggacggcctgggctccggcgaagaccggaaggacctcggccgtctcaccgactcgttctccaaggtcatgcccggcgagctggagaagctcattacaagcatcaacgccgatggacgagagcgcgagaggccagctggttgatcgccgacgtgaacatggcg

SEQ ID NO: 36958 - DNA, 327 bp, Zea mays
  Clone ID: LIB3060-036-Q1-K1-C11
accgtcgcggtagagaggggagggagagggggaaaaaactgtcccagatcgagaggtacagcacgaaaaagagaggctagagagataggggaccggagggcggctggccggggcccaagaccgaggggctcgtgcgcaggaagctgatgaggctcctgtcgctcgtccccttcggctgccgtgctggacccatcgacgacgcgccgtcgtccgtggaccacgccgccgccgcgaggaggcgccggacgaggagggccaacatggcctgccagctgctgggggctgctgcgggtgcgccgcagcagtggcgcccctcgctcggcgaca

SEQ ID NO: 36959 - DNA, 416 bp, Zea mays
  Clone ID: LIB3060-036-Q1-K1-C12
aaccatagttggcattgaggacgatggcgagcgtgacgcttacgttcttgtacgagtgcgcgcgctacacaaccctttaaaggttcgcttttcaacggtggagagggtaacatatggttttgctgctggagactgggtgcggctgagggaggaggacaagaagcgctctcaggttggcattcttcacagcatcgaccgtgacggtgcagtggcagttggtctgataggagtggataccccttggaagggcaattattcagacctccagatggctgaagcctactgtgtcggacagtttgtgcgcctgaaggccagcatttcaagcccaaggttcgaatggcagcgaaagcggggtggattagcttctactggccgaatttcacagatacatccgaacgggttgctcgtcgtgaaat

SEQ ID NO: 36960 - DNA, 428 bp, Zea mays
  unsure at all n locations
  Clone ID: LIB3060-036-Q1-K1-C2
cggacgcgtgggtttttgatgagtagagggggctccccgtctcggccctcctgccggttgaggccagcagagtgatgagtgaacggagtcatgcttgtgagattaggctttgtcgttgtagcctccgtcgcagctttaactcttcagagagctaacagtggggccaggcacagcaaagactatgtccaagcaaggaaaaggaaggataaggctaacaattctgaacatggggagaaagaagaagagaaggaagaggttaaaacaatcagcggcataatcaactcagcccgctcgctagacgatgacgacgatgatatgctttccgagatcgaaagcctcctatcaggagacattgacatccctataccaagcgatcgcttcgacgttaatggacggtcacggtacaacaacgcttacatggnctacga

SEQ ID NO: 36961 - DNA, 388 bp, Zea mays
  Clone ID: LIB3060-036-Q1-K1-C3
agcgactagcgagcgagagcagcacacacgcagctagctaggagcagcagcagaggagcggcgatggcggcctccatgatctcctcgtcagctctggcggtggcgcctcagggcctgccgcccctcggccgccgcgccttctccttcgccgtcgtctgctccaagaagaagatcaagaccgacaagccctacgggattgggggtggcctgaccgtcgacgtcgacgccaacgggagaaagggcaagggcaagggcgtgtaccagttcgtcgacaagtacggcgcgaacgtcgacggatacagcccaatctacaacgaggatgactggtctcccaccggcgacgtctacgtcggtggaaccactgagcttctgatctgggccgtcaccc

SEQ ID NO: 36962 - DNA, 425 bp, Zea mays
  Clone ID: LIB3060-036-Q1-K1-C6
agcaaccttcacgagctgcgtggtgaggttgaccaggactccttccggatcgggagataaggccaccgctcgggtcctctccacctccctcctccttcactccctccccttgcgtttagcctcccgctgttgtggagccgcgggccattcccaaccatcgttgcggtggtggccggtattggccgagacccatgggcatccaggtcgcggcggtcgtgatcccgccgccctgctcttctccttcctcctcctcctcctctccggcgtcgccttcgtcctcggccattgccacgtcgccgcagcatgccgttcttggcgccaggctggcgaggagccagtcgtcgctggcttgctggaacgccgccggtctcggccggcggcgcggcggcgagcacacgatcaggcgcgctctcagcgcgagcatc

SEQ ID NO: 36963 - DNA, 392 bp, Zea mays
  Clone ID: LIB3060-036-Q1-K1-C7
agaggactaggcgcttcggggctccgcgcgcggggatggacatggacctggccaggggcgccgtcgaggtgatcaacgacctgggcttcgacacgctcaccttcctcggcgtcacggtcctcgtcgtccccgccttccgcgtcgtcaatgccagcccaattctcggcttcttctgcgccggcgtcgtgctcaaccagttcggcctcatcaggaacctcaccgacgttaagctgctctccgagtggggaatccttttcctgctgtttgagatggggctggagctctccctctctcgcctcaaggctcttgcgaggtacgcctttgggatgggcttgcctcaggttcttttgtcaacccttgctttcacggcgttcgagctttcttctaatgat

SEQ ID NO: 36964 - DNA, 402 bp, Zea mays
  Clone ID: LIB3060-036-Q1-K1-C9
agggaatcctgtacttaggcattcacggagcttgcctgaaactggccgaggagcaagacagaaggtctcatcaattacagagaaactatcccaaatgtctgtgacctctagaacacggagcgctgtgaagcctgctgcccccatgatgaaggccggacatggcaagtcggactttcttgggaagtctgacgatatccctccagcaaagaggctgacaagaaaattggtcagctaaatgagggtatgtggagtgaaaattcgatcagctgcaagaggggtgttgtgtatagtgtgcagaaaccagtgtgcccgaagaggatagtcagcctgagcgtttgcccatcgatggttgtgcggatttgccatcaccacagtttcgctgcgtcgagacatattagaatg

SEQ ID NO: 36965 - DNA, 419 bp, Zea mays
  unsure at all n locations
  Clone ID: LIB3060-036-Q1-K1-D1
atcctatgctgccacatcgaaggaagatgatgacttcctcaaatcttgcccatcggatcgatgccacaagcatggaccagagatccggttcccctttcggcttccaagccaccctccatcctgtggcacacctgggatgcaattatcatgctctgggcatgacaccatccttgatcatccagttcttggctcctgcagagtgacagcaatatattacaggcatcgtgtcatgaatgtcatcccgccagaggactcatcgtcacactgccaacttcagaagcttgttaaaagaaatcaatcaactgatgtgtacacacctgtagcacatcctgtctcagtagttgtaggatgctcaagagaagcaacaaaccaagatgatattgcangcccaagctcttngccgagcctcattaacaatg

SEQ ID NO: 36966 - DNA, 379 bp, Zea mays
  Clone ID: LIB3060-036-Q1-K1-B3
gcgcagcacttgatctcctccattatctgtgcgggcttaacagtcggagtagtagggttggtgaaagccaatgggaaacaattttgctctaggccccgtctgtgtggtctaatctaatccttggtcttttcccccccttccctttcatattgccctttgttagaaattgaatgtaaaaggattagaatgttgttttattcgttgcaagagtaaggttaaataaggaggcaggatggcctgccggtcccgtaatctgaagctgctaatttgtaagcctatagtttggatttgcacattctatttgttatactttatatgtatccatgaatagaaaattacgcctcgaaattccaaatttgtaataaatccgagagaccac

SEQ ID NO: 36967 - DNA, 381 bp, Zea mays
  Clone ID: LIB3060-035-Q1-K1-H9
cttggttacagaggaatttttccagctgacacaataccacccctagttgagtgtgacgaagaagcagatgaacgccattatcaactttggcggatagaaaatggagtcgcagaaggttcaactgagatcccaaaaggtgaagcaatcccgctggagtacaatcttgctggcttgaacgccatttcgttcgagaagggctgctacatcgggcaggagcttatcgcgcggacgcaccatcgcggtgtcatccggaagcgcctaatgccaatgaagttcgtcgacgggaatgggcaagaactcgagcatgccgtcgctccaggctcggaggtcgtggacgaggcttcaggcaagaaggtccgagcagtgagcaccgctctgggc

SEQ ID NO: 36968 - DNA, 344 bp, Zea mays
  Clone ID: LIB3060-036-Q1-K1-A1
ggagaggagaggaagaagaagaacccagtcaaatcctcagtcctcaggctgctcacagctcgtgccgtccactctctcccgagccagtctattgcgttcgctgctcgacatggcgctccacgcggcgacgtacttgctccgctctgccctctccacgcgcaaggaggggtcagcgaaggactcggcgtcgttcttgggtgttcggctaacggcggatggactcaaactggacaccaccgatctgggcctacgcaccttgagggtgagccatgctgcagacatccgcgcgcagacggcagctgtgtactgcccgatagtgacccccgcgtcgacgtctggcaaga

SEQ ID NO: 36969 - DNA, 401 bp, Zea mays
  Clone ID: LIB3060-036-Q1-K1-A11
ctggtgcccctcctggcggtcatgatcgtgccctgcacgctcatcgcgcatgccaacactctgttcgtggagcagggcacgacgatggaccggcacatgggcccgcgcttcgagatcccggcggcgagcctgggcgcgttcgtgacgctgaccatgctggtggccgtggtggtgtacgaccgggtgttcgtgagggccgtccggcggtacaccaaggacccgcgcgggatcacgatcctgaggcggatgggcacgggcatgctgctgcaggtggcgaccatggcggtggcgtcggcgatcgagagccggatgctggcctacgcgcggagccacggcctggacgccactgtgggccagctgaggctcaccatcttcgcgctgcttccgcagttcgtgctgat

SEQ ID NO: 36970 - DNA, 409 bp, Zea mays
  unsure at all n locations
  Clone ID: LIB3060-036-Q1-K1-A4
agcccacatagcccttccagcaacgcgcgatcgaagggttgagagctattggaagcgagtacgtgcatggcgaggtttgcgctcgtggcgtgcgccgctgccacggcggcgctgctgctcggcgtggcggcagcggacgtggcgtcgatcatcacgcaggacgtgtacaaccagatgctgcccaaccgcgacaacacgcagtgccccgccaacggcttctacacctacgacgccttcatccaggccgtcaacttcttcccggggttcggcaccggctccagcaccgacgaactcaacaagcgcgagctcgccgccttcttcggccagacctcccacgagactaccggtggcacgacaggtgccgtcgaccagttccagtggggttactgcttncaggaggagatcaaca

SEQ ID NO: 36971 - DNA, 360 bp, Zea mays
  Clone ID: LIB3060-036-Q1-K1-A5
gacctaccacagggctgggccaaccagtcccgatcgatcagccagcatggcgtcctcctccaaacggtcgctgccatgcgtgctcctcctcctcctcgctgtcttccaccacggctgctcgtcggcgagggcccacagacgcgccggcgacatggaggggagcatgagcaccgacgacagctcgatgatagagcggttccagcggtggaaggcggcgtacaacaagtcctacgccacggtcgccgaggagcggcggcggttccgggtgtacgcgcgcaacatggcgtacatcgaggccaccaacgccgaggccgaggcggcggggctcacgtacgagctcggcgagacggcctacaccga

SEQ ID NO: 36972 - DNA, 429 bp, Zea mays
  unsure at all n locations
  Clone ID: LIB3060-036-Q1-K1-A6
cgccatggcctccctctcctctgccgccgtcaccgccccttccttcgccgcggcagggccagcccgcgccgtggtcagaaggaggtccttcaccgtgcgcgcctctctccgcaaggccaccggcaccgccgccgtggcaatggctgccagcgccctgcttgccggcggtgccatggcccaggaggtgctgctgggcgcaggcgacggcgggctcgtcttcgagcccagccagttcaccgtcaaggccggcgacaccatcacattcaagaacaacgccggctttccgcacaacgtcgtcttcgacgaagacgaggtgccgagcggcgtcgacgccaccaagatctcgcangatgagtacctcaacgcgccaggcgagacctactccgtcaccctcaccgtgccgggaacctacggcttctactgcgagcc

SEQ ID NO: 36973 - DNA, 409 bp, Zea mays
  Clone ID: LIB3060-036-Q1-K1-A7
gtgggaggaacatccgtccgtgaggaccaaaggattcttggcagtggtgtgcgtggtgttgttggtacacctggtcgtgtgtttgatatgctgcgcagacagtccctccgccctgataacatcaagatgtttgttctagatgaagctgatgaaatgctttctcgtggtttcaaggatcagatttacgacatcttccagcttctcccagccaagattcaggttggagtcttctctgctaccatgccccctgaggcccttgagattacccgcaagttcatgaacaagccagtgagaatcctcgtgaagagagatgagctgactcttgagggtatcaagcagttctatgtgaatgtggataaggaagactggaagctggacacactgtgtgacctgtacgagacccttgcca

SEQ ID NO: 36974 - DNA, 337 bp, Zea mays
  Clone ID: LIB3060-036-Q1-K1-A8
gcttaattagttgacggtgatcttgctttgtactccgccgatctgtccatctgtagatgttttcgtcttcacacaacaacctctgctacgactacgtatatatgcatgctactagctgattgattttaacgaccagtccgaccccgaaagctagcttggaccaagttttgtacccattaattctaccgatgcatctctcagtttagactcccataatcatacaaactgctagctttcatctgcatctgcttagtacatctaactatttgtaccgcaaggtgacgtttttgcagaactcctaattatataccatgcataataaagtggtgtcaacaat

SEQ ID NO: 36975 - DNA, 368 bp, Zea mays
  Clone ID: LIB3060-036-Q1-K1-A9
cctgaggctggtgcccctcctggcggccatgatcgtgccctgcacgctcatcgcgcagacgagcacgctgttcgtgaagcagggcacgacgatggaccggcacatgggcccgcgcttcgagatcccggcggcgagcctgggcgcgttcgtgacgctgaccatgctggtggccgtggtggtgtacgaccgggtgttcgtgagggccgtccggcggtacaccaaggacccgcgcgggatcacgatcctgaggcggatgggcacgggcatgctgctgcaggtggcgaccatggcggtggcgtcggcgatcgagagccggaggctggcctacgcgcggagccacggtctggacgccacggggggccagctga

SEQ ID NO: 36976 - DNA, 414 bp, Zea mays
  Clone ID: LIB3060-036-Q1-K1-B10
gttgtgagaattcttaattcatgagttgtagggagggacttatgtcaccacaaacagggactaaagcaagtgttggatttaaagctggtgttaaggattataaattgacttactacaccccggagtacgaaaccaaggatactgatatcttggcagcattccgagtaactcctcagctcggggttccgcctgaagaagcaggagctgcagtagctgcggaatcttctactggtacatggacaactgtttggactgatggacttaccagtcttgatcgttacaaaggacgatgctatcacatcgagcccgttcctggggacccagatcaatatatctgttatgtagcttatccattagacctatttgaagagggttctgttactaacatgtttacttccattgtgggtaacgtat

SEQ ID NO: 36977 - DNA, 401 bp, Zea mays
  Clone ID: LIB3060-036-Q1-K1-B11
gacaactacgcatctgcggggcgccctccaccgggccccgcggcctcttcccccgggcggcccttctcggccggccgcttggcgttccgcacctccgaacgtcgccacgtaacccgggaactggccgcctacgacgtcgtcttcctggcggcgctcgtgggcatggccgccgaggagaaggcgcgcgtcgtcgagcacctagggaggcacatggcgcccggcgccgcgctggtggtgcggagcgcgcacggcgcgcgcggcttcctgtaccccgtggttgaccccgaggagatccgccgcggcggcttccacgtgctcgccgtgcaccacccgtgaggggaggtgatcaactccgtcatcatcgcgcgcatgccactgccggtcgtcgacgagcacgcccg

SEQ ID NO: 36978 - DNA, 402 bp, Zea mays
  unsure at all n locations
  Clone ID: LIB3060-036-Q1-K1-B2
gaaccagtgtgctagtgctacagctacggcctagctacctaacctactacggcgcggctagcagcggcggccatgaccgacgggcgcgaggagagcaccagcagcaggtggccagagctggccgccctgcgcgcgctggcgcgcgacgcggcggcccgggccgggagggagacggcggggtggcgcgggcgggagcgggaggatcaccgccacggccacggcaagacggccaaggtcatgcacctgctgctctggggacccaaatgaggtgaagtgaagcgctgctgctgcagcacagcacctgcctctgcctcgtggcccgcgcgcggcgtcctcgcttncttctccgtccgctgcccgcacgggttgtacttgtacatgtaccactggtagactagtact

SEQ ID NO: 36979 - DNA, 436 bp, Zea mays
  Clone ID: LIB3060-003-Q1-K1-D7
catcgatctacacacatacatagtttcttctactacacgacgacaaacatggggaagcctgcgaagatcggagagtggggtggatacgccggcgatcgtcgggatctgagggctactccggaccggctgatcgaggtgaaggtcacggcggacaacagcagctgcatccgctccatctccttcatctacatcggagccgatggcaaaccgtacgaggaggggccatggggtttcggccatgctggcacggagtacaagattgatctgtgcaggttcgacgagagcttgacggagatctccgggaccacgggcccagcctacaacattgacaatctggtcaagtctctcaaattcgtcaccaacaaacgcgcttacggaccgtacggcagggacgagggcaccccgttccgtgtcaaggtgatgaacaacggccacg

SEQ ID NO: 36980 - DNA, 330 bp, Zea mays
  Clone ID: LIB3060-003-Q1-K1-E1
catcgatctacacacatacataggtttttctactacacgacgacaaacatggtgaagggggctaagatcggagagtggggcggatacgccggcgatcgttgtgatctgagggctactccggaccggctgatcgatgtgaatgtcactgcggacaacaacagctgcaatccgctccataatcttcatctacatctgatcctatggcaaaccgtacgaggaggggccatggtgtttctgccatgctggcacggagtacaagattgatctgagcaggttctactaagagctttacggagaatcttgggatccacgtgcccaacctacaacatt

SEQ ID NO: 36981 - DNA, 429 bp, Zea mays
  unsure at all n locations
  Clone ID: LIB3060-003-Q1-K1-E10
cccacgcgtccgccactccagcactgaacacttgattgattcagtaggtagctagctagctgaatcacaatggatcctaccaagttccgtccgtccagtagccacgacacgacggtgacgacgacgaacgctggcgctcctgtgtggaacgacaacgaggcgctgactgtggggcctcgcggtcccatcctgctggaggactaccacctgatcgagaaggtggcgcacttcgcgcgggagcgcatcccggagcgcgtggtgcacgcgcgcggggcctncgtcaagggcttcttcgagtgcacccacgacgtgacgtcgctgacgtgcgccgacttcctgcgcgcgcccggcgtgcggacgcccgtgatcgtgcgcttctcgacggtgatccacgagncggggtccccggagacgatccgcgacccgcgc

SEQ ID NO: 36982 - DNA, 282 bp, Zea mays
  Clone ID: LIB3060-003-Q1-K1-E2
taccgtatcggaattacccggcgccgaaccagcgccagcccgctccgttgttataaggaggtttttcaccgcgcgcgcctctctccgcaagggcgcggtcaccgacgtcgtggcaatggctgccatcgccctgcttgccggctgtgccatggcccatgaggtgctgctgggcgcatgctacggcggtctcgtcttctagcccatccagttcaccttcaaggccggcgacaccatcatattcaagaacaacgccggctttccgcacaacgtctacttcgacta

SEQ ID NO: 36983 - DNA, 442 bp, Zea mays
  Clone ID: LIB3060-003-Q1-K1-E3
cgtcttcctcttcctcttcctcctcctgcctcgatctgacgagagctcagccttgccttagtctcgccatcgcagaaggcagaagcactagttcctgatagccacaaaaccaaccaaaggcaccaaaggccaagctaccgtgaggtgagggaaagggaaagatcagatatcgcctattcgcctacctctgtgtgcatcagaagatgatccccttcataaagatgaaacattcccattccctccactagaagctccgggaggacgcagcaagctcaccgaagccagcaaccgatggatcagaggcgcgtcacggcgaggttcggcagcaagacgagctcggagcggaggatgctgcggcgagtgaggctccccttctggtcctgccctccaaaccggccttcaggcacctgaacgcctcgaatcctcgatagaacagctggtc

SEQ ID NO: 36984 - DNA, 259 bp, Zea mays
  Clone ID: LIB3060-003-Q1-K1-E4
gacacacgcgtgctgctacgtccgcccttttttacttctttttttatcttgtctttagcttcatacttaccggggcttttttcatttttttatgtaaaataaatatccccgaacaactttattacatgcattattacaaagggcctacctaccagtttattaacgtatccaatagaacccttttgctctattccgttaatttattcaacttatgacattcatgcaaaaaacacctttagacaaaaaaaccccgttttat

SEQ ID NO: 36985 - DNA, 442 bp, Zea mays
  Clone ID: LIB3060-003-Q1-K1-E7
acttgagcaattggttcccgttatggatcaaaagacatattgggctgttgtgtcgaaaaattttgcttcaaagcccaggatagatttgataaagtactatctgaatgtgttcctgatgagaagagtgttgtaccagtgcagactcggtcttctggaaattgatagtgacgaagatgacgtggaggaagaagaggatgaagatcaacctgaaggatccagctctcttcagaggactcaagatgcccaagacttgaagaaggtgccatgattctgctgacaacaatctgacatgcttttttgcatgtgccttttgttcaagtttatgctgagacattgcatcaagtgatgcaccattgctccgagtgattgcaagtctaattttttgcagattttttggttgagggttgcattcactttggttcagccatcttttgtggacaga

SEQ ID NO: 36986 - DNA, 431 bp, Zea mays
  Clone ID: LIB3060-003-Q1-K1-E8
cctccgcttcctcgccaggttcctcctcgtcgcactcctgctcggcaggcgttcgcacaccgtcccgcgtctcgcctcggacatacgcacgctcttagatgactccaaaaagtccttccaggatgccgaatacaaggagtggaagcatgtcgtgcaagagatcgcgaggttcctgcgagctgactcaccatttatgaacatgaggccgctcaggtacagctatgcattcgatccgcccccggacacgcttcgtactgtgccaactactgtcaagaagcgaggtctcgtcttaagtgacaccatactttgcagctactatcctaacgaggtcaaatttacagacctctccatagatgtattcagaatggttcagtgcctcgaatgggaaccatgtgggtcatttgcgctaaacgatgtttacagcgcccatg

SEQ ID NO: 36987 - DNA, 405 bp, Zea mays
  Clone ID: LIB3060-003-Q1-K1-F1
cccactactacagtgcccgccgccgctgcgtccaccaccacctcctttcccaactcctgcgcgtacccccgccctctccggcggcccgcgtaaccacccgcgcagatggcgacggcggccacggcgtccgcgacggcggcgacccgcttcacgctcctagcgggcgccggcctccgcagccgcatcagccgcctccccaccgacgtgcggttccagcgccagcgggggctcaccaccaccgcgctcctgaagaccgacgaccttcagcccaaggagcagggcaagcccgagacgctcgactaccgcgtgttcctcgtcgacggccggggccggaaggtgtcgccgtggcacgacgttccgctgcgcgccggggacggagtgttccactcagtcgtctagataccc

SEQ ID NO: 36988 - DNA, 414 bp, Zea mays
  Clone ID: LIB3060-003-Q1-K1-F10
cggatcgacccacacgtatccataagctgacatctgatcgtcatggccgccgttaccatggctctcacctcccgcgcgctcggcggcaagccggcgaccagcaccagggacgtttacggcgaggggcgcatcaccatgcgcaagactgctggcaagcccaagccagcggcgtccggcagaccctggtacggggccgaccgcgtactgtacctgggcccggctgtctgccagacatcaagctacctgaccggcgaggacccacgagactacgggttggacaccgcagggctgtgcgccgacccggagactttcgtcaagaaccgcgagctggaagtgatccactgacgatgggccatgctgggcgcgctcggatgcgtgttcccggagctgctcgcccgcaacggcgtcaagttc

SEQ ID NO: 36989 - DNA, 258 bp, Zea mays
  Clone ID: LIB3060-003-Q1-K1-F12
tcccgctcccttccacgggactctagacaatggttggcgatcgccaacgactcgcactgtataaatgcatacgcctcagatccgccatggcgcgcccacgccaccagccgaccattcggctgccgaacgagcgctcgacaggcgactacgccgtactgacccagaggaccgtgctcatcagcggcttcaacggctactacaactaccggcaccaggcggacatatggcatgcataccagatcatgaagaagggcggac

SEQ ID NO: 36990 - DNA, 275 bp, Zea mays
  Clone ID: LIB3060-003-Q1-K1-F3
cccacgcgtccgcgagcggcgccgctcgaaggcgacgagcagcagttgcggcggaggctggaggaagcggcgctcctcctccgcaggatcaaagggcttgtgcgctggatcgtcgaagaggttgccgccggccgctccccgtctatagtgctccaccgtgcctgcagctacgacatccccgtcggcacggacgtcctctctctgctccacaaggactaccacacctcccgcctcaatgtgctcctgagggtgctggtcgtggtgcagcagcttct

SEQ ID NO: 36991 - DNA, 455 bp, Zea mays
  Clone ID: LIB3060-003-Q1-K1-F4
gattcccggtcgaccagcgttcggcgccgcattcccaccagtgccccggaaaccaggattgccgtgtcaccggctgcaacaaagggatcgggctagaggtgtgccggcagctggccggcgccggcgccaccgtcgtcgtcttaacagccagggacgagacgaggggtgcagccgctgcacaagagctcagagaatctgggctctccgatgtcatcttccatcagctggacattaacgaacgctgcgagcgtcagtcggctggctgagttcctcaaggctcgttttggaaagctagatatcctggtaaataatgccgcagttggtgctgttgagtacgtccaagatcctgctgacagttcaacgagcgaggaagagctgagtggcatggatatggtccaaaggcttcagtgcatgcttaagagagtccgggagacctacgacgctgcgacagaagg

SEQ ID NO: 36992 - DNA, 411 bp, Zea mays
  Clone ID: LIB3060-003-Q1-K1-D6
gaagagtgcaatgtatagaaggtgtgaatcaaccaaggttgattctgtaattacacatgcatcatgtcatacaactttaagttaaaccccctgcgtagctattttagtgtatgaatcatctaccttgttcatacatctttagtgaatagagtgtatctgttgcccttctcgatagatgaatcaacaagaagcccctacgggagttggagagtttctacgagattttggtgttccagtggtcctgtggcgactacttcaagaagtcggatataccgaagcacccaagtaccagtggccacgcacggttcttagaggacaaccatggtatgaggtagtagtgcatattccagaacgtgctagaaaccatcttggccacattggatgttccatgctgaaggaatgactccttgg

SEQ ID NO: 36993 - DNA, 434 bp, Zea mays
  Clone ID: LIB3060-003-Q1-K1-B9
ctgatcattcaactctccgtcttccttttgaccataatatgtatggccagaaccttactgttcagaatttcttgaacgcatcagttcctgtttctgtgcaagcaaccttcccttataaattcgttgtgagcaagttcttgcagcctggagcttatgatctggttggttacatagtgtatgagatcgaccagcacccttaccagaatgtattctacaatggcactattgaggtcgttgaggctggaggcttactcagtgttgagtctgtgttcctcatcacccttggaatcgctcttcttggtctctttggattatgggcatatggccaggttcagcagctctcgaagaaaacgaagaaggcccccaaggtggagctcggaactggaacaactgatgccaacatcgatgagtggctggagggcacttcgtttgtg

SEQ ID NO: 36994 - DNA, 429 bp, Zea mays
  Clone ID: LIB3060-003-Q1-K1-C1
aattggacagcagaaatacaattcaacactatatatgtcctagctgcaataaaagatactcagccttcgatgcactacaactggtaagctacacggatgagtacttccattgtgaaacttgcaatggtgaactggttgcagagagtgacaagcttgcttctgaggaaatgggagatggcgatgacaatgttagaaagcgcaggcgtgagaaattaaaggacatgcagcaaagaatagaagagcaattgaagccattggttgcacaacttgatagagtgaagaatattcctgcaccagagtttgggagtctacaaacatgggaaagagcaaatattggtgcttttgcaattggtgaccctgctgcagctgattcttctaggaattcacaagggcagtatggtacaccaatgccatacattggagagacaa

SEQ ID NO: 36995 - DNA, 420 bp, Zea mays
  Clone ID: LIB3060-003-Q1-K1-C10
atctccctgctcctgcgcctgcttcttgatccagccaagtctgggatcgccatgtcggactctgaggaggagcactttgaatcgaaggccgacgccggagcgtgcaagacctatcctgaacatgctgacaccgtccgtaagaacggcttcatcgtcattaagaacctgccctgcaaggatgtggaggtttctacctctaagactggtaagcatggacttgcgacatgctactttggcgccatatacatattgaacggcaaaaagctggaagatattgaatcttcatcacacaactgagatattcctcatgtgaaccgtactgagtactagctgattgatatatcataggatggatttgtgagcctacttactgcacatggcaacactaaaggatgatcttagacttctaactgattagac

SEQ ID NO: 36996 - DNA, 397 bp, Zea mays
  Clone ID: LIB3060-003-Q1-K1-C2
ccggcggtggcatcgcaacgccggggtacgctccggcggtcccgtacgggatgtcgcaggtgaacatcgagggcaacgggtgcgggcgggcgctgccgccgcagccgaccgtgaaggtgtactgccgcgccaaccccaactacgccatgagcgtccgcgacgggaaggtggtgctggcgccggcgaaccccaaggacgagtaccagcactggatcaaggacatgcggtggagcacgagcatcaaggacgaggaaagttacccggcgttcgcgctggtgaacaaggcgaccggggaggccatcaagcacttgctggggcagtcccacccggtgcgcctggtgccctacaacccggactttttggacgagtcggtgctgtggacggagagccgcgacgt

SEQ ID NO: 36997 - DNA, 432 bp, Zea mays
  Clone ID: LIB3060-003-Q1-K1-C4
gttttgaatttgaatagggtctcttgttttgaataggatctctctttccgagaatcttctggtttttgtagacagaagttgtacttcctagtgctcatctgcacaaatagaaatgattggatcacgtgtcgtttagaaaagatggaataatactgaaacacaccagactgaatcatctatgtgttgcatgacgtggactgtgtcgttcttattattacgcactagcatagctgaactaattctcttgacctcgagttgcctgggtgcctcttcaaccttcatgttcagaatagcatttgttgtgggatatcatctcttatcttggtatatgtcttcagtttcagtctgctctcttggagcagacaaacagctcagagtcctatgttggttggttaaatgtctgcaggatttagtggtggggtatatgggagt

SEQ ID NO: 36998 - DNA, 435 bp, Zea mays
  Clone ID: LIB3060-003-Q1-K1-C5
cactcgccagtcgccaccgctcgctgtccacgcgcatggcgtcctcgctcgtctcgcgcccgcacctcacccagcgcccggtccgtgccgccacgctcgcctccgctacccgaccccgcctagaggccggggccctcgacgggcgctgccatgcgcaagcggagtgggactaggacgacgcccactacatgcggcggtgcgtggagctggcgcgcaaggcagacggccacaccagccccaaccttatggagggctgcgtcatcgtccgagacggccgcgtcttccgagaaggattccaccgcaaggcctgacaacctcatgccgaggtatttgcactaagagatgcatgtaatctagctgaaaatgctacggcctatgttagcttggagccctgcaaccactacgggagaacccatccggtactgaagcgctcat

SEQ ID NO: 36999 - DNA, 310 bp, Zea mays
  Clone ID: LIB3060-003-Q1-K1-C6
cccaacgtaccattcaactgatgaggtgatccttgtgaaccaacacgttagcccaccagcacttagcggtgatccgagaactttcatggcctgagttgatcatgttgcaaagcttacggtgctgcatgattcctataccgctcattatacagagactgatccaagcaatggcgatcaatgaagctgatattgccgtgacacacacatgtgtctaagtgtagacaaaaatgatgaatgcttgtaggcagatcattatagatcctacgctatgaactgacgcattatgcgctaagccgtgtataggcgtatc

SEQ ID NO: 37000 - DNA, 414 bp, Zea mays
  Clone ID: LIB3060-003-Q1-K1-C8
cggacgcgtgggttccatttcttttcttcttggaaatggttcaaacagtggttacatgtctcctgaatatgctatggaaggctcattctctgtcaagtctgacacctatagctttggtgttctactactggagattgtaagcggcttaaagattggctcaccccatctgataatggactatccaaatctcattgcttatgcatggagcttatgggaaggttgaaatgcatgggaataggtggactcgtcggttctggtgagttgtccacttcaggaagctgtacgatgcatccacttgggtcttatatgtgtccaagacagtccaaatgcgaggccgctcatgtcatccattgtgttcatgctagaaaatgaaacagccccggttcctaccccaaaaagacctgtatattttac

SEQ ID NO: 37001 - DNA, 363 bp, Zea mays
  Clone ID: LIB3060-003-Q1-K1-D1
ggaatcagagaaacgtgggataacatttgacaagttactaactgttcctgagaacgatagctgggtctatgaagatggtcagtcagcatcttgtgtggctttcgtccttatgatgtacaaggaggctggactctttgaccctattaccagctctattgaagttactgaattcacaataaaagatgcttatatcctcaactcttttgaggacaactcgacccgacttccggagtggggcaacaaggatgacgatgtgaaactttccttttgccagatcaaggggcagtacccgatggagctgtctgtatacaacaccctgaaaccctatgcgcacatgaacgcgagatgtgcatacctgtctcc

SEQ ID NO: 37002 - DNA, 421 bp, Zea mays
  unsure at all n locations
  Clone ID: LIB3060-003-Q1-K1-D10
cgcccatgggcacgggccacgcgaagcgtgcttgctcctcccacggcagccatggtcaccgggaccacctccccgctcttctccctctcctccctccgcgcctccctcccttcccccacccgatttcacacgtctctctcgctccgagccctctccccacgtgctcgtctctctgccgccctccctttcgcctccccactcgtttcaggcgggtacgggacctgngcggcgacttcaatctcgtccgcgggaaggttgagacggcgggggctggaggtggtgtgcgaggccacgaccgggcggcggccggactcggttaagaagagggagcgccagaacgacaagcaccgcatccgcaatcacgcgcgcaaggccgagatgcgcactangatgnaaaaagtcttaagagctcttgaaaagc

SEQ ID NO: 37003 - DNA, 415 bp, Zea mays
  Clone ID: LIB3060-003-Q1-K1-D2
ctcccaccttcttggagacaccgccaggcgccatcttccggccgctgcccgcctgccccccccgggaggtcgaactgccttctagagccctctcctgttttcaggcgaatgtgcaggtagcttgacgtctgatgaacgctcagccatgctgctgatgctacacgaaactcttcctttcgtgaggccgacgagttcttgccgggacccaaaactctccgagaagagtgcctctgctttccacggtaaattgggatgcagtgcggtctgcaattcaacggaagggcatcgtgtacagaaaccacacattgttcacagctacaaagttagcttcactaggaccagccatcatctgtgtaaaagcttaaacgagagaactacaaggcactgcctgcatcggttccatgttaatgcttcg

SEQ ID NO: 37004 - DNA, 444 bp, Zea mays
  Clone ID: LIB3060-003-Q1-K1-D4
gccagcacggtaaacagcaacacggttttctacgctcggatgtgccccgacgcctatacctacgccactgataatggtcccgttacatattcgtgtccgtcaggaacagattaccagatcattttctgtccccccgtcgatcttgtgtcattgtctccacctccaacttcaccattgtctccgcctccaacttcacctactgcaacaaatggaacaagcagcatcacatcctcatcaaaatccaagaggccaagaatatttggttatgttctaggtggttcaataggtggcttcactttgatcgcatccttggtctttttcttcgtcctgcatagacgacgattgcatcgacgccaagagatgcaagaagaggaagaagcagagtttgtgaggctaccaaggatgcccagacggttcacatttgagcagctacaggaagcaact

SEQ ID NO: 37005 - DNA, 430 bp, Zea mays
  Clone ID: LIB3060-002-Q1-K2-H9
gattgtcgttaatatggtgaaggaacgccttcggcaaccagacgctcaagaaaatggttggcttttggacgggtacccaagaagctattcacaggccatggccttggaaactcttgaaatccggcctgatactttcattctgttagatgttccagatgaactccttgttgaaagggtggttggaaggcggcttgatcctgtaacagggaaaatatatcatttgaagtattctccgccagagaatgaagaaatcgcttcaaggcttacacaaagatttgacgatacagaagaaaaggttaagttgaagctggagacttattaccaaaatatcgagtccttgctatcaacatatgagaacattattgttaaagtgcaaggagatgccacagtggatgctgtctttgctaagatcgacgagctgctgggttct

SEQ ID NO: 37006 - DNA, 251 bp, Zea mays
  Clone ID: LIB3060-003-Q1-K1-A1
cagcaagcgaagcccagcaagaaaaccacatgccccacctcgccgccactccccccacttgctccgccgccgccgtccccgccgcgggccgcatcgcgttccggcgcccgtggaacacgccacagccggaagcgctgcgcctgcgcctacgcctgcgcgcgcggggcgttcggcatgaggacggcggttgcgtgcgcacggtggagcatgagcagacagtaccgcggacgttctacgacctgctcgggatc

SEQ ID NO: 37007 - DNA, 435 bp, Zea mays
  Clone ID: LIB3060-003-Q1-K1-A10
cgacccaagcgatccgagaaacgtatgtcgtgtggttagagatcctttgttgagtaaatcgattcagatcgccgataggtccccggagagtggagacttgatctccgacctacaacctaagtcaggatgtgaacattatgaataaaaatgatgttgtattgatgagatggtgaaattagaccagatgcaaacagagtctattaatatttaatctggcgttaaaaattgaaagtaaggactcactttagtaagctatttctgcaaaagtatctaagttgattcttgctaaagcctctccttgattcccaaatccagcatatccttgagagtcttttctttagtcgggtaagtcttgctgagtaattccatactcagggttttattccctgttgtttttcaggatataactttgtgctgctgtgatggtgttaaatg

SEQ ID NO: 37008 - DNA, 208 bp, Zea mays
  Clone ID: LIB3060-003-Q1-K1-A3
ccggctcgacccacacgtgcggcaacttggatatgttgttcacaaacctttttatatatttataggcgtggaaaacttaggagcagctttctgcctcgatccccatgtgcctgggagcattgccaaaagaaattacttacccactggatccgtacagtctgagagcctagattggcctaaatattttcccaaaggaacataaagattt

SEQ ID NO: 37009 - DNA, 366 bp, Zea mays
  Clone ID: LIB3060-003-Q1-K1-A4
gaatacccgggcgagccatcctgtgcccccgcggcgatggccaaggcgctgctctactccttcctcctccacaggctgccccgcgcggtcgggagcagccggagcgctgccgcgaggctgctgctgctcccgcctctacggctgcgccgaggccggcgcgccgcctccgcgtgcgcggtgagggcggccctgcacgggctcgactccgtcggcgggccccatctccaggccgcgctggagcgcgccaaggcggcgctatacacgctcgccgacgcagcggtagccgcggcggacgccgacgcgggcgcggtagacgacgccagccaagctgcttcggaagcccagaagaacagcagttgggtcggc

SEQ ID NO: 37010 - DNA, 228 bp, Zea mays
  unsure at all n locations
  Clone ID: LIB3060-003-Q1-K1-A5
gccgaccaggtctcgccgncgncaccgtcgcggtagaaaggggagggagagggggaaagaactggcccagatcgagaggtacagcacgaaaaagagaagcaagagagataggggaccggagggcggcgggccggggcccaagaccgaggggctcgtgcgcaagaagctgatgaggctcctgtcgctcgtccccttcggctgccgtgctggacccatcgacgacgcgcc

SEQ ID NO: 37011 - DNA, 429 bp, Zea mays
  Clone ID: LIB3060-003-Q1-K1-A6
cgctcgtctccccgtaccgcccgcaacccccctcccctgcgagatccggggcgcgatgtggcgcagctgcgtctcgcggggcctctccagggccaaggcctccgcctccaggctcctctccacggcgtcgtcgtcctacacggtggtcgaccacacctacgacgcagtggtggtgggggccggcggcgcggggctccgggcggcgatcggcctctccgagcacggcttcaacaccgcgtgcatcaccaagctcttccccacgcgctcgcacaccgtcgcggctcagggaggcataaatgctgcacttggaaacatgagtgaagatgactggaggtggcatatgtatgacactgttaagggaagcgattggctgggtgaccaggattctattcagtatatgtgcagagaggcaccaaaagctgttataga

SEQ ID NO: 37012 - DNA, 405 bp, Zea mays
  Clone ID: LIB3060-003-Q1-K1-A9
cacgcgaagaaaaggagatagagtacaggttatatgagaggcagagagcaaagatgtgtggtggtgcgatcctcgccgagctcatcccgactacgccggcccgccgcggcggcgcggcgtggcccgccggcaagtgcaagcggcggaaggcggacgacttcgaggccgcgttccgggagttcgacgaggactccgcctccgccgccggggcccccgccagccgcaagcgcgcccgcgccgccgacgccgtcatcgacctcgaggaacaagagcagcgcccggccgcggcggccctgaagcacgaggccgccgagtgctccggatccgacgcgctcccggacttctcgtggcagggcgtgtcggcggcctacgacgagccccccgcgccgcgcccggccttcgact

SEQ ID NO: 37013 - DNA, 221 bp, Zea mays
  Clone ID: LIB3060-003-Q1-K1-B1
ggccatcaggttagcaagaccaacaaattcttacactgatacgttcccttcgaagttcgggcccacctcccatggccaccgtcgactgccccctgccctctcccgcggacctcgacgacaacggattcccggctctacccttcttccccgctgcctgtagcagcggcttctcggaggatttctaccgcagcggcacctactggtccttcttacgcgcccct

SEQ ID NO: 37014 - DNA, 330 bp, Zea mays
  Clone ID: LIB3060-003-Q1-K1-B10
cggacgcgtgggttttgtgtattaaattatgaacactaaaataaattatatgatgaagataattggagatgttgaaaaatcagtttcccttcttaaacagaaataaatattgtaaatgaagggaaatgtaatagaacacccttttcgccacgggtaaaaatgacagaaatgtatggtttgttttaccttcatttctgttacaattaaaacttgttagtctaaacttttacttcttcccaacttaaccctaactctttttttttattttcctttatggactgcattcttaatttctaactggtaaacacttgattggagactttttttaaa

SEQ ID NO: 37015 - DNA, 423 bp, Zea mays
  Clone ID: LIB3060-003-Q1-K1-B11
attggaagtgggaggtgggtatccttcctccactgtcctttttcatctctctctctctctttgctctctctaaaagactttgctaattggcctgctagccggtctccctcccccggcctctttccctttcagctggaggagatagatgagagagaggatcagaggaagcaggaaggagagagggatatataggccggtgtcttctgtagagagagagattgagagcaaaagggaaataaaggagctctcgcaggcactcggtactgacatgagtgatctcatgctcttgataccttggtactcttacatcaccccttcttcaccttcttcttgttcttgctcatccctcctctccggccctctcttcctcctgcctctctctagctaggacgatcttcacaaaccctttcccctctaattctc

SEQ ID NO: 37016 - DNA, 441 bp, Zea mays
  unsure at all n locations
  Clone ID: LIB3060-003-Q1-K1-B2
gcgaggccgcctactaccagcagggcgcgcggttcgccaagtggcgcaccgtcgtcaggatccctaacggcccctccgagctcgccgtcaaggaggccgcgtgggggctcgcacgctacgccgccatctcacaggacaacgggcttgtgccgatcgtggagccggagatcctgctggacggcgagcacggcatcgagcgcacgttcgaggtggcgcagaaggtgtgggccgaaaccttctacgccatggcggagaacaacgtcatgttcgagggcatcctgctgaagccgtccatggtgacgcccggcgcggaggccaaagacaaggccaccccggagcatgtggccgcgtacaccctcaagctcctncaccgncggatccccccctccgtgcccgggatcatgttcctcttcggcgggcaatcggaggtggaggcgacgc

SEQ ID NO: 37017 - DNA, 295 bp, Zea mays
  Clone ID: LIB3060-003-Q1-K1-B4
gtagaagaacaccacatgaaccgcatatgttccacgaccaaaggaagaggacgactactgaccaagcagataatgattaccagtcacttaagctctgatccctggtacacatcgatgcgctagaccctctaggagtcgaatagccaccagctaggagagcgtgcaaatgaggccgacgacggcatgttcactgatgcatgcggcgacgcaaactgttagcctgatcagccagctcatgatactgtcctcaactccatatccaatatagcatggactaaatgaacgaatgcactca

SEQ ID NO: 37018 - DNA, 129 bp, Zea mays
  Clone ID: LIB3060-003-Q1-K1-B7
cagcatgcagccctcctcctcgtcctcctccgctcacccgcccgaccatcccaactggagccctcccgcgtcggcccccggcatgggctaccccggcaaccaggcccgcaacgggaaccgcagcgccta

SEQ ID NO: 37019 - DNA, 403 bp, Zea mays
  Clone ID: LIB3060-035-Q1-K1-F6
cttttgctgcaaatctttctctgaattgtgggtctccgacaatggcggcgctcgctggatccaagattctgggcacccagctcaacttcgcgggctcctcccgctacgccaccgcagcgcccaccgcgggggctcagaagattgtctcccttttcagcaagaagcctgcccagaagcccaagcccgctgcggtatcgtcgtcttctccagacatcagcgacgagctcgccaagtggtatggtcctgacaggaggatctacctgccggatgggctgttggaccggtcggaggtgccggagtacctcaccggagaggtccctggagactatggctacgacccttttggcctgggcaagaagccagaggacttcgccaagtaccaggcctacgagctgatccatgc

SEQ ID NO: 37020 - DNA, 379 bp, Zea mays
  Clone ID: LIB3060-035-Q1-K1-F7
gattgactctgaactctatcatgctcagtccccaatcgctactgatctctgccgcgaggatttcgacttatatcacctttctgagtcaagcttgcatatctatcctctgaatattgtcatcaagacctgtggcactcccgacctcctgctcaccattccaagaatccttcagcttgctgaagacctgtctatgccacttgctgatgtgaagtacttctgcgggacgctcatgttttatgtcacacacccattcccctacaagtacttctgtgacgaagtcgctgtacttaaccgctactatagctgcctgaaataccgtgatcatgctgatatcaactgagattcagccatacttggaccgatatggtacgtcttctac

SEQ ID NO: 37021 - DNA, 428 bp, Zea mays
  Clone ID: LIB3060-035-Q1-K1-F9
gtgctgtagacattggaggtggattttccttaattggagatattgaaaaattggaaagaaatgtgacttgacctgtgctgcaacaaccttaaactaggaggggcttctaattcttcatctctaccaacagttctctcctgttactttttaaaccaataactttttcaagtttgtgcagatgcacacatccttgagccaaaatagaaaaaaaatcatagaagagttctttggctgtcacgtgattcaagagtattaatgatatacaaaagtttgctttatggcaagtcaggtaaccacaaattttgggcaatgacagggatgtgcagtggtggtctcttaaaagaattttgtgttccagcgtagctatttccactgcaaactatcaaatcattacaaactgctgggaacatgctccatcttattatcga

SEQ ID NO: 37022 - DNA, 418 bp, Zea mays
  unsure at all n locations
  Clone ID: LIB3060-035-Q1-K1-G10
gctttggcttggcaaacccgattggatcttcagaaaaatcgccatcccctctgcctcgtctcgtgtccatcgctgctctacccattcttacttgaatcttttctgaagaggaaatctgacttcgggagcggctcctccgcgttgcctggatcgcccgggatcagtattttgcttccagtcagaggtccaaaatatcaaagggatgcagaaagatgtggttgcatgatggagtaccttgcctggaaattggcaggatacacatacataattgtactttacttgatctcgatgacattggagtgcaaatatatgcacaacgattgcctcatgcacacacacataatggggccgcgagttgtagctcaaccatcatctctggtttctntctaggtggagatggttaaaattgctggtcact

SEQ ID NO: 37023 - DNA, 430 bp, Zea mays
  Clone ID: LIB3060-035-Q1-K1-G11
aacatataaagcacaatcatataccttcaatttcaaccaaaatattttgcttccttgtctcgttaaactttatgcaagtgctgctaccgcaaccattttcccacaatgctcacaagctcctatagcttcctttcttcccccatacctctcaccagctgtgtcttcactatgtgaaaacccaattcttcaaccctacaagatccaacatgcaatcgcagcatgcatcttacctttatcacccttgttcctccaacaaccgtcagccctattacagcacttacctttcgtgcattttttggcacaaaacatcaatgcacaacaactacaacaactttttctatgaaaccttgctacctactctcatcaacagcactttcttccattcaaccaacttgcttcatttaactctactgcttattttcaacaacaa

SEQ ID NO: 37024 - DNA, 415 bp, Zea mays
  Clone ID: LIB3060-035-Q1-K1-G2
ggcggcagcgctgcgagcaagggagggagggagcggggatgaggatgctgtcgaaggcgtgctcgattgtggcctcctccctcccgcgctgctcctcctccgccgccgcccccacgatgagggggcagccgtccttgctgccaagcgtgcggaagcaatggcccgggaagccactgctgtatggaatcggcaccctgttggtcatgccactgaggacactgtatggagtgggtcgtgtttttggcgcaggacggtttctctgcaacatgaccaacgtctcttcgtcgctgcaaattgagcttgtaccatgccttcgagataactatgcgtatatcctgcatgatgttgatactggaacagttggagtagtggatccttctgaggctatgcctattataaatgcattggaaaagag

SEQ ID NO: 37025 - DNA, 394 bp, Zea mays
  Clone ID: LIB3060-035-Q1-K1-G5
aaccggtccagcactttcacgctcagctccagcaatggctgcctccaccatggcgatgtcctccacggcgatggccggcacccccatcaaggtgggctccttcggcgagggccgcatcaccatgcgcaagaccgtgggcaagcccaaggtggcggcgtccggcagcccctggtacggccccgaccgcgtcaagtacctcggccccttctccggcgagcccccgagctacctcaccggcgagttccccggcgactacggctgggacaccgccgggctgtccgccgaccccgagaccttcgccaagaaccgcgagctggaggtgatccactcccgctgggccatgctcggcgcgctcggctgcgtcttccccgagctgctctcccgcaacggcgtc

SEQ ID NO: 37026 - DNA, 407 bp, Zea mays
  Clone ID: LIB3060-035-Q1-K1-G6
atcgtcccagggcagccacgccggtcgacatctctcggcagaagcggcggtggggccgctgcccggtgtcgtcgtcggagcattattacgccaccacgctcgacgaccaggaaaccgacgacgtcggcgatggtgcaaaagggacgactgcgaaccacggctcggcagtcgtgccgccgcacgttcttgtcgcgcggcggaggaggctggtgcgcggccggacggcggcctactccatgtgcgctggcaaggggaggacgctcaaagggcgagacctccgcgacgtccggaacctcgtcctcaagatgacaggcttcatcgaggagtgaatgaatgcgtgccgtcgcatcgcatggatccagaggattcttttcagcaagccaatggaagaagcacccgtagcagtc

SEQ ID NO: 37027 - DNA, 213 bp, Zea mays
  Clone ID: LIB3060-035-Q1-K1-G7
tcctcccactattatatactaaaatcacacattctagacatcatatacgaatcatacctacaatctcgtacaccatgtgttacacacataccatatctaatttcactgctctatactcaccaactataaacacaacaatcacccacacattattcgtcccataacatattaaacaccccatccttactatctttatcaccctctatctatcca

SEQ ID NO: 37028 - DNA, 423 bp, Zea mays
  Clone ID: LIB3060-035-Q1-K1-G8
ggattgatctataagccttttggtggctaacggttgggagctttggaggagaactcgagtccttgggctctaggttggtctggacgaggccggaggaagttgccaatggagccgccgactgggttctgggcctcgcttctgagcttcctcaagttcctcccctacttctgcggcctcctcgtccttggactcatcaaaggtgttttgttgtgcccttgggcatgtctgattatggcgattggaatatctgccctggtcctgggcttatggcctatgcatctgatttggacatactactgcattgtcagaaccaagctggttggacctgtggtaaagcttctgcttcttattgctgcgactgcagtcttgatcatatggttgataattggcatcccgggaagcatatttgctggattggtatat

SEQ ID NO: 37029 - DNA, 403 bp, Zea mays
  unsure at all n locations
  Clone ID: LIB3060-035-Q1-K1-H1
gttgccaaagaattccctcccctagccgtcgccgccgctcgtctccctgagaggtgcggggagcgangaactggccgagttctaggtagagaatcggttttgcttgtctcagcacggggtctgctgcgtctggtggtggtgaaggggagaaattcgtgagatctgttccggatcaggcgtgcgagctcgggaatcaggggtttcacacatagcttcgtcgatttgaatttgatgtactaatggagtctaagggtggcaaaaagtctagcagtagtcgttccatgatgtatgaagctccccttggctacagcattgaggacgttcgacctgccggaggcgtgaagaagttccagtctgctgcttactccaactgcgcgaagaagccatcctgatatccctttgg

SEQ ID NO: 37030 - DNA, 418 bp, Zea mays
  Clone ID: LIB3060-035-Q1-K1-H3
cccacgcgtccgcccacgcgtccgcccacgcgtccgcccacgcgtccggtcggatctgggacgagacgagacgatcccgcctcccctcaaccggaacttgttttaccccatctcatcccactgactccacccacccacccgcccgctgcctccgccggatctcgtcggactcggatccgcccgaccacgaccaccccgcgtcgtcgccgcgcagcagcagcagatcagagaagatggccggactcgacaccttcctcttcacctcggagtccgtgaacgagggacaccctgacaagctctgcgaccaggtctcagatgctgttctggacgcttgccttgctgaggaccctgacagcaaggttgcttgcgagacctgcaccaagaccaacatggtcatggtctttggtgagatcaccac

SEQ ID NO: 37031 - DNA, 379 bp, Zea mays
  Clone ID: LIB3060-035-Q1-K1-H4
gtggacgggtggtgtgtatatagttaagcgggcgggcgggcagccaatgccgtcgggggcgcagggctaggagcatgggcggagggggcgcgatcgtgcacggcttccgccgctggttccaccgccggagcgaaggctccacctccaactccaaccagccgtccctcgccggcgagggggaagcggacgacggctcatccgatctcgaggtcatcgaggacccggatctcctcggcctccgcgccatccgcgtgcccaagcgcaagatgccgctgcccgtcgagagccacaggaagaactcagtagaaatggagttcttcacagagtacggagaggcaagccagtaccagatccaagaagtcattgggtaagggagcta

SEQ ID NO: 37032 - DNA, 405 bp, Zea mays
  Clone ID: LIB3060-035-Q1-K1-F5
acatgagttcccgttttgctcccgagttctctctcacgtccatccctctctctggtcgcgttctttagcagggccggctggagcgcccactcctccctccagcccggccccagccgcgccgccgcgccggtcgtagacccaacgcccgccgcccagcccagcgcgccctccggccgtgaggcggagaggatcgggcgggcctcggggcgagcgccacgcgtagacggcggttgaggagcctgagaaaacaacggtcctccttcaagatcctgatccctacgcgcaggcgtaggagattgtattccgtctgattaatcggcggagagcaagcgggtgttgcggctgcgcgagcatggcgggcgaggaggctgcggagggcagcggaaccaggaggcacatggatct

SEQ ID NO: 37033 - DNA, 429 bp, Zea mays
  unsure at all n locations
  Clone ID: LIB3060-035-Q1-K1-D9
caaagtccaggtcttctacctcaagatgaagggtgattactacaggatattggtttggaggagttggcccccttatcctattaggctttggctgatgcttaacctctcaactctcctgatcttgctcgtggtctccccaaacaggtttggtttctagatccattacatggagtgtgtagtgtttttcctcttttttgcaatcctcatgatgtgccaccaggtctggtctaatcgttcccctaaaattgtggcctataatcagcttcttggcctatgatccttttgtatgtaggcaaagccaacgaatgaaagggactcactcgcagcaacaaccaanaagctgatcacgcattctccttttcacatttgttgcatttaattaattcatccaatagcatanattggcactccttttgtgttattgctctt

SEQ ID NO: 37034 - DNA, 284 bp, Zea mays
  Clone ID: LIB3060-035-Q1-K1-E12
taattcccatctcgacgccactcatacgcttgcctactcatcccactccacagctttttcttaaccattactatctaaaacatatggacaggtatacaaagcaacatagctaaggcacactaatacatataacaccaaccctcatttcagcttcctctcctagacctctgacaaccattccctctacaatctctcgttacccatcgacgcgtatatagaaatcacgatcatactagcaacaacaacacgaacgtacagcgtatcttggctcctgacattcacca

SEQ ID NO: 37035 - DNA, 413 bp, Zea mays
  unsure at all n locations
  Clone ID: LIB3060-035-Q1-K1-E2
aataagacgacttgtttcattgattcttgaagagatcgagcttcttttgcaccacaaggtcgaggatgtcttgcaactgcggatcaagctgcggctgcggctcaagctgcaagtgcggcaagaagtaccctgacctggaggagacgagcaccgccgcgcaggccaccgtcgtcctcggcgtggccccggagaagaaggccgcgcccgagttcgtcgaggccgcggcggagtccggcgaggccgcccacggctgcagctgcggtggcaactgcaagtgcgacccctgcaactgctgatcacatcgatcgacgaccatggatatgattattatctatctagcttgtggtggtggttgaacaataataagcgaagccgagctggctgccatacataggtatngngtggtgtgtgtg

SEQ ID NO: 37036 - DNA, 406 bp, Zea mays
  Clone ID: LIB3060-035-Q1-K1-E4
cgccttccctccatttcgtccttccaaccatggccgcgtgcctcccggctccagtccggccactcctcacggtgcccttgctctatctcctccctgctcctctgccccatttcgagctgctcccatggcgccgttggccggatctccctggccgtgtgcccctgcgctcggtcgcctctcctgcagctcgctctctcctccctccatctctctcaagcgctagccgccgtggttccctcccctgggctctgctcgccggagcttcctgctcggccacgcccatgcccaacgcctagccgagcggcctcactgcacgttcctcctttctccaagttgagctccatctccctgcgcgcggtactctctccggcgtccagttttctccgcgccgaagttccctccatgt

SEQ ID NO: 37037 - DNA, 398 bp, Zea mays
  Clone ID: LIB3060-035-Q1-K1-E5
accgacgcgtccgcaaggaagtccctcccctagccgccgttttcgtcgctcgtctccctgagaggtgccgggaccgagtaactggccgagtgctaggtagagaatcggtttttcttgtctcagcccggggtctgctgcgtctggtggtggtgaaggggagaaattcgtgagatctgttccggatcaggcgtgcgagctcgggaatcatgggtttcacacatagcttcgtcgatttgaatttgatgtactaatggagtctaagggtggcaaaaagtctagcagtagtcgttctatgatgtatgaagctccccttggctacagcattgaggacgttcgacctgccggaagcgtgaagaagttccagtctgctgcttacttcaactgcgctaagaagccat

SEQ ID NO: 37038 - DNA, 425 bp, Zea mays
  Clone ID: LIB3060-035-Q1-K1-E6
accggccggattcccgggcaaggagaggatctcgatccgacacctcacgcctctcttcctctcgccccaggacaacgaaaacggaaagaagagaaccaaaggaaacagagcaagagcatcgctctcgaagcaaaacgcgcaccacgccgtcgccggccggccacttcgcacgtacgtaggacgcgcacgcaccggtgcatatatggggctcctgaaccagctgtgggacgacacggtggccgggccgcgcccggactccggcctcggcaagctccgcaagtacgcctccttctccccctcgtcgtcgtcgtcggcggcggtggcggcggcggcggcggcgggctccgcgccgacttcgggcgccgtgacgcggagcttgaccatgctgcggcggccggcggcgctgtccgtcgtcacgtcgcccc

SEQ ID NO: 37039 - DNA, 392 bp, Zea mays
  Clone ID: LIB3060-035-Q1-K1-E7
gttcggagcgcacacacacacaaccagatctcccccaaatccacccgtcggcaggtcggcttcaagatgcagatctttgtgaaaaccctgactggcaagactatcaccctcgaggtggagtcgtctgacaccattgacaacgttaaggccaagatccatgacaaggagggcatccccccagaccagcatcggctcatctatgctggcaaacagcttgaggacgggcgcacgcttgctgactacaacatccacaaggagagcaccctccaccttgtgctccgtctcaagggaggcatgcagatctttgtgaaaaccctgaccggcaagactatcaccctcgaggtggagtcctctgacaccattgacaacgtcaaagccaagatccaggacaa

SEQ ID NO: 37040 - DNA, 393 bp, Zea mays
  Clone ID: LIB3060-035-Q1-K1-E8
accacacacacacacgaagagccggcgatgaaaatgtccgcttccgttgctgcggctgcccccaccctccgcttctcctccgccactcatcctctccaccgaccgctccgccggcggctcccgtccgttcgatgctccctcgccgccgccgccgccggccccggtgtccgggcgccccctgagctcgtcgactccatcctctccaaggtgaagggaactgaccgaggagtgctgctgccaaaagatgggcaccaggaagtggctgaggtcgcgctgcagctggggaagtattgcatagacgaccccgtcaagtccccgcttatattcggagaatgggaggttgtgtactgctcggtgccaacctcgccgggcgggctctaccggacgcccctt

SEQ ID NO: 37041 - DNA, 402 bp, Zea mays
  Clone ID: LIB3060-035-Q1-K1-F10
gtcttcacactcctcgccatcacataaaaccagtgcaagcagaagcagcgcagtggcgagcagcaccatggccgtctcctccacagccttcgccggcaaggcagtgaacgtgccgtcgtctctcttcggcgaggcccgcgtgacgatgcgcaagacggcggcgaaggcaaagccggcggcgagctccggcagcccgtggtacggccccgaccgcgtgctctacctgggcccgctgtccggcgcgcccccgagctacctgacgggcgagttcccgggcgactacggctgggacaccgcggggctgtcggcggacccggagacgttcgccaagaaccgggagctggaggtcatccactcccgctgggccatgctgggcgcgttgggctgcgtgttcccggagct

SEQ ID NO: 37042 - DNA, 392 bp, Zea mays
  Clone ID: LIB3060-035-Q1-K1-F11
cgctctacaacgccacagcttgcgcccgcaatggcgctcgtctccgcctgctggtcctgcaccaccgacgccacggcgctccccaggaatgggcagcactcgtcgtactgcttcctcggcggcatgacgctgctgagacaggccgaggcggcccggccgtaccacgtcgtgcgcgccacggcagacccgaacaggccgatctgcttccccggcagcaccctttcggcgtggatcgactgcaggctgaccggcgacttcgagctctatccctgtggcactggatctgacccggagagcctgccgacgatacgtgcacgcggagctggtgcactgtcagttaccgatgctcatctcggcgggcatgttcatacccgagttcctgaccaagatcg

SEQ ID NO: 37043 - DNA, 384 bp, Zea mays
  Clone ID: LIB3060-035-Q1-K1-F3
gtgctttatctggcatctgtatcatttcaaatttttcatctgatcctcctgtttctctggagcacaatggatacatatacattgctttctcatggcttgtttgtgagaaagaaatgctctaaacagacccaggtccccaggtgtttcggttgtttatggtggtcatgcattccaatttaggtccttctgttctagttgcacatatttagttctgatgtttatgatcactacagaggcaagtttttccttttaattcactattcccacctatacaacttggtggttgattaagagttgtattctcatgtacatagtctctgattcatgatacttattttatagttgggcccaaaaattaaagatctatattctctaaagtgtgca

SEQ ID NO: 37044 - DNA, 413 bp, Zea mays
  unsure at all n locations
  Clone ID: LIB3060-035-Q1-K1-D8
ggtttggtgatgctgatgccggtgccgcatgtctatattgggtaggtgacgctgagggctcgttccccaatcagacttgttcggcctcttcgacggcgtgcccgtctccccgagctcattcgccatgccttcctcagcctccgcgagaggaggacgagggctcctcttgccggcggctgctgaggcggttgtggtgctaatattgggtgcagtggcgccagcggcgggttgttatccgcgcgtgttcagcttcggggactcgctggccgacacggggaactacccgttcgtctacggcaacgactctgggtctggcggggccgcgctccggccaccctacggcgagaccttcttccaccgcgccaccgggcgcgcctncaatgggcgcctcgtggtcgacttcatcgcggaca

SEQ ID NO: 37045 - DNA, 447 bp, Zea mays
  Clone ID: LIB3060-035-Q1-K1-C10
ggattcccggtggacgccacgcgtccgatgatggctggggtgttgctgtgctggtgggtgtgccacataaggacgctgagttcagtacccacccgatgaacttgctgaacgaaaggaccctgaaggggaccttctttggcaactataagccacgcactgatctgccaaatgtggtggagctgtacatgaaaaaggagctggaggtggagaagttcatcacgcacagcgtcccgttcgccgagatcaacaaggcgttcgacctgatggccaagggggagggcatccgctgcatcatccgcatggagaactagatttcgctgtctagtttgtgatctggcctgggcttggggttaataaaagaggcaatgctagcctgccctttcgatgaggaagtacatacacgctggcgatggaccgcgcttgtgtgtcgcgttcagtttggctttt

SEQ ID NO: 37046 - DNA, 420 bp, Zea mays
  Clone ID: LIB3060-035-Q1-K1-C11
gtatttcttgtgcctgcttattgctgggctagccgccggtctcttgctctgagagctggctccaggacgtacgtacgtacgtagatcgatccatcgatcgctagctagctgacgaccatggcgtccctctcctctgccgccatcaccgccccttccttcacggccgcgcccgctcgcgcagtggtcagcaggaggtccttcaccgtgcgtgcctctctccgcaaggccactgccaccgccgccgtggccgttgccgccagcgtcctgcttgccggcggcggcgccatggcccaggaagtgctgctgggcgcaggcgacggcgggctcgtcttcgagcccagccagttcaccgtcaaggccggcgacaccatcaccttcaagaacaacgccggctttccgcacaacgtcgtgttcgacgaa

SEQ ID NO: 37047 - DNA, 399 bp, Zea mays
  Clone ID: LIB3060-035-Q1-K1-C2
ctacactacaccacacccacccgacgacgatcacacacgcagaagatcgagttcgttggatcgtgaccgtgacgcaggaagctataagctagccaagacaggaataataatggcggcgtcgacggtggcgagcctctctgtcccggtgacgacgacgaccttcgcggcggcgggcggcggcgacgtgctgatcgtcgtcccgaggagggcgggcgccaagcgcgtcgtctggttccccgcggcggcgcgccgcggcggcgggcggttggtcgccgtgcggtccagcgggccggccacgccgccggagatctccgacaaggtgtcggagagcatcaagcaggcggaggagacgtgcgcggacgaccagaagggcgacgccgagtgcgcggcggcgtggga

SEQ ID NO: 37048 - DNA, 334 bp, Zea mays
  Clone ID: LIB3060-035-Q1-K1-C3
gtcttattgccctccctgttcttgttgctgcttgcattgagaaaagagagagagagagacagagagagatagaaagtggttgctagttgtatggtcgtccggtgggcgcgatgaccatggagcacggcgaggattgctgcgtcaaggtggcggtccacgcgcgccccctcatcggcgacgagaagctgcagggctgtaaggactgcgtcgccgtcgtgccgggcaagccgcaggttcagatcggcagccactccttcaccttcgaccatgtctacggcagcacaagcacgccgtcggcggccatgttcgacgagtgcgtggcgccgctggtcga

SEQ ID NO: 37049 - DNA, 166 bp, Zea mays
  Clone ID: LIB3060-035-Q1-K1-C4
tattgccctccctgttcttgttgttgctttcattgataaaagacatataagaggcagataatatagaaagtgggtgcttattatattgtcgatctgtgttctcaattaccatttatcacttctaggattgcttcttcaactttactgtccacactctctccctcat

SEQ ID NO: 37050 - DNA, 140 bp, Zea mays
  Clone ID: LIB3060-035-Q1-K1-C6
acactacaccacacccacccgacgactattttacacgcacaacatctagttcattcgatcgttaccatcactcatgaagctgtaaactagccaacacacgaataataatgacggcgtcaacagtggcgagcctctctgtc

SEQ ID NO: 37051 - DNA, 402 bp, Zea mays
  Clone ID: LIB3060-035-Q1-K1-C8
atttgccgatggactcttggtggtgagcagcgagagatagagagggtgaaactacatgtgcatatacaaatacatgtagctagcggcgtagtactggatactgtgccatacggagtatagtatatatactcgctgtattagcagtagaggcggccgtgcagcgatcggtcgacgatggttgttgccgccatgagagacgagggagaggagggacgacgacgggcggtggtggcgatacgggactacgatcccaagacggaccgcgacggcacggaggccgtcgagcgggagtgcgaggtcggcccggccgccgccgccggcgggatgtcgctgcacgccgacctgctcggcgaccccgtcgcgcgcatccgccactcgccgcactacctcatgctggtagct

SEQ ID NO: 37052 - DNA, 421 bp, Zea mays
  unsure at all n locations
  Clone ID: LIB3060-035-Q1-K1-C9
gcgcgcgctagctcttggtctagctttaggtgcaccagcagcgcgcgaacgggtgatggatcagcttcgtctttcaattcttctccacatcatcatttgcgccacgtacgtaaatcggctgctgcgggagagacgaccggccgccggcgacgccgccatgaccaagcaaaaggcagtgatcaggcttggcgtaacgaacgaccagaaccggtctaaggccatgcagctggcgtcccgatttcacggagtgaccttggtgtcgatcaccggcgcaggcaaggaccagctggaggtggtaggagaagacatcgacatcccctgcctcgtcaattcgctgcgcaagaaggtctgccgctccgccggcatcgtcgtggtggaggaagtcaaggacaaggcgaaggtggaagangagaagaagaag

SEQ ID NO: 37053 - DNA, 398 bp, Zea mays
  Clone ID: LIB3060-035-Q1-K1-D1
cggacgcgtgggctgttagaaagggagaacgcttagttccccctgtttcatttgactggttcatgagagccacatttcctgtttctaatgctcgagtgaaggctacagaaaggtttgaagcagcctacccaatgatcaaggagttggctcttgccggtcctcctggctcaaaaactgtgaaacaagcatcacaacagcttttacctttgtgtgcaaaagcaatgcaagaaaacaacgcagagctcaccagggaggctgttgatgttttcatttggtgcttaactcaaaatgcagagtcgtacaagcagtgggaaagaatctatcttgaaaatattgaagccagtgttgctgtcctgagcaaagttgtgattgattggaggggtgtgtcttctaagctc

SEQ ID NO: 37054 - DNA, 415 bp, Zea mays
  Clone ID: LIB3060-035-Q1-K1-D11
gcaaaagccaaaaggcatcaccgccgcgacgacgatggcagcctcgctccaaggcgcggccaccctgatgcagccggccaagatcggcggccgggcgccctttgcctcgctgccgtcccgcccgtcgtcgcaactcgcctgcagggcgttcggcgtcgacgccggcgccgccaggatcacgtgctccctgcaggacgtcgccagcaggtgcgtcgacgccgcgaagctcgccggcttcgcgctcgccacctcggcgctcctcgtctcgggcgcgagcgcggagggcacgcccaagaggctgacctacgacgagatccagagcaaaacgtacatggaggtgaagggcacgggcacggcgaaccagtgcccgaccatcgacggcggcgtggagtcgttcccgttcaaggccggcaag

SEQ ID NO: 37055 - DNA, 404 bp, Zea mays
  Clone ID: LIB3060-035-Q1-K1-D3
cagacgagatcggagccgctccccttacgcctctcggcgaaaaactcgttctccttcgccacgatgggacaggagcaactcaccaagtccaagaaggcatagaagcccactatctccaaggagacacagaagacagagaagtcggagcactacaagttcattagagaataacccatccagtccaagtcacgcatcagagaaaataaattcatctgtaaaacaaaggctggaagaagaaaagaaaaggcgtcaaaaggaagctgaatttaagttactggaagaggagcttgctagaagggtcgaagaagctataaggaaaaatgtcgaggaacgtctgaaatctgaagaggtgaaacgtgacatagaacaccgaattgaggaaggtattagaaagttatttgatg

SEQ ID NO: 37056 - DNA, 447 bp, Zea mays
  Clone ID: LIB3060-035-Q1-K1-D4
caagaagggaaaaaaaaagagggacaggaaaaaaaatcattctcgtttcgctctccgcgagacgccgcccgaatcaatggagattagggctccgccgacgagcctgaggctcgcgccgccgcccgccgccgccagcttccgccgaaccccgcttaggacctccttccttcgcggcagcgtgtcacttaaagttgtgcaagtacggcagtcaaatgtcaacagatttaagtgcaatagcatacgaagtaacctctttgataggctaacaagggttgtcaggtcctacgcaaatgcagttctaagttcgtttgaagaccctgagaagattctagaccaggcagttctggagatgaatgatgacttgacaaagatgcggcaggccactgcacaggtcttggcatctcaaaagcggcttgagaataaatataaagctgcagaacaagcgtt

SEQ ID NO: 37057 - DNA, 368 bp, Zea mays
  Clone ID: LIB3060-035-Q1-K1-D5
cctagcctgccactgccagcaggtgccaccgccatctctgctctgctctcgcggcgcgggcacacgcccggccgcctgccacagttgccatggcgaccatagccacgatggcgctgctgaagcccgccgccaaggccgcggcgcggtcggcgccgtccaccagcagcggcagcgtctcgctgcgcgtccggacggggcaggccgccaagaaggctgcgctgtccgtgtccgcgtcgtccacgctggcgggcgccttcctcgcggcgctggcgtcgtcgcccgacgctgcgctggcggacgtggcggcggcagacgccggctgcgacagacgcagccagctgctgctcgtggtggtggcgcccgacatc

SEQ ID NO: 37058 - DNA, 272 bp, Zea mays
  unsure at all n locations
  Clone ID: LIB3060-035-Q1-K1-D7
cagacccgtacccctcccattcactcctttcacccaaaaactcattctccttgggcacgattttacataancaacttatcaaatccaataatgcatacaagcccactatctacaangagacacacaacacacataaatcggagcactaccagttcattagacaataacccatccagtccaaatcactcatcaaagaaaataaattcatctttaaaacaaatgctggaagaagaaaaaaaaaagcctcaaaaagaaactgaatttaagttact

SEQ ID NO: 37059 - DNA, 392 bp, Zea mays
  unsure at all n locations
  Clone ID: LIB3060-035-Q1-K1-C1
gaagaaaaaataaaaggaattctatcaatttttattttccattgagttagttagtttttcttaatgaaattgaaattattaactaacagagcaaacacaaataaagaaacaactttgctgaccatgatagatttttatctagttggaagagtcctcttaatattcatctagtcttatataagtttgggtatatagaaatacaaacagaaaagagaggatagaggataggctcattacataaaaaaaagatatggaaatagccataatacataacanaaaagaaaaaaaggagcgggagagccaaatgaatcgaaagattcatgtttggttcgggaagagatcataaaaattgtaaacttaatagcaagataatctactttcattaaaagatt

SEQ ID NO: 37060 - DNA, 430 bp, Zea mays
  Clone ID: LIB3060-002-Q1-K2-F9
ggcgctcccgtcttcgaccaatactgcgatgcggatctcggtgacaacgccatggagcgcgtccagcgtggccccgtcgacatcgaacgcatcgacctccgcaggggtgcgctagctggctgctacggcgagcagtccgcacgcggacacactccttcctccttcaacgacgatttgggtgcctcgctcgactcggtcgccaacagctccgtccatggcggccacggatccgtgctgccccacctcacgcccatctgcgcgggcactagcaggatccctgtgcccgacgaccggaggctggactgcgccgaggatttcgacaccaatcacttggacaaggggttcgagtcggatcccgtccctcttcccgtcgtctacgaccgctacgacgagccgaaccacaacgagatcgttgaggtgctcgcgctac

SEQ ID NO: 37061 - DNA, 319 bp, Zea mays
  Clone ID: LIB3060-002-Q1-K2-G1
cgacttattgaggtaataaagcaagcagcataggaaggggcactggttctctacacccgtgccgatccttcaatggccgaggcgactaagaaggcctgcgatttctggggtgttccatgcaccgatgttcttcggcctactgtcgaagccattgcctctcacatcggtgttgctccatctggaattccacgaagctctccgagtcgaaatggtcggctatcagaggattacttccaacggatcgatgctatcgatttcaccatcaaacaagacgacggtgctctgccacagaacctctaccgcgcagacatcgtgcttg

SEQ ID NO: 37062 - DNA, 231 bp, Zea mays
  Clone ID: LIB3060-002-Q1-K2-G3
caccggccactccagcaaggcggcgggcggtccgagttctccgggctcacgagctccccgtcgctgcccatgcgccggaatgccacctccgacgacttgatgtccggcgtcttcttcaggacccacgcggccggacgaacggcggaccgcggcgggcgccgacggaggcgaagctgaaggtggccatcaatgggttcggccgcatcgggcgcaacttcctgcggtgctggc

SEQ ID NO: 37063 - DNA, 437 bp, Zea mays
  unsure at all n locations
  Clone ID: LIB3060-002-Q1-K2-G6
cggatatcgcccgcccgaacgggtggctgcggcgcatgcaatcgccttatccggccggcccgccgccccgcggccacaagcgcaagcagtgaacacggcgcctcctcgctcgcgcggccacgcccccgtcgtcgtcttctcccggcaggtactacagcgcataaatacgcagcaccgccgcccggctcggttcccgtctggccacccatccgatcccacccggcagcggcgctgcgcaatggccacccacgcagctctcgccgcctcccgcatccccgccggcgcccggctgcacagcagggcgccggcgtcgtccaggcacggcgtgcagaggctggacttcgccgacttctccgggctcaggccggggtcgtgctccgtgagcgctgccgcgcgggaggcgtnctttttccgacgtccttggcgcgcagctcgtc

SEQ ID NO: 37064 - DNA, 402 bp, Zea mays
  unsure at all n locations
  Clone ID: LIB3060-002-Q1-K2-G7
ccataaacaagaaaaagaaaagaaaacccccgctgccagcgacagaagaagaaggggtgccttctccttggttgcgttgcgcctccctcctgtctgcgtgcgtgcaatcgacgcagaggcgcgggcgctcgcaccaccacgaccacgacccgatggctttcatgcgctcccgctcaaatgcatcttctggcatgggagttgctcctaacattagggagacattcgtcgagcttcaaatgaagaaggcattccgatatgttatcttcaaaatcgaagagaagcaaaagcaggtggttgtggagaagacaggggctactactgaaagctatgatgactntntggcctctctcccaaagatggactgccgatatgcgctggattgatttgaatttggtactgggg

SEQ ID NO: 37065 - DNA, 420 bp, Zea mays
  Clone ID: LIB3060-002-Q1-K2-G8
aaacaaccggagcttttaccccacccgctttcccctccccgccaggaacaacagggcgcctcgcaataattcgtccatccatggcgaagctcgtcaacaagctggtcgattcgttcgaccaccacgaggcgccggcgccggacgtcggctgcgtgcgcgccgtgctggccgagctcgtcctcaccttcctcttcgtcttcaccggcgtctccgcctccatggccgccggggccggcgggaagcccggggaggctatgccgatggcgacgctggcggcggtggctatcgcgcacgcgctggccgctggcgtcctggtgacggccggcttccacgtctccggcggccacctcaaccccgcggtgacggtggtgatcttggttcgcggccacatcaccaagctccgggcgctgctgtacgtcg

SEQ ID NO: 37066 - DNA, 180 bp, Zea mays
  Clone ID: LIB3060-002-Q1-K2-H1
agcagcagaggcagcgacacgatcgcgagcgcacgcacgtaagcacgttgtcggaagctcaagttagaagaagcaccagtgcctgatcgatggcggcccaggctctcctctccggccggcagctgctgggccgccccgtgcagtcggccgtctctaggtcgtcggcgaggaaagcgccct

SEQ ID NO: 37067 - DNA, 428 bp, Zea mays
  unsure at all n locations
  Clone ID: LIB3060-002-Q1-K2-H10
gcgagctgaagcatccaggctctggaatcatcgtcgggatgtctgtgccagcatcagcgcaggtgcctcacaccatacgatctgctgggagctgctgcttcaggtcgtcgcatcaactatctgcgcagaatctgggccgacatcgcaggtggcgggggaccggaaagaagaagatcctttccacccgtggcgtgcttgagtccaggaacggtgcgcatcctggtggccttacgaagagaaagaaggtcgtggagcacatcatcctgctcagagccaagcccaacatctcagacgctgaagagaaagacatgctggactacctatacacatcgcagtaccagatgcgagggatacttgcggtctcgctaggccgcatcgaggaccccaacagcgacaacttcacgcacgctgngttcatgcgtttccag

SEQ ID NO: 37068 - DNA, 415 bp, Zea mays
  Clone ID: LIB3060-002-Q1-K2-H11
ggctccctcctcctccctgcaaatcctgcagacaccaccgctcgtttttctctccgggacaggagaaaaggggagagagaggtgaggcgcggtgtccgcccgatctgctctgccccgacgcagctgttacgacctcctcagtctcagtcaggagcaagatgggtgccggcggcaggatgaccgagaaggagcgggagaagcaggagcagctcgcccgagctaccggtggcgccgcgatgcagcggtcgccggtggagaagcctccgttcactctgggtcagatcaagaaggccatcccgccacactgcttcgagcgctcggtgctcaagtccttctcgtacgtggtccacgaccttgtgatcgccgcggcgctcctctacttcgcgctggccatcataccggcgctcccaagccc

SEQ ID NO: 37069 - DNA, 364 bp, Zea mays
  Clone ID: LIB3060-002-Q1-K2-H12
ggctcctaatacttccttctatgcttcaaacaccaccggtcgtttttctggttcgcgcacgatataaagggagagagaggttatgcgcgctgtccgtccgatctgctctgtcccgactcagctggtacgacctcctcagtctcaaacatgagcaagatgcgtgccgacaacatgatgaccgacaaagaacggcagaagcatgagcacctcgcccgagctaccggtggctccacgatgcagcggtcgccggtggagaagcctccgctcactctgggtcagatcaagaaggccattccgacacactgcttccagcgctaggtgctcaaatccttctcgtacctggtacacgacctgatgatcgtcg

SEQ ID NO: 37070 - DNA, 389 bp, Zea mays
  Clone ID: LIB3060-002-Q1-K2-H2
cccacgcgtccgcggacgcgtgggcgaaaattgaggggcatcagcacacctgagatggactgggcttgggcagctaaccggttaattgacaaggatgaggcagaaactccagacgatgctcctttaaattatttgccgcggaagaggctaattttgacaagccagttgatccagcaacttctccctgctataccagcgaccattctgagagcacaagctgtgtctgcttacggaagtgcgacatacactctatcaatgttgacactaagggatgcatgcagcatggcatcatcatcatcatcatcatcatataactcttgctcacctgtggaggatgaaaataacccatctgaacaaccgagtgctaagaaaatggaagacagagtgtc

SEQ ID NO: 37071 - DNA, 428 bp, Zea mays
  Clone ID: LIB3060-002-Q1-K2-F8
cggcatcatgtttctcgccggttccgtcatcaacgccggggccgtcaacgttgccatgctcatcgtcggccggatcctgctcggcttcggtgtggggttcacagcgcaggcggctccgctgtatctggccgagatatcacccaccagatggcgcggcggcttcaccacggcctaccatttcttcctcgtcgccggcacgctcgccgccaacgtcgccaactacgtcacgaaccggattcccgactggggctggcgcgtctccctcggcctcgccgccgtgccgtccgccgtcatcgtcatgggcgcgctcctcgtctcggacacgcccagcagcctcgtgctgcgcggcgagccgtacgcagcccgcgcgtcgctgcagcgcgtccgcggggcgggcgccgacgtggaggccgagctcaaggacatca

SEQ ID NO: 37072 - DNA, 346 bp, Zea mays
  Clone ID: LIB3060-002-Q1-K2-E11
cacgttccttcggtaaattatgcactaaatactgtacctgatccttttatgggaaaagggggtcattaaccacattcaaattctactccacctgatcgagaaacattcatacgacctcaatatgagctctagcacttactccagcctagctcgcctattgattctgatcacgctacccactctcgataacatccctgatacgctcctcaaccctatagctctaatactcaactcggcatcttcgagtacattggagactccaatgtcaatgacactcaacatactaatctagccatccacgatatgcccagctttgacccttatcgcgcactgacacttggccaac

SEQ ID NO: 37073 - DNA, 351 bp, Zea mays
  Clone ID: LIB3060-002-Q1-K2-E12
cccacgcgtccggggaattctcaggcaaacgcaatatatgaggcttttataccagagggctgccagaagccacattcagattctacccaggaagagcgagaaaaattcatcaggtctaaatatgagctgcaggaatttctgaagccaagcttgcgcattgtttctcatcagcctagtgactctggaaaacatgccggaaatgcttctcattctgatggttccaagagtcaagtcggcatgatcgagttcattggaatattgaatgtcaaggtgattggaggcaccaacctagccatcagggatatgtcaagcagtgacccttatggcgtcctgacacttgggcaacagaaa

SEQ ID NO: 37074 - DNA, 405 bp, Zea mays
  Clone ID: LIB3060-002-Q1-K2-E4
cgagaagaaggagaagaggaggaagaagagcaggtgctgagaagcctgccggcgcgcgttacgacaagcatatatgggggagatcaccaatgtcatggagtaccaggccatcgcgaagcagaagcttccgaagatggcctacgactactacgcgtccggcgccgaggacgagtggacgctgcaggagaacagggaggccttctccaggatcttgttccgtccgcgcatactgatcgacgtgtccaagatcgacatgaccaccaccgtgctggggttcaagatctccatgcccatcatggtcgcccccactgctatgcagaagatggctcacccagatggggagaacgccactgcgcgcgcggcggctgcggcaggcaccataatgacactgtcgtcctgggcaac

SEQ ID NO: 37075 - DNA, 257 bp, Zea mays
  Clone ID: LIB3060-002-Q1-K2-E7
aaacggtggctgcgtggtgttccatcgtttcgccttgagccattatttaggcgaagaggtccacaattgcatactgcacttgaacatatatagtactcatgaagttgttctacatcatattggatttcaatgcttttttatcagtgacagttttctcttttttggtgagtacagtaattgtatttttatcttgtaatagattagttttattcatacgacaagcactatgcactgtgatatttgttgatttttccttt

SEQ ID NO: 37076 - DNA, 336 bp, Zea mays
  Clone ID: LIB3060-002-Q1-K2-E9
cccaacaagcccgcacgacacgacaccaagtcgaggagctcgagagggcaccaataatggccggcgtgaactccagcgtcgtcgggctcaagcccgccgcggcagtgccgcaggccgccgccgcctcatcgccggcgaagcgggtgcagctggccgcgcccgagggccgccgcgccgctctgctcggcctggcggccgtcttcgccgtcacggccaccaccgggtcggccaaggccacgatcttcgatgagtacctcgagaagagcaaggccaacaaggagctgaacgacaagaagaggctggccaccagtggagccaactttgcgcgcgcctaca

SEQ ID NO: 37077 - DNA, 281 bp, Zea mays
  Clone ID: LIB3060-002-Q1-K2-F1
gacatatagcggctccaacaagcgctaggccctgctcggtctattctcctctcttaagcgatggcagtcgcagcgcatgcactcggctggtagccggtctcgacagcatagaacccaacttcaatcatgcctgcgctagttccgaactcactcagcacccagtacacgctcgactgtcagtcgattgatatcactgttacgctcattgctgccatcgcacaactgagccgcaactggtgacatccatgctgctggtcaagaactagtcataggaagaatat

SEQ ID NO: 37078 - DNA, 422 bp, Zea mays
  Clone ID: LIB3060-002-Q1-K2-F10
gagcagcacacacgcagctagctaggagcagcagcagagcagcggcgatggcggcctcgatgatctcctcgtcagctctggcggtggcgcctcagggcctgccgcccctcggccgccgcgcctcctccttcgccgtcgtctgctccaagaagaagatcaagaccgacaagccctacgggattggggtggcctgaccgtcgacgtcgacgccaacgggagaaagggcaagggcaagggcgtgtaccagttcgtcgacaagtacggcgcgaacgtcgacggatacagcccaatctacaacgaggatgactggtctcccaccggcgacgtctacgtcggtggaaccactgggcttctgatctgggccgtcaccctcgctgggatcctcggcggcggcgccctcctcgtctacaacaccagcgccc

SEQ ID NO: 37079 - DNA, 368 bp, Zea mays
  Clone ID: LIB3060-002-Q1-K2-F12
cccggtggacgtatgcgtactagcatccactcacaaatgcctccgaactgccgaacagcaccatcgacctgggcttcgcggacttcgtcggcaaggccgtcaacgtcccctcatcgtccgccttccgctaggcccccgtcacgatgctcaagactgctctgaaggccaaaccagatcaagactgccaaaccctacggtactgcccctaccctgacctgcacctgggaccactgcccgacaagccgccaagctacctgactgtccaattcccgggccactaccggtgcgacaccgcacggctacaggccaacctacaaacgttatgactgaactggcagctgcaactgatccactcccgctaccacatg

SEQ ID NO: 37080 - DNA, 307 bp, Zea mays
  Clone ID: LIB3060-002-Q1-K2-F2
cattcccctcgtctcatctcaagagcgactagagagagagaggaagagaacaagcgagaagcgcatctcgcacgcaagatgcgggctccaaggggcgcatgcggctgccgcggcggccaggagcatgtggaactgatccctggcatccccgacgacgtggccgaggactgcctggcgcgcgtcccccacgcctcccaccgcgcgatgcgccgggtctgccgcggctggcggagcgccgccgcggcgccggccttcgcgtcggcgcgcgccgcggcggtcgccaacgaggaccttgtgtacctgatgc

SEQ ID NO: 37081 - DNA, 431 bp, Zea mays
  Clone ID: LIB3060-002-Q1-K2-F3
ctagaagagcggcggcgcgggcggacaaggatcaggcggaggaggagctgtgccaagggacagtgggtatctcacgcgactcgatgcacaagcgccgtgccaccggtggaaagcataaggcctggaggaagaagcgaaagtatgagcttggtcgtcagccggccaacaccaagttgtcaagcaataagacagtgaggagggtccgtgttcgtggaggtaacgtgaagtggaaggctcttcggcttgatactggtaactactcatggggaagtgaagctgttacccgcaagacccgtatcctcgactaggtctacattgcattaaacattgagcttgtgaggacacatacccttgtgaagagtgccattgtgcaagttgatgctgtcacattcaagcagtggtacctcactcactatggagttgacattgtt

SEQ ID NO: 37082 - DNA, 347 bp, Zea mays
  Clone ID: LIB3060-002-Q1-K2-F5
aaggaaagtacgtggcggagcaggcatggcttcatcggtggccgacgctgcgagcagagtcctgggcgcccgtctggcgcaccaggcgccacagaacggtctcatcgtcgcccgcttagggtccgacttgagcggcaaggcgaagcctgctcctaagaaggtggcgaagacatcgacctgctttgaccggccgctgtggatccacggcgccgtgacacccgactacctggacggctcgctggtcggcgactacggtgtcgacccgttcagcctaggcaagcccgcagagtaccttgcagatcgagtacgactcgatggaccagaacctgtgcatgaatgacgccggc

SEQ ID NO: 37083 - DNA, 442 bp, Zea mays
  Clone ID: LIB3060-002-Q1-K2-F6
ggtggagtcttctgacaccattgacaatgtcaaggctaagatccaggacaaggagggcatccctcctgaccagcagcggcttatcttcgccggcaagcagcttgaggacggccgcacacttgctgactacaacatccagaaggagtcaacccttcatttggtgctgcgccttaggggaggcatgcagatctttgtcaagaccttgactggcaagacaatcacccttgaggtggagtcttcagacaccattgataatgtcaaggctaagatccaggacaaggagggcatccctcctgaccagcagcggcttatcttcgccggcaagcagcttgaggacggacgcacacttgctgactacaacatccagaaggagtcaaccctccacttggtgctgcgccttaggggaggcatgcagatctttgtcaagaccttgactggcaag

SEQ ID NO: 37084 - DNA, 355 bp, Zea mays
  Clone ID: LIB3060-002-Q1-K2-F7
ggcggctacggcggcggccacgggtaccctcctcccgccgccgccggcgcgtaccctgacccgcacggcgcataccctcacccgcacggcggccacgggtaccctcctcccgccacctaccccgcgcactcggcgcactacgggcacacggggtcgtaccacaccagccacaacagctacggcggcggcggcggccaccacggcatctacggcggcggcaagcacggcgcgttcggcggcggcaagcacaagagcggcggcggcaagttcaacaagtggaagtgaagcgaccgaaacgaatcaaaacaacacccttaagtctcgcttcgcacacgtgcacccgcacacgaatcct

SEQ ID NO: 37085 - DNA, 370 bp, Zea mays
  unsure at all n locations
  Clone ID: LIB3060-002-Q1-K2-E10
caagtttcgtgggtagaggaggcactagatactgtgccagatcggggtctggtagtggcagttgggtgattacgacggagtgggatgggcctcctcgacaagctgtgggacgacaccgtcgcgggcccgcgcccggacaccggcctcggccgnctccgcaagcagcccgcgcgccccgccgccgttaagatcagtgatccggccggggacgctgcagcgctcgtgccgccctcgccggcttcgggtagcgaggagacgccggtgaaggtgacgcgcagcatcatgatcaagcgccccgcggggtacccgtcttcgccgaggagcgcggcaagcacgccgncggcctctccacttgggactatccccgcca

SEQ ID NO: 37086 - DNA, 269 bp, Zea mays
  Clone ID: LIB3060-002-Q1-K2-C7
cgcggagctcgccggggacgggctagtgcaggccgcggtggtcgccggcgccgaggcgctcggggtcgtcgtgggcctatccgtggtaaatggtatcctgaagcccgaggcgtagatggtgtaggctgctgggccttgtagtttcggccgaatacaagtgtttgggctttagcgcttcgttgtcggtgtcgctgtaatttgctgatgacctcttttgtgtgtaaattgttattattatagcaattattggagtgcggatatgggcagct

SEQ ID NO: 37087 - DNA, 380 bp, Zea mays
  Clone ID: LIB3060-002-Q1-K2-C8
caagcacttcgacgtcacacgggcgctgcacacagacacaccaagcgtcggcaccaatggcttactaccaggaggtggactactgctcggaggaggtgaggtcggtggccccggccggtttcggccgccacggcggcggcgtccagcagcacgtcgtcaaggaaaagttcgaggaggtcgacacggtcgaacgcgccggcgccaaccaccaccaccaccatggtcaccacggcggccacggtttcgtggtgcgcgagaccagggtcaaggaggacatcaacacctgcaccggcaaggtccacaagcgcagggagagcttcctggccagggctaactgagcagcccgggcggccggcatccacgcccgttcgtgcttgcct

SEQ ID NO: 37088 - DNA, 297 bp, Zea mays
  Clone ID: LIB3060-002-Q1-K2-C9
ctcctactaataatataatgatctccattaatgcctacgaattagaactcaagtctttgggcactcatcctatactacttattctaatctttaccccttacacattaacatctcaaagttcacctcacattactaatacttatccatataagtttaactataagccttatcctgtatagataccatcacttctatcaaacttatcattatccgtaatatactactctgaatatccatataacaatctactattactactattcatctccaatcaacatcaacatcttatcttatcaa

SEQ ID NO: 37089 - DNA, 405 bp, Zea mays
  unsure at all n locations
  Clone ID: LIB3060-002-Q1-K2-D1
gaaagaaaaaaaatcatctgaagaactacgggccattattaaaaatatcggtgacattggaaaagagatagaagaagatggacgtaggatcaatcaactgagaagtcaaattgatgatatacgacggcgccaacaaaacaaactaacggccttcggaggagatagagttccgagcctctataaatcagtagagagacacatgagtaaattcaaatgccctcctattggtccaataggatatcatctgcaactggcaagcgattcctggtctgttgcaattgaatatgcattanggaggttattagatgctttcattgtctcatgtcataaggattcactcgttttacgagaatgtgcaaaagaagtgaactaccgcaaccttcaaattattatatatgacttcac

SEQ ID NO: 37090 - DNA, 424 bp, Zea mays
  Clone ID: LIB3060-002-Q1-K2-D10
ccctgtcgttgtgagaattcttaattcatgagttgtagggagggacttatgtcaccacgaacagaaactaaagcaagtgttggatttaaagctggtgttaaggattataaattgacttactacaccccggagtacgaaaccaaggatactgatatcttggcagcattccgagtaactcctcagctcggggttccgcctgaagaagcaggagctgcagtagctgcggaatcttctactggtacatggacaactgtttggactgatggacttaccagtcttgatcgttacaaaggacgatgctatcacatcgagcccgttcctggggacccagatcaatatatctgttatgtagcttatccattagacctatttgaagagggttctgttactaacatgtttacttccattgtgggtaacgtatttg

SEQ ID NO: 37091 - DNA, 416 bp, Zea mays
  Clone ID: LIB3060-002-Q1-K2-D12
cccacgcgttccgagaattcttaagccatcacaatatatgaggctcttatgcgcacaaggctcacagactccaccttgagattctacccaagatgagcgagaagaattcatcaggactaaatacgagctgcaggaatttctgaagcctaccttgcacattgcttctcatcagcctactgactctgtaaaacatgccgcaaatgcttctcattctgatggttccaacagtcaagtctacatgatcgagtacattggaatatcgaatgtcaaggcgattgcaggcaccaacctagccatcaaggatatgtcaagcagtgacccttatgtacgcctgacactatgtcaacataaagcacaaacttcagtaatcaatggcaacctgaatcctgactggcatgaagaactgaagctctctg

SEQ ID NO: 37092 - DNA, 438 bp, Zea mays
  Clone ID: LIB3060-002-Q1-K2-D2
atccggctgcacgtttacgaagtattggtaggtattgactttgataaatgagataaggtgcaggagctcgacgaattacttctgaataacttcagaaatcatatggaagaaccatagcatttcgcgattcattggtaaatttactttgattctctatagaccaataatgtgagaccattaacacggttaaagctaaactgcttgaagtccgggcaaaaaggggtactctttctacaactacattagtattactctcgaaatgctttaaacgggaaatagctagtgtagaatgtatctgatatacaacactcatatcgatgaaatagtttgaactatttactagaaaggcaacccatcctttttcccatggccaatcgaccacctaatgattaaaaaaagggaaattttttggaattggaggacaaattaaagggattc

SEQ ID NO: 37093 - DNA, 423 bp, Zea mays
  Clone ID: LIB3060-002-Q1-K2-D3
cgtccatctgcgcgctggacttccgcatggacgagtggggcgtggacgtggcgctcacggggtcgcagaaggcgctgtcgatgccgacggggatgggcatcgtgtgcgccagccccagggcgctggaggccagcaagacggccaggtccgtgcgcgtcttcttcgactggaaggactacctcaggttctacgacatgggcacgtactggccctacacgccctccatccagctcctctacggcctccgcaccgcgctcgacctcatcttcgaggaagggctggacaacgtcgtgaggaggcacaaccgccttgggacagccaccaggctcgccgtcgaggcgtgggggctcagcaactgctggcagaaggaggagtggttcagcgacaccgtcaccggcgtcgtcgtgccggccaacatcgaca

SEQ ID NO: 37094 - DNA, 441 bp, Zea mays
  Clone ID: LIB3060-002-Q1-K2-D5
cacaaacagtacttcgtctcttcggatgtcggtgccggtaaaatgcaatggtatgcttttcacaaggaagaggctggtggcactgaccctgagaacggcaaaaagaaaagattgcttgagatatttgatgggtggtgtgataatgtcatcgatttggtaaacgcaaccgacgaagaagcgattcttcgccgagatatatacgaccgcccacctactataaattgggggaaaggtcgtgtcaccttgctcggcgattctgtccatgctatgcagccaaatctgggtcaaggtggctgcatggctatggaggatggttaccagctggccgtaaaactagagaatgcctgccaagagagtgtcaagactggaactcctatggacaatagttcctccttgagacgttatgagaaagaagagaagggtgcgtgttgctgttataca

SEQ ID NO: 37095 - DNA, 384 bp, Zea mays
  Clone ID: LIB3060-002-Q1-K2-D6
ccggaagctacgaagcatggcgtccgtcaccgcccgcgccccggtcgcggccctgcgcgcgtcgtcggccttccttggccactctagccgcctcggccgcaccgcgtcgcccacgaggcgcagcctcaaggcggaggccaagggcgagtggctccccggccttccctccccctcctacctcgacggcagcctggcgggtgacaatggcttcgacccgttgggcctggcggaggaccccgagaacctgcggtggttcgtgcaggcggagctggtgaacggccggtgggccatgcttggcgtggccgggatgctcatcccggaggtgctgaccaaagccgggctgatcaaacgcgccgaagtggtacgacgccggcaagtcggagt

SEQ ID NO: 37096 - DNA, 383 bp, Zea mays
  unsure at all n locations
  Clone ID: LIB3060-002-Q1-K2-D9
catcaagaaagcaagaaagaaaagactgtagctagctagccaccgcgcgcgcgcacgagtagtctagctagaatacactcgcgttcaaaacaaacacacagcgtcgtgctgcgtgatctctgaccgcgtcgacaactaccgcagcaccaagcagctgatggcggccaccgtatcttcctgcctgagcctcgtccccaccgtgcaccaccgggccggcgggttccccagcagtgtggcactgacgaacacgcttcagcgccgtcgtcgttctcgccgctatcttgtcgtcgcctcggcgacgagagccgaacaggaggccgnccctgtgacgatcgaggacgtggacctcagctctcatcaggccgcggccgacgacggggagc

SEQ ID NO: 37097 - DNA, 410 bp, Zea mays
  Clone ID: LIB3060-002-Q1-K2-E1
gatcggaaacagaagtcccaaattctttcttttgcttggtcaagtgccaattgggaggcagaacggaagacagaacctgcatgcgaactttagtcgcgctgatttcgatggaatcggaactgatttaggtgtattttagctctgattgttcttggcaggagtacaattttagtagcaccgattgatggtacggttcttctgggtggtaaattgcccttactgcgacgcgatgtcagacttcgatctctgttggaagacgctagacattgcagacatagatattgttactgcaatcatgagctcgaaatccaaatgtaatcaggtgccaggttagacaatcgctggaacatgtgtaaaagctggacgaggtttcatatactcgattgaatcctcggcttcggcgctaaatc

SEQ ID NO: 37098 - DNA, 439 bp, Zea mays
  Clone ID: LIB3060-002-Q1-K2-C5
cgccgtcgtctaatctaccgcgcgcaagccttccctcggggctagatctccgggctccgcttgcccaacttccaccactgaggcgatgcaggaggccaagcacctcaccacctcaaagcttccgccgcaatcccaatcctcatccccatccccttcggctcccgccgcgaaccctcccccataccatcacgactatggtacctttcaccggccgtttcagccgacgctgcccgtcgtaggccccgcctaccatgactaccatgcctctcctatcgggttcggcagccaggggttcgttgcctacccgggcgccgtccagcagcaggtcttcgtggagggcatccccgtccgagagccggccttaccgttctgcggcgtcggcgtcggctggtttttgttctaattggggttcttcttggcggcaatcccctggtatgct

SEQ ID NO: 37099 - DNA, 358 bp, Zea mays
  Clone ID: LIB3060-035-Q1-K1-A4
gcaaccggtccaacactttcacgctcaggcgctcagctctagcaatggctgcctccagcatggcgatctcctccacggcgatggccggtacccccatcaaggtgggctccttcggcgagggccgcatcaccatgcgcaagaccgtgggcaagccccaaggggcgggcgtccggcagcccctggtacggccccgaccgcgtcaagtacctcggccccttctccggcgagcccccgagctacctcaccggcaagttccccggcgactacggctgggacaccgccgggctgtccgccgaccccgagaccttcgccaagaaccgcaagctgaaggtgatccattcccgttgggccatgctcg

SEQ ID NO: 37100 - DNA, 346 bp, Zea mays
  Clone ID: LIB3060-035-Q1-K1-A5
cacaccaccaccacctcctccggtccccaacccctgtcgcaccgcagccgccggccagggcctgcctcaccgacctcgtcaacctcaacctctcggacaacaccgagaagatcatcgcggaatacatatggatcggtggatctggcatggatctcaggagcaaagcaaggaccctctccggcccggtgaccgatcccagcaagctgcccaagtggaactacgacggctccagcacgggccaggcccccggcgaggacagcgaggtcatcctgtacccgcaggccatcttcaaagacccattcaggaggggcaacaacatccttgtgatgtgcgattgctacacccc

SEQ ID NO: 37101 - DNA, 408 bp, Zea mays
  unsure at all n locations
  Clone ID: LIB3060-035-Q1-K1-A7
ccattccctactcgctccgtggttcccccagctccctcttccatgggcggtgtgtgcggctcctggcgcatggcatgggcacctgcgcctcttccccagaagtcgccatgacctcaccaagaccccagccgagctcgcccccggacccttgcttcccatggcactcgccctcttctccctgacacgcgccctcccagccgagcagctcgccctcgctccctcaaactcgccgcgcgcgccctgctccctgcgcgccgcggcttcctagctcctctccagcgtctatcacagtccgagcctnctncacgccggccggaccttcacctcgcccatggcggcttcccccgctcagcgtactccctcgctggtggtcgggcagcagtcgcagctgcaaccgagtggagaaac

SEQ ID NO: 37102 - DNA, 314 bp, Zea mays
  Clone ID: LIB3060-035-Q1-K1-A8
tcttctactctgggatgacactctcccacatcaaattgtgctccttttatgaggacaccatcacccttcacattaaccatctctattccaaattttcagatctacacagaatttagaacaattccatccacgtaaaacatctctgatcttgttacaccaaatgctcgtactttctcacctcatacatccactacaaatacaactgatacaacctcggacatttcagctatacatatacattataccactacccctagatcgacattatccacttcaacaagcatatgctgctctcactttgatttgtcttaccc

SEQ ID NO: 37103 - DNA, 355 bp, Zea mays
  unsure at all n locations
  Clone ID: LIB3060-035-Q1-K1-B1
ggaggtcggtagtttagttttcagaagccaaattaaattaaaggctgtctgtctcactgactgactcactcccagaagagagaagaccacaccacacaaacaaacacctctttggtttctacaaatagaggacgcactgactgagctacaccggtaaaagctgccaaggatatatatcccaccagtcaggaatgcccgcaaccagacatttcagtacataacaggagctgaacaactaacgtacaggctgacagcagcagatgtatcatcagcaacagctccacacccataaccagcacctgtcctcgtcaaggccgggcttacctnctgagaagcagttcctnctgcacggagc

SEQ ID NO: 37104 - DNA, 466 bp, Zea mays
  Clone ID: LIB3060-035-Q1-K1-B10
ggattcccggtggacgccagcgtccgcccacgcgtccggagaccaactagcgacatagaaagcacaatagtgtaccaacaatgtgagccaaaatattgtgcctccttatgctccttggtctttctgcaagtgctgctaccgcgaccattttcccgcaatgctcacaagctcctatagcttcccttcttcccccgtacctctcaccagcggtgtcttcggtatgtgaaaacccaattcttcaaccctataggatccaacaggcaatcgcagctggcatcttacctttatcacccttgttcctccaacaatcatcagccctattacagcagttacctttggtgcatttattggcacaaaacatcagggcacaacaactacaacaacttgtgctagcaaaccttgctgcctactctcagcaacagcagtttcttccattcaaccaactagctgcattgaactctgctgc

SEQ ID NO: 37105 - DNA, 410 bp, Zea mays
  Clone ID: LIB3060-035-Q1-K1-B11
atcatcgaggccgggttcccggcctcctcccccgacgacctcgacgccgtgcgctccgtcgccatcgaggtcggcaacccggcgccaggacccgccggggaggaggacgccgtccacgtgccggtcatctgcggcctctcgcggtgcaaccggagggacatcgacgccgcgtgggaggccgtgcgccacgcgcgccggccccggatccacaccttcatcgccaccagcgacattcacatgcagcataagctcaggaagacgcccgaccaggtggtcgccattgccagggagatggtggcctacgcccgcagcctcggatgcactgacgtcgagttcagccccgaggacgccggcaggtcaaatagagagttcttgtatcatattctaggggaagtcataaaaactggagc

SEQ ID NO: 37106 - DNA, 408 bp, Zea mays
  Clone ID: LIB3060-035-Q1-K1-B2
gttgctggaacatctaccagaaatcagtatcttcagagaaatgcacacgagagcagtgacagtgaatctgagagtattgatttacactcttggacaagaaatggtggccctcttatgaggacagcctcagccaataaattcatcagctttgttcagaatcttgagatcgacacagaattcagaacaattccatcgagggaaaacctaactgatcttgtgacaccaaatgctggtaccttggcagctcatgcagtgagtagagaagcaaccgataggagcttggacatttcagctttagatatccatgataccgctacccctagatcgacatttggccgttcaacaagcatcgttgtttctgaaggtgacttgttgcagcctgaaaagattgaaaatggtattttggtt

SEQ ID NO: 37107 - DNA, 369 bp, Zea mays
  unsure at all n locations
  Clone ID: LIB3060-035-Q1-K1-B3
atagcaaccggtccagcactttcacgctcagctccagcaatggctgcctccaccatggggatctcctccacggcgatggccggcacccccatcaaggtgggctccttcggcgagggccgcatcaccatgcgcaagaccgtgggcaagcccaaggtggcggcgtccggcagcccctggtacggccccgaccgcgtcaagtacctcggccccttctccggcgagcccccgagctacctcaccggcgagttccccggcgactacggctgggacaccgncgggctgtccgncgacctcgagaccttcgccaagaaccgcgagctggaggtgatccactcccgctgggccatgctcggcgcgctcggctgcgtc

SEQ ID NO: 37108 - DNA, 367 bp, Zea mays
  Clone ID: LIB3060-035-Q1-K1-B4
ctgctcgcccagatcaactgtttctactcctgccatctacttctacacgtccaccaactcgctgcgtctcacaatgccacccctagggcaaagcgccgctcttatgggagatcaccggcgacagctgccatgtcatctaccaccacatagacatcctcaaaggcttatgcccgaagtcgttttcgccggtctggctggggtgcttctactccaacgtcattgcacggcttacgagatacaagaaccgaacatacactgtcaccgttgtaccggcagacaatgaacagatctggccagtcacactgaaggtggtgcaaggagctactgcgctgacagcactgcactgatcgatcattatgacgccgat

SEQ ID NO: 37109 - DNA, 250 bp, Zea mays
  Clone ID: LIB3060-035-Q1-K1-B5
cacacctcgtgcggcggtggcccaaccaaagggcagccggggtcgcttgaggcggtgagtcctcgtcctcgtccgatatcgcagcggaacaaggtcatgggcttccaggtggctgccgtggcaccgacgccgtgcgcgcgctcctcctgcgacttatcgtcgccctcgaccttcttgcgggcggtccttggaagccggcggcgaatcccccggcctcgcgagatcccggcaacccgtaaactgggaaacc

SEQ ID NO: 37110 - DNA, 176 bp, Zea mays
  Clone ID: LIB3060-035-Q1-K1-B6
cgcatcagtcactctctcgacttcggtcatccactctttaccaactactacacgctgtgcctcaaaaagccttcgcttttctaaatcgcctttttcaaatcacctgaacggttctatcttccatttcacccaccaacatttcaaaattcctttcaccgttgttaccggtgcccttt

SEQ ID NO: 37111 - DNA, 408 bp, Zea mays
  Clone ID: LIB3060-035-Q1-K1-B7
aggagccctgccaagaatggctggacacgatcgaagttatgtgtaacgagatgttagggaactatacgaaaaaagaagatcagttgatgactgcagccttcgactcccgaccgaagcgaagattgaatcaagtaatggatgctctacattttgaatatcctgattatgagcggttgaacaagggcgccgaagggcagaaaagaaagagaattgtcagtgttgtgggcagacaggccgctagaacggtaaaagaagatgaagaaaaactgacgaagaggaaactgagccttgagccgacaacggttgctccgaagaagagaaaagctgcagctctaaagcaaaaggcgactgatattgaagaagaaactcctgcatcaccttctgttgccgatgtggcagaaattctaa

SEQ ID NO: 37112 - DNA, 380 bp, Zea mays
  unsure at all n locations
  Clone ID: LIB3060-035-Q1-K1-B8
ggagcccatccacctggtcctgctctcaccacaccgccgcgccaatggcggctcgccggcagcaccgccgcggcttcccgctggtcccgctcctgctctccctcctggccgccgccgcgtacggccgcctcatctccgacggcggcccgtccgcgcagctcctctcggtgatccgcctctcggggtcctcgatggccgcgggggcggccaacaaggccgaggagaagtgcgagcagtcctacgggttcctcccctgcaccaccaccgtgctcggcaacctcttcctcgtgctgacgtacggctacctcatgtacaaggcggccacgtacctgtcggcggngagcgagctgctgctcgagatcatggggccccggcctcgt

SEQ ID NO: 37113 - DNA, 428 bp, Zea mays
  Clone ID: LIB3060-034-Q1-K1-F8
cgcacatgctttgtcccatggatgcctaccacctcatggtgttcaagaccatgctcgccgtcaggtggtagtcccggcgagcgagatctccccactccaggctctctcccatcgctcgctgccgcctcatgttgtttgcggccgtgctcgccaaccgcggcacggaggcgtcgatccgaccgggagcccttcgcaatggacaaagccttcctcctctccggcaatgagggcatcgtcggctcgtcgctaacgtgagcacgtggcagaccctgctgcccccatccttcttcatcttcactaagtgaggaactctctcgacccccttccccacccttcttgtcttcggagttcggatggctggagaacacggtgtttggtcatggcttctagaaggtggtgttttgcatttaaaaaggaaaaaattggag

SEQ ID NO: 37114 - DNA, 424 bp, Zea mays
  unsure at all n locations
  Clone ID: LIB3060-034-Q1-K1-G3
gaaaattctaccattctgattctttttcttttgctacaatacaatacacttttacattgtcattttccaacaataacactataatatttttgaaacaagaaatttggtcatgggacatagttgtttgtcctaatgcagctagctcatttgttttcctttgattcagctacaacatcagtagccacattcgttgttctggtagtcactgcactctatctttcactgaagaaaagatataatgaagcaatacatctcanagtagaaatgtttctcaaaacatatggcacatcaaaacccacaaggtacactttctccgaagttaagaagatagctaggcggttcaaggaaaaagtaagccaaggtggattcggaactgtttacaaagggcagctaccaaatggtgttccagtggcggtcaaaatgc

SEQ ID NO: 37115 - DNA, 429 bp, Zea mays
  Clone ID: LIB3060-034-Q1-K1-G6
agaaaacgaagaagaagctatagtcgtagaagaagttgtcccgcaagctgagaatcgttcggttgagaacaacttctattttgacatttgtgggacagatccagaacctcctgcaacacaagataagccccgatgcatttacccctttccttgttgttttaaactctttatcacttgagatgatgcattaggtgataggagttgtgtgctaaacaattgctgcatttccttggaactgattaccattccttgatacctgttttacttaaagttttctgatgcttagctttgctttagaaaacaaaatggtttggtttaaacaaaagatgatgcttcatatgggatgggaagttttcaaagaaaagacttgatggtgaatccatcttggtcatgatgggttcaacatctaaaaatatgtacctatgtctg

SEQ ID NO: 37116 - DNA, 403 bp, Zea mays
  Clone ID: LIB3060-034-Q1-K1-G7
cagaggcagcgacacgatcgcgagcgcacgcacgtaagcacgttgtcggaagctcaagttagaagaagcaccagtgcctgatcgatggcggcccaggctctcctctccggccggcagctgctgggccgtcccgtgcagtcggccgtctctaggtcgtcggcgaggaaggcgcccttcgtcgtcagggccagctccagcccttcagccaagcaaggtgccgacaggcagctgtggttcgcgtccaagcagtccctctcctacctcgatggcacgctgcccggcgactatggcttcgacccgcttggcctctcggaccccggaggcaccgggggcttcatcgagcccaagtggctggcctacggcgaggtgatcaacggccgctacgccatgctgggcgcggtgg

SEQ ID NO: 37117 - DNA, 182 bp, Zea mays
  Clone ID: LIB3060-034-Q1-K1-G8
ttttcacattcctgctacacctctaatcgccgggtgacgtccaaatccaccttgttaatacattactttatttccaaactgtaacaacactaaaccctatactacactattcactacatccatatatcaccctacctgatacgatgcaattaccccgacaaaacctttttccaacacatatg

SEQ ID NO: 37118 - DNA, 427 bp, Zea mays
  Clone ID: LIB3060-034-Q1-K1-H1
aggaaatgggactacttgagattaaacatggactgctacaagttgcagagacgttagattttcttcataacaatgctcatcttgcccatcgagctatatcacctgagacggtctttataacttctaacggatcttggaagcttggtgggtttggttttgctctttcagttgatcaagccacaggtggtttgacttcatcacagctattccattattcggactatgatgtcgaggatacagctttacctcttcaaccgtcgttgaactatactgcaccagaattggttcgaagtggagattctaaagttggctctgcttgtgatatgtttagctttggatgtctagcttaccatctggttgctcgtagaccacttctggactgccataacaatgttaaaatgtacatgaatgccttgacatatttaac

SEQ ID NO: 37119 - DNA, 328 bp, Zea mays
  unsure at all n locations
  Clone ID: LIB3060-034-Q1-K1-H3
nagagagctagcatacatcgctagctctctatatcatatatattacataaatattggcgtatagtaacaaaactgaatggacgaccatatcgcccgctaggtctcttacggaatcattggtaagtggcacaacatcttcgacgattgcggattccgtgaaatccatgctgacccaattaaactcgagcgtccgcacaagcgtccgccacagaagcagaatgcggagaatggaacgaccaccaacgtttatgaaccacaggaattgactaaatacgtgtgcatcaacggacacaacgggctatccctgaacgatcttatgccaaaagga

SEQ ID NO: 37120 - DNA, 429 bp, Zea mays
  unsure at all n locations
  Clone ID: LIB3060-034-Q1-K1-H5
gccgccgccgccgcgctgccttgttcgcagctctcttggccgctcgctttcgcaacaggattatacccacccaatcgaccgacgcaatcgaaaccgcctcccatctcatccgtctctctcgaatcccaccgtgcgctcactgcgatggacggctcatccaagcggatcggcggtggcggcgacgacatgcccagccccgaccacgaccagaacgccagccccaacgtcccgccgtccgccgctggtgacggcggcgcatcagccactgcggcggcagcgcccgccgncgggaggcggccgttcaccagcctcagccaagaggaagccgacctcgcccttgcccgcgtcctccaggagcaggagcgggcgtacatgatgctgaccggcggcgagtacgcgatctcggacgccgagagctacgactacgac

SEQ ID NO: 37121 - DNA, 290 bp, Zea mays
  Clone ID: LIB3060-035-Q1-K1-A1
ctgtttttttttttttttttaaccagaaaatcctttttaatttatttcacacatactgtgacactaaacatcactttttgttgcacagatggcacgacataaaaccacacaaagcagccgctcactgtcacgacggggagctcgttgctccgtcacgcaaggcagccgcctagcggggcgccgacgtaacgtatactcatatcatatctcgccgtcccatagttcctcgaatgacttgtagggcccgtgctcggagacgtatcgacggccctggttgaacttcagctggg

SEQ ID NO: 37122 - DNA, 417 bp, Zea mays
  Clone ID: LIB3060-035-Q1-K1-A2
ctagaatctataccatctttcgtggacttgaattctcgggtaagccacatgttaaccgggacagtattcgacatccacacccgtctcctgtgctatcaatttcctgtaaccacttgttggtaaacttctttctgtgttttacccaagacggtgcatgtgattctgtttggggaaaatcacgtatttaccgctcacccaatagactcggatagtacaatgtcatcagaaaaagcaaactgcacacatgaaaccttatgtgttcttgtggcaggtagcgtctctactatgggacatctctaaattagcttaaggcgatatatgatatgcccactagagaaactacatcctgaggcactcacctttacttggactatcttagggttatcgctgatatggatatgggttacatacttctct

SEQ ID NO: 37123 - DNA, 422 bp, Zea mays
  Clone ID: LIB3060-034-Q1-K1-F7
aatggaaggaggtgctattaagttatttgattcccggtcatatgacaagggtgcattggacactttcttggttggtggagatacagctgaagtttctgacatcaaatttagcaacgatggcaagtctatgcttttgacaacaactaacaaccatatatatgttctggatgcatatggaggggataagaggtgtggctttagtttagagccatctcccaatgtaacaaatgaagctgctttcactccagatggtcaatatgtaatttcaggatcaggtgatggaaccctgcacgcttggaacatcaatacagtacaagagcattgaagtgggcccctcgtcgagcgatgtttgcaactgcatcaactgccctaactttctggattcccaaccaatcgaattaggatcaggtgcatggagaaag

SEQ ID NO: 37124 - DNA, 327 bp, Zea mays
  Clone ID: LIB3060-034-Q1-K1-D1
aaacgcgccattgacgcgcactcgtagtcttgactcttgcgtgcttccctcgtcttctcggacgttccgttccatcgccatggcggaccagcttagcgaggagcagattgccgagttcaaggaagctttcagcctcttcgacaaggacggcgacggttgcatcacaaccaaggagctcggaaccgtgatgcggtctctcgggcagaaccccaccgaggcggagctgcaggacatgatcgccgaggtggacagcaacggcagcggcaccatcgacgagcaggagttcctgggcctgatggcgcgcaagatgagggacgccgagtcgga

SEQ ID NO: 37125 - DNA, 194 bp, Zea mays
  Clone ID: LIB3060-034-Q1-K1-D2
ctgtacacacacgaacccacgaacgcatgctcccgagaacagcagcccccattggatttggaagcttctccatgggacaccgagcctcgtagacgaagcagaggggaccagagaaaccgaggagcaagaagcagggagccatggcgttccttctacccaagctcacaacgccgtcctgcaagttgcccccgagc

SEQ ID NO: 37126 - DNA, 391 bp, Zea mays
  Clone ID: LIB3060-034-Q1-K1-D4
ctgtctctggccgcgcgcgagctcctctgttgaacgctgctgttcggctccctgctgcgtctgcctgccatggcgtgcccaggctccagctcgccctgcgctaagattccgtctccctctacgcatctctctctggtcgctcgctctcagtggagctcggtctccatctgcatgcagccgtcgagctcccctgctcgctggtcgcccttccctctatccgcttgcgcgcagccgggtccctgctctggtcgtcgggcgcgccaggccctgctggggctcagctccagtcgaacgcgcgcgctggtccctgcactcgcctggcgttcggcccttgcttcccatgggcggaactcccagcgccgcggctacctttctctggtgcttggctagc

SEQ ID NO: 37127 - DNA, 420 bp, Zea mays
  Clone ID: LIB3060-034-Q1-K1-D7
agcgctccacacaattcgtgcctgcctccctgcctcggcctcctccctcggcctcggctcctccgccgcctcaaacccggccccctcgcgcgcgtgcgcggcgctcgaggcgacgaatccagccacctcctccgcacccatccccgccgccggtcgccgatgagctcggaaggctgggacgctgacccgaattttatggggagaggatgccagagctgcgaagcaatactcgtcaagcacgcttaaggtctaagaagcttgacgatctgcagccaggagagccgcttgcgaaaccggtgtcacctgctctgccgagcgcacggaagcgtgctcctacacgtgctgctaggggcagaaagggtgctgctgggagaggagtgccttccgcaccaaagcctagaagaaagggggttgatattg

SEQ ID NO: 37128 - DNA, 426 bp, Zea mays
  Clone ID: LIB3060-034-Q1-K1-D8
cgcaaccgcaagcaaccaccgatccagtccgttcggcctttcggcgaatggtgacgaaccaggacgcggaggcggcatcggcggcagccccggggccaggggcgacggtggacccgatgcgcctagcgtcgcggtggcggtcccagacggagtgggaccgcgcggtgccggagctggaggctgagccggagccgtccgagctcaacaccgtcaacagttcgggactcttctccgtcgtctctacggacaagttgtccgtgaaatacctcggcagccatcaccacggccacgaacgtcgtgtcgtgcaagccggaccgcccggttccacgcgccgggccgggtactacttcgagatggccgtcaagaacgcgggatacaaggggcagacatccatagggttcacgagcgagagctttcagatgaggc

SEQ ID NO: 37129 - DNA, 418 bp, Zea mays
  unsure at all n locations
  Clone ID: LIB3060-034-Q1-K1-E1
gtggaacgggcagaggatgtggctggtccggagaacgacctcgtacctctacggcttcgtcgacaccgtcagggactcgctggggctgtccaagatgggcttcgtggtgtcgtccaaggtgagcgacgaggacgaggccaagaggtacgagcaggagatgatggagttcgggacggcgtcgccggagtacgtgatcgtcgcggccgtcgcgctgctcaacctcgtgtgcctggcagggatggcggcggcactggatgtgttcttcgtccaagtcgctctctgcggggtgctggtgctcctcaacgtcccggtctatgaagccatgttcgtcaggaaggacaaggggaggatgccgttcccgatcacgctagcctncgttggctttgtgacgctggccctcattgtgccattcttttga

SEQ ID NO: 37130 - DNA, 369 bp, Zea mays
  Clone ID: LIB3060-034-Q1-K1-E2
ggaccgtgggaaaactgaccctgtggtgctggctcgtcaggtgggaatcagaatcttttggagtaaacctatttcttctgggggatcagaacctacttggaacaacccaggtttggtgacgatgacaatgtaataataagtgggtttggacgcggaaatcaggcagaggagaggaagagtttggtggtggggtggggatcatcatgaatggaggcacaaaacgggaatcagtggggaaggtctgaaaaccatgaaccaaaaggggtttgatggcgcagaagaagaagcccctttgggcgaagtgaccgcaatcaaagcaacaacttggggtcaagagatggtggcagctggggctcttgcaggggaaat

SEQ ID NO: 37131 - DNA, 424 bp, Zea mays
  Clone ID: LIB3060-034-Q1-K1-E3
ggatttttggatattttttttgatttggcattattcaacaagaaaaaaaatttcgacgaattcctttttttttgaaaattatgtgataattatgagaaccaatcctactacttcgcgtcccgggatttccacaattgaagaaaaaagcgtagggcgtattgatcaaattattggacccgtgctggatatcacttttcccccgggcaagttgccttatatttataatgctttgatagtcaagagtcgagacactgccgataagcaaattaatgtgacttgtgaggtacaacaattattaggaaataatcgagttagagctgtggctatgagtgctacagaggggttgatgagaggaatggaagtgattgacacgggaactcctctcagtgttccagtcggtggagctactctcggacgaatttta

SEQ ID NO: 37132 - DNA, 431 bp, Zea mays
  unsure at all n locations
  Clone ID: LIB3060-034-Q1-K1-E4
gaataggagaggcaggcgatgacgatggcgacgaaggcggcgtgcgtgctggcggtgtgggtgctcgtcgccttgggcctgtgcgacctgggctcaacgcgcgcgcccctgggcagcaagccgcagcgggagttcgactacttcgcgctctccctccagtggcccggcaccatctgcgcctncacccgccactgctgcgccaccaacggctgctgccgctcggagcctctccagacgttcacgatccacgggctatggccggactacgacgacgggacctggccggcgtgctgccggcggacccaattcgagatggacaagatattgccactggaagaagtgcttgacaagtactggccgtccctctactgctccaaatctggaacatgcttcagcggcaagggactcttctgggctcacgagtgggagaa

SEQ ID NO: 37133 - DNA, 405 bp, Zea mays
  Clone ID: LIB3060-034-Q1-K1-E5
acgtgctcgatctccatctcgaccgttgctcaccgggaagctacgctacgacgaagcatggcgtccgtcaccgcccgcgccccggtcgcagccctgcgcccgtcgtcgtcgtcggccttccttggccactctagccgcctcggccgcactgctaccgcgtcgccgacgaggcggagcctcaaggcggaggccaagggcgagtggctcccgggccttccctcccccgcctacctcgacggcagcctgccgggtgacaatggcttcgacccgttgggcctggcggaggacccggagaacctgaggtggtacgtgcaagcggagctggtgaacgggcggtgggcgatgctgggcgtggccgggatgctgatcccggaggtgctgaccaagggccggctgatcaacgcg

SEQ ID NO: 37134 - DNA, 243 bp, Zea mays
  Clone ID: LIB3060-034-Q1-K1-F2
ccgggatttggttgtattgtttgctcctgtcctagtgaatgcctatggttcaagttaccattttgtggtaattgtgttgtaaaaactatatgtatcgaattatattagtactgtagctttacacagttagttctttacggaagatttatgaggtgtttggtttgatgaatcactctatccaaaatgaagtggtgcatcatgggtccattcctcaaatttggggggatgacttcattccacata

SEQ ID NO: 37135 - DNA, 421 bp, Zea mays
  Clone ID: LIB3060-034-Q1-K1-F5
agcgagacccggaagtggaagactagggttagggtcccagctccgccgttgtctgggcgagtcgagacatggccggccctgcccccgccgttgcagccagtgccgccgcctcacagtcgccgccgatgcagctgccgtcgccgttcgcggagctagtcaagggttcctccggcctcgagaagatcgtgcttcgcggcgctcgcaactgctgtgccgagatctatctttatggaggtcaagtaacatcatggaagaatgacaatggggaagagttgctttttctcagcagcaaggctattttcaaacctccaaaagctattcgtggtggtataccaatttgctttccccaatttggaacacatggaaatcttgagcaacatggatttgctaggaaaccgttttggactatcgacaacaaccc

SEQ ID NO: 37136 - DNA, 401 bp, Zea mays
  unsure at all n locations
  Clone ID: LIB3060-034-Q1-K1-C8
ctgcccttttatctagtcgctgcagggccagggcagtgaagtctcttctcgttcttgagttctagcgagagtgcatcgtgtgagtgttgtggttcatgttcacgtcggtgtttactctccccggccatcagtgtctcattgggaacgccgcggtgccgccggtgaacgccgctgggaatgatctcgacatggcagaccttgtttggggccggttgcgtgcgtgatctanggttggtctgctctatggtgagtcgctagtgcctgctccaccgtggttgggaactctactgcgtcgtcggtccggcttaacaccgtcagagttgggcgccgccggcacgcgcagaggaagcgcgggcgcgcgtggtgctggagcctaaggctgtaagcgctatctgagtggg

SEQ ID NO: 37137 - DNA, 411 bp, Zea mays
  unsure at all n locations
  Clone ID: LIB3060-002-Q1-K2-A7
cgaccaccaccgccggccgggaagcaagctcaaaccctaatcgccgtccgccggcgacgccagcacgatggcccgctacgaccgcgccatcaccgttttctcccccgacggccacctcttccaggtggagtacgctctcgaggccgtccgcaagggcaacgccgccgtgggcgtccgcggcacggacaccgtcgtcctcggcgtcgagaagaagtccacacccaagctccaggactccaggtccgtgcgcaagatcgcgtgcctagacactcacatagctctggcgtgcgcggtgctgaaggcggacgcgcgcgtgctcatcaaccgngcgcgggtcgagtgccagagccaccgactcaccgtcgaggaccccgtcaccgtcgagtacatcacccgctacatcgctgggct

SEQ ID NO: 37138 - DNA, 442 bp, Zea mays
  Clone ID: LIB3060-002-Q1-K2-B10
gcagcccctagctaggcggtggatcggagcctgtatcagaaatcgaaataatataagagtgtcttcaacggatcacactgccgctcccccacgctaaatttgggggctacagtgcacacgctagcctatcaacggctcacgctaccaggcgctctacgcggatgtgccccctagccagcttctctctccccctcgttctgtggtgcctctctcaccctctctaatattgttcacgtgggcccacttccaattattagtagatgaaaaattgataggaggtgaaaagtaggtatagaaaatgatattttatggttgtagtggggtataaggggaaggatttagggggaaacgctgtacagagtggagatataggggggaagagaacgctgacgtggcacgtgagtgggatatagggagagaaatttaggggtaaccgctgaag

SEQ ID NO: 37139 - DNA, 331 bp, Zea mays
  unsure at all n locations
  Clone ID: LIB3060-002-Q1-K2-B11
ggctccctcctcctccctgcaaatcctgcagacaccaccgctcgtttttctctccgggacaggagaaaaggggagagagaggtgaggcgcggtgtccgcccgatctgctctgccccgacgcagctgttacgacctcctcagtctcagtcaggagcaagatgggtgccggcggcaggatgaccgagaaggagcgggagaagcaggagcagctcgcccgagctaccggtggcgccgcgatgcagcggtcgccggtggagaagcctncgttcactctgggtcagatcaagaaggccatcccgccacactgcttcgagcgctcggtgctcaagtc

SEQ ID NO: 37140 - DNA, 444 bp, Zea mays
  Clone ID: LIB3060-002-Q1-K2-B12
ctccggtcggtcatccactcatcctcatcccctggcccctgcccatccgatccgatcggtcatcccctacccctacctgatcggatcccctgctcttccgccgagcaccaccaggcagcaggctgcagccgtcgagcaccagcaggagcacggccaggaggacgacgcccgcatcctgcctcttctctgctgctggagcttctgctgccaggagcacggccagaaggacgacgcccctgctgctgccggttgctcttctatggagacttccaaagaacaggcttccaaggactatgctggtttcgagaagaaagttaagaggacaatatatattgaccacctttctcctcaagtaaaggaatcggccatcaaagctgctcttgcacaatgtgcaaatgttgtccatgtggagttcatcgtcaattacacgatcccctataaaga

SEQ ID NO: 37141 - DNA, 400 bp, Zea mays
  unsure at all n locations
  Clone ID: LIB3060-002-Q1-K2-B2
cgtgcacctcgtcctcggtcgtcgccatggggaggtcctcttccacggagaagctggtgtgcttcgtcctggcggttctggccgtgctgtccccgctgtacatcgaccggcggcccgtggcggagcgagaggaggaggacgaggacgacggcggcggcccgtcggcgctgtggctgccggcggtgctcctcgcgctcatcctcgccatcaacgttacgtgcttcatggaccggcgcgtggtcaggttcgacccttactggatccaccgcgtgtgggggtcctccggcggcctcctcgccatgctgctgctcctcggcttcgtgctcaggtgcaaggcgtncctgctgtataccagctactaggtggtagctcgggcggtcgtcgtcatgggtcttttttt

SEQ ID NO: 37142 - DNA, 395 bp, Zea mays
  Clone ID: LIB3060-002-Q1-K2-B3
cgctgtcggaggagggcgtggttgggggaagtgccgcagcgcgaggagataaagcgtggtccaatcttccaatccccttcggctgccacttgttctagtatctagttagttgtgaactttaaaataggttaaataaatacatgggagtccaagaagattctaggccttctggcgccctgggtggcctatacagggtacagcttgtgggccggtcaatatacagtgatgacgaagcattcaagactcgcattatggattcttcaacttgtgaaccacatgaggataatggctccagccggcgtttgctaatctggagatcatggcagcatagacccccatgcttgaagcccatacactgtagcctctcatgcgactaacatgttggtgaaactatt

SEQ ID NO: 37143 - DNA, 442 bp, Zea mays
  Clone ID: LIB3060-002-Q1-K2-B5
gcggcataacaatgtggttccaaccatggccttgggagtgcagcagctgaagaaggagctgggccgctcaaggaaggttccattcgagttcgatgagatcgacgagttccttgaccggttctacatgtcaaggattggcatccgcatgctgatagggcagcatgtggctttgcatgaccctaaaccggagcctggtgtcataggcctcatcaatacaagattatccccaatccaggtggctcaagctgcctgtgaagatgctcgttctgtctgtttaagggaatatggatcagctcctgatattaacatttatggcgatccaaattttacatttccatacgtcacattacacctacacctgatgttatttgaattggtgaagaactctttccgcgcggtgcaagaacggtatatgaactctgataaagatgttcccccagtt

SEQ ID NO: 37144 - DNA, 425 bp, Zea mays
  Clone ID: LIB3060-002-Q1-K2-B6
attttcttttttatttaatagtctctgactatcattaaataaagggtagagcaattcgtttttctagagattctagagaaagtgagacaaagtgaagcgaaagagttttctttgtataagaattaggtctatatcatatctaaatagaagggaaatcaaaaagaagggaagtggggattacattggatgaatccttaaggaagacatatcacaaaagaaataaaggctaaagtaagcgctccttgcctttggtttgagcaaaacagattcttgtttcaccgaggaaaagagagaagttctggataaattgacaatgtcaacttgaattgactaattcagttccgcctattccacattaatgggagtccattaatgtttctgctttacgaatatgatattttttggacatttctaataatagcagg

SEQ ID NO: 37145 - DNA, 407 bp, Zea mays
  Clone ID: LIB3060-002-Q1-K2-B7
gcaagctaaggagagtgtgatcaccaacagctagtgctagtcccccttccttccatccatccatggcatgcgtcagcaccttccagagctgccccattgccagaagagcaaagatcaacaccaggtccaggggcagcagcagtagcgtggcgaaggggtcaccaccaccagccttccagttccagtgcagggcgtcgactttcgcggcggacaccagcctccggctcgagctggacgagaaccccgaggcgatcatctcgggggcgtggcccgggaactgctccctcctcagctacgacgacctccgcgcctacctcgagtcgcaggagacggcggcccaggcagacgatcagcgcggcgtggcgctcctgaccgagaccatgtccacacccgtgctggtggccaca

SEQ ID NO: 37146 - DNA, 402 bp, Zea mays
  Clone ID: LIB3060-002-Q1-K2-C1
cgctgtcggaggagggcgtggttgggggaagtgccgcagcgggaggagataaagcgtggtccaatcttccaatccccttcggctgccacttgttctagtatctagttagttgtgaactttaaaataggttaaataaatacatgggagtccaagaagattctaggccttctggggccctgggtggcctatacagggtacagtttgtgggccggtcaatatacagtgatgacgaagcagtcaagactagcattatggattcttcaacttgtgaaccacaagaggataatggctccggccggcgtttgctaatctggagattatggcagcaaagacccccatgcttgaagcccatacactgtagcctctcatgcgaataacatgttggtgaaactattgcaaatg

SEQ ID NO: 37147 - DNA, 378 bp, Zea mays
  Clone ID: LIB3060-002-Q1-K2-C10
gcgaagcaagcagcctaaaaaaaccgtatcgtctcgcctgttcagtttccttctcttcccgcagcccggtttgccgaccaggttccaccgttccagagtagccaagcgaatcccgtgtctggttcgcgcgatggcggaggagcagtccaacccccagcaccagcaagcggaggagagggaggttatggtggagcagcagcagccgaggagggccccgaagctgaggtacctggacttcgtccaggtggcggctgcccaggccgcggtgtgcctcgctgggctctacggcctcgccaaggaccacgccggcccgcttccgccccagcgttgacgccgtcgagtctgccgtgaagggcgtcgttagccccgtctacgacc

SEQ ID NO: 37148 - DNA, 395 bp, Zea mays
  Clone ID: LIB3060-002-Q1-K2-C12
cccacgcgtccgttttctttatccaagcaaagacttacttccagatgataaggagatgagtatatttgatcatctagaggagcttcgtgacaggattttcatctcagttttggctgttggggctgcgatattaggctgttttgctttttcaaaagatttggttatttttcttgaggcaccagtgactgctcagggtgttcggtttttgcagctctcgcctggggaatttttctttacaacattaaaggtttcaggttattgtggccttttacttggaagtcctatcattttgtatgagatcattgcatttgttatcccaggtttaacaagggacgagcggaaatttcttgggcccaatggggtggggtcctctggtctattctatctaggcattt

SEQ ID NO: 37149 - DNA, 276 bp, Zea mays
  Clone ID: LIB3060-002-Q1-K2-C2
aaaaaaaaaaaaaaaaaaaaaaaaaaaaaaaaaaaaaaaaaaaaaaaaaaaaaaaaaaggggaaaaaaaaaaaaaaaaaaaaaaaaaaaaaaaaaaaaaaaaaaaaaaaaaaaaaaaaaaaaaaaaaaaaaaaaaaaaaacaaaaaaaaaaaaaaaaaaaaaagtgtaagccatttaaagctcaaaattaaactacagggtgctaacaaagcaaaacttttaaaaatacacaactaaaaaagaatccattaaatgcattataaaatatctaacctg

SEQ ID NO: 37150 - DNA, 263 bp, Zea mays
  Clone ID: LIB3060-002-Q1-K2-C4
ggccggcgtctaatatagtgagcgcaatcgatgcctacgaactaggtctcaaagctggggtcgctcaacttgtactacagaggcgaagcttgagggcttacgcatgaacatgtcaaaggtcgcttcagagtatcaaagctgacagggataagttgcactattagcgttgtacccgtacagcatacgatcactaatatcgaacttggcattgtccgtaatatactacgctgaagctcgataggagagtctaccaggagtaccat

SEQ ID NO: 37151 - DNA, 327 bp, Zea mays
  unsure at all n locations
  Clone ID: LIB3060-002-Q1-K2-A6
gcagtcaccaaaccaaaccgctctcgagtctccatccattctctccgctcatccgcaggtctctagtctccagctctagctagccttagcctcgtccaagggacgaaggggccaccatgagcgtggtgatcctggacggctccacggtgcgcggcttcgtggcggacgaggcggccttcgcgcgcagcctggacgcgcgcttcgccgcgctggacgccaacggcgacggcgtgctgtcccgcgccgagctccggcgcgcgctcgagtccttccgcctcctcgacggcggcggcttcgggtccgnccagccggcgccggttcccggcc

SEQ ID NO: 37152 - DNA, 199 bp, Zea mays
  Clone ID: LIB3060-001-Q1-K2-H11
accggagagagaacccgcttcgaatgcacaaacttctgtaaccccacttacatgagcgattgatctaccgtcatcattgactgcgctggatccacacccaaagactaccagaacagcacgaaactgaaaaggactaaagcttttaagtatactcaaccaattacaccagcactaatgaaacaaatgcctgatgatttct

SEQ ID NO: 37153 - DNA, 425 bp, Zea mays
  Clone ID: LIB3060-001-Q1-K2-H12
agcatctcgccgtgaagcacttctctgttgagggtcagcttgagttcaaggctgtcctgtttgtgccgaagagggccccctttgacctctttgacaccaggaagaagccgaacaacatcaagctctatgtgcgccgtgtcttcatcatggacaactgtgaggagctgatcccagagtggctgagctttgtcaagggcattgttgactctgaggaccttcccctcaacatctcccgtgagaccctccagcagaacaagatcctcaaggtcatccggaagaacctggtgaagaagtgcattgagctgttctttgagattgctgagaacaaggaggactacaacaagttctacgagtccttctcgaagaacctgaagcttggcatccatgaggactccacgaacaggaacaagattgcggagctgctg

SEQ ID NO: 37154 - DNA, 357 bp, Zea mays
  Clone ID: LIB3060-001-Q1-K2-H2
cccacgcgtccgcaggaagctgacatggatttattccttgggaacctgcaacatcaatgctaagtttgagtctaaacctattgaacttattgttacaacatatcaggctgcattgctactactgtttaatggatctgacaggcttagttattctgagattgtaacacaattaaacctgtcagatgatgatgtagtgcgtttgctccattctctttcttgtgcgaagtacaagatccttaacaaggaaccggctagtagatccatctctcccaatgatgtttttgagttcaattcaaagtttactgacagaatgagaagaatcaaggttccactccctcctgttgatgagaagaaaaa

SEQ ID NO: 37155 - DNA, 338 bp, Zea mays
  Clone ID: LIB3060-001-Q1-K2-H4
ctgagataaatcaagttgctactcaagaaaatgaaatcagtcagaatgttagacctgcgatctgaaacatgttcagcactaccagaacctattccagctgatgggagtgtgatctcagaccatgtgacagctgatagtaatgtcacggagaagcaaataagtgatctttctgctaatgggactgccattgaaagtaatgataatacccagccacctgtgcaagtgcccaaagaggatccaaagaaggccctacttgttgctcctccccctccaactcagatggatgttactaagaaatcttatgcatccattgtcaaggtcatgaaggagggcccacc

SEQ ID NO: 37156 - DNA, 445 bp, Zea mays
  Clone ID: LIB3060-001-Q1-K2-H5
gctcgatctccctccgccactcccatccatctcctcgctcccagtcccccggaagctacgaagcatggcgtccgtcaccgcccgcgccccggtcgcggcccttcgcccgtcgtcggccttccttggccactctagccgcctcggccgcaccgcgtcgcccacgaggcgcagcctcaaggcggaggccaagggcgagtggctccccggccttccctccccctcctacctcgacggcagcctggcgggtgacaatggcttcgacccgttgggcctggcggaggaccccgagaacctgcggtggttcgtgcaggcggagctggtgaacggccggtgggccatgcttggcgtggccgggatgctcatcccggaggtgctgaccaaagccgggctgatcaacgcgccgcagtggtacgacgcccgcaagtccgagtacttcgcgtcgtcg

SEQ ID NO: 37157 - DNA, 87 bp, Zea mays
  Clone ID: LIB3060-001-Q1-K2-H6
gtcctactattttgtgaagcgtttggatcgtgatccattaccacctcacctttggacgtggacaggatatgaagcgaagtttgtttg

SEQ ID NO: 37158 - DNA, 171 bp, Zea mays
  Clone ID: LIB3060-001-Q1-K2-H7
caccgtcttattctataccacattcagactgtcatttaaaaaaaaccggaactgtaaatactacatctaaacaccaactactaccatcatccactataactttctatacgaaataaatttaatcacttcctcctttacaacgcaaactataaaaccctactaacccaactt

SEQ ID NO: 37159 - DNA, 315 bp, Zea mays
  Clone ID: LIB3060-001-Q1-K2-H8
ctgagataaatcaagttgctactcaagaaaatgaaatcagtcagaatgttagacctgggtctgaagcatgttcagcactaccagaacctattccagctgatgggagtgtgatctcagaccatgtgacagctgatagtaatgtcacggagaagcaaataagtgatctttctgctaatgggactgccattgaaagtaatgataatacccagccacctgtgcaagtgcccaaagaggatccaaagaaggccctacttgttgctcctacccctccaactcagatggatgttactaagagaacttatgcatccattgtca

SEQ ID NO: 37160 - DNA, 403 bp, Zea mays
  Clone ID: LIB3060-001-Q1-K2-H9
ccgtgacaagatccaccacggcggatggatggccaagatcttctgctgggtcatcatcggcttcctcatgttcttcgtgcccaacggggtcgtcagcttctatgaatctatatccacgtttggctctgggctgttccttctcgttcaggttgttctgctgttggattttgtgcacggatggaatgagaactgggtcgccaaggatgagcagttctggtacatggctctgttggttgtctcggttgtctgttacattgccacgttctgtttctcgggtctcctatttcactggttcactccatctggacatgactgcggactcaacctgtttttcattgtcttcacgttgattcttgtttttgcgtttgctattgttgccctgcacccaaagatcaatggaagc

SEQ ID NO: 37161 - DNA, 373 bp, Zea mays
  unsure at all n locations
  Clone ID: LIB3060-002-Q1-K2-A1
cacgccgctcggaatcggagcttgcatccgaccgcgagcaagcggaccaaatcctnctgcatagtctatcgcgtgcacgcatctgggccgctcgaccctcggcggcggcggcggcgacggcgacgacgacgatggggctggagatggaggcgatggcggggtcgatcggcgtgtcggtgcccgtgctccggttcctgctctggttcgcggccaccatcccgacgggcctcctgtggcgcgcggtgcccggcgccatggggcgccacctctacgcggggctcactggtgccacgctctcctacctctccttcggggccacctncaacctnctcttcgtcgtgcccatgacgctcggttaccttggcatgctcct

SEQ ID NO: 37162 - DNA, 443 bp, Zea mays
  Clone ID: LIB3060-002-Q1-K2-A11
atttcggctggaaaggacgcggagagcgcttactgggaactcgttataaaggatatccaggatgcgtgcaaactttttgagcccatctacgatgagactgatggggctgatgggtatgtctccgtagaggtgtctcctaggttggcaaatgacactcaaggaactgttgaagcggcaaagtggttacacaaagtggtcaaccgccccaatgtctacataaagatcccagctactgcagaatgtgttccttccatccaggaagttatcgctaatggcattagcgtcaacgtcacgcttattttctcaattgcaagatatgaggctgtgattgatgcttacctcgatgggctagaggcttctggcttgagtgacttatcccgagttactagcgttgcatccttctttgtcagccgagtggacacccttattgacaaaatgcttga

SEQ ID NO: 37163 - DNA, 371 bp, Zea mays
  Clone ID: LIB3060-002-Q1-K2-A12
agggactgtgccattatttgaccttgctcttctcgtgcaggtttccgcaaggaagaccgaaatatacatggtgcttgagtacgtcaatggaggagagctgtttgacaagatcgcgttgaagggtaagctgacggagaaggaagggaggaaactgttccagcagctcatagatgccgtgggatactgccacgagaagggggtttatcacagggacctcaagccagagaatgtccttgttgatgcaaaaggaaacataaaagtttctgatttcggattaagtgcccttccacagaaccaacaaaaagatggtttgttgcataccacatgtggcagccctaactacatagcccctgaggtccttctgaacaaag

SEQ ID NO: 37164 - DNA, 382 bp, Zea mays
  unsure at all n locations
  Clone ID: LIB3060-002-Q1-K2-A3
cagaggtgggctggcttctcctccccctcttaccaagtcctccttgggttagggttccgttagggttttgtggagggcgatggcggcggctgatgtggagtaccgttgcttcctcggcgggcttgcctgggccaccagcaacgagtcgctggagaatgccttcgccttctacggcgagatcctcgactccaaggtcatcaccgaccgggagacgggaggtctcgcggcttcggcttcgttaccttctcctccgagaactccatgctcgacgctatcgagaacatgaacggcaaggagctcgacggccgtaacatcaccgttaaccaggcccaatcccgtggcggtggcggtggccgcggtggctacggcggcngtcgcggcg

SEQ ID NO: 37165 - DNA, 301 bp, Zea mays
  Clone ID: LIB3060-002-Q1-K2-A4
gttgaactaatgggtggtcagataaactttgtcagccgaccacatgttgggagtacgtgcacatttactgcggttctcaaaagatgtgacagaagcgctattggtgacagtaagcctgttatgttgcatcctcttccatccagtttcaaaggtttatctgcactattggttgatagaagaccagtaagagctactgtaactaagtatcacttgcaaaggctgggaattgcctgtgatgttgttgctaccattgaactggctcttggtgtgctgtccgggagaaatggcagttccctaacca

SEQ ID NO: 37166 - DNA, 405 bp, Zea mays
  Clone ID: LIB3060-002-Q1-K2-A5
cggacgcgtgggttcaaaggtggcattgccggtctgggatgatgatagacatggaaggcctaatcggggtgactggaaatctgcttcttcaagggagcaaaggctggactgtggtgacagaagggattctacaagagtgaaaccaacagatcatgatgggagcaatgggggatcgggaaggtctttcaggcatggtcgttcaatgtctccagaagagcacaggcatcggggcaggcatgaatctcatccatcatcgagagtgtccagaagtgcagcacatatcgaggatattaacttcgagaggaggtgaagcatccccggaatggagatcctgatgctttggcaacaatgaacggcactgcagaagctcttgaagcaaaggaaaagcaaaggccatcgtttgaa

SEQ ID NO: 37167 - DNA, 393 bp, Zea mays
  Clone ID: LIB3060-001-Q1-K2-F3
cggacgcgtgggccaaggcgcacgtgctgacccacgacacggggtaccacggtctggggagccactggctgcgcacgcactgctgcgtggagccctacatcatcgccgccaaccggcagctgagccggctgcacccggtgtaccgcctgctgcacccgcacttccgctacaccatggagatcaacgcgctggccagggaggcgctcatcaacgccgacggcatcatcgaggagtccttctggccgggcaagtacgccgtcgagcttagctccgtggcgtacggcgcgacgtggcagttcgacacggaggcgctgcccaacgacctcgtcaaacgcgggctggccgtgcgcggtgaggaccgggagctggaacttaccaataaagactacccct

SEQ ID NO: 37168 - DNA, 379 bp, Zea mays
  Clone ID: LIB3060-001-Q1-K2-F6
aattgatgagattctgtattggcacaatgctgttctgagagaactgagtgatatagcggaggagactaaaaggatacatcagtctggagatttttctgacatagcaggatttaatatgaggctgcaatttattgcagatgtgtgcattttccacagtattgccgaggatcaagttatattccctgcagtggatggtgaattgtcctttgtgcaggagcatgctgaagaagaacggcgattgaataaatttaggagtttaattgaacaaattcaactagcaggagccaagtcaactgtagttgattttcattcagagttatgctcacaagctgatcaaataatgcagaaaattgagagtcacttcaatgatgaggaatta

SEQ ID NO: 37169 - DNA, 324 bp, Zea mays
  Clone ID: LIB3060-001-Q1-K2-F7
cggacgcgtgggccaaggcgcacgtgctgacccacgacacggggtaccacgggctggggagccactggctgcgcacgcactgctgcgtggagccctacatcatcgccgccaaccggcagctgagccggctgcacccggtgtaccgcctgctgcacccgcacttccgctacaccatggagatcaacgcgctggccagggaggcgctcatcaacgccgacggcatcatcgaggagtccttctggccgggcaagtacgccgtcgagcttagctccgtggcgtacggcgcgacgtggcagttcgacacggaggcgctgcccaacgacc

SEQ ID NO: 37170 - DNA, 406 bp, Zea mays
  unsure at all n locations
  Clone ID: LIB3060-001-Q1-K2-F9
ggacaacgaaaacatcaaacaagagaaccaaaggaaacagagcaagagcatcgctctcgaagcaaggcgcgcaccacgccgtcgccggccggccacttcgcacgtacgtaggacgcgcacgcaccggtgcatatatggggctcctgaaccagctgtgggacgacacggtggccgggccgcgcccggactccggcctcggcaagctccgcaagtacgcctccttctccccctcgtcgtcgtcgtcggcggcggtggcggcggcggcggcggcgggctccgcgccgnctccgggcgccgtgacgcggagcttgaccatgctgcggcggccggcggcgctgtccgtcgtcacgtcgccccgcagcgagtccagctccgcgccgtcgtccccgtcgcccgcaagcggcgc

SEQ ID NO: 37171 - DNA, 335 bp, Zea mays
  Clone ID: LIB3060-001-Q1-K2-G12
atgcaccgcggcggcgatcgctccggcggcccctcgagcggcggagaccgctctggagcccggttccagcggggtccctcccgctggtctggcagcagcggcggcggattagggggtagcccgcccaatcgctactcctcccgcggcgcggcagatggaggtggtggaaggggcggtggcagtggcggtggcgggaggttccacccttaccgtggttcttccgactattctagcggcggtggagggtacagaggcggtagtggcgttggtaacgacttcggcgaccagaagcaacgttacggcggcggcaacagaggcggaggccgtggggattt

SEQ ID NO: 37172 - DNA, 335 bp, Zea mays
  Clone ID: LIB3060-001-Q1-K2-G3
cttcagagttcggcgaggcgaggcgaggcgaggcgtggagggatgggaaatttttggggaggggaagaagccttaaccggaagaaagtgaagagagaatagcttccgatcttgattaccccggtctccgtatcgggaatccaattcggttccatccaacgcctgagatcggattccaacccccatttcggaccgatcgctttccgcagaccgatcggctttgggggattttttttcccgagcgatttttctggaggctcagatcgggtcggtctgagtttagttgatcgcggagcgatgctaatcgaggagcttccgggcgatccgggtggagga

SEQ ID NO: 37173 - DNA, 334 bp, Zea mays
  Clone ID: LIB3060-001-Q1-K2-G4
cccaaatatcccagccactgccgtcgtgcagtcaaagtgtcaaaccatgccggcagtggcgttcgcgtcagctcctgccatattcgcctccgtcttcgcgcgttcctgccggagcgcgggtccgggcattctttcctgcgacttcgggcgggcccgccgaggctcgcgttgcgccgtgcagtgtgaggtcgacttcttcttcgcaccgtccgcggctggaccccaggcccgacggtgggcccagaggaccgtggtcattccggcacagcgccgcgggtgccacctcatcaccaacaagatcgtaaatgagatagggaatgacctggccgacttc

SEQ ID NO: 37174 - DNA, 452 bp, Zea mays
  unsure at all n locations
  Clone ID: LIB3060-001-Q1-K2-G8
cttgctggaaggggtgacatgaatgtaactcttggtataccccggctgagggaaatagtgatgactgcatcagataatattaggacgcctgttatgaagtgtcctttgctcgaacatatttctgaggatgatgctaaaatggtggttgcaaagcttaggagggttcgtgtggctgatgtagtggagaaaattgaagtctgcacagttcctttttacaactctaatgggcgtgtttcaaccctgtacaagttacagatgaaactctatccacaagaccagcttgagtcaggtcttactatagatgagtgtcaggcaaccttgagaacagtttttgttgaggcaatggaacatgcaattgaaaagcatctagatctgctatacaaaataaatgaaatccgtgctngtaagatggaagattcagagggctcattattaaatggtgatgaagaatc

SEQ ID NO: 37175 - DNA, 446 bp, Zea mays
  Clone ID: LIB3060-001-Q1-K2-G9
cacacatcggggaatggcgacctacgaccatgccgccaccccgacaccgcagtctccgggcgtcggcggcgtacccttctcgtcctgcatcggcgacctcctccgcttcgtcctctcctcccacgccgccgcctaccccggtgacgacacggtcgctttccccctctcgccctcctactgcgcccgcctcctcaacgacggcgaactgttcgagaagctggaggcctgtattcagcagtgcctcgaggaggggcggctcccggggccgcccgcggtggttgggattccggctgaggaggaggggccggaggagagagggtggaagctgctgctgccggagaaaggcgctgagttgaagcggatgtacgatgctgttgagtttgagctgcatgttcaggaaccctacttcactcaactcagagccggagtcaagaaggttgaaggga

SEQ ID NO: 37176 - DNA, 353 bp, Zea mays
  Clone ID: LIB3060-001-Q1-K2-H1
caggaagctgacatggatttattccttgggaacctgcaacatcaatgctaagtttgatgctaaacctattgaacttattgttacaacatatcaggctgcattgctactactgtttaatggatctgacaggcttagttattctgagattgtaacacaattaaacctgtcagatgatgatgtagtgcgtttgctccattctctttcttgtgcgaagtacaagatccttaacaaggaaccggctagtagatccatctctcccaatgatgtttttgagttcaattcaaagtttactgacagaatgagaagaatcaaggttccactccctcctgttgatgagaagaaaaaggttgttg

SEQ ID NO: 37177 - DNA, 432 bp, Zea mays
  unsure at all n locations
  Clone ID: LIB3060-001-Q1-K2-F12
gtgcatttcaaaataatatcttcctgggcttttcctaaccctttggcatccaaggaaacaataaacaaccggcgctgttacagccncgccaagaacaggagcaataacaacaaggctcctcgcaacaatccattctcatccatggcgaagctcatgaacaagctggtcgattcgttcgagcacgacgagataccggacgtcggctgcgtgcgcgccgtgctggccgagctcgtcctcaccttcctcttcgtcttcaccggcgtctccgccgccatggccgccggatccgacgggaagcccggcgacgctatgccgatggcgacgctggcggcggtggcaatcgcgcacgcgctggccgctggcgtcctggtgacggccgggttccacgtctncggcggccacctgaaccccgcggtgacggtggggctcatg

SEQ ID NO: 37178 - DNA, 424 bp, Zea mays
  unsure at all n locations
  Clone ID: LIB3060-032-Q1-K1-H8
atccgatcggcagctcctggccgctgcccactcctccccgctctggctcttcctcgcgcctcgcgcgcccacccaccttcacgcgctctcccagctagatcgaccccactggcaatcgcgcaggctcccctatcccttcctgttccttcaaaaagactggactggatcttcccagagttcccgttcggagagccgccggatcttcttcgacgaggcttcgatctgctgctctccgtcggcgtgttggggacttgcaccttatccgaagatgtcttttcggagcatggttcgtgatataagggaaaagtttgggaatatatcgaggcggaactttgaggtgagaattcaccacagagggaagtctctngggtcttcaggtgacttgcaagacaggcctgctgaagttcagcanagcaagtgggct

SEQ ID NO: 37179 - DNA, 366 bp, Zea mays
  unsure at all n locations
  Clone ID: LIB3060-034-Q1-K1-A1
cagctagcccacatagcccttccagcaacgcgcgatcgaagggttgagagctattggaagcaagtacgtgcatggcgaggtttgcgctcgtggcgtgcgccgctgccacggcggcgctgctgctcggcgtggcggcagcggacgtggcgtcgatcatcacgcaggacgtgtacaaccagatgctgcccaaccgcgacaacacgcagtgccccgccaacggcttctacacctacgacgccttcatccaggccgtcaacttcttcccggggttcggcaccggctccagcaccgacgaactcaacaagcgcgagctcgccgncttcttcggccagacctcccacgagactaccggtggcacgacaggtg

SEQ ID NO: 37180 - DNA, 330 bp, Zea mays
  unsure at all n locations
  Clone ID: LIB3060-034-Q1-K1-A2
aatggatttaacgatcggtcaggaccaagtttctaaatagtagtttcttttgcccaagccctggcgccatctaatttttgccattggttgctgtcattgattgttgtcttgcgaatccttggttgttgtcttgctgtcttgagaatcctgtagacagtggggctagaattaaacaacttgaacatctgattgtacaagtaacctcttgtaattttcttttaacacaaaaggaatgatactctagagaaagatattgntgtccattcatgtctgntatgtttccctttcttaacttataaaattaccgtattcttaattttctgcaaaagc

SEQ ID NO: 37181 - DNA, 421 bp, Zea mays
  Clone ID: LIB3060-034-Q1-K1-A4
ctcttcatcatgagaggaacactagagagtaccacaacaaatggtgggcaaactggttgcttcaactctaatgttctaaaaggtggagacttctgtggtgaagagctcctcacgtgggcccttgaccccacttcagcttcaaatcttcctggctcaactaggacagtgaagacgttgtctgaagtcgaagcttttgctctgagggctgacgacttgaagtttgttgccacacaatttaggaggctccacagcaaacaacttcagcataccttccggttttactcacagcaatggaagacctgggctgcttgcttcatacaagcagcttggcacagatactgtaagaagaagctggaagaggctttatatgagaaggagaagaggttacaagcagcaatttgtagtgatggcactacttcgc

SEQ ID NO: 37182 - DNA, 413 bp, Zea mays
  Clone ID: LIB3060-034-Q1-K1-A7
actggagcttggaccatatattgaggtgctcaagaaaactcatggcgccatgtctgaatttgtaaatcccaagtatactgattcgaccaagacagcatttaaatcatccactcgtctagaatgcatgatgcaagactatccaaagacgttgcctccctcagcaaaagttggattcacggtgatggatacatggcttgcttacgctcctgtgaagaataatcccgaagacgcagctaaagttccaaagggcaacccttatcatagtgcaacatccggagagatggcaatttacagggcgaacagccttattttgagaaaggctggtgctcagatagctgatcctgttgttcacaccttcaacggacaagaggtagaggtttggccacgcgtaacctggagcccacgggggggtc

SEQ ID NO: 37183 - DNA, 319 bp, Zea mays
  Clone ID: LIB3060-034-Q1-K1-A8
ctcgtcatcgggagaggaacactagagtttacctttacaaatggtgggcaaactggtggcttcggctctaatgttctaaaaggtggagacttctgtggtgaagagctcctcacgtgggcccttgaccccacttcagcttcaaatcttcctggctcaactaggacagtgaagacgttgtctgaagtcgaagcttttgctctgagggctgacgacttgaagtatgttgccacacaatttaagaggcttcacagcaaacaacttcagcatacctttcggttttactcacagcaatggaagacctgtgctgcttgctttatac

SEQ ID NO: 37184 - DNA, 380 bp, Zea mays
  Clone ID: LIB3060-034-Q1-K1-B1
ccgcgacgccaccaccacacgttcacggtagcgagagcttatcgtcgtcggcggcgaagatggtgtcgctgaagctgcagaagcggctcgccgcgagcgtcctcaagtgtgggaaaggcaaagtctggcttgaccccaatgaagtcagcgagatctccatggctaactcccgccagaacatccggaagttggttaaggatgggtttatcatcaggaagcctcagaaggttcactctaggtcccgtgcaagaagggcacatgaggccaagcagaagggaaagcactctggatatggcaagcgcaggggtaccagggaggctaggctccccaccaagattctgtggatgaggaggatgcgtgttctgaggcgcctgctccgc

SEQ ID NO: 37185 - DNA, 394 bp, Zea mays
  unsure at all n locations
  Clone ID: LIB3060-034-Q1-K1-B3
ctccggcatcgacgaggcgaaccccagcgcccgatccctctcctgctcccacgacccatggcggcggatatggcgtacgcgccgncgatgaaggcggcaaggccgggttnaggctggcatgatggatccgcacacaggatccgcatcacgctctcctccaagagcgtcaagaacctcgagaaagtctgcggggatctggtgaagggcgccaagggtaaggagctcaaggtcaagggccccgtgcggatgcctaccaaggtgctccacatcaccaccaggaagtctccctgtggagaaggtaccaacacctgggatcgctttgagatgaggattcacaagagggtgatcgatctcgtcagtacaccagacgttgtcaagcagatcacctcaatca

SEQ ID NO: 37186 - DNA, 331 bp, Zea mays
  Clone ID: LIB3060-034-Q1-K1-B4
gagccagagaggagcttcatcagctcattcaattctcgttccatccctcgtctcttgtgtcccgcctccgttccataattcaccagcgtcgtcctacccatatctcccatcgtcttctccctcgcgccatcagcttccccaagccagcggcgaccatgatctccccggacaccatccgcacggccatcggcgtcatcggcaatggaactgcactcgtgctcttcctctccccagtgcctacgttcatccgcatctggaagaaagggtcggtggagcagtactcggcgatcccgtacgtggcgacgctgctgaactgcatgatgtgggtgct

SEQ ID NO: 37187 - DNA, 208 bp, Zea mays
  unsure at all n locations
  Clone ID: LIB3060-034-Q1-K1-B6
ggcgggagcgggggcggcggcgcggtgtggagggagtggaggggaggatgaggaggaggagggggagaagaagaagggactgttgcccgagtggatgaacttgacaacagaggacgccaagacggtgctggccgcggtagctatctcgctcgctttccgaaccttcgtcgccgagccgcgcttcatccnctcgctctccatgtttccc

SEQ ID NO: 37188 - DNA, 409 bp, Zea mays
  Clone ID: LIB3060-034-Q1-K1-C1
ggtgcatccatgctctggaagcacagacagtgattgcatttatgaacaacaccaagccactgaaggatgttgtgtttaagttggaggcccgtggtatcaaagccactgagctacatggagaccttggaaagcttgcaaggtcgacagttttgaaaaagttcaaggatggtgaattcagagttctcgttacgaatgagctgtctgccagaggactggacgtgccagaatgtgaccttgtggttaatctggaccttccaactgactccacacattatgctcacagagctggaagaactggacgtcttgggcggaaagggatcgtggtcacaatatgcgaagaaagcgagggatttgttgtaagaaaaatgcgcaagcagttagatgtggccatcaagccatgcgagttcac

SEQ ID NO: 37189 - DNA, 258 bp, Zea mays
  Clone ID: LIB3060-034-Q1-K1-C3
cggggctgacggacgactgaaccaccttcagacttcatggccgactgcgcctgcagcggctccggtctcgactaagcctccctggccagccaacctgcgatctccaccagcttcacgctgagcagcctgatatcagcaaggaaccccatgatgagcacgaacctgcagaggaatggcaagaacacctgcatcacgatttctcgagactggctgcggatgcacctaagcgtgataagcttgcggctcatgaactggatg

SEQ ID NO: 37190 - DNA, 428 bp, Zea mays
  Clone ID: LIB3060-034-Q1-K1-C4
ctgcccactgcgcctaaaaatggccgtgtcccactgaaccaatcgtctgcacatcctgttgctgttgccgctcgctcgccgtgccgcaatggctacggccgtcgcctcccatacgttgctctcctccgccttcgctccgcgccactaccaccgccgcctgacccggaccgcgtccgtggggccgtgccgggccgccccggtgggactggccgtgcggtgcgagaagagcgacaagcagaagaagcagccgctcgccgcgctcgggccccgcgagcagcgcttcatgttcgagggagacgagctctgcggccccgacatatggaatacaacctggtatcctaaagctgcagatcatgtaactaccgagaagacatggtatgttgttgatgcaacagacaagatcctaggcaggctagcatccaccattg

SEQ ID NO: 37191 - DNA, 432 bp, Zea mays
  unsure at all n locations
  Clone ID: LIB3060-032-Q1-K1-H7
ctccctctctgcctgaccagctaggatcagcggaagcagcaatggtgatggcgtcggcgagcgggctgaggagctgcagcgccgtgggcgtgcccagcctgctggctccgtcgtcccggtccggccgcctggcgccgttctgcgccaacgccaccacctctggccgcgtcaccatgtccgcggagtggatgcccggccagccacgccctgcccacctcgacggctcctctcccggggacttcggcttcgatccgctgggcctcgcgaccgtgccggagaacttcgagcggttcaaggagtcagaggtgtaccactgccgctgggccatgcttgccgtccccgggatccttgtgccggaagctctgggcctgggcaactgggtgaaggcgcangagtgggcggncgtccccggcgggcaggccacgtacctgg

SEQ ID NO: 37192 - DNA, 446 bp, Zea mays
  Clone ID: LIB3060-032-Q1-K1-F4
ctttcacgctcagctccagcaatggctgcctccaccatggcgatctcctccacggcgatggccgggacccccatcaaggtgggctccttcggcgagggccgcatcaccatgcgcaagaccgtgggcaagcccaaggtggcggcgtccggcagcccctggtacggccccgaccgcgtcaagtacctcggccccttctccggcgagcccccgagctacctcaccggcgagttccccggcgactacggctgggacaccgccgggctgtccgccgaccccgagaccttcgccaagaaccgcgagctggaggtgatccactcccgctgggccatgctcggcgcgctcggctgcgtcttccccgagctgctctcccgcaacggcgtcaagttcggcgaggccgtctggttcaagggccggctccagatcttcagcgagggcgggctggacta

SEQ ID NO: 37193 - DNA, 435 bp, Zea mays
  unsure at all n locations
  Clone ID: LIB3060-032-Q1-K1-F5
aatttttaagttgggtgcctgctgctctcaaaatgcctgaggatgagttgattagccgtgccggtctggattcagctgtgtatctgaggatttacttggtcggacttaaaatatttgctccaatctcagttctagctttcattgttcttgtccctgttaattggaccaatgatactctgcaattctcgaagttagagcacagcaatgttgataagctttcaatatcaaacataccagttggatcaaaaaggtttatagcccacttggcaatggcgtatgttttcacattttggacctgctatgtactattacgtgagtatgaagtagttgcaaagatgagactgcgatttctttcatcagagaaacgcagaccagatcagttcacggtccttgtgcggaatataccgnctgatccagatgaatcaattagtgagc

SEQ ID NO: 37194 - DNA, 415 bp, Zea mays
  Clone ID: LIB3060-032-Q1-K1-F7
gccagagcaaagccgcagagatgatttggaatcgatcggatacgttcttctgtattggcttaggggaagtcttccttggcagggcttgaaagcagccacaaagaaacagaagtatgacaaaataagtgagaagaagctttcgactcctattgaggctctatgtaaatcccatcctgtggaatttgcttcctatttccactactgccattctctgacatttgatcagcgtcccgattatagtttcttgaggcatgtctttcgagaattgtttgagcgcgaaggctatcaatttgattatgtgtatgactggactttgctgaagtgtaagcaatcccagaaggctaaggttcagcaaggatgctctcatgatgcatgcgtaagcagccgtccagttgcaacatacgtggacaagcac

SEQ ID NO: 37195 - DNA, 319 bp, Zea mays
  Clone ID: LIB3060-032-Q1-K1-F8
gcttcttttgcatcacaaggtttaggatgtcttgcaactgcggggcaagctgcggctgctgatcaagctgcaagtgcggcaagaagtaccctgacctggaggagacgagcaccgccgcgcaggccaccgtcgtcctcggcgtggccacggagaagaaggccgcgcccgagttcgtcgaggccgctgcggagtccggcgaggccgcccacggctgcagctgcggtggcaactgcaagtgcgacccctgcaactgctgatcacatcgatcgacgaccatggatatgattattatgtatctagcttgtggtggtggttgaac

SEQ ID NO: 37196 - DNA, 398 bp, Zea mays
  unsure at all n locations
  Clone ID: LIB3060-032-Q1-K1-G2
cttgaagagatcgagcttcttttgcaccacaaggtcgaggatgtcttgcaactgcggatcaagctgcggctgcggctcaagctgcaagtgcggcaagaagtaccctgacctggaggagacgagcaccgccgcgcaggccaccgtcgtcctcggcgtggccccggagaagaaggccgcgcccgagttcgtcgaggccgcggcggagtccggcgaggcccgccacggctgcagctgcggtggcaactgcaagtgcgacccctgcaactgctgatcacatcgatcgacgaccatggatatgattattatctatctagcttgtggtggtggttgaacaattataagcgaggcccaactggctggcatacataggtatngngtggtgtgtgtgagagagagag

SEQ ID NO: 37197 - DNA, 124 bp, Zea mays
  Clone ID: LIB3060-032-Q1-K1-G4
ccgacccacacgaaccaagaataccacgcctaccacacaacctcctaccctttccacaccaccaactaacaccgacctactggactactatcaacaacatcttcaccccaaaaaacctcccact

SEQ ID NO: 37198 - DNA, 333 bp, Zea mays
  Clone ID: LIB3060-032-Q1-K1-G6
atgtcttgcaactcgggtcaactgcagctgcagctgaagctgcaagtgcggcaagaagtaccctgacctggaggagacgagcaccgccgttcatgccaccgtcgtcctcgtcctgaccccagataagaacgcctcacccgagttcgtcgaggccgttgcggagtcctgcgaggccgcccacggctgcaactgcagtggcaactgcaagtgcaacccctgcaactgctgatcacatcgatcgacgaccatggatatgattattatctatctagcttgtggtggtggttgaacaataataagcgaggccgaactggctgccatacataggtattg

SEQ ID NO: 37199 - DNA, 437 bp, Zea mays
  unsure at all n locations
  Clone ID: LIB3060-032-Q1-K1-G8
cgctgcggctcacggctacgcagcccgctctcccgacccccccgtgccgtcctcttgttgctactagcacatagagtttcgcccgaatcgatcgccgactgactccgctagggttcggcccgatcgccgcttcgtcctcccggctcccgcggggaccccgccgagatgtctgactggagctcgccggctgcgccgacgttcttcccttttggcccgcaggccgaggggtgggacgtcaccttcaaggtcaaatatggtgatacacttaaaaggttttatggttgtgccaatgggagtcattttgacatgaatttatctgctctacgggcgaggattgatactgcctttaagtttggtcctgacgttgactntgttctgacttacaccgatgaggatggtgatattgtcatgctagatgatgatgatgacttgcgtga

SEQ ID NO: 37200 - DNA, 433 bp, Zea mays
  unsure at all n locations
  Clone ID: LIB3060-032-Q1-K1-H2
cgatcgcgagcgcaagcacgtacgttgtcggaagctcaagttagaagaagcaccagtgcctgatcgatggcggcccaggctctcctctccggccggcagctgctgggccgccccgtgcagtcggccgtctctaggtcgtcggcgaggaaggcgcccttcgtcgtcagggccagctccagccctccagccaagcaaggtgccgacaggcagctgtggttcgcgtccaagcagtccctctcctacctcgatggcacgctgcccggcgactatggcttcgacccgctgggcctctcggacccggagggcaccgggggcttcatcgagcccaagtggctggcctatggcgaggtgatcaacggccgctacgccatgctgggcgcggtgggcgccatcgncccggagatcttncgcaagatgggcatcattcccccgg

SEQ ID NO: 37201 - DNA, 126 bp, Zea mays
  Clone ID: LIB3060-032-Q1-K1-H3
ggcctcttccacttagtatagaggtcaaacctctctccatgcacgacagagctttttgttcgttgccttttaatatcttttttactgtttctaatgataatgagatacgcacgcgcgtttacctgt

SEQ ID NO: 37202 - DNA, 299 bp, Zea mays
  Clone ID: LIB3060-032-Q1-K1-H4
gtcaaccaagtcgaagacttacacaaagaatggagaatcttgtacgataacatatgggtctgggcggatcgctggcttcttcagtgaggacaatgtgttggttggcaaccttgttgtgcataatcagaaatttattgagacaactcgagaaaccagccctactttcatcattgggaagtttgatggaattcttggtctcggatttcctgaaatttctgtaggaggagcccctccaatttggcagagcatgaaacagcagaaactggtcgcaaaggatgtcttctctttctggcttaatc

SEQ ID NO: 37203 - DNA, 426 bp, Zea mays
  unsure at all n locations
  Clone ID: LIB3060-032-Q1-K1-H5
gcttcgtgaagaggagaggcctgaaaccggccatcagagcgtatgacaagctggtcctcatagggtgcgagcctggccaggtcacctacgcatcagtcatcaacgtgtactgccggctcgggcgcagcgacagagcagaggccatcttctccgagatgatcgagcgaggcttcgacaggtgcgtggttgcctatggcaacatgatctcgatgtacggcaagatcaggagggcgtcggaagccacgaggctgctggccctgatgaagcagaaggggtgcgagcccaacgtgctggtgtacaactccctgctcgacatgcacggcaagctggggaactcgaagcaggccgagaagatctggaaggagatggtgcggcgcaaggtccggnccgaccggatcagctacacggncatcatnctggcgaaca

SEQ ID NO: 37204 - DNA, 209 bp, Zea mays
  Clone ID: LIB3060-032-Q1-K1-H6
gccatccagatgtgtatgagccatgtgatgattcctttgcccttgttgatgcactagtctcagacaaggcacaactcttgacactacagccaaggttatgtatggaggtagggtctggtagtggttatgtcatcacctggctggcaatcatgctcaggcagttaggctttggagcccagtacctagcaactgacattaaccaacatgct

SEQ ID NO: 37205 - DNA, 258 bp, Zea mays
  unsure at all n locations
  Clone ID: LIB3060-032-Q1-K1-F3
cgcagctgacggacgactgaaccaccgacagacaacatggccgcctccgcctccaccgtctccggcctcgccggcgcctccctggccagccgcccggcgttctccaccagcttcacgcggggcagccgggtgtcggcgaggaaccccctgatgagcaggaacctggagaggaatggcaggatcacctgcatgacgtttccccgggactggctgcngagggacctgagcgtcatcggcttcgggctcatcggctggatg

SEQ ID NO: 37206 - DNA, 421 bp, Zea mays
  unsure at all n locations
  Clone ID: LIB3060-032-Q1-K1-C8
ctatagcaaccggtccagcactttcacgctcagctccagcaatggctgcctccaccggggcgatctcctccacggcgatggccggcacccccatcaaggtgggctccttcggcgagggccgcatcaccatgcgcaagaccgtgggcaagcccaaggtggcggcgtccggcagcccctggtacggccccgaccgcgtcaagtacctcggccccttctccggcgagcccccgagctacctcaccggcgagttccccggcgactacggctgggacaccgncgggctgtccgncgaccccgagaccttcgccaaagaccgcgagctggaggtgatccactcccgctgggccatgctcggcgcgctcggctgcgtcttccccgagctgctctcccgcaacggcgtcaagttcggcgaggccgtctg

SEQ ID NO: 37207 - DNA, 438 bp, Zea mays
  unsure at all n locations
  Clone ID: LIB3060-032-Q1-K1-D2
atttgtccattccccctccaccattcctccccgctttctccaccatcagggcgaaaattttatgcgagctttggaaagcgcgagctagtttatccggccgggcgtggtcaccgaggcagtagcggcgagagaggggaggatctgatcgatgtcgtcgggcgaggacgggtactgcagctcggattcgccgcgggcggaatcccccgaccagccgcaggcagctgcggacgcggagtcgcctcgcgccggagccgggccgaacaagcgcgaccttcacgcctcgtcgccggcagctaagcgcagccggagatcggtggagaagcgggttgtgtcggtgccgctggccgagtgcggtgaggggccgncgncgtctgactcgtgggcgtggcgcatgtatgggcagaagcccatcaagggctccccctacccacgtgggta

SEQ ID NO: 37208 - DNA, 435 bp, Zea mays
  Clone ID: LIB3060-032-Q1-K1-D4
cggacgcgtgggccgccttgtttggaccgcacgcgcggccacccttctcctcctctgctctcttgacctacctattctctctcgctcggcgcgcgtagaagagaagaggcacttcttcctcctcgccggcttcccctcgcgtgtcgcaagtgcttaccctacaccgtggcccgtggatcgtcgccggacgccaggcatcggcaagcggcagcgcagccgtccaccctgattttgccaagacagactaaggacttgccgccgaccgaccagtctgccgagcagggcaacggttcgtgtttgcgctgccgccggcgaggcaaatggagccatcatcatcgacgccgacgcactgcccctgcacctgcagcatcttcacgcttgcagcgtttcggccgcttaagcgcagcgtatgtctttgcaagaaagatgatgatg

SEQ ID NO: 37209 - DNA, 111 bp, Zea mays
  Clone ID: LIB3060-032-Q1-K1-D5
ctggaatgtgatcatatcacaaaggctcaaacgctgaatcaacatgtgctgctcttgctggggccacaatctgagaattcggaagcaaccacgaatctacgccaatggaga

SEQ ID NO: 37210 - DNA, 416 bp, Zea mays
  Clone ID: LIB3060-032-Q1-K1-D7
gtcctgacaggaggatctacctgccggatgggctgttggaccggtcggaggtgccggagtacctcaccggagaggtccctggagactatggctacgacccttttggcctgtgcaagaagtcattggacttcgccaagtaccaggcctacgagctgatccatgccagatgggccatgctcggtgccgctggcgctgtcatcccagaggcctgcaacaagttcggcgctaactgtggccctgaggctgtctggttcaagaccggcgcgctgctcctggacggcaacaccctcaactacttcggcaacagcatccccatcaacctggtggtggccgtgatcgcggaggtcatcctcgtcggcggcgccgagtactaccggatcaccaacggactggacctagaggacaagctgcacccc

SEQ ID NO: 37211 - DNA, 435 bp, Zea mays
  Clone ID: LIB3060-032-Q1-K1-D8
gtgcaatcaatcactcttcccgtacttatctcgaaggcataaagtttggtgattttggctacaccgagaacaatttcagccagaaacttaatggattggattcatctgatgcacatgcattaaccagcagtgatatgaatgctcctagatggaccagcacttgtaaaatcgctccctacgcaaaccacagctatcaaactggaaaacaaaatcggctacatgtgttgccttcagatgatctgcaatttgctcatagagatcacgctgcaagaacagagaagccaaattttgagaaagttggcagtggtgcaataccatcagcggatttgtgcatcaaggatgattttgataaaaggtttcaagaagatcttgatgaagcagtgcgccaaagccttggatacgatgcttattctggctggtacaataagcacttca

SEQ ID NO: 37212 - DNA, 424 bp, Zea mays
  unsure at all n locations
  Clone ID: LIB3060-032-Q1-K1-E1
cactcgtagagagaaggaaaaatatccccaaaccctagctcccgatctcgatggcgaaccctcgcgtcttcttcgacatgaccgtcggcggcgccccggcgggccggatcgtgatggagctgtacgccaacgaggtgcccaagaccgcggagaacttccgcgcgctgtgcacgggcgagaagggcgtgggcaagtccgggaagccgctccactacaagggctccaccttccaccgcgtcatccccgagttcatgtgccagggcggcgacttcacccgcggcaacggcaccggcggcgagtccatctacggcgagaagttccccgacgagaagttcgtgcgcaagcacaccgnccccggtgtgctctncatggccaacgccgggcccaacaccaacggctcccagttcttcatctgcaccgtcgc

SEQ ID NO: 37213 - DNA, 381 bp, Zea mays
  Clone ID: LIB3060-032-Q1-K1-E2
ggtggagacaggatgccggctggccacggcctgcgctcgcggacgcgcgacctcttcgcgcgccccttccgcaagaagggctacatcccgctcaccacctacctccgcacctacaagatcggcgattacgtcgatgtcaaggtgaacggcgccgtccacaaggggatgccgcacaagttctaccacggccgcaccggtcgcgtctggaacgtcaccaagcgcgccatcggcgtcgaggtcaacaagcaggtcaatgggcgcatcatcaggaagcgtatccatgtccgtgtggagcatgtgcagccgtcccgctgcacagaagagttccgcctgaggaaggcgaagaatgaccagctgaaggcggatgccaaaaagcgcggc

SEQ ID NO: 37214 - DNA, 443 bp, Zea mays
  Clone ID: LIB3060-032-Q1-K1-E4
cgtctgtccgctacccctccccgaccagatcgctacgagacgccgcgcgatccgacgcaggccgacgccgacgacccctctcgccgccggcggccatggcgtacggcgaccgcgtcaccaccttcgaggactccgagaaggagagcgagtacggctatgtccgcaaggtctctggacctgtggttgtggctgatggaatgggtggtgctgccatgtatgaacttgttcgtgtcggacatgataacctcattggggaaattatccgtcttgagggcgattcagctacaatccaagtttatgaggaaacagctggactgatggttaatgaccctgtattgagaacaagaaagcctctttcagttgaattgggacctggaattcttggaaacatttttgacggtatccagcgacctctaaaaaccatcgctattaagtcaggagat

SEQ ID NO: 37215 - DNA, 440 bp, Zea mays
  Clone ID: LIB3060-032-Q1-K1-E5
caacttggtggtgacgtgccatttcagaaggtttatttacatcctatgattcggcatgcacatggccgaaagatgtcaaaatcacttggtaacgttgttgaccctcttgaggtgataaatggcatgtcactggatggtcttctgaaacgtttggaagaaggcaatctggatccaaatgaattaaacattgcaagagatgggaagacgaaggattttcctgatggcatagcagaatgtggtaccgatgcgctccgcttcgcactgatatcgtacacctcccaggttcttatggcacccagttgagttttttcatgtttaatgtagcatacatggctttatgcaatccccccctcttcagtctgacaggataaatcttgatatcaagagggtggttggatatagacaatggtgcaacaaattatggaatgccattcgttttg

SEQ ID NO: 37216 - DNA, 435 bp, Zea mays
  unsure at all n locations
  Clone ID: LIB3060-032-Q1-K1-E6
gctaccgatgcagtcagtctccagcttgctgctcgccggtccttcgcctagctcgcgggaagccgcggagacgacgccgccaccgatgcagccgctacaatgtcaacatgagcgattggtgggcaacatgtgcccttctctctatctcgccgtctacagagggcggatggcggaggtcacggcgctgcttctggaacaacccgccgttgcaatagccactgccacgccgggtattaagggcactgctattatgcacggacagtgcgacatacttgagttgacagccgagaggaacaccgctctacatgtggctgcggagcaagggcgccacgagctgatccgggagctctacttcaggttctcagaccagggcctnctcaatcgcctgaactcggcgctggacacgccgntgcattccgcggcgagggcaaggca

SEQ ID NO: 37217 - DNA, 384 bp, Zea mays
  unsure at all n locations
  Clone ID: LIB3060-032-Q1-K1-F1
gtcatctccatctccagctccagcgccgccttgctctgtgtgcttccgcccgctctgtgttgctattgctaaactagtgtgttctgtcgctatgggctccctggccaccgcggacgggccgttgccgccgctcaagtaccctcaggctcgccgggacgaagacatcgtcgacgactaccacggcgtcctcgtgccggacccttacagatggatggagcaggtggattcgaaggaggtgaaggagttcgtggacgcgcaggcggccgtgaccagcgccgtgctgtccagctgcgaccaccgcgggcgcctgcgcgggcagctcaccgcgctcttcgaccacccgcgcttncgcgcgcccttcaaagcgccgggcagctacttcta

SEQ ID NO: 37218 - DNA, 367 bp, Zea mays
  Clone ID: LIB3060-032-Q1-K1-F2
tccactgttctcttctttttcctgatggcccttgtcgtagctgctatgctctgtgtcatgtacaccacctcggcacaagctgtaaggactggatacaactcctacgaacctgatgtaaggggtggatacaactctcttcccatcaacatcggtggcaaccactagctaggcggcgtatcggaccctgtctcataaatcgaaataatataagactgtcttcaactgatcacactgccggtgcaacactctaaatttgagggctacagtgcacactctagcctatcaacggctcacgctaccacgcgctctacaccgatgtgccccctaaccagattctctctcccccttgatctggggcacctatttc

SEQ ID NO: 37219 - DNA, 369 bp, Zea mays
  Clone ID: LIB3060-032-Q1-K1-C7
gcgagatacgaggctgtgattgatgcttaccttgatgggctagaggctggtggcttgagcgacttatcttgagttaccagcgtcgcatgcttctttgtcagtcgagtctacacccttatcgacaaaatgcttgagaagattggaacacctgaggcacttgccttgagagggaaggctgccgacgtacaggccaaactagcaaatcggctctaccagaagaaattctctggcccgaggtgggaagcgtctgccaagaaaggtgccaagaaacagatgttgttgcgggcgttcacccgtgtcaagaacccagcttatcccgacactctttacatcgacagtcttattggacctgacacggtcaacacgatt

SEQ ID NO: 37220 - DNA, 338 bp, Zea mays
  Clone ID: LIB3060-001-Q1-K2-D2
ctgctccggtcgctgctgaacgccgatctgattggcttccacacttttgattatgccagacacttcttgtcgtgctgcagcaggatgctcgggctcaagtatgagtcgcagaggggctacattgctctggagtactatggccggacagttactatcaagatcttgcctgtgggagtacacttggagcagctacggtcagtcctcaacctcccggagcttggggtcaaggtggccgagcttctgaaacagttctgtcatcggaaccgtctgctgttgcttggtgttgatgacatggatatcttcaaaggaattagcttgaagcttttggcgtttgagca

SEQ ID NO: 37221 - DNA, 311 bp, Zea mays
  Clone ID: LIB3060-001-Q1-K2-D3
gcaagagtctaggaggtcattgcaaagcgagatcaccaagctattacaatcgaactctgttctatcaaatgaactaaatgattccattgaaaaacagaagaggtttgaacatgatttcagcaatcttgttagtgaagcagttagtaaagatatcctcagtgtgatctttagaagccttcatgaagagaggacattgcagctgaagtctttgcataataactttggctgtcttcaaacagcaggcggtgagctttatcaggagatcaagatgatgaacaagaggcttggagacatagaaatggagaacaagt

SEQ ID NO: 37222 - DNA, 326 bp, Zea mays
  Clone ID: LIB3060-001-Q1-K2-D4
accacagccgccggaagctcctcctcctcctccatgagagagatctagcaaagcataggctccttcctgctggcgggatctccttttgattcgtaacttataacagaagaggaggaggcacagcaccttgtcaaatgatgaactctcagaagctgcagctgcccgttcaggatctgatgagtctgagagggagatcattcatcatcagcaaggtgatgatgcaccagtgcactgcagctgcttcgtcgtcgtcttcacctgctcctgctgctagaggcctgcaggttgctgcccatcccagtcccagcaggaggcggcgtcctcgt

SEQ ID NO: 37223 - DNA, 344 bp, Zea mays
  Clone ID: LIB3060-001-Q1-K2-D5
ggggagggatcattgaaagccgcagcgcccatgtcccaggcccgtctgttcgccaccaggtgtccattccccctccatcattcctccccgctttctccaccatcagggcgaaaattttatgcgagctttggaaagcgcgagctagtttatccggccgggcgtggtcaccgaggcagtagcggcgagagaggggaggatctgatcgatgtcgtcgggcgaggacgggtactgcagctcggattcgccgcgggcggaatcccccgaccagccgcaggcagctgcggcggcggacgcggacgcggacgcggagtcgcctcgcgccggagccgggccgaacaagcgcg

SEQ ID NO: 37224 - DNA, 364 bp, Zea mays
  Clone ID: LIB3060-001-Q1-K2-D8
ctcgtcgagcgtggtatggtccccctcaagaacgaggagcagctcacggacgggtacgtagacaccatcgtcgactggatcccgggcgcgcccaaggacctgcggctccgggacttcccgagcttcgtgcgcaccacggatccgaacgacgtcatgctcaacttcttcatccacgagacggagggcatgtcgcaggcgtcggcggtggtcatcaacaccttcgacgagctcgacgcgacgctgctcgctgccatggcgaagctcctgccgcccatctacaccgtgggcccgctccagctgacggtgcggaacaacgtgcaggcgaacagtcctgtcgctgctatggggtccaacctgtggaagg

SEQ ID NO: 37225 - DNA, 445 bp, Zea mays
  Clone ID: LIB3060-001-Q1-K2-D9
gccagagtgctaccagaacggcgtgtttggcctgccccgggggaagatggatgtggtggagaagatgcggccaggtgctaagctgttcttgtatgattttgacctcaagctaatgtatggggtatacaaggcagatacaaggggaggattggatcttgtgcgacatgcctttgatgggaaattccctgcacaggttaaatttagtgttgacaaggattgtcttcctattcctgagagtagtttcaagcatgccattaaggagaactacagctcaaaaggcaggttcacccaagagctgaactctaaacaagttcaaagactattggcaatgttcaagcctatcgaccttcctcaatcagctccacaacatatcgaggaagtgcgacaatcacatatcattgaagatattagaaacccgagtgactatgaagatagaagacgattg

SEQ ID NO: 37226 - DNA, 401 bp, Zea mays
  Clone ID: LIB3060-001-Q1-K2-E10
gtaagaaacacgtcgaagtcgtcgtagttttacgtgctcccgtccgtcccgtgcgccatggcacgcagcaacgccttgatgtggttgttgcttctcgcgctctcgtgctggtcgtggtgcggcgccgtcacggcgcggccgaccccgagcaccagcaccagcaccaccacagccggcggcggcttcatcaggtcgtggtgtgcggggacggactacccggccctgtgcaacgcgacgctggccccgtacgcggcggaggtcggggccagccccgcgcgcctgtcgctggcggcgctgacggtcacgctggacggcgcgcggagggcgacggccgcgatgaaggcgatggcggcgggcggcgcgagcagccaccacctcgtgcccgtggcggccgaagcggc

SEQ ID NO: 37227 - DNA, 417 bp, Zea mays
  Clone ID: LIB3060-001-Q1-K2-E11
gtacgtacgtagatcgatccatcgatcgctagctagctgacgaccatggcgtccctctgctctgccgccatcaccgccccttccttcacggccgcgcccgctcgcgcagtggtcagcaggaggtccttcaccgtgcgtgcctctctccgcaaggccactgccaccgccgccgtggccgttgccgccagcgtcctgcttgccggcggcggcgccatggcccaggaggtgctgctgggcgcaggcgacggcgggctcgtcttcgagcccagccagttcaccgtcaaggccggcgacaccatcaccttcaagaacaacgccggcttcccgcacaacgtcgtgttcgacgaagacgaggtgccgagcggcgtcgacgcctccaagatctcgcaggaggagtacctcaacgcgccaggcgag

SEQ ID NO: 37228 - DNA, 443 bp, Zea mays
  unsure at all n locations
  Clone ID: LIB3060-001-Q1-K2-E3
aaaatattgccagtcccgccgtcgagatggccccacgccgcctgctcgtcctcgccgtgctcgccctcgcggccaccgccgccgcggccaactccggcttcgcggactccaacccgatccgccctgtcaccgaccgcgcggcctccgcgctcgagtccacggtcttcgccgcgctcggccgcacccgcgacgcgcttcgcttcgcacgcttcgccgtcaggtacggcaagagctacgagagcgcggcggaggtccataagcggttcaggatcttctncgagagcctncagctggtccgctccaccaaccgcanaggcctctcctaccggctcggcatcaaccgcttcgcggacatgagctgggagggagtccgtgcgacccggctcggcgcagcccagaactgctccgncacgcttaccgggcaccaccggatgcgcgccgcc

SEQ ID NO: 37229 - DNA, 315 bp, Zea mays
  Clone ID: LIB3060-001-Q1-K2-E4
atccattcgacgggtacagcgtagacagtgacccacataggctcctgctgatcgaggtcttcatgtgcgcttcaacagcgaccattatccactagtgcgggttggattctgatgatagctaggttggggagcatcggatcatgtccagcgcggagttgaacgtgtctgccggctccggccgcagcatcatggggcagatcatcacactacttctgtgcaaaccgcgaacacgaggtagcagacggagaggtcagcgatgaacaggaaggccaggagcggctgcagcgccagctgagcctctaccatgtaccagat

SEQ ID NO: 37230 - DNA, 454 bp, Zea mays
  Clone ID: LIB3060-001-Q1-K2-E5
ggaaaagttgactgaaaagcttaatacaatgcaaaaggaaagtgatgagcagaaacgcaaaatcaagaagacagaacgtgctcttaaagtcgctgaggaggaattgatgaggttgcagttagaagcaactgctaaatcaaaacagctgactgaggttcatggagcatggttaccaccttggttagcgacacactatgctcgttacatggaggttgtctcaggtcactggaattatcatggaaaacctgctgtgcagaatgttttgcataaggcatcagaaaaatcagcacatgcaaagaaatgggctgaaccacatattgagactgctaagatgaaatggattcctgttaaggagaaattggttgtcctcaagaaaaatacagaaccttatgtacagaaggtatcgacaagatcagtggagttttatgagtcatccaaggatgctgtgacacct

SEQ ID NO: 37231 - DNA, 362 bp, Zea mays
  Clone ID: LIB3060-001-Q1-K2-E6
gttcgttgcaagtcgcaaagatttgcgccgcctgccgggcgtcgtcggctcatcgccgtcggcggtaggcttctgcctcccccgtctcgatacctctcattcggcgaagactcgcagggaggtccccacttcatcacctccgtttcctaccggaaaaggcaacttctgtcggccatctcagtactttttttggaagatggatccagaagactctagtgagtttgaagaggacgacgacgaagaagaagatgatgacttaatgctattcatattgccagcgctatatctagcatctactggaattggaactctggatcaaacatctatggttagtgatggtactgcgattgaaactccaagtc

SEQ ID NO: 37232 - DNA, 376 bp, Zea mays
  Clone ID: LIB3060-001-Q1-K2-E8
gcgatttccgtgctcggcttctccctcccgctatctctatctctgcgcgcgagctcggccctgctcgccctgctctcccatggccgcgcccaactccgtgcgctcgccggatcccctgctcggcttcgactgccgttccccgtgctcgcgttatctccctcctctctgccgcagctcgctgagtccctctgtttcctcccatggcgcggggttccctgcaggctgctcgcggcacccatctcctctgctcgaccgcgagctcgctccctggtcatgccgctccctcgcctaatcgtggtcgcgcgcgcgtgtgccttctcttggtggtgctcgaccccggcctcaggcagccacgtccgtggtcgtcgggcatgct

SEQ ID NO: 37233 - DNA, 421 bp, Zea mays
  Clone ID: LIB3060-001-Q1-K2-F10
agcccaccgaattccctgcgattcctctcccctcgcctcctcgtctccccctaggggagcgtcggagaggaatcgcaaagagggccgtctcatccgagttaaggaagccatggagcacaaggaggctgggtgccaggcccccgagggacccatcctctgcatcaataactgtggcttcttcggcagcgcggcgaccatgaacatgtgctccaagtgccacaaggagatgataacgaagcaggatcaggccaagctggctgcctcctctatcgacagcatcgtgaacggcagcgacgccgtcatggagccggttgttgctggcagcaacacggtagtagctgttgcccaagttgagttgcaaacaatgaacgtgcagcagcccgctgatgttgccggacccagcgagggggtggcggcgatc

SEQ ID NO: 37234 - DNA, 360 bp, Zea mays
  unsure at all n locations
  Clone ID: LIB3060-001-Q1-K2-D12
ggccccggccgccgggggcaagccggaggccccgattggggtgaacgcgcgcggcgggcgtcgagcccgaagctgccgaacgggcggcggctgcnggtggctgtggtgggaggcggccccgccggtggcgccgcggcggaggcgctggccaagggcggcgtggagacggtgctaatcgagcggaagatggacaactgcaagccctgcggcggcgccatcccgctgtgcatggtgtcggagttcgacctgccgctcgaccttgtggaccgcaaggtgaggaagatgaagatgatttcgccgtccaacgtcgccgtcgacatcggccgcacgctcgcgccccacgagtacatcgggatggtc

SEQ ID NO: 37235 - DNA, 444 bp, Zea mays
  Clone ID: LIB3060-001-Q1-K2-B7
gcccaatggagccgcagtgcaacgtcggtatgttcacgcgcgccgagctgctggaggccagcgtggagcttcgtcatcacgccctcggctacgtcaagtccacggccctccggtgcgctgtcaagctcggcgtcgccaacgccatccagcgccgtggcggcagggcctccgtcgaggacctgctcaccgagctctctctggacgcaagcagactccgctgcctgcacagcgtcatgcgcgcgctcgccgcgttgggcgtcttcaaggaggggagcgacggcgagtacggcctcactgccgtttcctctctgctcgtggacgacgacagcagcgtccgagattgggcccttgctggtgtcgatggtagcgacgacgacaacaactgcagtgctcgaagaacggcgttcaagatgacgcacgggcaggacgtctgggatgtcctcg

SEQ ID NO: 37236 - DNA, 329 bp, Zea mays
  Clone ID: LIB3060-001-Q1-K2-B8
ctcatggccgagcacaagtcttcctcaagcgtcgcctgctgtaccagtgtcgagctccgcacgcccaccgctactcctagcccctctcctccctggatttcgcccagtctccatctctctttctagccatggacggcgacctctcctgcctacagcaggtcagcgccccatctcctcaacatctcggctccctgtcccatctctctcacgagccactcttctcgttctccatggcgtcgacatggggctcgcccctgcaacctcgcctcgctgggtttcctcagggcgccgggatgctgcttcctatacatcgtgcgactccctggtgc

SEQ ID NO: 37237 - DNA, 422 bp, Zea mays
  unsure at all n locations
  Clone ID: LIB3060-001-Q1-K2-B9
cgactcccagcgccaggccaccaaggacgccggcgtcatctccggcctcaacgtcatgcgcatcatgaacgagcccaccgccgcggccatcgcatacgggctcgacaagaagtcgagcagcgacggcgagaagaacgtcctcatcttcgacctcggcggcggtacctttgacgtctcgctcctcaccatcgaggagggcatctttgaggtcaaggccaccgccggcgacacccacctgggaggcgaggacttcgacaaccggctcgtgaaccacttcgtccaggagttcaagaggaagaacaagaaggacatcactggcaaccccagggcgctccggcgactgaggaccgcctgcgagagggctaagaggacgctctnctncaccgnccaaaccaccatcgagatcgactcgctctatgagg

SEQ ID NO: 37238 - DNA, 371 bp, Zea mays
  Clone ID: LIB3060-001-Q1-K2-C2
gaggccacaaaacagaggtacccaaacgatcgatctgtgcatctccccaccgtccgtgccgcaaccatctgattcagaagcagacatcaatggctagcaacggctgcaacggcaacggcaacggcaaggcggcgccggcgggtgtggtggtgccggagatcaagttcaccaagctcttcatcaacggcgagttcgtcgacgccgcctccggcaagacattcgataccagggacccacggaccggcgacgtgctggcccacgtagcagaggcagacaaagctgatgtggacctggcggtgaagtccgcccgggacgccttcgagcacggcaagtggccccgcatgtcaggctacgagcgcgggcggatcatg

SEQ ID NO: 37239 - DNA, 365 bp, Zea mays
  unsure at all n locations
  Clone ID: LIB3060-001-Q1-K2-C4
caaccctcgcttccccaaaccctagccaagggacacggtggccggcgatggacggcgacggaggaggcgctggtgcgctgcaccaccacacgcgctcacccgaggacgtcttccgcgatttccgcgcgcgccgagccggcatcgtcaaggcgctcaccacggatgtggagaagttctatcagcagtgcgatccagagaaagagaacttgtgcctttatggtttgccaaatgagacttgggaggtcactcttccagctgaggaagtacctcctgagcttccagaaccagcactggggataaactntgcccgtgatggaatggtcgaaaaagactggttgtctctagtttgcagtcatagtgatgca

SEQ ID NO: 37240 - DNA, 415 bp, Zea mays
  Clone ID: LIB3060-001-Q1-K2-C5
gctagctgatgaacgagatgacgggggagagcgagctagctagcacagcacggagcgagcacacgcacatcttcctccgtgtgacgcggtcgaggtagccgagggcgtcgccgtcgccggggaaccagctgtggatggtggaggagacgttgacgatgcggccctggacgcccgtggcccgcgccgtgtccgccatcttgtccagcagcagcctggtgagcaggaagtggcccaggtagttggtggcgaaggtcatctccacgccgtcctccgacacggcgaaacggtcggcgtacttgccggcgttgttgctgcacgtacgtacgcacgcacgtgaaccatgtgtcagtccatgtaagttagccgcagttgttgctgctgctgccttggcaggtggactgctcactgatggatg

SEQ ID NO: 37241 - DNA, 179 bp, Zea mays
  Clone ID: LIB3060-001-Q1-K2-C6
actacctaattacccagacgaccgtattgagcatgctagctatcacagcagtgaaccggcacactcaaaaatcactcctcattacactacaacatctccatcttcaccgaaaccgcatggaaccactcttggatattgtagtacacgatatcaattctaccaatctacttctcaacaca

SEQ ID NO: 37242 - DNA, 323 bp, Zea mays
  unsure at all n locations
  Clone ID: LIB3060-001-Q1-K2-C7
ggcagcagcaatgacacttccctgcgccggcggctgcgagatccaagccagcggcattaactaccgcatcgccgtctccacccgacctctcaaggtctggagcagatcagacgacgacgtccattcccaagaccaccacagcgtcgtccgccaggtgctccgggacgtctcctgccgcgcgcgccccggcgagctgctcgccatcgtcggccccagcggcgccggcaagtccaccctgctcgagatcctcgcggggcgcctctccccgtccccgccgccccacctgctacgcatcgacggcgccgncgnccacagcgccgacc

SEQ ID NO: 37243 - DNA, 330 bp, Zea mays
  Clone ID: LIB3060-001-Q1-K2-C8
gttggcttctcctccccctccggttcgggttcgggttcgtgaggttctccggggttcggtttcgtgggtgggcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgag

SEQ ID NO: 37244 - DNA, 424 bp, Zea mays
  unsure at all n locations
  Clone ID: LIB3060-001-Q1-K2-D1
gttggcttctcctccccctccggttcgggttcgggttcgtgaggttctccggggttcggtttcgtgggtgggcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggcggctaccgtggtggccgtggaggcngcggctaccgcggtggcgggcgccgtgatggcg

SEQ ID NO: 37245 - DNA, 424 bp, Zea mays
  Clone ID: LIB3060-001-Q1-K2-D10
gtgcgtggccggacctgaaaagccggttcctcccccgaccccggcgccccaccgcagccgccggggcccaccgcccggcgcaccccgtcacctctccaccaaccggatacccggacggatccgctcccacctggatcctgatccggggaagtcaaaggggagatcgaagcttgaacagagggagccaaaatggtgaaggacacgcggtactacgacgtgctgggcgtggacccgtccgccaccgagtccgagatcaagaaggcgtactacgtcaaggcgaggctggtccaccccgataagaacccgaatgatccgcaggccgcggagaagttccaggaactaggagaagcataccaagttctcagtgaccctacacagcgccaagcttatgactcacatgggaaagacggcatctcaacggagg

SEQ ID NO: 37246 - DNA, 413 bp, Zea mays
  unsure at all n locations
  Clone ID: LIB3060-001-Q1-K2-D11
attcgcttcagccttcaggcccatcagcttatccattctctccctcacgagtcacgaatgaatagtacacggcgctcgctccctcctcgagagcgtgtatgcgcagctgcagctcggtaaggcagatgttgctgactcgtctgtccagcgtttcttgctcgtcaacagcgcagcagttgcatgcgccgtcggcaagttcgccgccgccgcatgctggagctggaagaagaagcgcgaggagctcccctgcttcagggccagactggccgccaagccgacgcgcgcctcaccggcgaagggcggcattgttccggccagcgacgatgacgacggcgttagcctcggcaccgtgaagctgccgggcaacatcgacaccgctcggttggagtccttgctcttncagtgggggaaca

SEQ ID NO: 37247 - DNA, 446 bp, Zea mays
  unsure at all n locations
  Clone ID: LIB3060-001-Q1-K2-B3
ataaccttcttggtgaaggaggatatgggtcagtttataagggtaaattagctgatgggagggtggtggctgtaaaacagttatctgaaacatctcatcagggaaaacagcaatttgcagccgaaatagaaactatttctcgagtgcaacaccgtaatcttgtgaagttgtatggttgctgtcttgaaggaaataaaccactgttagtttatgagtacctagagaatggaagccttgataaagcattgtttggaaacgggaaactgaacctagactggccaacacgctttgagatatgcttaggcattgcaagaggcctcgcttatctccatgaagagtctagcatccgtgttgtgcatagggacataaaggctagcaatgtcttgcttgatgcanatctcaaccctaagatctcggatttcgggctcgccaaactttacgatgac

SEQ ID NO: 37248 - DNA, 260 bp, Zea mays
  Clone ID: LIB3060-001-Q1-K1-E12
caactctgctgcgtaccgacaagttcgactacaaatacttcatccattggtagtggctaacccattggtcgccgccttcctacagcagcaacaattgctgccatacaaccagttctctttgatgaatcctgtcttgtcgaggcagcaacccatcgttggaggtgccatcttttagattacatatgagatgtactcgataatggtgccctcataccgacgtgtgtttcctagaaataatcaatatattgattgagatatac

SEQ ID NO: 37249 - DNA, 268 bp, Zea mays
  Clone ID: LIB3060-001-Q1-K1-G12
catccatgttatggcaactgagccatccaaagatgcgacacaagcagaagaaccaaagacactgccagatgcctggagaagtggtggaagtggaagacatggtggaagtgtgggacatggtggaagctgtagacactgtttaagcattagacatgttgatatgctggggacatggcatgagtacatggcttatgatgcaaatgctactgtctaaatgacatcaaatgtaacttaaaataataaaacacaaacatgaacttaatacact

SEQ ID NO: 37250 - DNA, 414 bp, Zea mays
  Clone ID: LIB3060-001-Q1-K2-A1
ccagaacaatccagcgagctcgaaaaaaagggcacgaatacgaaccccaatccagggccggaggagggcgagcgaactcaaaagcaagccgttccagtccaatccgcctcagtccaaatctaatcgccgggtttaggcagaaggggcgggacgcggcgaggtttaggcggggtttgttttgtcccttccgtgcgattctgctctccgcgcgggaggcaagtactgacggaagcgaaggcgaaggcggaggagggggtccccggcggtggaagtggaacgcgccgatgcgcaagtttcaggactccatcaaggccctccaggccgacatcgatcacgccaatgcgatggcgtcggaattcctgagggactacgacggctcggtcatccagattgcggtggcgtacagcgccgtcg

SEQ ID NO: 37251 - DNA, 434 bp, Zea mays
  Clone ID: LIB3060-001-Q1-K2-A10
gttggattgggttcaaagttgggcttttggacagctgtggtgtgcacggcagctctgtgacttgtgaggaggaagggaggaagaaagcggatccatggcgtcgaagcggatcctcaaggagctcaaggacctgcagaaggatcctcccacctcttgcagcgcaggccctgttgccgaagatatgttctactggcaggcgacgattatggggccatcagatagcccatacgctggtggcgtatttttggtcactattcactttccaccggactacccattcaaaccaccgaaggttgcattcaagacgaaggtttaccatccgaatatcaacagcaacgggagcatctgtcttgatatcttgaatgagcaatggagccctgcactgaccggtttttaaggtcctcctatcaattggttcccttctgacggaccca

SEQ ID NO: 37252 - DNA, 448 bp, Zea mays
  Clone ID: LIB3060-001-Q1-K2-A11
gtccgcccagaactatctcgctcgtccgcgttcagctcagctactccaatttcgcaacaagttgcaagcaataaccgaccaaggacgacgaacgggtcgatggccacgctctcctcctgcagccgcctgagtagcggcaccggcgccgcggccatccaccggcagccggcccgtgctggagccgtcctcgtcgtcacctgcaggcggagctcctccgcgaccgtccgcgccgcagccgctgccacggcggcggcgccggctgccgtagagctgcagaacaaggggtaagtgtatatatagtggtgtaacaaataagctggctgctgctcttgtagctaattgatcgatgctgctgctgctgctgctggacgcgcgtgcgtgacctccgaccgacttgcaactgcaaagggtgtcgctgccgacgtgggcggagttcgagctcgggcgg

SEQ ID NO: 37253 - DNA, 348 bp, Zea mays
  Clone ID: LIB3060-001-Q1-K2-A12
gtctgatcagaactaactcgctcgtccatgttcagctcagctactacaattcctcatcaggttgtgagccattaccgaccaatgacgaccaaccgctccatgtccatgctcttctactgcactcacctgactagcgacaccatctccgacgtcatccaccggaagccctcccgcgctagaaccgtcctatttgtcacctacacgcctaactccttcataaacgtcctcacctcatgctctgtcactgttgagcatccatctgccatatagctgcacaacaacgcgtaagtatatatatattgatgtaacagattagcttactgctgctatcgtaactaattgatccat

SEQ ID NO: 37254 - DNA, 430 bp, Zea mays
  unsure at all n locations
  Clone ID: LIB3060-001-Q1-K2-A5
ccgtacacaaacaaggccgtagcccgcagcttcgtctgttacgctacgtccggttcccgaccgcgccgtgtgaaaaaaatggctgtgccggaggtggtggtggacggcgtcgtcttcccgccggcggcccgcccgccgggctccgcgggctcgcatttcctcggcggcgcaggcgtgcgtggcctcgagatcgaaggcaacttcgttaagttcacggccatcggcgtgtacctggaggacgcggccgtgccggcgctggcgaggaagtgggccggcaagacggccggcgagctcgcgtccgacgccgncttcttccgcgacgtcgtcacgggcggcttcgagaagttcgcgccggtgacgatgatccgnccgctcacggncgagcagtacgccgngaaagtggcngagaaactgcgtgcgtactggaagg

SEQ ID NO: 37255 - DNA, 455 bp, Zea mays
  unsure at all n locations
  Clone ID: LIB3060-001-Q1-K2-A6
gaattcttaattcatgagttgtagggagggacttatgtcaccacaaacagagactaaagcaagtgttggatttaaagctggtgttaaggattataaattgacttactacaccccggagtacgaaaccaaggatactgatatcttggcagcattccgagtaactcctcagctcggggttccgcctgaagaagcaggagctgcagtagctgcggaatcttctactggtacatggacaactgtttggactgatggacttaccagtcttgatcgttacaaaggacgatgctatcacatcgagcccgttcctggggacccagatcaatatatctgttatgtagcttatccattagacctatttgaagagggttctgttactaacatgtttacttncattgtgggtaacgtatttggtttcaaagccctacgcgctctacgtttggaggatctacgaattc

SEQ ID NO: 37256 - DNA, 364 bp, Zea mays
  Clone ID: LIB3060-001-Q1-K2-A8
ccggcagctgagccggctgcacccggtgtaccgcctgctgcacccgcactgccgctacaccatggagatcaacgcgctggccagggaggcgctcatcaacgccgacggcatcatcgaggagtccttctggccgggcaagtacgccgtcgagcttagctccgtggcgtacggcgcgacgtggcagttcgacacggaggcgctgcccaacgacctcgtcaagcgcgggctggccgtgcgcggggaggacggggagctggagctcaccatcaaggactacccctacgcccacgacgggctcctggtctgggactgcatcaagcagtgggcgtccgagtacggtaacgtctactacaagtccgacgag

SEQ ID NO: 37257 - DNA, 405 bp, Zea mays
  Clone ID: LIB3060-001-Q1-K2-B1
ccccaatgaagtcagcgagatctccatggctaactcccgccagaacatccggaagttggttaaggatgggtttatcatcaggaagcctcagaaggttcactctaggtcccgtgcaagaagggcacatgaggccaagcagaagggaaggcactctggatacggcaagcgcaggggtaccagggaggctaggctccccaccaagattctgtggatgaggaggatgcgtgttctgaggcgcctgctccgcaagtaccgtgaggccaagaagatcgacaagcacatgtatcatgacatgtacatgaaggtcaagggtaatatgtttaagaacaagagggtgcttatggagagtatccacaagtccaaggctgagaaggccagagagaagacactttctgatcagtttga

SEQ ID NO: 37258 - DNA, 432 bp, Zea mays
  Clone ID: LIB3060-001-Q1-K2-B10
gctacatgtcgtctcttttcgtttctcacttcctctcttcgttcccaatttgaaggctgcccaacccttgcgccggtaggcggtggcggtgaggatagagggttacctgaggaggcagtgatggcggccacgattcagtacaaccggagcaacccggcggtgaagcggatcctgcaggaggtcaaggagatgcagtccaacccctcacccgacttcatgtccctccccctcgaggaggacatcttcgagtggcaatttgctatccttggtccgagagacagcgagtttgaaggtggaatttatcatggcaggatccagctaccttcggattatccattcaagccaccgtccttcatgctacttacgccaagtggacgctttgagattcagaagaagatttgcttgagcatatccaattaccaccctgagcac

SEQ ID NO: 37259 - DNA, 404 bp, Zea mays
  unsure at all n locations
  Clone ID: LIB3060-001-Q1-K2-B11
gcaaccggtccagcactttcacgctcagctccagcaatggctgcctccaccatggcgatctcctccacggcgatggccggcacccccatcaaggtgggctccttcggcgagggccgcatcaccatgcgcaagaccgtgggcaagcccaaggtggcggcgtccggcagcccctggtacggccccgaccgcgtcaagtacctcggccccttctccggcgagcccccgagctacctcaccggcgagttccccggcgactacggctgngacaccgncgggctgtccgncgaccccgagaccttcgccaagaaccgcgagctggaggggatccactcccgctgggccatgctcggcgcgctcggctgcgtcttccccgagctgctctcccgcaacggcgtcaagttcgg

SEQ ID NO: 37260 - DNA, 368 bp, Zea mays
  Clone ID: LIB3060-001-Q1-K2-B12
ccccgagtaccagctctgcgactacggaggctggctccgcgaccgcgtcgccgacccacagtactggaccaccatcagcgcctgcctccgcgacggccacgcctgcgccggcatgaggcgcctcgcgcgggaccccaacactggcatgctcgtgccggagacgcccaccatgttctacggccgcaacctctccccgatccagtctggatgctgcaagccaccgacgtcatgtgcgttcagctacatgaacgagacgtactggacacaaaaccccagcgtcccgacggtgaccaacgacccagactgcaaaaggtggagcaacgaccagcagacgctgtgcttccagtgcgactcgtgcaaggctggcg

SEQ ID NO: 37261 - DNA, 376 bp, Zea mays
  Clone ID: LIB3060-001-Q1-K2-B2
cgaccgggattccctccgccaagcgcggatctgaacgctgcgctccgtgtcgccgctcgaatccgccatgaagggggccaaatccaagggcgccgccaaggccgatgccaagctggcggtgaagagcaagggggcggagaagcccgccaagggcaggaaagggaaggccggcaaggaccccaacaagcctaagagggctcccagcgctttcttcgtgttcatggaggaatttcgcaaggagttcaaggagaagaaccctaagaacaagtctgtcgctgcggtggggaaagctgctggcgacaggtggaaatccctgagcgagtcggacaaggctccctatgtagccaaagctaacaagctcaagctcgagtacaac

SEQ ID NO: 37262 - DNA, 415 bp, Zea mays
  unsure at all n locations
  Clone ID: LIB3060-001-Q1-K1-E10
acccactcgtccgcttggggaaggggtggttntaggagtcatacactgcatggcagtggcaatggtagcaagagcagatgttatcgcagtagtcgcttggctaagttagttgattatctccatagcttgaatgaaaacactgatgagttagatgtccatctcattcttttgtctttagacaaacaaattacaccaagcttgcagcagccacacctttgctgtcggccaacattgtctgtgaagcatctttgtgaatatgttgctcatcagacacctttgctggttgaagaagttgagatattggcaattaaaggaagctgcagtacagtttgtgacaagtcatttgatgagacttcattctctgatgagctaactacgcttggtatagatcctagccaagatgaactggaaactc

SEQ ID NO: 37263 - DNA, 391 bp, Zea mays
  Clone ID: LIB3060-032-Q1-K1-A6
gagaagtacccaaagccaagttggatgtggagcaagaagcagggcgcggggcgagagctagacgcggcaaccaccgctgcactgcactgcacccctcgatgctccgagctcagcagcagcagcagcagcgactcgctcgaggcatgacgccatccatgtcaggaaagatatacctggtcggccgaacgagctactgtgcttatccgaagcactgacactccagcggatgcgctgcctgacagccacttaggacgacagattcagacgcgggcgatcaagatggcgcacgagcccatcctggactatgcggactacttataggcggttgcggcagatgtcgccacgacaatggacgaccacatcctagcgccggagctctatagcctgcatg

SEQ ID NO: 37264 - DNA, 414 bp, Zea mays
  Clone ID: LIB3060-032-Q1-K1-A7
gtcggctcacacacagctagccgccgtcgccgctagcttagccaccaggagtccgagctgatctacaggcaaggggcaactagctagctagccgcgcgccggcgccatgatgaacctgaacctgaagcagcctctggtgctgcccgcgcaccacagcaatgtcgtcggctcgcgcctgtcgtcgtcgtcgccctcggcagccgccgccagcaggaggaccggcggcggcgtgtcctcccggtccggctcccggcggcacgtgcggctgccgaggatcagctgcagcgccaccgaggaggtcagcggcgccgtgtcgtccgtcaccgtggagaggatgctcacggtgacggcgtctgtggaggcgtcgccggccatcgggcagatgtacttccagcgcgccgtcgacgacatcgg

SEQ ID NO: 37265 - DNA, 400 bp, Zea mays
  unsure at all n locations
  Clone ID: LIB3060-032-Q1-K1-A8
caaaggagcgcggcggcccctcattccttcctcccacttctctcgcgctgcgctcgggtacctcgcttcgcattccgttcgagcaggggagcggccgtgagaagggaagggagggaattaaggcaagatgttcatcgagagcttccgcgtcgagagcccccacgtgcggtacggcccgacggagatcgagtcggagtaccggtacgacacgacggagctggtgcacgaggccaaggacggcgcctcccgctgggtcgtccgccccaagtccgtcaagtacaacttccggaccagcaccgncgtccccaagctcggggtcatgcttgtggggtggggaggcaacaacgggtccacgctgacggctggggtcattgccaacagggaggggatctcatgggcg

SEQ ID NO: 37266 - DNA, 239 bp, Zea mays
  Clone ID: LIB3060-032-Q1-K1-B1
aaaaaaacccaaagatcctgactttctcttgctgctagcctcccttttcccttctccgttaatcgcactgttggaagctcttcgctgtcacccccacccaccttcggcgctcttttttagcattttccttgggctctggactccaaaatcccagccttttgtttgcttctctgtctcctgctgattggtgtccccgggtccaggactcttgatttgctcctcgcgggggttcggtccca

SEQ ID NO: 37267 - DNA, 442 bp, Zea mays
  unsure at all n locations
  Clone ID: LIB3060-032-Q1-K1-B2
gataagcagcagctcatcacctgaaggagagcagcccggaggagggggagcaagcagcagccgtgcgtggaagaagatgtcgtacctgctgccgcatctgcactcggggtgggcggtggaccaggccatcctcgccgaggaggagcgcctcgtcatcatccgcttcggccatgactgggacgagacctgcatgcagatggatgaagtgctggcagcagtagctgagaccataaagaactttgcggtcatctaccttggtgacatcacagaggtccctgatttcaacaccatgtatgagctgtacgacccttcgacagtgatgttcttcttccggaacaagcacatcatgattgatctcgggactggganacacaacaagatcaactgggccctgaaggacaagcaagagttcatcgacattgtggagaccgtatacaggggc

SEQ ID NO: 37268 - DNA, 400 bp, Zea mays
  Clone ID: LIB3060-032-Q1-K1-B3
ccacgcgtacccaggcgttccggcaaatcttgcagtgtttaacggattcatgtctattgcaagccaaagctcctctgccgctgtcactatgttgtcactgctcacagctgtgtgctctgtcttcctgtgtttgcgatgatcacagccaccaaattcatcacaccatagctagaacattctatggagttgctggcccgtatgaagcttgtttcgcaatcatctcagaacgcgaagaagaagtggaagtccctgaagagaatacaacaccacctttggagtctcatgcagggtctcgtctttactttaacatctgcgggcctgagactaactcatctataaacaaaggtgacgaagctacaaattattgttgattttgctccaaggtggtatcaaaagaaga

SEQ ID NO: 37269 - DNA, 411 bp, Zea mays
  unsure at all n locations
  Clone ID: LIB3060-032-Q1-K1-B4
ctcagagctagaccaaaagggaaggaattagtgcgatatgaatcccctattgaacactgcccgagtgtagatgatgttaaacgagtgcttaatggaactgcaaacagcttcagtataattgatgcttacccaaggtactttcgagttactggatcaggtgaagtccggcgattagaagcagcgatagattcagtaagtggcgaattgctattaaataatggcactccttggtggtcattctatgatacaaacccatcagatttggcaggctgtcaagggctgaatggtcccatggctataagttgttctgaggagacacctcanggcattattggcgaaacactcagtaaatttagcatatggagtttatatattacttttgttctagctgttgcgagatttattaggctt

SEQ ID NO: 37270 - DNA, 438 bp, Zea mays
  unsure at all n locations
  Clone ID: LIB3060-032-Q1-K1-B5
gccaaagcttgcagtggtgtgagggattcatgtgtattgcaagccaaagctcctctgccgctgccactaagttggcactgtccagagctgtgtgcgctgtcttcctgtgtttgtgatgatcacagccaccaaattcatcacaccatagctagaacattctagggagttgctggcccgtatgaagcttgtttcgtaatcatctcagaacgcgaagaagaagtggaagtccctgaagagaagacaacaccacctttggagtctcaggcagggtctcgtctctactttaacatctgcgggcctgagactaactcatctataaacaaaggtgaggaagcgacaaatttttgttgcttttgctccaaggtggtatcaaaagaagaaaaacaagagtgaagatgcgggaggacgtggtcctncatataggactttttggtttaa

SEQ ID NO: 37271 - DNA, 253 bp, Zea mays
  Clone ID: LIB3060-032-Q1-K1-B6
acaaactaaagaacacaacagataaccaaaggagcgagggctgaggagtgactggtgtgtacattagctgaaggggaggttaagggtagagatcgtttgatcagtatcatctgtatatccccatgcatggggtttcgttttgtgcgcttacttctggcttgccagcgtatggttcaatgtggaaacacatgtattagtacgagaactaatagacttataattaatataaatcaagcacgtacgacttctagct

SEQ ID NO: 37272 - DNA, 291 bp, Zea mays
  Clone ID: LIB3060-032-Q1-K1-B7
accagctgccattgccatctactgacctgtgacctccgcatttccaaacagcccgagcgagctagagctagcagagcggcaggcacctccctcctcaaggaacatggcccgcacgcagcagttggcagtagtggcgaccgccgtggtggccttggtgctgctggcggcggcggcgacctcggaggcggccatcagctgcgggcaggtggcgtcggccatcgcgccctgcatctcctacgcgcgcggccagggctcggggccctccgccggctgctgcagcggcgtcaggag

SEQ ID NO: 37273 - DNA, 358 bp, Zea mays
  Clone ID: LIB3060-032-Q1-K1-B8
gcggaggccgaggtaggtccggcggaactctgccggcgtgaggtcggagaacttagtggccgcccgcaacacgagggcatgttcccgggccctacctcgcagccttcgcccgacgtcgccgttgcgagcagcggcgtccagtcgagctgggccggcgacatctgctcgaccttctgcggcagcaaccaggtgcccaggacgccggcagggatcagggggaaggacgcggcattgcagccggaggtgccgagccgtgccggcgcgcacggacgcacatcgtcatcccgtgggtccggaagcaactatgggggatccgggctgcccaatgacagcgtccatggtcccaagaggaagggga

SEQ ID NO: 37274 - DNA, 403 bp, Zea mays
  unsure at all n locations
  Clone ID: LIB3060-032-Q1-K1-C1
gtctatgctgttgaggagaaaaatccggggaatctaggtgaagaagagacagaacccgtccgtcgcttaccaggtgctgggtgaaaggctcaaaccgactatcgttgtcgcttaatgccgatcgagtcagcttaagtcgtggtttgactcgctagggggttgttgcgacccgcgcaaaccttgccgagaccaacaggagcagggaagggggcgcagcaagacacaacaagatgggatccagagcaagagagctgaccttgtcaagacagaactgctcgcggagatggcggctgaggagacgcggcggcggaggtgctcgcggagatggcgggctgaggagacgcggcgatggaggtgctcgcggagatggcggctgangagacgcggncggagtgctcgtgga

SEQ ID NO: 37275 - DNA, 393 bp, Zea mays
  Clone ID: LIB3060-032-Q1-K1-C2
aaatgccgaaaggatggtgacgctcccagagatcctagcaatgtgccgaaagatcggaatcagccagaaagtcggtcagacgtacccgtcagcatcttccggagacgtctccgtgcagcagaatctgggggataacataagcctgatcgaaatgtattttctgtcaatcgatcacgacggccgtgggtttctggactttgagcagttccgggcgatagtcaaaatgattagatctaatccggatgtcgcagacgtttggcgcaagctgtctagcacggacggtatcagcagacaggcccggaatcacattgccaactttcgcgcaatggctgcgtaatagtcagggttctcgcgctacagatgacgagatcctgcgaatgtttcacgagttca

SEQ ID NO: 37276 - DNA, 351 bp, Zea mays
  Clone ID: LIB3060-032-Q1-K1-C3
gtcgagcttgcaacgccttacgcctccacactcaacagtcatggtcgtcatgggcaaggagcagcaacaacacgaggtggaggaggtgcaagggaaggtcgtccaagaagaagtgcaagtcgttcaagagacggtggtgccggtgccgtcggaggaggacaaggaggccgaggcggcgctggtgcacaagatctccagcctggccgccgccatcgcgaagctgccatccctgagcccgtcgccggaggtgaacgcgctcttcaccgagctcgtgacggcgtgcatcccgcgcagcagcgtggacgtggagcggctgggcccggagctgcaggagatgcgcggcgggctgat

SEQ ID NO: 37277 - DNA, 318 bp, Zea mays
  Clone ID: LIB3060-032-Q1-K1-C4
cccacgcctacccaggcatcctgtatcgcctcacgcctattactgcactctcattgcacaatggcgggacaagggcaactctactacacggacatgcacggcaccctcatcacaagagcttcttcggcgatggcccacatcaccattcgcatgaccgtcggcaaaccacaagtagccccatgcggcaatccctgatacgacctccaccgtgtcaagtaccatcgccacttatccagccagccccccaactaccttaccgaacagtttcccgacgactacggctgcgacacccacgggctgcacgactacccccatacc

SEQ ID NO: 37278 - DNA, 404 bp, Zea mays
  Clone ID: LIB3060-032-Q1-K1-A4
ggaatccgggctccacctggtgctccgttgcgaggtggtatgcagatctttgtgaagaccttgactggcaagaccataaccctggaggttgagagctccgacaccatcgacaacgtgaaggcaaagatccaggacaaagagggcatccccccagaccagcagcgtctgatcttcgctggcaagcagctggaggatggccgcaccctagcagactacaacatccagaaggagagcactctccacctggtgctccgcctccgtggtggtcagtaagccatggttcatttaagctgctgctgtacctgggtatctgcgtcgtctggtgccctctggtgtacctctatatggatgtcgtcgtctaataaacatctgtggtttgtgtgtcatgaatcgtggttgtggct

SEQ ID NO: 37279 - DNA, 409 bp, Zea mays
  Clone ID: LIB3060-030-Q1-K1-G12
gcggcgcgggccggccgccgggcgaggtgcgcgtacctgccgtcgatcgtcgccggatccatcgaccatgggcggtggcaacggccagaagtccaagatggcccgcgagcgcaacttggagaagaacaagggggccaaggggagccagctcgagaccaacaagaaggccatgagcatccagtgcaaagtgtgcatgcaaacattcatgtgtaccacgactgaagtgaagtgccgggagcacgccgaggctaagcatcccaagacagacgtgtaccagtgtttcccccatctgaagaagtgaaaggcctgaacttagcaaccagcgctggtttggtcactacgatcgggccagggggcgttccttgtgttgagggtgttcattccgtggtatcttcccgtcagtcatgcg

SEQ ID NO: 37280 - DNA, 147 bp, Zea mays
  Clone ID: LIB3060-030-Q1-K1-G3
gtttcacttgctgtgtgcaaagctggagctatggtgaagaagattcctctttaccagcacatcggatatcttgctgggaacaaaactctggtgctccctgtacctgcctctaatgtgattaatggatggtcacatgctggaaacaag

SEQ ID NO: 37281 - DNA, 301 bp, Zea mays
  Clone ID: LIB3060-030-Q1-K1-G5
gagaagcgaaaccgacctttccccctcccccgtattccacctcgcggagatccagtccagccctggggtttcgccagcggcgagccaaactccacgagcgggggaagaggggaaagcagggacgacgagggggcagccatggggcagcagtcgctgatctacgcgttcgtggcccgtggcacggtcatactggccgagtacacggagttcaccggcaacttcaccaccatcgactcccagtgcctcatgaagctacccgcaagcaacaacaggttcacctacaactgcgacggtcacactt

SEQ ID NO: 37282 - DNA, 282 bp, Zea mays
  unsure at all n locations
  Clone ID: LIB3060-030-Q1-K1-G7
caaaggattcagcacgccgcccgttgggaagggagcttcgaggcggcccgccgcggcgcgtcggccgggcgggctgagccaatggcacgggcccttggggcgcgaacgccctaacgtgggtcggngcgggcggcgagcagaggcgccgtgtgctagcttggattctgacttannaggcgtcagtcataatccggcacacggaagcttcgggccaatggcttttcaaccaagcccgatgaccaattgggggaatcaacggttcctttggaactaggtggaatt

SEQ ID NO: 37283 - DNA, 364 bp, Zea mays
  Clone ID: LIB3060-030-Q1-K1-G9
aatttgtatgaaattgagtcaaacaaaccggtgaggcagaagataacagagccaaagacaccatatcacccaatgatagatgatgatggatcattgtcgccaacacgtcctttcgacaaatgtcttgatgagactgtccaggctgaagctatcttaacagccttaaatggtgtggcttcttcaagcattagcatttcaaaggatgatggttggggatcgtcagatgatgatacagatgccatagatcaagatgctgaccctgaagctgacacgacaaggttgagtttcaaggagcatcgccgtgcccactacgatgaggtccgcaagggtaaggagctgatgaggactggatcccttactggtg

SEQ ID NO: 37284 - DNA, 321 bp, Zea mays
  Clone ID: LIB3060-030-Q1-K1-H10
gccaagaggcatcaccgccgcgactacgatgtcagcctcgctccaagccgcggccaggctgatgcagccggccaagatcggcggccgggcgccctttgcctcgctgccgtaccgcccgtcgtcgcaactcgcctgcagggcgttacggcgtcgaggccgaacaacctagtcatcacaggcgttattcatgaccctagcagccagcgccaagacgggctcatgctggacgcctatgtgctacccgcagagcctcgtcatgaccgtgcagagcgggatcaggtgatgccagttcctaagaagggccttgcgggccatgatctt

SEQ ID NO: 37285 - DNA, 463 bp, Zea mays
  unsure at all n locations
  Clone ID: LIB3060-030-Q1-K1-H12
acgcgtcggctcgtgtcgctcccctctttgcgccgcccctagatccggcaccgcccgctgctcgagcccgcggcccacgcccgcaggccgggaccggtgggcgcgcgccgggcagtaggagggagaggaagggcggcatggcggcgccgccggcgagggcccgggccgactacgactaccttatcaagcttcttctcattggggatagcggtgttggcaagagttgcctcctgttgcggttctctgatggttccttcactacaagctttattaccacaattggtattgactttaagatacggacaatagaattggatggtaagcgtataaagctacagatttgggatacatgcggccaagaacgcttncgtactattaccactgcgtactaccgtggagctatgggtatctggctgggttatgatgtcaccgatgaaatctctttcaacaacatcccgaaact

SEQ ID NO: 37286 - DNA, 215 bp, Zea mays
  Clone ID: LIB3060-030-Q1-K1-H3
gatcacgaacagctagtgctagtcccccttccttccatccatccatggcatgcgtcagcaccttgcagagctgccccattgccagaagagcaaagatcaacaccaggtccaggggcagcagcagtagcgtggcgaaggggtcaccaccaccagccttccagttccagtgcagggcgtcgactttcgcggcggacaccaggcctccggctcgagct

SEQ ID NO: 37287 - DNA, 424 bp, Zea mays
  Clone ID: LIB3060-030-Q1-K1-H4
gagctcgctcgtccgcgtacagctgagctactgcaatttcgcaacaagttgcaagcaataaccgaccaaggacgacgaacgggtcgatggccacgctctcctcctgcagccgcctgagtagcggcaccggcgccgcggccatccaccggcagccggcccgtgctggagccgtcctcgtcgtcacctgcaggcggagctcctccgcgaccgtccgcgccgaacccggtgcaacggcggcggccccggctgccgtaaacttgaaaaccagggggtggtcgttgccaacttggccgaagttcaagctgggccggcccccgtcttattggagaacaacaaccggcttccggccttggcgggccaagggcttaacctggtctaacacccggccgctaacaaaaatggcccgaaccaaggtgtccggctt

SEQ ID NO: 37288 - DNA, 240 bp, Zea mays
  Clone ID: LIB3060-030-Q1-K1-H6
cgcccgccgtctccggcacccgataggccttctccccacacccctcgcgtggcttccgtggcccgtagcccggcgcgcttcccttcaaagccactgcttcgcctcctccttctacttaagcgcagccggccccggccggcactcgcatccggtagctcgatcacttcttcctctggattttgggaaggaggcatcggacgtcggatgcatgacacactcattgcattagcgcctacgcct

SEQ ID NO: 37289 - DNA, 55 bp, Zea mays
  Clone ID: LIB3060-030-Q1-K1-H8
gcccgcggagccatgctcggcgcgctcggctgtgtcttccccgagctgctctccc

SEQ ID NO: 37290 - DNA, 416 bp, Zea mays
  Clone ID: LIB3060-032-Q1-K1-A1
aaaacccatatccctccggcataaacccaaaaagctgcaagcagtgtgaccaaaagcaggcctgacggcgatcctcggctctctagccaggcagcaggagatggagcacgacgtgcaccaccagcaccagcaggccatggagctgccgccggggttccgattccaccccaccgacgaggagctcatcacgcactacctcgccaggaaggccgccgacgcccgcttcgccccgcgcgccgtcggcgaggccgacctcaacaagtgcgagccatgggacctgccatcccgggcgacgatgggcgagaaggagtggtacttcttctgcgtcaaggaccgcaagtacccgacggggctgaggacgaaccgggccaccgagtccggatactggaaggcgacgggcaaggacagggagatct

SEQ ID NO: 37291 - DNA, 381 bp, Zea mays
  unsure at all n locations
  Clone ID: LIB3060-032-Q1-K1-A2
gaagctattacagaagctgtctctgtggctgaaaggattaatacaaattatggttcttcaagttacaagcctgttgtcctaattgatcaccacataccattttatgaaaagattgcattctatgctgcgtctgattgctgtattgtaaatgctgtgagggatggcatgaacttagtaccatatgagtatactgtttgccgacagggaaatgaggagattgataaactcagaggtcttggcaaagacacccatcacacaagcacacttattgtttcggagtttgtgggttgctccccatctcttagtggtgctttcagggtaaatcctttgagtgtcgatgatgtggcngatgccttgtgccgtgcaactgatttgactgaa

SEQ ID NO: 37292 - DNA, 401 bp, Zea mays
  unsure at all n locations
  Clone ID: LIB3060-030-Q1-K1-G11
cttccctcgcaggataaggtgcctcggccgttaacagagtggttgttccgcttcgtcccagcctctagttcttcctttcctccagagtgatggccaaatgctactcagattggcccccgattccgcctttccatccatcgcgaagaacgccgccgcaatcccacgcctccccgatcacgatcaggcggcagctcgcgtccttcgtgctccactgctccagatcctgcgctcccctcctcgagcccaagaacctgcccgatgagttcgaggccgtaccggcgacgacgacgccgncgctgccggacgccgccccgaagctggggatttctaacaagttcatccgaggcctctgcggtgacccgcagaccgagcagctggccttcgagggctacaggaaggcg

SEQ ID NO: 37293 - DNA, 345 bp, Zea mays
  unsure at all n locations
  Clone ID: LIB3060-032-Q1-K1-A3
ctcgtcgcttatttatacggccgacccgaatcaatatggaaggagcggccgaccatgagcggcaggtggacgacaagccgccgtacgccgccgtggacgacaccatgaccaccaccacgaagaagatggtggaggagcagctctcagacgacgccggcggcggcggcgagctgccagagcagaactaccgtggatggaaggccatgccctacgtcatagggaacgagacgtgcgagaagctgggcaccatcggcaccacggccaacctgctggtgtacctcaccaccgtgtacggcatgtcgggcgccagcgccgncaccctgctcagcctctggtcgggcaccg

SEQ ID NO: 37294 - DNA, 425 bp, Zea mays
  unsure at all n locations
  Clone ID: LIB3060-030-Q1-K1-E2
ggcgcggctactgctgtggtggacagcgctgctcctcccatccctcctcgccggcgttggtccggccggcgncgncgncgcgtccccgccccacgatgcgtgcctggtgcctaccatcgcgcaatccgtccttaggaactcccgacacgtgctcgacgctggatcgccgncttgccgacccggtcggcgtcatcaaggaagataaggtgacgttggcaaggccagttaatcttcttaacgcaaccaaggatgactacatggccgaactatccaatgcctgggggtgccaattttaacaggattgcaacccgaatttggagacactggctaactaattccaagttatccggcatttggaattgaaggaatcggcatttaggccagccttatttccagagatccggttcaagggtttccaacaattt

SEQ ID NO: 37295 - DNA, 294 bp, Zea mays
  Clone ID: LIB3060-030-Q1-K1-E3
ccaaggcttccgcgagatgatgaggaagcaatactcccctgtgctctccttgtgcctgatggcccttgtcgtaactgctatggtctgtgtcatgtacaccacctcgggacaagcaagaaaggaatggctacaactcgtacgaaccttattgaaagggttgattccaattttgttccattcaacggcgttgccagcccttacttagccgttgaatcgaaccctgtttaaaaattcgaattattttagaactgctttaaacggttcacattgcggttccccaaccttaaatttggg

SEQ ID NO: 37296 - DNA, 373 bp, Zea mays
  Clone ID: LIB3060-030-Q1-K1-E4
agcgagagatccagagatagcacaatcgcatcttacactccgagctatttctactttgagagaatgccctggtcccacaaggagcgagtaatttgaggcagagaccgacacagatggcagcggttatggtgtctcgccaaggccgggagctgcagcggtacagcgcgagcacggccgggcgcgtggtggtgggctgcgtcccgtaccgcgtgcgcgggggcgacggcaaggtggaggtcctggtgatcagctcgcagaagatgggccccgcgaagggcgtgctgatcccaaaggacggttggaagctgaacgagtccatggccaaggcggccaggtgcaaggccccctaggcggcctgctttctccggttgac

SEQ ID NO: 37297 - DNA, 109 bp, Zea mays
  Clone ID: LIB3060-030-Q1-K1-E5
atcgaatccgtcggatcgggagcgggagagaccactcccaaatcgcgtcgcgtcacgtggagagcgagagcggaagatgtgcgcgcgggggaaccgatccgactgatgg

SEQ ID NO: 37298 - DNA, 385 bp, Zea mays
  unsure at all n locations
  Clone ID: LIB3060-030-Q1-K1-E6
cccacgcgtccgggccggcagggccaacgagtgggtggtgacggcgaagctcggcagcgccatgaagatgaaatcggctaacaaagcggggctcaggaagcagttcatgaggatatgggagaggctgcacgtcacggagctcggggtggcagccttcctcttctcctgcggctggtacgatcttgcgtacgggagggaccatntcttcatctaacctctcttccagtctgtcgcgtttttcatcgtcggcgtcggctacgtcggcaccatcgtcccgcagtcgtagcggaagcgtgtccagatcatccgcttctctctggttttcgcattgtgtcttgggtaagtttcgtagtggatgaccggtttgaggtaaagatcatgcatg

SEQ ID NO: 37299 - DNA, 214 bp, Zea mays
  Clone ID: LIB3060-030-Q1-K1-E7
actctttccggttcgttcccctacgcccgtttctctctcgtcgcgcaacatcagagcacaagcgaggaacccagtccagtcccgggaatggagtgcgtattgggcgtggttggccgcgacttcgtgctggtggcggccgacaccttcgccgtgcagagtattctcgtccacaagaccgacgaggacaaagtgatggtgctcgactcgcaaaagc

SEQ ID NO: 37300 - DNA, 277 bp, Zea mays
  Clone ID: LIB3060-030-Q1-K1-E8
caaacgcccacaccctccggagcgtcgcagttatcccacccctccttctccccttcggacgtcgatggcggagcgcggcggcgagcgtggcggcgagcgcggcgggtttggccgtggcttcgggcgctgctggcgcggcgaccgtggccggcgcccaagggggccgcgcgggccggcgcaaggggcaaaggaatgggtccccggttccaaacttcggcggcttgttcaggggaaccaggtccaccaggtccaaggggaccaacttcaattggttccc

SEQ ID NO: 37301 - DNA, 285 bp, Zea mays
  Clone ID: LIB3060-030-Q1-K1-F1
aaaggattcagcacgccgcccgttgggaaggtagcttcgaggcggcccgccgcggcgcgtcggccgggcgggctgagccaatggcacgggcccttggggcgcgaacgccctaacgtgggtcggggcgggcggcgagcaaaagcgccggttgctagcttggattcttacttaaaagccgtcaatcataatccggcacaccgtaacttcgcgccaatggcttttcaaccaagcgcgatgaccaattgtgtgaatcaaccggtccttttgtactaaggtgaattacta

SEQ ID NO: 37302 - DNA, 322 bp, Zea mays
  Clone ID: LIB3060-030-Q1-K1-F10
ggggacacagacagtgcgctccagctgttctcggaaatgctgaagggcgggatagagcccaacgtaatgagctacaccattgtcatccaatgcctcgggaaggcgcataggatacagcaagcggtggaggtgcttgagtccgggctggagaagggtctcaagcccgacgatcggctctgtgggtgcttgctctctgtcatcgctctgagcagcgtcgaggagatggaaatggtgctttcctcactggaaaaggtcaaccagaacctgggcaagctgatcagagcgctcggcgacgcccatgtcgactgtgacgatatcacaa

SEQ ID NO: 37303 - DNA, 340 bp, Zea mays
  unsure at all n locations
  Clone ID: LIB3060-030-Q1-K1-F11
ccgctccttcctccccctatctagctagccttcccgttcctgcatcgcggcggagatgggcgcgtccaccacgccgctcgcgtcggcggcggcgctgcttctgctgctgctcgcgccgctcgccgcggcggcggacagcatgtcgatcgtctcctacggcgagcggagcgaggaggaggcgcggcggatgtacgccgagtggatggcggcgcacggccggacctacaacgccgtcggcgaggaggagcgcaggttcgaggtgttcagggacaacctccgctacgtcgacgcccacaacgccgccgccgacgcgggcgtccactccttccgnctcgggctc

SEQ ID NO: 37304 - DNA, 324 bp, Zea mays
  unsure at all n locations
  Clone ID: LIB3060-030-Q1-K1-F12
cccacgcttaggccgcagctacctacccctatctatttagcctttaaaancctgcatcgcggcagagatgcacgggtacaccacgacactcgcgtcagccaatgcgctgctaatgcatatactacagaagctcgccacggcgtcctacagcatgtagatcacatcctactgaaagcggatcaacgaggatacgcacccgatctacaccgagaacatagcagcacacggccggacctacaactcacagctgccatcagtaacacatgtaccagaatgccagggacaacctacgatacatctacgcccacaacacaaactccgaca

SEQ ID NO: 37305 - DNA, 336 bp, Zea mays
  Clone ID: LIB3060-030-Q1-K1-F2
gcgttgcagcgagcgcggcgggtttggccgtggcttctggcgctgctggcgcggcgaccgtggcgggcgccgaggctgccgtcgccggcccacgtaagaagaaaaaaaattggtccccattaccaaacctcgaccgcttcttaaagaaaaccagatcaacaaaaaccaagaaaactaacttcaattgattccccttaaagaacaacaaaacattcaaaaccttgttcccgagcttaaagaccaagttaataaaaacaaccccgttcaaaaacaaacacctgcccgacaacacaaccggttcaaaggctctttcctccttggccaattgcaacggca

SEQ ID NO: 37306 - DNA, 317 bp, Zea mays
  unsure at all n locations
  Clone ID: LIB3060-030-Q1-K1-F3
caaaggattcagcacgccgcccgttgggaaggtagcttcgaggcggcccgccgcggcgcgtcgggcgngcgggctgagccaatggcacgggcccttggggcgcgaacgccctaacgtgggtcggggcgggcggcgagcaaaagccccgggtggtagcttggattctgacttaaaagccttcaatcataatccggcacaacggaactttgggccaatggcttttcaaccaagcgccatgaccaattgggtgaattaaccggtccttttggactaaggtggattactattgcggcgccgtcattaatagggtgaaactt

SEQ ID NO: 37307 - DNA, 348 bp, Zea mays
  Clone ID: LIB3060-030-Q1-K1-F4
gcacaggggacgccgccgtctccctctccctgccccttcaccacgcccacgcccacggcccgcgcccgctgccgcacccggcgccccaccacctacactgcgcggtcccgctcaggcaccacgccacctccgcgtccgccgtaaccgcgccgtcgcccaagcctgacgttcaggctccttcaatcggccccctgaaccccggccttggcgggccaaggccaacccggtcggccccggccggcgggcgcttcttcaagcgggccggcaccggataccccggaacgcttgcccacccctgccttcggtccggcacccctcgccgggccgagcgccaagcgcgcgcgcttc

SEQ ID NO: 37308 - DNA, 217 bp, Zea mays
  unsure at all n locations
  Clone ID: LIB3060-030-Q1-K1-F5
atgcccagccccgaccacgaccagaacgccagtcccaacgtcccgccgtccgccgctggtgacggcggcgcatcagccactgcggcggcagcgcccgccgccgggaggcggccgttcaccagcctcagccaagaggaagccgacctcgccctttgcccgcgtcctncaggagcaggagcgggcgtacatgatgctgaccggccgggagtacgcgatc

SEQ ID NO: 37309 - DNA, 330 bp, Zea mays
  Clone ID: LIB3060-030-Q1-K1-F7
ctcgccatcacataaaaccagtgcaagcagaatcagcgcaatggcgagcagcaccatggccctgtgctccacagccttcgccggcaaggcagtgaacgtgccgtcgtctctcttcggcgaggcccgcgtgacgatgcgcaagacggcggcaaaggcaaagccggcggcgagctccggcagcccgtggtacggccccgaccgcgtgctctacctgggcccgctgtccggcgcgcccccgagctacctgacgggcgagttcccgggcgactacggctgggataccgcggggctgtcggcggacccggagacgttcgccaagaaccgggagct

SEQ ID NO: 37310 - DNA, 256 bp, Zea mays
  Clone ID: LIB3060-030-Q1-K1-E12
gcagggaaggtcttccaagtcaactaaggttggcgacatcatgaactggaagaagaccagactgatgacagtgaattccgacaccaagggcctgcaagcaatgcagcttatgacagaaaaccgggttagacacataccggtgatcgacaggacagggatactctggatagggtccatcggcgacgtcgtgcgcgcggtggtgggcgagcacagggaggagctgaaccggcttaatgactacattcagggagggttc

SEQ ID NO: 37311 - DNA, 454 bp, Zea mays
  Clone ID: LIB3060-030-Q1-K1-F9
gttctgctctgccgccgccgccgctgccgctcccgctgccgcaggaaccctagaccacgctgagcaacccccggcctacacggcgtagctttgcaggaaatggaatacggcgccgtcctcgccgccgcgccgctcgtcgcacggccgaactggctcctcctctcgccgccgccactggcgccgtctattcagattcagaatcgtctttattcgatctcgtcattcccactaaaggctggacctgtaagggcatgcagagctttagcaagcaactacacgcaaacatctgaaacagttgatttggactgggagaacctgggttttgggattgtgcaaactgattatatgtatattgctaagtgcgggacagacgggaatttttctgagggtgaaatggtgccttttggacctatagcgctgagtccatcttctggagtcctaaattatggacagg

SEQ ID NO: 37312 - DNA, 433 bp, Zea mays
  unsure at all n locations
  Clone ID: LIB3060-030-Q1-K1-G10
ccaggctgggttgtttaacacgacctccacagcacaggacaggcgagcattgctgcaggagatactcaggagaggaacaagctcactgggaacggatatccccagtgaacgtgagataaaccgcttggctgctcgaaacgatgaagaattccggttgtttgagaagatggatgaagaaaggaggctaagggagaactacaaatctagacttatggatggaaatgaggtcccaaattgggtgtttgccaatgataatgaaaccttacgcaagaaaaccgtggcagatgaattccggaatataattgttggttcaaagagacgtagaaaggaggttgtctattcggactctnttggtgatcagtggatgaaatccgacgagggatttgaagagattgcaaagatgactccaagggtgaagcgaactgcttattcg

SEQ ID NO: 37313 - DNA, 167 bp, Zea mays
  Clone ID: LIB3060-001-Q1-K1-A10
tccacccatacaccccttctccttcccaacctctcaaatcaaaaaccaccgaaataaaaaaacattccaaacggaccaacaaacgaccccaaactctttcatcaccttcttcaccaatctctatcgatccaccctccttgcccatcacttccatccccaatttccct

SEQ ID NO: 37314 - DNA, 278 bp, Zea mays
  unsure at all n locations
  Clone ID: LIB3060-001-Q1-K1-A9
gacccactcgtccgctctggtccgtggccatggcgatgtccatgctctccgctaccaccgtgccactgcagcgggggggttgaaagtccgagttctccgggctcaggagctccgcgtcgctgcccatgcgccggaatgccacctccgacgacttcatgtccgccgtctccttcaggacccacgcggtcggcacgagcggcgggtcgcggcgggcgccgacggaagcgaagctgaangtggccatcaacaggttcagctcgatcgggcgcaacttcctg

SEQ ID NO: 37315 - DNA, 238 bp, Zea mays
  Clone ID: LIB3060-001-Q1-K1-B10
acagcaaactagcatagcaacgtttaaatcttaaaaaatccagtccatataattcactggatttttctcccatgaaaaagcaaacttcagctaattatggcctaataaaggctgtcatgcctactgctggggagtatgtataccaaagatcaatgagccaacctttcttatatgtcaagcctgttgaacatcatgcactaatactatcaaaaactcttaccattttcaaattaatata

SEQ ID NO: 37316 - DNA, 445 bp, Zea mays
  Clone ID: LIB3060-001-Q1-K1-B9
cgggccgacccactcgtccgcgagtcccagcgccatgccaccttagactccggcgtcatctccggcctcaacggcgtggggttcatctacaagcccaccggcgcggccatcgcatacgggctcgacaagaagtcgagcagcgacggcgagaagaacgtcctcatcttcgacctcggcggcggtacctttgacgtctcgctcctcaccatcgaggagggcatctttgaggtcaaggccaccgccggcgacacccacctgggaggcgaggacttcgacaaccggctcgtgaaccacttcgtccaggagttcaagaggaagaacaagaaggacatcactggcaaccccagggcgctccggcgactgaggaccgcctgcgaaagggctaagaggacgctctcctccaccgcccaaaccaccatcgagatcgactcgctctatgagggca

SEQ ID NO: 37317 - DNA, 449 bp, Zea mays
  Clone ID: LIB3060-001-Q1-K1-D11
cgggcagacccactcgtccgcccacgcgtccgttctgatgttgatagcttcgtttgaaggaaaggtgagagcagaatcgtggggagaatctggtattgtgtcctggctgttgttttcgcgatcaaaacgatgtcgtcgccggacattgtctcgatattggataactcgaaggagctcgatcgggttaggaaagaacaggaggatattctgtcggagatcaacaagcttcacaagaagcttcaagcaactcctgaagtggttgagaagcctggggataactcattggcaaggctgaaatttttgtatactcaagcaaaagaactttcagaaagtgaagcaagtatttccaacttactgataaaccaaattgatgccctactgcctacgggtccacaagggcaaacacgaagaagaataggaaaaggtaatgagcagaaaaggaaacgagt

SEQ ID NO: 37318 - DNA, 134 bp, Zea mays
  Clone ID: LIB3060-030-Q1-K1-B6
ggattcagcacgccgtccgttgggaagggagcttcgaggcggcccgccgcggctcgtcagccgggcaggctgagccaatggcacgggcccttgtggcgcgaacgccctaacgtgggtcggagcgggcagcgagc

SEQ ID NO: 37319 - DNA, 109 bp, Zea mays
  unsure at all n locations
  Clone ID: LIB3060-030-Q1-K1-B7
ggattgagcacgccgcccgatgcgaatggagttacgaggcggaccgacgcggcgcgncgccgggcagccctagccaatggcacgggccctaggggcgcgaacgccctaa

SEQ ID NO: 37320 - DNA, 266 bp, Zea mays
  Clone ID: LIB3060-030-Q1-K1-C10
ggaattcatcgccagcgacgtctccgaccgtcgactccccaaggacatcctcctgcgcgtcggggactacgctagcgcctctcatgaccgcgcaactaaactacatgatatcacactgcaagatgaccattacgctggtacagacctggtccacctgccgcaacggtagtcctgccgatcggttcacgctaagcatgaccatgtgcctcgactacgtacactgggatctcacgtacaatgcactgactaccatgatggcaccagac

SEQ ID NO: 37321 - DNA, 312 bp, Zea mays
  unsure at all n locations
  Clone ID: LIB3060-030-Q1-K1-C3
gttggtgacaccataaccactcctgttcgttgtgcacccacgcggccgaacagtgaaaggcatcgtctggacgtctcgtgaccgctggactcgccgncgccccaggctagctcgatgattgggtgcgccaagccgctcgcggcgccgctgcaggcatgggctcgcccgccgtctcccgccggtcgccgncttcccccctcgttctgcgcccctgacaccctcccagctctcacccgggccggtcaaagcccaagccaggtctaatctgaccacgccccggcaacaagctccggtgaaggccgcttgttcctt

SEQ ID NO: 37322 - DNA, 248 bp, Zea mays
  Clone ID: LIB3060-030-Q1-K1-C4
cgccagattggtatatcgatcgattgatcggtggcggttgaaggggaggacggtgggcagatggggtcgggccggtgcttcttcgagtgcctgctcaggctgctcaacttcatcctaaccgtcgccggcctcgctatggttggttacgggatctacctgctcgtccagtggattaagatatcccaggaccgcatcggctgggcttcgaccgtggaagttctcgacttttgccggccgctgttgggggc

SEQ ID NO: 37323 - DNA, 181 bp, Zea mays
  Clone ID: LIB3060-030-Q1-K1-C5
ggcagaggcaagaggcccctcaccctcaggtgatcaggtcgctagctcccggcttaactagtaggcagccatgaatttcggtgggaatggcaacgcgacgatccggtgcaagtactgcagggcgagcctgagcgtgatccccggcgagcgcgccatccagtgcgcgcaatgcaactgcgtg

SEQ ID NO: 37324 - DNA, 378 bp, Zea mays
  Clone ID: LIB3060-030-Q1-K1-C8
gcaagccattcatcagctggagttggacggttttgttactttaacttataatatcagtgaagcggatgcagtgatcgcgttacattcaaagctcaagaagaactctcagattcaggctgtgctgaaatctcaagatataccggttttcctcgtaaagacaaactccctgcctcaaaataccagggcactccgggctcttgtccaccatcacattgaccaaattatagaataccatgattaagaagaagccaggtcattaaaagaaacccatgcttttgaagaagcaagggttgcaattcaaccagtagtgattcccaaaggccaaaaccttcaactacttgccaagccattaagccttattttgttccaagtgggtct

SEQ ID NO: 37325 - DNA, 336 bp, Zea mays
  Clone ID: LIB3060-030-Q1-K1-C9
cgcgatcgtgggcgcggacggcgttaactcttgcgtggccaaggacatgggcgcgggcgactgcgagtacgccatcgcgttccaggagcgcgtcaagatccccgacgacaagatggtgtactacgaggagcgcgcggagatgtacgtcggcgacgacgtctctcccgacttctacggctgggtgttccccaagtgcgaccacgtcgccgtcggcaccggcaccgtcacgcacaaggccgacatcaagaagtttcaggccgtcacgcgcctacgcgccaaggacaagattgagggcggcaagatcatccgcgtcgaggcgcaccccatcctcgagca

SEQ ID NO: 37326 - DNA, 270 bp, Zea mays
  Clone ID: LIB3060-030-Q1-K1-D10
gactagttctggaggaggactagctaggtttatgtataagctttggagggtttctacgttcctgcttttgtaataagttatgcactttgagtatatcagtacttgtaataaatattattctttcaaaacatgtaaaacttgagttttgaaaaggtaaagaatgtttgtaaaaaaaaaaaaaaaaaaaaaaaaaaaaaaaaaaaaaaaaaaaaaaaaaaaaaaaaaaaaaaaaaaaaaaaaaaaaaaaaaaaaaaatataaaaaattaaaa

SEQ ID NO: 37327 - DNA, 404 bp, Zea mays
  unsure at all n locations
  Clone ID: LIB3060-030-Q1-K1-D2
gaatgtgcaaaggccgcgctggatccttctgtagaacttcatgtagaaggtgtggtcttaacggcgccagctattcatgttcaaccatctcatccaatcatcaaagtaagcaatagatgtttgtcttcaacgaaacaataccctngttgttttctgggtgacgccatccttctacacgaagtcctgaaggaaaatggcttgcattgtcaaattggtccttaatttaatgattaaatggaattaaccagcctttttaacctgccattcaagggaaaattgaattttccatgattcattaacattcctggttctattagatccagaaaccattttgtggtaagtcttacaccagaattgcttgttgacttgagcacaaaacccattcatttaatggtcctctttaa

SEQ ID NO: 37328 - DNA, 114 bp, Zea mays
  Clone ID: LIB3060-030-Q1-K1-D5
aagaagacgagtgtcaagtgaacctgaaacttgcggtgtcactggctggtatagcctgagtgtgagtgagtgatcgagctagctgagctccgatcctcgctagctagctaggat

SEQ ID NO: 37329 - DNA, 201 bp, Zea mays
  Clone ID: LIB3060-030-Q1-K1-D7
cgtcgtgctccattaatattggcagcaagctaggatcatcagcatctgagcttatatatgactagatcgatcggttgccaaatggcggggatgacagtcggcaataagctggcgctggctgcggtgctgctgtccccggcggcggccatggccacggcgcagcaggcctccggcgtgcgcgcaacttacaacttttacaac

SEQ ID NO: 37330 - DNA, 393 bp, Zea mays
  Clone ID: LIB3060-030-Q1-K1-D8
gaggcacgcggattaagacccgcatgcggaatattgcagctcctttggaccctgcatgattctgtgatgcaattgttcagatctatttggataatggtggagacctggaacttgtcgccaaaagtatcgagtcttcagacctcaacttctcacgttacggtgacaccttttttgaggtggtttttgttggagggcgcactcagccaggcactgtacaacctgaagaacgagaccgccacccttattcggtgttagattgtgcgtcacagcgtggaagcatttttgccttcggactcaatatccagaaacctttgcccaggaggcctttttaattaaggatcctggaaatggtaatgcttaattcctggcattcttggaagtccttgaaggaaa

SEQ ID NO: 37331 - DNA, 407 bp, Zea mays
  unsure at all n locations
  Clone ID: LIB3060-029-Q1-K1-H7
ctgcttgctctggggggaaggagagagagagagcgagagagagagagagatctagtggagaggctagtaggtggtcctcgaacgaagatgttggcggtgttcagcgggcaggtggtggaggtgccggcggagctggtggcggcgggcagccggacgccgtcgcccaagacgaaggcgtcgcagctcgtggggcgcttcctggccgcgtccgagccggccgtgttcgtgcagctcggcgaccacggccacctcgcctactgccacaccaaccaggcgctcctccgacccaggtcgttcgcggccaaagacgaggtgttctgcctgttcgaaggggtgctggacaacctgngtcggctgagccagcagcacgggctgtcaagcatgggcgccaacgaggtgcttctcgt

SEQ ID NO: 37332 - DNA, 415 bp, Zea mays
  Clone ID: LIB3060-029-Q1-K1-H8
ctgctccttgcttcttccttctctctctcacttgccgtggaggcctcatcgtatgtgtttcgttcttcagaagtttagagcgtccctatctccttccctctgctctgatttttccagcagctggtttccccggatattcttccacgctgcgccgattagcacctggatatgttctccagcgcacagccttatcctgcagccgccctcgcctgattctttgccagccgccgctctgggcgattaaaaatcctgctcgccggccggatctccggcgtcgtctgcccctgcttcccttggcgttcttcccccagtcgtctccttcctctgctcgtcgctaaaattcgctggccgcgaatgcccatggcgcacccccagtccctgctgtctctctgtctctctcttatccatggacgcg

SEQ ID NO: 37333 - DNA, 380 bp, Zea mays
  Clone ID: LIB3060-029-Q1-K1-H9
cggtcgcccacgcgtccggcaactacggccagcacggccggatctccattgtcaacgacctgtggtacggcccgggccagttcaagtacctgggccccttctccgcccagacgccctcgtacctgaccggcgagttccccggcgactacggctgggacaccgccgggctgtccgcggacccggaggcgttcgcgcggaacagggcgctggaggtgatccacgggcggtgggcgatgctgggtgcgctgggctgcatcaccccggtagtgctggagaagtgggtgctcgtggacttcaaggagcccgtgtggttcaaggccgtctctcagatcttctcggatggcggtctggactacctgtgcaaccccaaccctgtgcac

SEQ ID NO: 37334 - DNA, 395 bp, Zea mays
  Clone ID: LIB3060-030-Q1-K1-A10
ccgtaggaccgtaccctcagctagtcagctttctccatccaccagaccagaccatacgagaccggaccagaccaatggccctgcgcctaccaatctcatcgtcccacgggctggcctccacgccggcgccaatctccacgacgacgtgccggccggccgtcttggcgacggccgcggcccagaagaggagcctgctgctggcgacggcctccgagacgaggggagtcgcgccggtgaggtccagcgggatcgagacgagcacggtgggtctgggatgtgaggccgtcaccgggcaggtcacggaggtcaacatggacaccttctggcccatcgtcgaggccgtcggcgacaaggtcgtcgttctcgacatgtacaccgaatggtgcgggccttgc

SEQ ID NO: 37335 - DNA, 400 bp, Zea mays
  Clone ID: LIB3060-030-Q1-K1-A12
aatcaatcatgattctattttttatgaaaacaatgcaaaatatctaaggaaaatctggagtatgtcgcccctaactgcacgcgcggcctagccactgacgtggctccagtgcctataggtgacgccggtcataacaacaatactcaagagattcattgcttcagctgcacaccatatggatccttcattccctgcagcttgtaaaaccttgtttagtttaggaaacactccattgataaaactagaccgatcctaaaaggaataggtggctttattatatcagtattaagaagaaaataagcactcaaattcacctctaggacttgaacctaagtgttgtgggcgttcacaccctcaaccagctaggctcagcttccttgtctctttcgtgggctctatg

SEQ ID NO: 37336 - DNA, 439 bp, Zea mays
  Clone ID: LIB3060-030-Q1-K1-A3
cggacgcgtgggtggcgctgggccttctgggttggcacctgcattacagaatgataggcaaccaggccctgaggaagcaaggactagtggttggtcatcaatggatcggcgtcgtgccccactaccaattacaagtgtggggacattatctaagcagaaagcaccggtagggaatgatgctattgtttctagagacgctgtgatatctggaccaaatttcttgggaaggtcaagtggatcttcaaggaagcctggtatctcgagtagccgcgatgccgtggtcaccgatagttccgagccttcacgagcgcgcacaactgatgcaagccctggggtgttccgcagagcctcaagtcctcagagaagctcacctgtccactctgcagaacagaagcgctcattctcaagccgtcatccatctaatgcgaagaactacgat

SEQ ID NO: 37337 - DNA, 267 bp, Zea mays
  unsure at all n locations
  Clone ID: LIB3060-030-Q1-K1-A5
ccggatccgagctaggcacccgcacgaccactcgcctcctgccggtcaccgggacctagcatcgccgggcggcggcggnggaggggaaggtaggcgatgaggaaacgtgagcgggagaatccgtgcgggatctgcgggcactaccacaagtacgaggagggggaggtatgcggngtgtgcggccaccgctggaaaccgtcggacggggagggcgccccgtcgaggcacgagtccgncttccccacagaagtgctcaaggacttcctc

SEQ ID NO: 37338 - DNA, 301 bp, Zea mays
  Clone ID: LIB3060-030-Q1-K1-A7
gtgccttctcacatcgcaacccccgctgcccgcccgctccacgcttgccacgccggcctcgctggccacctgccaccagagacgctgctgcgggccgagtccacaccacagccggcatggaggctgcggcggcggcgccgcatctactgcactgcggcggcttcggccgcgtagcgcaacctccaacgcttcaacggccagggcaggtcccacgccttcgggccggcggcaccgaacccaagctggccaacttcaacttcttcttcttccgggggaaggaccagaacccgaatggactttt

SEQ ID NO: 37339 - DNA, 333 bp, Zea mays
  Clone ID: LIB3060-030-Q1-K1-A8
cgcggaccaggccaagctcgagctgcaggaggtcgtggatttcctcaagaaccccgacgagtacgagcgcgctcggagccaagatccccaagggttgtctcctcgtcggcccgcctgggaccgggaagaccctccttgcgcctgccgtcgcttgggaagcccgggtgcccttcttcttctgggctgcctcttaattccgcgagctcttcgtcggtgtcggtgccttcagggtgcgcgacctttttgagaaggccaaggccaaggcgccctgcattggcttcattgatgagattgatgccgttggaaggcaactcggtgccggacttggtgggg

SEQ ID NO: 37340 - DNA, 340 bp, Zea mays
  Clone ID: LIB3060-030-Q1-K1-B1
acccaggccaaaccagacaagcaaggaatccttcgatggctcatcgcgttctcctcctcctctcgctcgcgtcggccgccgcggttgccgccgccgtcgacgcggaggacccgctgatccggcaggtggttcccggtggagatgacaacgatctggagctgaacgcggagtcccacttcctgagcttcgtgcagcggttcggcaagtcctacaaggacgccgacgagcacgcgtaccggctgtccgttttcaaggccaacctgcgccgggcgcgccggcaccagctgctggacccgtcggcggagcacggcgtcactaagttctccgacctcacgccggc

SEQ ID NO: 37341 - DNA, 182 bp, Zea mays
  Clone ID: LIB3060-030-Q1-K1-B10
agcaagaagagaaccagtgtgctagtgctactgctacggcctagctacctactacgagtcagcgagcagcggcggacatgagcggcgggcgcgaggagagcaccagcagcaggtggccagagctggccgccctgcgcgcgctggcgcgcgacgcggcggcccgggccgggagggagacggcg

SEQ ID NO: 37342 - DNA, 379 bp, Zea mays
  Clone ID: LIB3060-030-Q1-K1-B2
caaatcgaaccgcgggcagcgcgcacgcgcattgactgccggcgatggcgagcctcaccctgccgccggcgccccccaacccacgccaggacgccatcgacctccacaaggccttcaaggggtttggatgtgacagtacaacagtggataacatacctactcatcgcgatccgtgccacgtggacctcatcaaccaggataccaggcctatggattaatgagaacctttccaaccgaattcaatttgacctaatggaaaccaccagaaaacctatgcccttgggaatcctgaaccctgctgaacttaatccaccggtttgaaaagagcctttaatggggacccttttgaacttaaaaccaccccctgaaataatttgtc

SEQ ID NO: 37343 - DNA, 364 bp, Zea mays
  Clone ID: LIB3060-030-Q1-K1-B4
gctccagctatgtggactctggaatgcatttctgggcttccagatacattgagagctgacttacataagaacatctttccatcatggcatccagtcaataaaagtgctacccaacaattcaagctcctcaagatctgtgtagtcaatacccatcagcttcaagaaaagccaaatgccatactctggtatccttcctctatgccttaaatctaatcaccaaaaccttaaccagaaaccagttcagaacccttcccgtccttttaaaccttattaaaccctgttgaatttgtccaaaaggataaaccgtccttcgaaagctgttaatataacctgttaacaatcatgtaatgattatcctgaccaa

SEQ ID NO: 37344 - DNA, 378 bp, Zea mays
  unsure at all n locations
  Clone ID: LIB3060-029-Q1-K1-G10
ctcacagtctcacactcaacactgggccccaagccgtacggaccgcccctaccttaacccttggattggaagccaaaacaggacctccgttggttccaaccgcttcctgggcttccttcgccccgctccgcatcccgccggagaaacagtcgggcctctacggccttcgagcttgacgaggacgacctcttctccgcaggatccggctcgcccgagccgccgcagccgttgcgccgtccactcatcctgtcctccgtccgccctgcaaaccctagccctgttccacgcctacgccgtccgccggagggcatcctggacgcccttcccgagcgccgtcgctcgccgnctcagtcctcttcatccacgtcctcgtccccc

SEQ ID NO: 37345 - DNA, 423 bp, Zea mays
  Clone ID: LIB3060-029-Q1-K1-G11
cctgccgctaaccctagtccagcacccgagatctactccgcgcaaacagccatggcggagacgctcgacatgaccctcgacgacatcatcaagaacaacaagaagagtaacccctcatctcgcggggcccgccgcagccgcggcggatccgcccctggcggcgggaccggcggggtcgggccgaccaggcgcccctttaaaagggctgggaacaggcaggcgccctaccagccgccgaaggcccccgacgctgcgtggcagcacgacatgtaccctgcggtcgccgcaggaggcggcggcggcgggagggtctcggctctcgagacgggcgccaagctctacatctccaacctggactttggggtttcgaacgaggatattaaggagcttttctctgagctaggtgatttgaagcgtttttcg

SEQ ID NO: 37346 - DNA, 317 bp, Zea mays
  Clone ID: LIB3060-029-Q1-K1-G12
gactagttgtaagaacccttatcctatctttctaatatatatcgatgcctcgttcctcggactggtccaagaaaaaaccgggcatgtaaaaacctcttaccggcctaggacgtccttcatgttacttggggacttcaacgatgcatggaatgattttgagaagatgattaccattgacaaatcatcagaacaggacgctacatccggactccctaaacttaagcagaaagaacacgaagccgaaaagaaagcgaggaagcaattcaaaggactctttgacaagaagccatgagagatatccgaagttggtgtagaat

SEQ ID NO: 37347 - DNA, 338 bp, Zea mays
  Clone ID: LIB3060-029-Q1-K1-G4
ttcgtctcttgccttcggcgccttgacttaccgcctgcttgccctgctcctggggctgccttttctatcgcctgcttgtgcctctgcacgccatggctcggggcaagaattcggacaagacccgattgccgtagtatgtcctgcaaacattcggcttcaatgtcccgtcctgctgtccctatccgtccgcagaagtctttcaatcgccagacatatgtgcatagaatagacctaagatcaagcctattcgacatggtgattcacgacccgtctgatcaacttccgttatggcgcccatcttcacaaggaatggagccgctccatttagatcatcccct

SEQ ID NO: 37348 - DNA, 427 bp, Zea mays
  unsure at all n locations
  Clone ID: LIB3060-029-Q1-K1-G7
cttttggatgcgcgcgcctagctgaccttcctgtgtcacgccccgactttgcccaacgccccgccgagctcctccttcgcccatggccgcggttctccaagttcccctgcgcgcgagctctacgcgcgcgaatccgtcgtcgcgtcttgttctctggcggtcgagctcgcccagctctgttgccatgtccctgttcctcggttcgcggcgcccatgtcaaagctccctgcgctcgcccatgtcgtgcgcccgagctcccctgccgtgctcctactgcttcctatgcgcgtagccgtgtctactccttcctcgccgtagtccctgcgcgcgtcgagctttcgtgtcgagctgttgaacatgtcctnccttgcttgtgactntgtcgtcgctagaaccctgactagattcgtgtcattcgcagctcgct

SEQ ID NO: 37349 - DNA, 345 bp, Zea mays
  Clone ID: LIB3060-029-Q1-K1-G8
aaagccaaaaggcatcaccgtcgcgactacgatggcagcctcgctccaagccgcggccaccctgatgcagccggccaagatcggcggccgggcgccctttgcctcgctgccgtcccgcccgtcgtcgcaactcgcctgcagggcgttcggcgtctacgccggcgccgtcaggatcacgtgctccctgcaggacgtcgccagcaggtgcgtcgacaccgcgaagctcgccggcttcgcgctcgccacctcggcgctcctcgtctcgggcgcgagcgcggatggcacgcccaagaggctgacctacgacgagatccagagcaaaacgtacatggaggtgaaaggcac

SEQ ID NO: 37350 - DNA, 386 bp, Zea mays
  Clone ID: LIB3060-029-Q1-K1-G9
atggccggcacccccatcaaggtgggctccttcggcgagggccgtatcaccatgcgcaagaccgtgggcaagcccaaggtggcggcgtccggcagcccctggtacggtcccgaccgcgtcaagtacctcggccccttctccggcgagcccccgagctacctcaccggcgagttccccggcgactacggctgggacaccgccgggctgtccgccgaccccgagaccttcgccaagaaccgcgagctggaggtgatccactcccgctgggccatgctcggcgcgctcggctgcgtcttccccgagctgctcttccgcaacggcgtcaagttcggcgaggccgtctggttcaaggccggctcccagatcttcagcgagggcgggctgga

SEQ ID NO: 37351 - DNA, 427 bp, Zea mays
  Clone ID: LIB3060-029-Q1-K1-H1
ccgccgcccgcacacgtctctcctcttccgttcctctcctgcctccagctctccacggtctctgacccgcacaactgaacccgcgatggcgcgccgcctcctcgtcgccctcctcgccgcgtcgctcctgctcccgctcgcccgcgcggactcctcctcgtccccgcccgacaccaccgcgtacgacgagctccgcctccggggcttcccgcgcggcctgctcccggccaacgtgcgggcctacacgctcgactccggctccggggacttcgccgtcgacctccgctccagctgccggatcgtgctgcccgcggggagctacctcgccgccttcagcgaccgcctcacgggccgtctcgacgaccgtcgcatctcgggcctcgactgcatccgcgtcagggccctcttccgctggtggtccatcacg

SEQ ID NO: 37352 - DNA, 428 bp, Zea mays
  Clone ID: LIB3060-029-Q1-K1-H12
gggcttgcgtgctcgcgcgcgagctctcgtggcgcagcctcaactaggcgaccgccgtcgtccctacgccacgtgcgcgagtctagcctcgtcgattgcttccccagtttaattgatctacaagcttcagaacatgttcaagaatacatttcagtctgggttcctgtccattctttatagcctcgggaccaagccattgcagatatgggataaggaagttgtgaatgggcacattaaacgaccccaagatgaagatatccaatctaatgtacttgaaattgttggaacaaatgtacagtcaacttacatcacatgcccagctgatccttctgctactcttgggattaagcttgcatttctggctattattgcgaaaaatcttaagaaatacttcacgtttgagatccaagttctggatgacaagaatg

SEQ ID NO: 37353 - DNA, 376 bp, Zea mays
  Clone ID: LIB3060-029-Q1-K1-H2
ccggttccgggctcgagccacgcgttcgccgccgtgcgcacacgtctctcctctttcgttcttctcctgcctccagctctccacggtctcggacccgcacaactgaacccgcgatggcgcgccgtctcctcgtcgccctcctcgccgcgtcgctcctgctcccgctcgcccgcgcggactcctcctcgtccccgcccgacaccaccgcgtacgacgagctccgcctccggggcttcccgcgcggcctgctcccggccaacgtgcgggcctacacgctcgactccggctccggggacttcgccgtcgacctccgctccagctgccggatcgtgctgcccgcggggagctacctcgccgtcttcagcgaccgtctcac

SEQ ID NO: 37354 - DNA, 303 bp, Zea mays
  Clone ID: LIB3060-029-Q1-K1-E3
ccacacgagtcgacactcgacttaagcccgctaaccgctcccctatgttccgtccccatattctcggggacctacccggcaactatcagctcaacaatagcgccgcaaaaccaccggctcaacatcatgccaacagtaaccacactcgccgtcatgaaggcgctgctcgtcagcaccacccgcggccacgcgctgttgaagaagaagtccgacgcgctcacggtacaactccgtgccatcctcaagaagatcgcagccgccaaagagtccatgacccagacaacgcgcgcctcctacttctcc

SEQ ID NO: 37355 - DNA, 422 bp, Zea mays
  Clone ID: LIB3060-029-Q1-K1-E5
ggagagtggcagtgctaggtttgggcttgaggacgtcattaaggaggttgtgggaagccagagaagggcagatggatctggtgagcccggggatagcatggaggtggacgagcagaaggcaaaagaagttgggatagagttgcctcacgcaactgatgtgctgcacaaaaacgggtcagatggactagaaatgaacgatgtttctggattgcgcactgttggaatcctgaatacatcttctgcgaaggaaagtgacgttcatagtttatccaataagatgaaacatcctaatatttccagagagcagcaaacaaggacaagtaacagtaatgctgctcaccatgcaacaaatagtattactgatcaaaccacagctttgccagatgctacaattcgcatcatcaagaaccagcttacgacag

SEQ ID NO: 37356 - DNA, 398 bp, Zea mays
  Clone ID: LIB3060-029-Q1-K1-E6
tagtgtgatcaccattagcctgtgctactcccccttccttccatgcgtccgtgtcatgcgtcagcaccttccagagctgccccattgccagaagagcaaagatcaacaccaggtccaggggcagcatcagtagcgtggcgaaggggtcaccaccaccagccttccatttccagtgcatggcgtcgactttcgcggcggacaccagcctacggctcgagctggactagaaccccgaggcgatcatctcgggggcgttgcccgggaactgctccctcctcagctacaacgacctccgcgcctacctcgagtcgcacgagacggcggcccatgcagacagtcatcgcgtcgtggcgctcctgatcgagaccatgttcacacccgttctggtggccacagca

SEQ ID NO: 37357 - DNA, 414 bp, Zea mays
  unsure at all n locations
  Clone ID: LIB3060-029-Q1-K1-E7
cttagcgaccttctccctcgaatttttccttcgtgcttagcgtagcggtagcgccgatcctgttcctgtgccgtgccggcttggaaaataggagggagaagatcaacgccgccgcggtgcggcctgtggagtattaaacaaagatgcgcagagccgcagagcccggcgccggcagctagcagccaacgcgaaacaaaccatcgtcacccaatagccaccggccaactgtcaagcactccttcggtgcttccccatctgcgccgcgccccgaacccttcggaccccgcgagcgaggccgtcgccggcgcgcgcgagatttgagctgaggccatggagtcaccgttccgggccgacgtggtcaaggacaaggcggcgctggtcaccggcggnggatccggcatctgctttgagatc

SEQ ID NO: 37358 - DNA, 385 bp, Zea mays
  Clone ID: LIB3060-029-Q1-K1-E9
cgacgggctcctggtctgggactccatcaggcagtgggcgtccgagtacgtcaacgtgtactacaagtccgacgaggccgtggccgccgaccccgagctgagggcgttctgggacgaggtgcgcaacgtggggcacggcgacaagaaggacgagccgtggtggcccgtgctggacacccgcgacagcctggtggagacgctgaccaccatcatgtgggtcacctccggccaccactcggccgtcaacttcggccagtaccacttcgccggctacttccccaaccggccgaccaccatccggaagaacatgccggtggaggagggcgggccgggcgaggagatggagaagttcctcaagcagccggagacgacgctgctggacatg

SEQ ID NO: 37359 - DNA, 432 bp, Zea mays
  unsure at all n locations
  Clone ID: LIB3060-029-Q1-K1-F1
ccagagtatgctcgaggtggacacgcatcaacatgcggggatgtttacagttttggaatagtgcttctagagatgcttacagggagaaggccaactgatcatgtgtttgtggacgaactaaacattgtcaaattcgtggagaggagcttccctaataaaatattggatgtgattgatggttccttatgtgatgacttcaagagtgcccaaataaacatggtaacagagcgtgagacctaccgatgcttgttttctctactgcaagtagcactttcttgcacacgtgagattcctggtgaacgaacgaccatggaagaagcagctagcagaattggttcaatccagaccacatatgctagaggaattgaaaacgcaagcaggcattgaatngaaaccatctctatgttgagcgaacatacgtggggatggaca

SEQ ID NO: 37360 - DNA, 349 bp, Zea mays
  unsure at all n locations
  Clone ID: LIB3060-029-Q1-K1-F10
gagctcccgctttttacgatcttttcttcctgtttgggaccgggccgcggccttgggcgttggacaagggccgtcggccggtggaaactgaacccagccccgacgcacctgccggcggcgcctgggctgctccagtctgtggaaaggcgacgaaccaactcgggggaattctagtcttgaggccgccgnctncgccttcagccctccaccgacttaactgtctggaactggaagtgtaccactactattcaattggccctagccctcgcatagcacgatgccgtcgccgccggttgagttcgcgatcctcgccgctgcctgcaggttcaacaagccccttaccgttctc

SEQ ID NO: 37361 - DNA, 258 bp, Zea mays
  Clone ID: LIB3060-029-Q1-K1-F12
catcggcaatgcttccttggtggtgtgctccatcggtgcaagcgagaaggagatcctggatgtcaccggcccataccgcatcgactacatggccaccaacaaacttgtacaagcttcgactgctgccaagcaagtggagcacttcatcctggttacatccctgaggaccaacaagatcggcttccctgcattcctcttgaacttgttctggggagttctgctctggaaaagacgagctgaataagcactcatcgcaag

SEQ ID NO: 37362 - DNA, 419 bp, Zea mays
  unsure at all n locations
  Clone ID: LIB3060-029-Q1-K1-F5
acactcccgcagcactttccgttgccgccgccgccgcagcccaaccggaaggacaggaggaagangccggcggcgcacgggccncggccgcggacccgcgaccagaccgcgcggccgcaccgcaagaagggcgacagcccgcacaccacgaaccngcgcaccnacaagaacggcgactacgtcgacgtcaaggtgaacggcgccgtgcacaagggcatgccgcacaagttctaccacggccgctaccgtcgcgtctggaacgtcaccaagcgctccatctgcgttgagatcaacaagcatgttaatggccgcatcatcaggaagcgtatccatgtccgtgtggagcatgtgcaacccttcccttgcacatgagagttccgtttgatgaaagccaagaacgatcagttcaaggttgatgc

SEQ ID NO: 37363 - DNA, 390 bp, Zea mays
  Clone ID: LIB3060-029-Q1-K1-F6
ccgttaccttctataatacgtctgcggtgtcaaaatttccctctcagccgtgttgctcgccgccgccccgccgtgttgctcgccgacaccgccccgccggcagccaaaatgccgttcaagaggttcgtggagatcgggcgagtggcccttgtaaactacggcaaggagtatggccgcctcgtcgtcatcgtcgacgtcgtcgaccagaacagggctcttgttgatgcccccgacatggttcgttgccaaatgaacttcaagcggctttccctgactgacatcaagattgacattaaacgtgtcccaaagaagactacactgatcaaggcaatggaggaagctgatgtgaaaagcaagtgggagaatagctcatggggcaagaagctgatt

SEQ ID NO: 37364 - DNA, 416 bp, Zea mays
  Clone ID: LIB3060-029-Q1-K1-F7
acgatcgcgagcgcaagcacgtacgttgtcggaagctcaagttagaagaagcaccagtgcctgatcgatggcggcccaggctctcctctccggccggcagctgctgggccgccccgtgcagtcggccgtctctaggtcgtcggcgaggaaggcgcccttcgtcgtcagggccagctccagccctccagccaaggtctgtgcgccgtaccctactatagctagtaatccgtccgtcgtcaatctcaacgatggcaagctcgttcgttcttgagaggactacgtactgctgagtgctgactcgattgttttcgtttcgcagcaaggtgccgacaggcagctgtggttcgcgtccaagcagtccctctcctacctcgatggcacgtacgtacctgcgctcgttgcccgccccgcgcgca

SEQ ID NO: 37365 - DNA, 397 bp, Zea mays
  Clone ID: LIB3060-029-Q1-K1-E12
cagatggccaccgtcctgagcagcccctctgcgtccgccttctccttctcccttcgggccgggccagcgcccactaccggggccatgacccgtggcggtggcgccagcagcaggctgcgcgcgcaggccacctacaacgtgaagctcatcacgccggagggggaggtggagctgcaggtgcccgacgacgtctacatcctggactacgccgaggaggaaggcatcgacctgccctactcctgccgcgcggggtcctgctcctcctgcgccggcaaggtcgtctccggctccctcgaccagtccgaccagagcttcctcgacgacagccaggtcgccgacggctgggtgctcacctgcgttgcgtaccccaccttcgacgtcgtcatcgaaacgcaca

SEQ ID NO: 37366 - DNA, 278 bp, Zea mays
  Clone ID: LIB3060-029-Q1-K1-C5
agctcatcgatgcgacgctcctcggagagcagcgcctcctcctgcgcggtcttctttggcgcgagggcgggcgggacggagggcgccgaggaggaggcggcggcggaggagctagggttagggttcgccgccgccgtctgagctgcggcgtcgaggttgctggggtcggaaccggtagcagctgcggcggaattcgcggagaccgccgacgtgccggccttggcgaggacctggcggtgctcttcgcggcgcttctggagctgcttctgctccagctc

SEQ ID NO: 37367 - DNA, 427 bp, Zea mays
  Clone ID: LIB3060-029-Q1-K1-C6
agcagaccccagcagaagaagcgaagtcgtcgccggagcaggaggaagagcgagcagcaagatgtcgtggcaggcgtacgtcgatgaccacctgctgtgcgacatcgaaggccagcacctcagcgccgccgccatcgtcggccacgacggcagcgtctgggcacagtccgagaacttccccgagttaaagcctgaggaggttgctgggatgataaaggactttgatgaacctggaactcttgcaccaactggtctttttgttggaggtacgaagtacatggtgatccaaggtgaacctggagttgtcatccgaggaaagaagggcactggaggcattactatcaagaaaactggcatgtccttgattatcggtatctatgatgagccaatgactccagggcaatgcaatatggtggtggagaggctc

SEQ ID NO: 37368 - DNA, 386 bp, Zea mays
  Clone ID: LIB3060-029-Q1-K1-C8
ctgttaagctagctatccttgcttactcccttcactttcttattgagagctctctggcgtgctgtaccggacgacaggggttggtaggtcgtaggtgtagctagctcggctagcgagcaatccggccaacagcacacgcgtcgatcgccatgccgagcggctgcggcaatggcgttggcagtagtcgcagtagagtgatgcccaacctgccggccggattgcgcttacaccagactgacgaggagctcatggtgcactacctcatgaggcaagccgacttcttgccgtgcccagtcctcatcatcgccgaggtcaacatctaccattgcaacccctgagatctccctgccaaggcattgatcggcgacaaggagtggttattcttc

SEQ ID NO: 37369 - DNA, 391 bp, Zea mays
  Clone ID: LIB3060-029-Q1-K1-C9
gttgaggaagttgatgagaatccaatctctccgttgcaatgcattatataaccacagcgctaccagattatctgtagtccctatccacgcatcacgctctcaggccctaaggtacctgtgtatacgattggggatagaagtgccaaatgttgcagtcctcgtgggtgaaagcggcgattcagattacgaggaactgctggggggtctccataggaccgttatcctaaagggcgagttcaacatcgccgcaaacaggatccacacggtgaggagataccccctgcaggatgtcgtcgccctcgatagctcaaacatcatcggtgtcgacggctacaccacggatgatctgaggtctgccctgcagcagatgggtatactggcacggtaacac

SEQ ID NO: 37370 - DNA, 427 bp, Zea mays
  Clone ID: LIB3060-029-Q1-K1-D1
gctgcccgcggtcttgatataccaaatgttgatttgattatccattacgaattgccaaatgagccagaaacttttgtccatcgttctggacgcactggacgtgctgggaaagcaggaactgcaatcttgatttaccagcagccaaaaaaggacagttaagtcacttgagcgtgatgttggttgcaagtttgagtttataagccctgcgtccatagaagaagtgctggagtcatctgctgagcatgtcattgctacattgcgaggggtgcacccagagtcaactcaataactttttggagcagctgagaaaataacagatgaactaggaccttatgcccttgcttctgcacttgcacatatgaattgattttgtcagacaccttattcacgttctttgatcagttatgagcagggatgggtgacattg

SEQ ID NO: 37371 - DNA, 411 bp, Zea mays
  Clone ID: LIB3060-029-Q1-K1-D4
gagtcctcgttgtgcctctcttgatctcctgtggtccatggttccggtccaaggtgccaagaaaaggaaccggccggagaagcccgccccggcgcctactccagggttgccgctgccgccgctgccggacggtagcgattggtggggcgtcttctaccgaagggttgcaggacattccccttttccaagagaacaccagaacatggagtctgtcctgaagatgtcaagaagaaccttcgactacatctgctcacttgttaagaaggacctgacaacaaagacatacggtttcagaaacttcaggtttggtgacaagaaagtccttggggtggaggatcaggtggcggtggctctgatgaggctgactactggtgagtcgctgcagaacataagaatgtgggttggcatgaa

SEQ ID NO: 37372 - DNA, 411 bp, Zea mays
  Clone ID: LIB3060-029-Q1-K1-D6
ggagaagagagaggagaattttcaatgctgccgcgcaccgtcatcactagctagtggaggggcggacgagaaggcgaggagctgaggggagagaggcttcacagagcttgcttgagcctggagggggctgccgctgtttgtctctccactccacccaccagcagttacctcgggagggcatggcaaaatctggtgcctcctttccggagtccagttggatggagagggatttcctggccgcgatcggcaaggagcagcagcacccgcacaaggaggaggcaggcgcggaggaatctgcttacttcggcggagcatgagcagcagcagcagccccggcaatggactggtccttcgctagcaagcccggcgccgtcccggcgttgatgtcgttccggtcagcttcgttccccc

SEQ ID NO: 37373 - DNA, 428 bp, Zea mays
  Clone ID: LIB3060-029-Q1-K1-D8
cttaattgcaagtccacggatacgcttcaacaaggaaggaactcttttggctgtctctaccgttgacaatggcatcaagatcttagcaaatgctgatggacttcggttgctgcgcacgctggaaaatcgttcttttgatgcttctcgtaatgcatctgaggctgtaacaaagcctctaataaatcccttgactgctgcggcaaatgcagctgcagcaagcagttcaggagctggtgctccgtcagctgtaactgcaatgaatggggataccagaagtttggttgatgtaaaacctagaatagctgatgagtcactggacaagtcaaaggcgtggaagcttatggagataactgagtcaactcagtgcagatcaattaaactggcagacaacatgagaacgaacaagatctcgagattgatttacacaa

SEQ ID NO: 37374 - DNA, 399 bp, Zea mays
  Clone ID: LIB3060-029-Q1-K1-D9
gtggcgccgacgacgctcgctccgactttactgcggcagaagcggtggagcggggtcgactgctgcctatgggtttacaggctctgcccattcttatttggacgactgggcaaaaccactttgccgcaccagatgggctactccatctacgggctatgggcgcccaactcggtgtctactctgtactacgctggcttccgttcactgagcctgctcaagggcacccctatgttccgtgagctcacgattccgtggatcgagcctttatactacgtcgcggtcgcctagaacgtctacagtgcgtgggaagcgctgtggcgcggagacacgctgagagggtagtggaacggccagatgatgtggctggtcctgaaaacgacctggtaactttacgggttc

SEQ ID NO: 37375 - DNA, 400 bp, Zea mays
  Clone ID: LIB3060-029-Q1-K1-E11
cgacggtcttccctcacaagattggcccagccgaggagacattgatgtgaaagatctgaaggttcggtatcgtcaaaacacgcctctaatcttgaaaggcattactgtgagcatcaaaggtggagaaaaggttggagttgtgggaaggactggcagtggaaagtcgactttggtgcaggctttattcaggatcgtggagcctgcagatggccatatcatcatcgatggtgtcaacatctgcactctggggcttcgtgatctgaggtctcgcttcggtgtgattccccaagaacctgtgctcttcgaaggaactgtacggagcaacatagacccagcacggcggtattccgaggctgagatatggcaagccctcgagtgctgccagctaaaggatatagta

SEQ ID NO: 37376 - DNA, 429 bp, Zea mays
  Clone ID: LIB3060-029-Q1-K1-A7
cttagggatcctaatttccagctggatgcattcagataccgaacgtctcggttgctacacagtgtcgctgctcggctacagaaacacagcaagacgcttggaggtttcggtgcgtggaatagatgtctgaaccatctgcttacgcttgcggaatcacacatcgagtccgtcatacttgcaaagttcattgaatcggtgaaaagctgccctgacgaaaaatcacgggaagtattgaagctggtatgcgacctttatgcgctcgacaggatttggcaagatatctgaacgtatcggaatgtatactacgttgccccaaacaaagctaaggctattcataagctgacagactacctgagttaccaagtgaagcttgtggcgcgagaactcgtctacgcatttgaccttgcagatcttatcatccgtgcccca

SEQ ID NO: 37377 - DNA, 406 bp, Zea mays
  Clone ID: LIB3060-029-Q1-K1-B10
gaagaaaaagcgcgtaactgatgaagacttagtagcgttattgtcggatgagatattgcagcctaaggttatttggtcccttgctgatgtacaggcaacatgtggtacacttgctttatctacggcaacagtgaaattgatagcaccagatggagaggagaaaatagcatgttcagtcggaacaggtccagtcgatgcagcttacaaggctgttgacaaaataatccagattccaacggttctccgagaatacagtatgacatcagtcacagaaggcattgacgcaatcgcgacaactcgggttgttgtcactggagatgtgagcaacaacgccaaacatgccctgactggccagtctttcaaccgctccttcagcgggagcggtgcatccatggacattgtggtg

SEQ ID NO: 37378 - DNA, 405 bp, Zea mays
  Clone ID: LIB3060-029-Q1-K1-B11
cagtcgcgtgcggaactagagctccttcagagaagtgccgtgccagtgccaccgccggccgcatcatcgttccgcccccctgagtgttcagtaacttcttccgatccatattatggcttcaaagcagcagcagaaacagttcctggatgaagccatgatcaagcagccgacaccggaggaggaccgtgagggcgcatggccctcagtgctgacgatcatcggctttggattcctaaccttcaactcattcatggctgtgtacaggtcaaatggagatgttggatctatctcctttgtggtcttctcttacctggtcctcgttctgctgttctactgcctgcgccgattcgagacaactccaccagagtcgcctagccgggagcacataaaaatggccgtgtgggt

SEQ ID NO: 37379 - DNA, 389 bp, Zea mays
  Clone ID: LIB3060-029-Q1-K1-B2
aggtcctccactagctaagctagtcgttactcccaatctcagagcgcgccgtcggtcgccagcgcggccaagaacagtgctactagccaagaaagctggggaacaggctgcttccttggacgaggagcaggaagacaagggatctggagccggagccccgatggcggtgacgggaacctcggtggcagcggcggcgacgatgctggcggcggcggcagccatcttcatcaccttcgtgatctgcttctacctcttcctgtgcgcgaagcggtaccgcggggccgtcccgaccatcggcggcgacagggcccggccccgcttcgtgttcgcgggcggcgcggggtgccacggcgggctggacgaggccgtcatcgcggcgctgccgaagg

SEQ ID NO: 37380 - DNA, 407 bp, Zea mays
  Clone ID: LIB3060-029-Q1-K1-B3
gttggaattgaagctatgagccgaggatgttcagaggcacatttcgttgagatggatccttgggtcatctctgaggtcctcaaaccaaatttggagtgtactggatttcttgacgtgtcacacatacatatgctccgcgttgaaaatttcttggccaatgccgaaaaatctcaaggtagatatccttcctttgattacattagtgtaacaccaccatatctggaggtcaactatagcacgctactcggccaacttgcaaggtcaccattggttggaaaagactgcttcatcctagtcgagtacccgctgaaaacagacatggctgaatcctgcggaaaccttgtaaaggtagctgacaagaggtttggtaggaccaacttgctgatatatgggccaacttggtcaga

SEQ ID NO: 37381 - DNA, 368 bp, Zea mays
  unsure at all n locations
  Clone ID: LIB3060-029-Q1-K1-B4
ggccctttcctccacagccttggccggcaaggcagtgaacgtgccgtcgtctctcttcggctaggcccgcgtgactatgcgcaagacggctgctaaggcaaagccggcggcgagctccggcagcccgtggtacgggcccgaccgcgtgctctacctgggcccgctgtccggcgcgctctcgagctacctgacggtcgagttcccgggcgactacggctgggacaccgcggngctgtcggcggacccggagacgttcgccaagaaccgggagctggaggtcatccactcccgctgggccatgctgggcgcgttgggctgcgtgttcccggagctgctcgcccgcaacggcgtcaagttcggcgaggccg

SEQ ID NO: 37382 - DNA, 414 bp, Zea mays
  unsure at all n locations
  Clone ID: LIB3060-029-Q1-K1-B6
cccgcatccataaacaagaaaaagaatagaaaacccccgctgccagcgacagaagaagaaggggtcccttctccttggttgcgttgcgcctccctcctgtctgcgtgcgtgcaatcgacgcataggcgcgggcgctcgcaccaccacgaccacgacccgatggctttcatgcgctcccgctcaaatgcatcttctggcatgggagttgctcctaacattagggagacattcgtcgagcttcaaatgaagaaggcattccgatatgttatcttcaaaatcgaagagaagcaaaagcaggtggttgtggagaagacaggggctactactgaaagctatgatgactttttggcctctctcccagagaatgactgccgatatgcgctgtatgattttgattntgttactggggagaat

SEQ ID NO: 37383 - DNA, 426 bp, Zea mays
  Clone ID: LIB3060-029-Q1-K1-B8
acgctcaccgtcgccacagcttgtgctcgcgcaatggcactcgtgtccgcctcctcgtcctccaccaccgccgtcgcggcgctccccaggaatgggcagcagcgggcgtcgtcgtcgttgttctcctcctcctcctcttcctccttcctcgtcggcaagacgctgctgaggcaggccgaggcagcccggccgtcgttcgccgtgcgcgccgcggcggattccgacaggccgatctggttccccggcagcacccctccgccgtggctcgacggcagccttcccggcgacttcggctttgatccctggggcctcggatctgacccggagagcctgcggtggaacgtgcaggctgagctggtgcactgccggtgggcgatgctcggcgcggcgggtatcttcatcccggagttcctgaccaagatcggc

SEQ ID NO: 37384 - DNA, 357 bp, Zea mays
  Clone ID: LIB3060-029-Q1-K1-C1
ggcggaagcgagcggataccgaggggttggggttaagaagcaacgagacgcatcgagcaagcgaaagcataccagagcaccaagcataggggcgcgcgcgcttctccagttctccctccctgccctgcaaggcggctgcaactgttccagctagcccctctcccagcctctgggtcgtagacgtagtagtagcagccgcagcagcagaagcggccgcgagcatgctcttggcacccctccccggctcctggcggatctgccggaaggcggcggccggagcgcttggagcgcggcgctaaccgcgttcgacggacctcgggatctgacgccgggcctcccctaatcggtcgacttcat

SEQ ID NO: 37385 - DNA, 390 bp, Zea mays
  Clone ID: LIB3060-029-Q1-K1-C11
gctctgcatgtatacacccaagtcctttactgggtccgccgccgcccctatgtacttcgttaggtttagtatattgttaagtttgtaattctagggtctggagggaagcatagatctcaagaggggtgaaatttggtggtaatgtcctgagaatttcaagaagacaagggcgcggaggttgtttctggagggatctgtgagcaaagcagcagaaatttgaggttggtggtaacctgtggatcaagcatggtgggtaaggagctggtggtgcaaaggaatggccctgttgacatacgtgagattgctgcaaaggccacgcttcgggaggtgcggcagagcgggcacacctacgtagaactacggcgtgtcgggaagcgtgtcatcttcttc

SEQ ID NO: 37386 - DNA, 437 bp, Zea mays
  Clone ID: LIB3060-029-Q1-K1-C2
cacagctctccaccctcaaaccatggttgttgctgacttaggctgctcatctgggcctaacacactacgcttcgtatccgaggtgattggcatcatagctcgccattgcaaagaatatggccgacaacatgaccacacacagcttcagttcttcctgaatgacctgcccggaaacgacttcaacaatctcttccagctgatccagcagttcaataagtcgacggcaataaaccacaagagtgaggcagctgaggcactacctcctccgtgctatatctctgggttgcctggctcctactacactaggatcttccctagcgaaagtgttcaccttttccattctttgttctgccttcagtggcgctctgaggcaccagagggcatcaaataaacatgcctagatatctacatcacaaagactatgtcaccgtcgatgg

SEQ ID NO: 37387 - DNA, 430 bp, Zea mays
  Clone ID: LIB3060-029-Q1-K1-A6
cccacctcttccacttccaccccgcccgtcgtctctcgcgaagcacccctatcgtacgttttccgtagctcgacggggacggcgagccgctcctgctgctgccgccgccggaggaggaggaacaggattagcgggaggaggagcagggcaccggtcgcttggggctgtgccacatgccgctctgggggaccgccgcgtccgcgcagccggcagccgagggcgacgccgcccgcgcgccctcagggtccggcggcggcggcgtcaaggtgatccggtcgctgctccccacccggcgccgcctccgcctcgacccgcccgctaagctttattttccatatgaacccggtaagcaagtccggagcgctgtcaggatcaagaacatcagcaagtctcatgtggctttcaagttccaaacgacagcaccaaagag

SEQ ID NO: 37388 - DNA, 273 bp, Zea mays
  Clone ID: LIB3060-028-Q1-K1-H1
ccaccacggcaccaccacactgtgcagcagcctcctttcgtctcgtagttggctggggttgccgacgcgacacctcgtcggaatccggtcgcgcgacctccccttctcgccggccggagcgggtgcgccatcaccatggacccggaagcggtacggaaaagcctggagcccaccgcaactgtcgaaaaaatcaccggctccacccctgcgcggctccacttctacgaccccttcgtcctcagcggagttaggaatcaaacccgccgagcacgg

SEQ ID NO: 37389 - DNA, 423 bp, Zea mays
  unsure at all n locations
  Clone ID: LIB3060-028-Q1-K1-H10
acccaatccaaaccagacaagcaaggaatcccccgatggctcatcgcgttcgcctgctcctctctctcgcgtcggccgccgcggttgccgccgccgtcgacgcggaggacccgctgatccggcaggtggttcccggtggagatgacaacgatctggagctgaacgcggagtcccacttcctgagcttcgtgcagcggttcggcaagtcctacaaggacgccgacgagcacgcgtaccggctgtccgttttcaaggccaacctgcgccgcgcgcgccggcaccagctgctggacccgtcggcggagcacggcgtcactaagttctccgacctcacgccggcagagttccgccggacctacctcggcctccgcaagtcccggcgcgctctcctcagagaactcggngagtcggcgcacgaggcgc

SEQ ID NO: 37390 - DNA, 95 bp, Zea mays
  Clone ID: LIB3060-028-Q1-K1-H11
atcaccaccattatttttacctctactactaatcacccaatgcaagtctcatatctcacatactgtgctataaccaccaccactcctaaaaccat

SEQ ID NO: 37391 - DNA, 409 bp, Zea mays
  Clone ID: LIB3060-028-Q1-K1-H12
gcaggagccgggcaaccctaccaaatcggccaaggccatgggaagggacctgagggtgcacttcaagaacacaagggagacagcttttgcgcttcgcaagctgcctttgaccaaggctaagcgataccttgaggatgttattgctcacaagcaggcaattcccttccggagatactgtggaggtgttggtcgcaccgcacaagcaaagtctcgccactccaatgggcagggtcgctggcctgttaagtcagccaggttcatattggatttgctgaagaatgctgagagtaacgctgatgtgaaaggcttggacgtggacaacctctatgtttcacacatccaggtgaaccaagcccagaagcagaggcgccgcacctaccgtgctcacggacgcattaacccttacatg

SEQ ID NO: 37392 - DNA, 280 bp, Zea mays
  Clone ID: LIB3060-028-Q1-K1-H2
accaccacactgttcagcagtctcctttcttctcgtaattgtctgatattgcgaactcttgctcctttctgaatccggtcgcgcgacctccccttctcgcctgccgtagcgtgtgctccatcaccatggacccggaagcggtacggaaaagcctgtagcccaccgcaactgtcgaaaaaatcaccggctccacccctgctcggctccacttctacgaccccttcgtcctcagcggaatcagcatctaatccgcctatcactgtctcctcctctgctcctt

SEQ ID NO: 37393 - DNA, 58 bp, Zea mays
  Clone ID: LIB3060-028-Q1-K1-H3
cgcccagccgctgcctgcccgccggccgactttcgcctcaccaaaagctgctgcctcc

SEQ ID NO: 37394 - DNA, 271 bp, Zea mays
  Clone ID: LIB3060-028-Q1-K1-H6
ccacgccggcgcttgcatgcagtaatatggccatttcgtcctatacgcaggaagctctggccttgaggtccctggccatgctcgtcaccaacgccgccgtcgctgcagactatgcgtcaccgtcctgccccaggctcacccttcacaacctctgtccttacccggtctggccgctcgtcaccgctaacgccgggtacccctccatcgccggcactgactcccggctcaacgggaacggctagggcctggttaccatggcgctgcctcaagg

SEQ ID NO: 37395 - DNA, 410 bp, Zea mays
  Clone ID: LIB3060-028-Q1-K1-H7
ccatttcgctcccgcaagcaccgatttgtttactgctctctccgacgcgcggcggcggagctggctacgacgactgaaccatgtgcggcggcgcgatccttgccaaccttcgcgagccggcgccgcgccggctcacagagcgggacatctggcagcagaaaaagaagctcaagaggggcggcggcggcgggaggcgctcgttcgcggcggaggacgatgaggacttcgaggccgactttgaggtcttcgaggccgactccagtgattcagatttggagctcagggaggggactgacgacgacgtcgtcgagatcaagcccttcactgccaagaggactttctccagcgatggcttaagcaccatgactagtgctgtagcaaggtcagccaagaggaagagaaagaatcta

SEQ ID NO: 37396 - DNA, 390 bp, Zea mays
  Clone ID: LIB3060-028-Q1-K1-H9
agaagaggagatgagggccaagaaggaggagctgtactgtgtggcgtgcaataaagagttcaaatcggacaaacagtggaagaaccacgagcagtcgaagaagcatagggataaggtttctgaactgaggatggcctttagggaggaggagtctttgaaagaggcagaggagggggaaggtgattggaatgaagttgatgtggggtttgattttaagcctacacaggagtcagatgatgagagtgcattttcagatgctgcagaagagttagctgaagaatttgaggaaggtttggaggtgcatgataaagagaacggtgataaggatttcgatagtgcagagcaggaggttgggtcatatgatgaggcaagtgtattggaggcaatgct

SEQ ID NO: 37397 - DNA, 416 bp, Zea mays
  Clone ID: LIB3060-029-Q1-K1-A11
cccacgcgtccgccgggcctcttcttctgcgcccctcttttcccaaactgcggatagagcagcgagccatcgacacgatcgcgagcgcaagcacgtacgttgtcggaagctcaagttagaagaagcaccagtgcctgatcgatggcggcccaggctctcctctccggccggcagctgctgggccgccccgtgcagtcggccgtctctaggtcgtcggcgaggaaggcgcccttcgtcgtcagggccagctccagccctccagccaagcaaggtgccgacaggcagctgtggttcgcgtccaagcagtccctctcctacctcgatggcacgctgcccggcgactatggcttcgacccgctgggcctctcggacccggagggcaccgggggcttcatcgagcccaatggctggcctat

SEQ ID NO: 37398 - DNA, 328 bp, Zea mays
  Clone ID: LIB3060-029-Q1-K1-A12
ctagagcaagatgggcggcgcactgctgcttgcgctactactcgtctctgctgctgccgcccctcaagtacttggagttggcaatggagacaatcacatgagaatcatccaggaggacatcatcgagacagtcaacaaccatcccagtgctgggtggacagcctcacgtaatccttacttttcaaactataccattgcgcaatttaagcacatacttggagtgaaaccagcaccacagaatgcactaagcaatgttcctgtcaaaacttattcaagatcactggaacttccaaaagagtttgacgctagatctgcatggtcccgttgc

SEQ ID NO: 37399 - DNA, 400 bp, Zea mays
  unsure at all n locations
  Clone ID: LIB3060-029-Q1-K1-A2
ggaaaagacaattttctccttacctcctgggctcaggcctcaggcgcacagccttctgcttggcttcctctcctcgcgtccccccaccaaaccctaacccgagcacccagcccctcctcgcgtctgctcgcgccggcctttggggctctcactctgagcggcagggacccgcagggctccggttgtgtccaggaaacatcccagttgttggcgagagaccaagaaatggcggagaaggagggagcgaaggttggagcggaagagatggaagagcgggagcaggaaggggaggcagaggaggtggaagtgaagtttcgtctcttcgatggctctgacatcggtcccgtgcgctgcaacgccgtcgncactaccgtagccgtcctcaaggatcgcgtcgtcg

SEQ ID NO: 37400 - DNA, 413 bp, Zea mays
  Clone ID: LIB3060-029-Q1-K1-A4
gaggaaaagggcaaaagccaaaaggcatcaccgtcgcgacgacgatggcagcctcgctccaagccgcggccaccctgatgcagccggccaagatcggcggccgggcgccctttgcctcgctgccgtcccgcccgtcgtcgcaactcgcctgcagggcgttcggcgtcgacgccggcgccgccaggatcacgtgctccctgcaggacgtcgccagcaggtgcgtcgacgccgcgaagctcgccggcttcgcgctcgccacctcggcgctcctcgtctcgggcgcgagcgcggagggcacgcccaagaggctgacctacgacgagatccagagcaaaacgtacatggaggtgaagggcacgggcacggcgaaccagtgcccgaccatcgacggcggcgtggagtcgttcccgttc

SEQ ID NO: 37401 - DNA, 418 bp, Zea mays
  Clone ID: LIB3060-029-Q1-K1-A5
cggacgcgtgggttcaagaatagattttatctatccggctgcactttagaatattcgtagtattttttttgataaataagaaaaggtgcacgatctcgacgaattacttctgaataacttcagaaatcatatggaagaaccatagcatttcgcgattcattggtaaatttactttgattctctatagaccaataatgtgagaccattaacacggttaaagctaaactgcttgaagtccgggcaaaaaggggtactctttctacaactacattagtattagtctcgaaatgctttaaacgggaaatagctagtgtagaatttatctgatatagaacactcatatcgataaaatagtttgaactatttactagaagggcacgcagtcctttttccaatgccaaatcgacgacctatgtat

SEQ ID NO: 37402 - DNA, 418 bp, Zea mays
  Clone ID: LIB3060-028-Q1-K1-G9
cacttgccacagctaaaactggtgctaattaatttcagctcatcgcacgctgatcaccaccgcttcaccacagcgaaccaccatggaaagattctactacgtcgccgtggccaccttcgtgctcgtcttcctgctccaccacctcttgacgaggaagaagcagcaacgtctgccacccggcccgcggttcgcgtaccccatcctcggccacctccccttgctcaagaagccgctccagacctcgttcgccgacctcgtgtcgcgccacggcccaattattcacctgcgcctcggccgccgccacgccgtcgtcgtcggctcggcggcggtggcgaaggagtgcttctccggagagctcgacgtcgcgatcgccaaaccgccgcacttcccgtccgcgcgcgaggtcaccttcgactac

SEQ ID NO: 37403 - DNA, 395 bp, Zea mays
  Clone ID: LIB3060-028-Q1-K1-F2
ctgaagtctgagttgttttttcacaggctatctaccacagaatctgtactgccttgactcatgttatggtgtccctccatgagctaaaattgttgcttcataaaatgagcgaacataatgtaagggctatggcagatgttgttatcaaccatcgaattggaactactcaaggatccaatggcatgtataatcgttatgatggcatcccagtatcatgggatgaacatgctgttacatcttgttctggcgggaagggaaacaagagcactggggataactttgatggggttcccaatatagatcatacacaaccatttgtacgcaaagatattatcgaatggttgatctggcttcgaaaatcagttggttttcaagattttcgctttgatttcacg

SEQ ID NO: 37404 - DNA, 452 bp, Zea mays
  Clone ID: LIB3060-028-Q1-K1-F4
tcccgggctcgttccctttcgaaagcccgcgcacgcacgtcggtcgtcccgagcaggacctcgatcggccgagatggcgacgccgggacgggcgttgcgcggatcgagacgaccgggaagaagaagcaggacaacggcgtgtggtacgacgacagctcggcgccggtgcgcgcgcagaccatcgacgagctgcactcgctgcagcggaagcggtcggcgcccagcacgcccaagcggtcggcgcccaccacgcccatcaagggcggtgcccactcgcccttcgccgtcgcgatctccgaggaggagcgccacacgcagcagatgcagtccatcagtgcgtcgttggcgtctctgacgcgtgaaaccgggccgaaagtggtcaagggcgacccggccgcgaagggcgaggccgccgcgcagggcgcgccatcgacgccgagggcgcaccagca

SEQ ID NO: 37405 - DNA, 443 bp, Zea mays
  Clone ID: LIB3060-028-Q1-K1-F5
gccaagaggaggccgacctcgcccttgcccgcgtcctccaggagcaggagcgggcgtacatgaggctgaccggcggcgagtacgcgatctcggacgccgagagctacgactacgacgaggaggaagacggcgatgggagcgactacgaggaggaaggcgaggcgctcgacgaggacgagcaggttggggacgcggaagcggagggggctgagggggacctggacctggacccttctcagtacgaggacgacggggagggcgacgtctccgacaggctcatggcgctcgtcgggatcggtgattggcgagcaatggagcaggatgatgctggggacgaggaggacgacgaagatgctgaagttcatacacagggtgcatgggaagatgttgacccagacgaatactcttacgaggagctaattgcgctgggtgaagttgtcggt

SEQ ID NO: 37406 - DNA, 449 bp, Zea mays
  Clone ID: LIB3060-028-Q1-K1-F6
aatcaccggaccagccccgagagcgggtttagttagaggctacgggcggtcgggcgcggcggcggcggcggccatgagcagggggagcgagagcactaccgccagcaggtggcccgagctggccacgctgcgcgccctggcgcgcgacgccgcggagcagctgcggctgccgcgggccggcacgtcggcgtcggcgtcggcgtcgtcgtcgccgtggcgcgggcgcgaggaccacctccacggccacggcaagacggccaaggtgatgcacctgctgctctggggacccaagtgaagcggcgagaggccaccgtaccgccggcgttgctcgttttgctctgcctgcaatccgccccgcacggactgtactgtactgtacctatacacctatatactacgacgtgcacatgtacgagtctacgacgtgctgctgtaccatactaatacta

SEQ ID NO: 37407 - DNA, 404 bp, Zea mays
  unsure at all n locations
  Clone ID: LIB3060-028-Q1-K1-F9
cacagagtcacagacagaccagcgctctgcatggccatcattctggtgaccacgcagaaaggaccagccattcccgggcaaagatggtttcagaagccagcgagcttggcattggcacacactatacacactggtcgctgatattttgattccccacgtgcgacacggcatctacccgtcgaggaactccacatctatctctccatgaagctcgctatatatgcatgtgagcttggcattggcacaccacagagcagccacttggatccggtgctcagcggaacagctagctatagcctgtagctagcagctagcttcagtcacaggccggacggtcggctcacacacagctagccgncgncgctgctagcttagccaccagtagtccgatctgatctacaggc

SEQ ID NO: 37408 - DNA, 371 bp, Zea mays
  unsure at all n locations
  Clone ID: LIB3060-028-Q1-K1-G1
cccacccgtcacgcatagggacttggtatacaaccacctactttcacgcttctccaacatcaacactgacgactcgaanactgtcaaaatccaacaattgcttcactctcctcaatgtccactgatatcaaccccatccagtccgactcattcttcaacccggtcctaactagcactcctcatcccaaccttattatcctacaccacagtgtcaaaagaaatgcatacagcacaaccaagtttttcagtaaaacaagcatctcagcattcatgcgtacacaataaatccacatccacatcacataatgccatacatctacaaacatcgacctgtctaattttcttacacactttactacgattttcaacac

SEQ ID NO: 37409 - DNA, 420 bp, Zea mays
  Clone ID: LIB3060-028-Q1-K1-G10
gaggtgacgatggcataccatctgatctcttcaccaccgttccttctcgcagaatggctcgccgtccctctccttctgctcctgctttaccacggctcatcaattcgccgccgtcgtcgcagcagcagatcggccaagcagggaggacagctcctgccgccttcgcccccggcgctgcccatcatcggccaccttcacctcgtcagcgacctcccgcacgtctacctccgtgacctcgacgtcaagcatggtggcgacgacggcctgatgctgctccgtctcggcgctgttcccaccctcgtcgcgtcatcgccgcgggccgcggacgcgatcacgcgcacgcacgaccacgtgttcgcgtcgcggcccacgtacactctcagcgacgagatcctgtacggaccctccgacatcatcttc

SEQ ID NO: 37410 - DNA, 422 bp, Zea mays
  Clone ID: LIB3060-028-Q1-K1-G11
atttacttgatgaatcctttaattacatcgcacaggcgaaacaaactgaacttcgtggtgggctgtttatggagtttaagaatgaggaagctacaggtcctggcgttctaagggaatggttttgtttagtgtgccaagctcttttcagttcgaagcaagttctcttctcaccctgtccggaggataaacgaaggttctacttgaacgaaacatctgctgtggatccactgcacctgaagtacttcacttttgcggagcggataattggattagccttgatgcataaagtacaagttggagttgtgatagaccgtactctgttcttgcatcttgctggcagaagtattacgttagaagatatttctgttgcagatcctgtcaaatatgcaagctgtaaaaaaattctagagatggatgctgct

SEQ ID NO: 37411 - DNA, 435 bp, Zea mays
  Clone ID: LIB3060-028-Q1-K1-G12
gaactgccgcctcgacccacgcggccgaggtacttgatgaatcctctttattacatcgcacaggcgaaacatactgaagtgtgggttagctgtccatggattttaagaatgaggaagctacaggtcctgacgttctaaggcaatggcactgtcaaatgtgccaagctcttttcacttctaatcaagttctcttctcaccctgtcctgatgataaaccaagtttctacttgaacgaaacatctgctgtggatccactgcacctgaagtacttcacttttgctgagcacataattgaattagtctagatgcataaagtacaagatgtagttgtgatagaccgtactctgttcttgcatctcgctggcagaattattaccatagaagatatttatgctacatatactgtcaaatatgcaatctgttaaaaaattctag

SEQ ID NO: 37412 - DNA, 361 bp, Zea mays
  Clone ID: LIB3060-028-Q1-K1-G4
gaaaaactcaccatgcttgtacataatgagcataaagctgctgtgtgtattggcaaaatagagagtgaagttaacaatatcatggatggtgttgggctacagcctgaaagacacactatcctgaaaaggctgaaagagttgttttccatgcgacagcaaggggtttcttcgcaagattgtgttgagtcaagcccagatcaatgtgtacctgaagaaacaaaggtcaatacaaacctttcctgtgacccattagatgtcactgtggaagacaaaacctcttttcaagaacaccatggagaatttgatgagcttcgacaaatcattgctgatttatccaagagggctgaagcattggagaaaa

SEQ ID NO: 37413 - DNA, 385 bp, Zea mays
  unsure at all n locations
  Clone ID: LIB3060-028-Q1-K1-G7
atcacacctgtagtgctcttcccgtcatttgcatctccaccatggtcgctgtcactgtacccagtcagacttagttcttcacccatcttgttgtacacaagtccatggttcactgtccctgcaatgtatctgagaactcgcttcatagccaccaagtgttcttgtctgggatcctgcatgaaacgactcaaatatccaactgagaaggcgagatctggccttgtgttcatcagatagcgcagacttccaatcaggcttctgtacttggttgcatcaacctgaggtgaatcactgtccttcagcagcttgagccttgttccattggtgntcacttgngtacaggtgctcagtcctgcattctccaatactttcacagcataggatg

SEQ ID NO: 37414 - DNA, 421 bp, Zea mays
  Clone ID: LIB3060-028-Q1-K1-F12
ccgcgcgctcgccaacgcggtgctcatcgagccggcctcccaccgcctcgaggatgtcgacgcgtgctccgccgagtgcgaggtccacatcgcgcaggagtggctcgacaagctgccgccaccgtcctacgaggagcggtacgtgctcacgcgcgcgtccaggaaccgcgagctcaacaagcacgcgcgcctgggctgccaggtcgtcctcacgccggagctgcatggcatggtcgtcgctgtccccgagcctaagccgtgggacatcccgtaatggcctgccgcgacgaatggcaaggtgcggctttcgacgctgtgagccttccttcattcccctggctcggtcaagcttgtgcgcctctgccatacccttttatgttacggatttgatgaagaataatagtttgatgggaaaaacctg

SEQ ID NO: 37415 - DNA, 420 bp, Zea mays
  Clone ID: LIB3060-028-Q1-K1-D12
cagatatccgctgcttcttccattctcagtcaccaagtcccgatggcgttagggtgcactctgcccaccatgggctgctataaccccggcacaagctccagcgctgtccgtctacgcgccgactactttcggtgatcagcgctccgtcggtgcagaatgcctgtggctgctagcccgagactcaccaactccaggctaaacgagcacgccttacagcgactccagctcgctagtgacgacgagcactaagaagggacaaacggatagctacaccgactagagatcacaaacggacgagaactagctcgccattgccagactcggcctgaccgacaagctcgtagccacgctcgagaagcgcgtgactacgcacctgttccccatacagagggctgagttgattcccgctcttgacggccg

SEQ ID NO: 37416 - DNA, 404 bp, Zea mays
  Clone ID: LIB3060-028-Q1-K1-D2
atcgggtatagtggcaactttcgggccagattcccctactgaagaggttgatgtctatatagcgtcccagatacatatctatgatgattgccctgaaagaagcttacttgtggtcgaaacatcgcatcgttcagctttactggttgaccttgttaagatcatctcggacatcatcattaatgtccaatctgtagagtttcgacactgaagctctcctggctaaagcaaaatttcatgtcatctacaagagcataacactgaccgaggctttacagcacgttctttataatagctcgcgctatttcttgacgcggccgacaacagacgacgccagcttctatccagatagatgatcatgaagcctatcaactttcttatgtggtggtattcacatgaattgaata

SEQ ID NO: 37417 - DNA, 161 bp, Zea mays
  Clone ID: LIB3060-028-Q1-K1-D4
tcctttttcattcccacccacttttccatttaaaattcactacaatatccctaacatgtaacattgtacaaattctaacacctcaccccctctactacacctcatactcaaaccctaaccctacaacctctcacccctctactcctaccaataactccccc

SEQ ID NO: 37418 - DNA, 449 bp, Zea mays
  unsure at all n locations
  Clone ID: LIB3060-028-Q1-K1-D6
aaatcatttaggtacgtttattgaccacgtgatgcggagaaccaaagctgagtcgaggccaagatgacgtaacgggtggactaattcgcaagatgattgccaagtggacgacttctaacaacactaacctagtgttatccaggcaagccccggtgcatgcaaccccttccttgtgtttttaaataatttttacacactttaagtctagtgaatgtgcattaggtttataggagttgcttggaaaccctttgatgcattgcctaccttgatatccatacctatatagatacttctggtgaagtatcaaaattatgatttacaaaaaaatgcttagccctgcttataggcagatagagtttgtcctttgcacttatgcctagctcaagttgatcctgaggaaggatgacctctacctgcacggatatttntattgggagcatggtgggatc

SEQ ID NO: 37419 - DNA, 409 bp, Zea mays
  unsure at all n locations
  Clone ID: LIB3060-028-Q1-K1-D7
ctcgacaccagcgtctaacgggatggcgagcctgaccatgccgacggtgccggcgtggccgcggcaggacgccatcgacctccacaaagcattcagagggttcggttgcgacagcacgacggtgaccaacatcctggcgcaccgcgacgcgacgcagcgctcgctgatccagcaggagtaccgggccgtgttcaaccaggacctgtcccggcgcatcgcgtccgagctgagcggccaccacaagcgggcgatgctgctgtggatcctggacccggtcactcgcgacgccaccatcctgaagcatgcgctcacgggcgacatcaccaacctgcgggcggccacggagatcgtctgctcccggacgccgtcgcagctgcagatcatgcgccagacgtaccgngccaggttc

SEQ ID NO: 37420 - DNA, 420 bp, Zea mays
  Clone ID: LIB3060-028-Q1-K1-D8
atcctttttcattcccacccgcccatcccttcaaaattcgctgcgtgtccctctctgtccctgcgctcgtgctccgcccaggcccctttcctccaccgcgggcgcaaaccctaaccctacagccgctcgccccgcggcgcctgccaatggcgccccccgtgtgagtgtgtgtgagaggcagagacctagaggccgctacccggggaggagagggagggagagggagaggctgatagatgtataagcaggggggagcgggggtaggggctggtctggaccggaaacggatcagcgacgcgctagacaagcaccttgagaaggcggtcgcatcgccgtccacatcgagggggtcagcgggcggcggcggtgtgcgcgaccaccaccgcctcatcgtgccgtcctccgtgtcgtccatcccca

SEQ ID NO: 37421 - DNA, 355 bp, Zea mays
  unsure at all n locations
  Clone ID: LIB3060-028-Q1-K1-E1
aattcccgggctcgtagctcctctactcgcgagtcgccatgggcaagattaagatctgaatcaacggcttcggaaggatcggcaggctcntgaccggggtcgccctccagagcgaggatgtcgagctcgtcgacgtcaacgaccccttcatcaccacggactacatgacctacatgttcaagtacgacaccgtccacggccactggaagcacagctacatcacactcaaggactccaagacccttctcttcggtgacaagccggtcaccgtctttggcatcaggaaccctgatgaaatcccgtggggtgaggctggcgctgagtatgtcgttgagtacaccggcgtcttcactga

SEQ ID NO: 37422 - DNA, 420 bp, Zea mays
  Clone ID: LIB3060-028-Q1-K1-E10
ctcttgtccgcaccatcgcctccgctccgattcgccgaatcggcgctggcgggcgagacgtggatctcgacggaggagactccgaccatcgctccatggaggccgcggactctgaatccgtcatctccaccttcacctgtccgcactgtcagcgggaggttccatcttcaaacattgcattgcacagcgcgcactgcgctcggaaccttcagaagtgcgaacattgcggagatatggttgccaggaagcttatggatgaacactacgatgaaaaccatgctccgatgaattgctcactttgcaaacacacagtagaacgcgagctatgggatcctaatacaggcatacaaggcccacaaaggatgctcgcgtgccaatactgtcagtttgaactgcctgcagttgatctttatgaacatc

SEQ ID NO: 37423 - DNA, 419 bp, Zea mays
  Clone ID: LIB3060-028-Q1-K1-E12
gccacacatgcctgagccatatcacgcctgcaggccccatgcatccatgcgtgcacgggatttcctcctaaagatcgatcgcagactttacttaggccgtcacaaggagaccctcctcagccgctagtaccagtagtcgtcgcgtttgcagctaggcagatctgagttagccggcggatccgatccgtgcgcgtgcgcagtgtgtgtgtgtgtgtgtgtgtgtgtgtgtgtcggtggagagatggccacagcttacgctcccatggcgagccaggtgatgaagagcagcctcgtcgtgcactcgaggccgaagggcctgtcaggcgctgctgcgctcacgaggcggcccggccggttcaccgtcaaggccatccagcccgagaaggcaacgtaccatgtggtgcagcccatcaacggcg

SEQ ID NO: 37424 - DNA, 59 bp, Zea mays
  Clone ID: LIB3060-028-Q1-K1-E2
gcagtggcagcaccgcagcagagagaagagagatcttctagcctagtagtagcatctac

SEQ ID NO: 37425 - DNA, 413 bp, Zea mays
  Clone ID: LIB3060-028-Q1-K1-E5
gtttcgaaagactctggcccagagctcgagttcacatgcacagccttccgcgaggaggtcacggtcgatgatatgctgatagtggagaaaacagacgacgacgacggagaagagaagttcccctacgagggccccgagttcaccgagctccctgtgaatgttcagaaaggcctgttcaagtacctggagcaaagaggggtaacgctgtcggctaccaactatatgcacgattacatggtgactaagcaggctcaggagtacatccggtggatgactaagctgaaggatttcgtggcgcagtgaggaacagcgtcgtgattcggcagcattgtttggttagcctagccttagcatgtgttacagccttacaggaacactacgactacaccgaattggccacactccccaaaaac

SEQ ID NO: 37426 - DNA, 424 bp, Zea mays
  Clone ID: LIB3060-028-Q1-K1-E6
caagtgctacgagaaccccaagcacaaggtcaccgctgtccccgccgacgaagaagagatctggggtgccactttcaaggtggtggaagggtctactgtcctgacggcgctgcactgatcgatcatcatcaggcggaggcgatgcgacgatacagaactttgtacatgcgtggtgggtgtaacatagtggctggcaacaagccatgctcatgcaaaccgatgaatctatctctgtatcatgcatcgatctcggttgcttgctagtccagactccagactccagacatggctatatatagctggtgctaataaataggagtataatcgtcatatcgatcggttgcgtgtggaatgccaatcaagtgtgtaatctgttccaaataacaaacctatgttcctccaaaaaaaaaaaaaaaaagggcgg

SEQ ID NO: 37427 - DNA, 417 bp, Zea mays
  Clone ID: LIB3060-028-Q1-K1-E8
cccaaaacctgacgagctggagggccgatccgcggctccccgccgcctgatccgagcagtctgctcggcccagccggggatccaagcgggatggggtacttgagctccgtgatcggccaccccaccgatggatcctccgtcagcggcggcggcctcagccagaatggtagatttagctatggctatgcaagctcccctggtaaaagggcatccatggaagacttctatgagacaaaaattgattgtgttgatggccagatagttggtctttttggagtttttgatggtcatggtggtgctaaggtagcagagtatgttaaagaaaacctgttcaacaatcttgttagtcatccaaagttcatcagtgatactaaagtcgctatagatgatgcttataaaagcaccgacagtgaattc

SEQ ID NO: 37428 - DNA, 420 bp, Zea mays
  Clone ID: LIB3060-028-Q1-K1-F11
atttaatttttcgcagcttgtgaacattgggaagcccaattaaatatttgaatctgcgtagagtattggaaatagtcaatagtggtgaacttttgaatgattcagttttgagactctggttggagcatgtgtagctactatttagtggggtgcatgtgacatcaaatttcgattgttgacctcatatatgttactggacttcaaaatttgttcttccattttcaatctgactaactacttcgtcgaagtttttctcatattttttgtgccattattagataccatgatgataatagatcctgactttattttttgtactacaggtagcacaagagtattctgaatgcccatcagggaagaaaggtggagatcttggttggttcccgcgtggcaagatggctggtcctttccaggaggttg

SEQ ID NO: 37429 - DNA, 383 bp, Zea mays
  Clone ID: LIB3060-028-Q1-K1-B12
gcaaccagcaaagtgatcagtgtgatcgatcacacactgccatggccgtcatgggcggggaggaggaggagcagcagcagcagcacaaggaggaggaggtggtccaaggagatgtgcgagtcgtcgtccagcaggagacggcggctgacgaggaggccgagtcggcgctggtgcgcaagatctccggcctggccgacgccatcgccaggctgccgtcgctgagcccgtcgccggaggtgaacgcgctcttcaccgacctcgtcacggcctgcatcccgcgcagcaccgtggacgtggagcgcctgggcccggagctgcagcgcatgcgcgcgggcctcatccgactctgcgccgacgccgaggcgctgctggaggcgcactac

SEQ ID NO: 37430 - DNA, 310 bp, Zea mays
  Clone ID: LIB3060-028-Q1-K1-B3
cacgcgtccaggatggtgctcaacattattcacttcaacactttgacatatcaggctgctgagcggccaacttgtactgtgtgccatattataacagtacagtctcataaaacatcagttggtggatctatactatctcctagtatccaaaaagttcgagaatcctgcacaatgcgaacaagctttggtcggcaagtttaagatactgtattacgaccttaccactgcgttccttaacctataagatgagtcacggtcaactgctgcacattttatctaagacattacctggctgccaaatgtcttataa

SEQ ID NO: 37431 - DNA, 437 bp, Zea mays
  Clone ID: LIB3060-028-Q1-K1-B5
ctcacccatccggcctatcctgggagtagtgttaacagcgccgcaccacctcgtgccgtgggaggtcgagctcatcgatgcgacgctcctcggagagcagcgcctcctcctgcgcggtcttctttggcgcgagggcgggcgggacggagggcgccgaggaggaggcggcggcggaggagctagggttagggttcgccgccgccgtctgagctgcggcgtcgaggttgctggggtcggaaccggtagcagctgcggcggaattcgcggagaccgccgacgtgccggccttggcgaggacctggcggtgctcttcgcggcgcttctggagctgcttctgctccagctccgaccgccgcacgaagctcttgccccccaagtcggccgtcgccgccttccgcttcttctccagttcccgcttcagcagatccattacgccc

SEQ ID NO: 37432 - DNA, 408 bp, Zea mays
  Clone ID: LIB3060-028-Q1-K1-B9
cgaatatatttgattgggggtctcgttcttgtgtagaactttatcacaaggggactgtaatataaatctatcgcatgagtcgcaagaagatgcaacgtccttggcggattgatgactttgacatgttcaaaaagagaatgcttactgataggaaggaccaatcatacaaaatagcactgctttttgttgataactcaggtgctgatgtggtccttggaatgcttcctttagctagggagcttttacgccatggaacagaggtagttcttgttgcaaattcgttgccggctttgaatgatgttaccgctaatgaacttccagaagttatagctgaaacctcaaagcactgtggtatccttcggaaagctgcataagctggtggattgatagtcgatgcaatggctggca

SEQ ID NO: 37433 - DNA, 216 bp, Zea mays
  Clone ID: LIB3060-028-Q1-K1-C1
gccacgcccacgccccaatggaagacagcgctaccaatggccatggagttgtgacggctgtacgggcctcgtggaactttgagccagcacgagaccctcctgggcctttcggcgctctcagctcgcggcgtgctgaccaaagtcctggccgagatgttgcccgacgaggcaccggacggcagtccggttggacagctgcgactcgacagacttgcc

SEQ ID NO: 37434 - DNA, 370 bp, Zea mays
  Clone ID: LIB3060-028-Q1-K1-C10
cttgggccgccgccgcgtccgcctagccaagcgcagcagccgccgcagcacatcgctctcttgatctcagccatggcggaggtggagcagcaacaggacacgccgaagctcttcaaccgctggaccttcgatgatgtccaggtgaacgacatctcgctgaacgactacctcgctgtgaacgcgacgaagcacgcgatgtacctgccgcacaccgcggggcgctactccaagaagcggttccgcaaggcgcagtgcccgatcgttgagcgccttacaaactccctcatgatgcacgggcgcaacaacggcaagaaggtcatggctgtccgcatcatcaagcataccctggagatcattcacctgctcaccg

SEQ ID NO: 37435 - DNA, 420 bp, Zea mays
  Clone ID: LIB3060-028-Q1-K1-C11
caggccgatctggttccccggcagcacccctccgccgtggctcgacggcagccttgccggcgacttcggctttgatccctggggcctcggatctgacccggagagcctgcggtggaacgtgcaggcggagctggtgcactgccggtgggcgatgctcggcgcggcgggtatcttcatcccggagttcctgaccaagatcggcgtcctcaacacgcccttctggtacaccgccggcgagcagcagtacttcaccgacaccaccaccctcttcatcatcgagctcatcctcatcggctgggccgagggccgccgttgggctgacatcatcaagcccggaagcgtcaacaccgatcccatcttccccagcaacaagctcaccggcaccgacgtcgggtaccctggtggcctgtggtttgaccc

SEQ ID NO: 37436 - DNA, 194 bp, Zea mays
  Clone ID: LIB3060-028-Q1-K1-C2
attcccggccacgtgaatcgcgtccagccacgcccactccccaatggaatacagcgttcccaatttccatgctgttgtgaccgctgaccgtgcctggtagaacttcgagccaaacgagaccctccttggtcttccagcgctctcatttcgcaacttgcttaccaaagtcattgcccagatttttcccgacgatt

SEQ ID NO: 37437 - DNA, 413 bp, Zea mays
  Clone ID: LIB3060-028-Q1-K1-C4
cgccctgctggtggttttccattcatcatcgatcttcctgcgtctctgaactttttctgctgggtctggtggccggtagcagaggttgctacacgtatatattctgaagaagagatcgagatgaccagcgtgtggaagaccaaggttctgcctggcctcaacaagatctttgacaaggatggcaagaaagctgcagctgcaggcttcttgaagtccttcaacaaggaggagattgacaaggagattgaggacaagaagacagagctggagcccaaggtcgtggaagcctacgaagcatctcctcctgaggtcaaggctctgttcaaggataagaagccagtcaaggtcagcaagaagaactcggctgcagtcaccaagttcctcgatgagctggctaagattgacttccctgg

SEQ ID NO: 37438 - DNA, 412 bp, Zea mays
  unsure at all n locations
  Clone ID: LIB3060-028-Q1-K1-C6
agtgcccaaataaaatcccctaaacctagcgccgccgccgccatgcttcgccgtctggccggggtcgcccagcggaccttctcctcctcttccccgcacgccccgccgctggctgcgtcgggctacaccccgcgccgcgagtacggcctggtgcccatggtgatcgagcatacctcccgcggggagcgcgcctacgacatcttctcgcgcttgctcaaggagcgcatcgtatgcatccatggccccatcactgacgatacggcgtccctcgtcgtcgcccagctgctcttccttgaatccgagaaccccgccaagcccgtccacctctacatcaactccccggngggcgtcgtcactgcgggcctngccatctacgataccatgcagtacatccgntcccccgtcaccacgc

SEQ ID NO: 37439 - DNA, 306 bp, Zea mays
  Clone ID: LIB3060-028-Q1-K1-C7
cccacgcgtgcgagtgcgcaaataaaatcccctaatcctagcttcgccgccgccatgcttcgccgtctggccaccgtcgactttcaaaccttctcctgctcttccccgcacgccccgccgctggctgcgtcgggctacaccccgcgccgcgagtacggcctggtgcccatggtgatcgagcatacctcccactgcgagcgcgcctacgacatcttctcgcgcttgctcaacgaacgcatcgtatgcatccatggccccatcactgacgatacagcgttacttgtagtcacccaacttctcttcctt

SEQ ID NO: 37440 - DNA, 426 bp, Zea mays
  Clone ID: LIB3060-028-Q1-K1-C9
gagaaatataggccgccgcctcctcctcattcggtgaaaggtgggcggttagggtggggagatctcttgactcacgacacgagcagcagaattcgtcgagggccgctggttgctgcgagaggtccgggccttcgtgggatctgtaagaatctcttgctctccatacatgttcttgttgtgcgatctgatccagtttgatgttcgttttttgtctggtattcgattatgctgggatttctaagaaaccctaatcccagtttgatggttagggaagtaataattacttgatttgtgaaaggggattaatttgtgaaggagaatggggtgcctatattccttcactaggactcgatttttcgtttcgttgagaatcttggatagccctctggcgtctgggtttctagtttcttcggttgcgtatcgaat

SEQ ID NO: 37441 - DNA, 357 bp, Zea mays
  Clone ID: LIB3060-028-Q1-K1-D1
attggctatgggggcaacttttgggccagaagcccctacggaagaggttgatgtggatatagggacccagatagatatctatgatgatggccctgaaagaagcttacttgtggtggaaacagcggatcgtccagggttactggttgaccttgttaagatcatctcggacatcagcattaatgtccaatctggagagtttgacactgaggggctcctggctaaagcaaaattccatgtcagctacaggggcagaacactgaccgaggctttacagcaagttctttctaatagcttgcgctatttcttgaggcggccgacaacagaggacgccagcttctaaccagatagatgatcatg

SEQ ID NO: 37442 - DNA, 349 bp, Zea mays
  Clone ID: LIB3060-028-Q1-K1-D10
cattgtttttcattgcaagttacgcaccactattcgtgagctagaatgaccatacgttgaacccatacacaatcatcttcaactcctgtcagcattacgtcactcccagttactggatgcatactcttttacgctagtctagtgttgctatgttccatccaactacaatcagctccagctactcaggttcacttgcagcgtctgcgattacctgtcaagactccgagaacatcttcctaagagtaaaagtcataaacttcgggtcagatactgtgaccctgacaatcttcacaaatggtctccaatccagtatcaacgctctttcatcaaccttcactgctctcacatc

SEQ ID NO: 37443 - DNA, 410 bp, Zea mays
  Clone ID: LIB3060-028-Q1-K1-B11
gccgaccacacggccatccttgcggcgccggagacccgggtcaccacgctgcccaagggcctgcgcgtggccacggagtcgtccctcgccgcgcgcacggctacggtgggtgtgtggatcgatgcgggcagcaggtacgagaacgaggaggcggccggcgtcgcgcattttgtcgagcacatgctgttcaagggcacagggaagcgtagcgccgcgcagctggagcaggagattgaggacatgggtggccacctcaacgcttacacgtcgcgggagcagacgacctactacgccaaggtgcttgacaaggacgtgccccgtgcgatggaggtcctcgcggacatcctgcagaactccaatctcgaccaggcccgcattgaacgtgagcgcgaagtgatcctacgagagat

SEQ ID NO: 37444 - DNA, 142 bp, Zea mays
  Clone ID: LIB3060-027-Q1-K1-H6
ggaactcttgagcactaaacacaagttggtcgaaggaaaatcatgatgagcaaagtgattgttgtgttaacgttttgggcatgccaagaactatttttttggttatgagtttgtcaaacatatgttgagtttgtcgctcatt

SEQ ID NO: 37445 - DNA, 262 bp, Zea mays
  Clone ID: LIB3060-027-Q1-K1-H7
gggactcttgagcactaaacataagttggtcgaaggaaaatcatgatgagcgaagggattgatgtgttaacgttttgggcatgccaagaactatttttttggttatgagtttgtcaaacatatgttgagtttgtcgctcatttcttaagagctatttctgtgatcgaagaaatttgtttattttagtggcatgaataagaaaaccaagcaaatccatggtagaaacttgtttgtgtgcatattttgagggctttgttttact

SEQ ID NO: 37446 - DNA, 435 bp, Zea mays
  Clone ID: LIB3060-027-Q1-K1-H8
ggctactccctgaatgtccctctagatgatgggattgatgatgataggttaccagtccctttttaagccaatcatgggcaaagttatggaggttttccgccctggtgcagttgtgcttcagtgtggtgctgattccttgtctggggataggttgggctgcttcaacctctcaatcaaaggtcatgcggaatgtgttaggtatatgaggtctttcaacgttccattgttgctccttggtggtggtggatataccataagaaatgttgcacgctgttggtgttatgagacgggagttgctcttggccaagagcctgaagacaagatgcctgttaatgagtactatgaatacttcggtccagattacactcttcatgttgcaccaagtaacatggagaacaaaaatacacgacaacaactggatgatatacgatctaa

SEQ ID NO: 37447 - DNA, 277 bp, Zea mays
  unsure at all n locations
  Clone ID: LIB3060-028-Q1-K1-A1
cgacggccttcaccgtcaaggcggagggcatcgccaagaacgccccgcccgagttccagaagagcaagctcatgacccgcctcacgtacacgctggacgagatcgagggcccgctcgaggtcggctccgacggcacgctcaagttcgaggagaaggacggcatcgactacgccgccgtcaccgtgcagctcccggggggcgagcgcgtgccgttcctcttcaccgtcaagcagctcgtcgccaccggcaagcccgagagcttcngcggggcccttct

SEQ ID NO: 37448 - DNA, 422 bp, Zea mays
  unsure at all n locations
  Clone ID: LIB3060-028-Q1-K1-A10
gggattcgctaatttgctcatgacatcccaaactagtcacacacaaataactagttgagttggcatgcgtgcaaacttgtgaactcaaatgtcataaaaagtgtcaaaaaatcctagtggtgtacacaacggaaagcatggatggtatgggagcaaagtggcatagacacaaatgcattaacattaaagggattaaaaatcctatgctggacaaaggtccccaattcaagtcagcaaaagtaggtaaaacacgtaaatgaatgtaataatctaattataaatgttcagtagaattctatatgtctaatcataccttngccaaaatatctttgtaaagagacttcangttccttttgaggcanatcatctaatctgagcatatctctctttatattactgttctcaatgttctcatcatggac

SEQ ID NO: 37449 - DNA, 414 bp, Zea mays
  unsure at all n locations
  Clone ID: LIB3060-028-Q1-K1-A11
gcggatagagcagcgagccatcgacacgatcgcgagcgcaagcacgtacgttgtcggaagctcaagttagaagaagcaccagtgcctgatcgatggcggcccaggctctcctctccggccggcagctgctgggccgccccgtgcagtcggccgtctctaggtcgtcggcgaggaaggcgcccttcgtcgtcagggccagctccagccctccagccaagcaaggtgccgacaggcagctgtggttcgcgtccaagcagtccctctcctacctcgatggcacgctgcccggcgactatggcttcgacccgctgggcctctcggacccggagggcaccggnggcttcatcgagcccaagtggctggcctatggcgaggtgatcaacggccgctacgccatgctgggcgcggtgggcg

SEQ ID NO: 37450 - DNA, 384 bp, Zea mays
  Clone ID: LIB3060-028-Q1-K1-A12
cagcactgcgaccccccacagcggcgctacccgctggagaagggcgttcctgcaccgtggtggcctaccggcgacgaggagtggtggccggagcttggcattcccaaggaccagggcccacccccctacaagaagccccatgaccttaagaaggcctggaaggtgagcgtgctcaccgctgtcatcaagcacatgtcaccagacatagagaagatccgtcgcctcgttcgccagtccaagtgcctccaggacaagatgactgccaaggagatctcgacctggctggcggtcgtcaagcaggaagaggagctgtacctgaagatgcaccctggcgcacgcccgccggcatccgctggtggcatcgccagtgccatatctttcaac

SEQ ID NO: 37451 - DNA, 316 bp, Zea mays
  Clone ID: LIB3060-028-Q1-K1-A2
cggacgcgtgggtggatgttctacgcaaaaatcctagtgttgcattgccagttattctaactagactcaggacaaaacaggaggagtggtcaaggtgtcgatcaaattccaacatagtttgggccgaaatatatgccaaaaattatcacaagtcacttgaccatcgtagtttctatttcaagcagcaagatacgaagaacctgagcacaaagtctctcctgacagagataaaagaaattaatgagaagaaaaggaaggaagatgatgtgctccttgccattgctgctggaaataggcggcctatagttcccaatat

SEQ ID NO: 37452 - DNA, 315 bp, Zea mays
  Clone ID: LIB3060-028-Q1-K1-A3
cggagtttcggacttggaggtgatctgacctgtgaagggctgagggcggaggatggtggcgggacgaggagggatgggtcggcggcaggagcggcaggccatgatggtgacgttcgcgttggcgctgctcatgggcatcgccgtctacttccgcatctgggcccgccagtccagcgacccctccttcaccgccgacgaccgcgaggagctccggaggcaatttgaacaagcaaacctagaagcgatggatgaatctgccgaatggaggatgaaatatgataaagaaatagagaaaaacaggcagttgcatgatga

SEQ ID NO: 37453 - DNA, 352 bp, Zea mays
  Clone ID: LIB3060-028-Q1-K1-A4
gtgcgagtggtcaatttcaggatagaatggttccattccgcttgaccttaaaataattttaggggtttgttttgttaattaagaaaaggtccccgatctcaacaaattacttctgattaccttcaaaattcatttggaagacccataccatttcccgattcatgggtaaatttactttgattctctatagaccaataatgtgagaccattaacacggttaaaagctaaactgcttgaagtccgggcaaaaaggggtactctttctacaactacattagtattagtctcgaaatgctttaaaccggaaattacctagtgtagaatttaacctgatttagaacactcatatcga

SEQ ID NO: 37454 - DNA, 402 bp, Zea mays
  Clone ID: LIB3060-028-Q1-K1-A5
cggcgtcggatgttgagtaccgctgcttcgtcggcggcctcgcctgggccacggaggaccacgccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggcggctacggtggtggccgtggaagcggcggctacggcggtggcgggcgccttgatggcggcggcggctacggcggtggcggcggcggctacggtggcggcggtggctacggtggtggtggtg

SEQ ID NO: 37455 - DNA, 452 bp, Zea mays
  Clone ID: LIB3060-028-Q1-K1-A6
cgatcctgctcttagaaggtttggtcggtttgatcgtgagattgatatcggtgttcgagatggagttgggcgccttgaggttcttcggattcacacgaaaaacatgaagctggctgaagatgttgacttggagatcattgcgaaggatactcatggttatgttggtgctgatcttgctgccctttgtactgaagctgctcttcaatgcattcgtgagaagatggatattatagatcttgaggatgagacaatagatgctgagatactgaactctatggctgtctcaaatgatcatttcaagactgcacttgggacaagcaacccatctgctctgcgtgaaactgttgttgaagtgccaaatgtctcttgggaagatattggtggcctggaaaatgttaagagggagctacaggagactgttcaatatccagtggagcatccagagaaatttg

SEQ ID NO: 37456 - DNA, 378 bp, Zea mays
  Clone ID: LIB3060-028-Q1-K1-A8
ggcgcccgctcggcgccctaccccgttttctttttctgggtgctggacaagcgcgcccgcgcatggtcgcgttcgcaggcggggatgtcgaacgcggccgaggacgcgttcctcgacctcgtccgcgcctacgcggcgcggctcgtgcgcctgcgccacccgggcgtgctgtacgtcgtgcaggcgctcgacgagaccaaggccgccatggccatggccactgagcccgtcttcgcctccgtagctaacgcgctcgggtgccttgacaatgttggcaaggtgcccaaggaggtcaagggcatggaaatggggctacttgagattaaacatgggctgctacaagttgcaaagacgttggattttcttcataacaatgct

SEQ ID NO: 37457 - DNA, 347 bp, Zea mays
  unsure at all n locations
  Clone ID: LIB3060-028-Q1-K1-A9
ccatacagggcaaacggagttattactgttgggggtatacagagtaaccactgccgtgcgacagccgtggctgctaagtatctcaatcttgattgctacctgatactacgtacctccaagcttcttgtggataaggaccctggtttggttggcaatcttcttgtcgagagactagttggggcacacgttgatcttgtgtcaaaagaagaatatggaaaaattggcagtgtggctttagctgacctgctgaaaaaaaggcttctggaagaagggaggaagccgtatgtgattcctgttggtggatcatactcattgngaaacttgggatatatngaggcaataaggga

SEQ ID NO: 37458 - DNA, 409 bp, Zea mays
  Clone ID: LIB3060-028-Q1-K1-B1
ctgaagcgcgcgagagacagacgcgtatactcaggcggcggttgaggaggaggagaagaagaagaagaagatggcttcctccgcgtacgcctcatggtccaagcggtggatccgtcccgaggtgtacccgctgttcgtgccgatggccgtggccctgggtatctgctcgtaccagcttgtgcgcaacatcacgggcaaccccgaggtgcgggtgaccaaggagaagagggcggccggcgtcctggacaaccacgacgagggcgagaggtacgccatgcacggcctcaggaagttcgtccgcgggaagaagcccgagatcatggcttccatcaactccttcttcgccgaccctcccaaggacgattaagctagattccgtcatggatggatgagtatgttttaccaatca

SEQ ID NO: 37459 - DNA, 397 bp, Zea mays
  unsure at all n locations
  Clone ID: LIB3060-028-Q1-K1-B10
cactcacactccttcatcgggctcggcccgcgcggtcgtgagttcgtgactgcgggggaagtagcgcaggcgaaaaggcggcagcagtggacggcggcgaaccctagcctagctccgcgagtgcgttggcggtttgattcgatggccgtggcgtcgcggctcgcggtcacgcgtgtgtcgccggcggacggcgcgcgccccgcggcggcggcggggaggaggagtgggctcgcggtggttcggctcccgccgaccgacagcagggggagaaggaggaggcgcggcggggccgtcgcggccagccccccgacggaggaggtcgtgcagatgacggagccgctcaccaaggaggacctcgtcgcctacctcgtctncgggtgcaagcccaaagagaact

SEQ ID NO: 37460 - DNA, 334 bp, Zea mays
  Clone ID: LIB3060-027-Q1-K1-H5
gcccagtcgtctcccacgtcctagcacaacagagtagagctagcaaaggtatctgccatccaccatggccgtctccatcgccggcagcagcatccgcctccacgttgccccgcccagtcgccgccgcgtcagcgtggtctccgccgccgccgcggcccggctcgaccggcgctcggcggccctgctcctgctgtccacggcggttccagcagcatcggcagcgacagctcccccagcgagcgccgcgggcatcggtctcttcggcatcctcaagaagctggagcgcgcggaggaggcggcggccgaggcggtgagggaggtggaggaggcggtg

SEQ ID NO: 37461 - DNA, 326 bp, Zea mays
  Clone ID: LIB3060-027-Q1-K1-F3
tccccgtcgaccgtcgtttcgctccctatcctccccagtccccaccagtccggcaccctctccccgcctaccgctgcgaccaccgcacccgcgaacttggcgggccgctcggcgctgcacaccaagccggggatggccgactcgcttgcgagctcgccgcttgaccacctaactacctcccgtctccgcctccccaggccccatgcctccgcttccagttcgggtccagtctgctggatcggcgtgtgctcgggatggatgctcacggcctagtggagagccctgatgcagcgccaccggcttcgatgcttgtccaccgacgggtg

SEQ ID NO: 37462 - DNA, 409 bp, Zea mays
  unsure at all n locations
  Clone ID: LIB3060-027-Q1-K1-F4
ggccttctttggttcaagaagggaatgtaccccaaccggaccaagaaccaggattcggccgctttccgtttcctcctccaacggtgcaccagtgccatccctgacaacagattcggagaagaagggcccagtgataatggaaattccactggaccaaatccggaggccactgatgcgaacgcgggccaatgatccagtcaaggtgcaagaactcatggacagtatccgtgtcatcggccttcaagtacctaatgatgtgttgaagtccatgggtctattatggctctctggatgccaccgctacgaggctcaccagcgcccttggtctcccaaccatccgctgcanagttcgccgtgggacaaaggaaacactgaggcaccatatgcgatgagttatattttattcagt

SEQ ID NO: 37463 - DNA, 342 bp, Zea mays
  Clone ID: LIB3060-027-Q1-K1-G11
gtagccttttgctaccagaagatgggcgtattcagaaaatccattgaaacatgcaataaggggcttgacgcaaatcccgtgcatgtgaaagctctttaccggcgaggaacgtccttcatgttacttggggacttcaacgattcaagggatgattttgagaagatgattaccattggcaaatcatcagaacagggcgctacagccggactccttaaacttaagcagaaagaacaagaagcccaaaaggaagcgaggaagcagttcaaaggactctttgaacagaagccaggagagatatccgaaattggtgtagaatcagatggtggaaaggatgcatgtgat

SEQ ID NO: 37464 - DNA, 388 bp, Zea mays
  Clone ID: LIB3060-027-Q1-K1-G12
cgcgagtgagtgaacaccagccgtattgtcccgaccccgaccgatcctcgcctgctgcagccatggcgacctccgcggcgctctccaccgccgccaatcccacccagctctaccggtcccgcgctttgctgggcaagccggtgaaggggcttggcctgagcatgggccgcgagcgcgcccagcggagcattgtgtgccaggcggcgagcagcatctccgccgaccgcgtccccgacatggagaagcggaagctgatgaacctcctcctcctcggcgccatctcgttgcccaccgtcggcatggtcgtcccctacggcgccttcttcgtccctgccggctccgggaacgccggcggcgggacctacgcgaaagacaagctgggcaacga

SEQ ID NO: 37465 - DNA, 257 bp, Zea mays
  unsure at all n locations
  Clone ID: LIB3060-027-Q1-K1-G2
cacgcgtncgatcccagagaaatagcgctggtggtgatgggactaccacgggcattggtttggctcggggaatcatcaatcctgggttggttgccagtggcaattgttcctaacccagttgctttgaaaaggggtattgacaaagccgttcatgagctaattaagatcttgaagagtaaatgtatccctgtgagtacaaaggaggacataaaagtaaatcttacgttctggaaaatagtgttcgtgtgtgtaaaaat

SEQ ID NO: 37466 - DNA, 410 bp, Zea mays
  unsure at all n locations
  Clone ID: LIB3060-027-Q1-K1-G3
cgcctactggcgcatggcgcgcaagctctgcgccaccgagctcttctccgcgcgccgcgtggactcgttcgagcgcgtccgcgcccaggagatgcgcgcgctcgcgcgcggcctgttcgagtgcgccggccgcggcgccgtcgcggtcagggagcacgtggcgggcgccacgctgcggaacatcctccgcatggcggtcggggagaagtggtcgggctgctacggtagccccgagggcgaggcgttccggcgcacgctggacgaggcgttcgcggtcaccggcgcggtcagcaacgtcggcgagtgggtcccgtggctgggctggctcgacctgcagggctgcgtccgccggatgaagcgcctncgcgcgcagtacgaccgcttcttcgagcagatcctcgacgaccacg

SEQ ID NO: 37467 - DNA, 74 bp, Zea mays
  Clone ID: LIB3060-027-Q1-K1-G4
ctccccatctcgcccggcggtttcggtcttaacgatcttcttgcacctcgtggcggggcctgttcccttcgatc

SEQ ID NO: 37468 - DNA, 375 bp, Zea mays
  Clone ID: LIB3060-027-Q1-K1-G5
ccgcatccacctcccctctcgccgccgccgtcctgcccacgaacttatcttccttctctcgctgcccacctcgccgcctcccgcgcatctcctgcctggcagcgcccgaacgcgggggcaacaatgcgtcgaacgcctcgccggcaccgcagcagccgaggtggggtgccgcggtatccgccgcgctcgcggcggccgtgattgccgcctctatgccagcttacgcggacctgaacaagtttgaggccgagcagcggggcgaatttggcattggctctgccgcgcagttcggctcggccgatctcaagaaggctgtccacgttaacgagaacttcaagcgggccaacttcacatccgctgatatgagagagtcag

SEQ ID NO: 37469 - DNA, 425 bp, Zea mays
  Clone ID: LIB3060-027-Q1-K1-G6
acgcgtccgcttatacaaaatggattgagtgagagggtagtacttagggtggacggtggattcaggagtggtcaagatgttcttattgctgctgctatgggagctgatgaatatggctttggttctgtagccatgatagctactggatgtgtcatggcacggatttgtcacacaaataattgtccagttggagtggctagtcagagagaagagcttcgtgcaaggtttcctggtgttcctggggatcttgttaactacttcctctttggtgccgaggaggttcgagctgcattagcccagttgggttatgagaagttggatgacatcattgcgcgaacagatgtgcttaacccaaagcacatctcattggtgaacacgcaacacattgatcttggatacctcctatcagatgctggattgcctga

SEQ ID NO: 37470 - DNA, 324 bp, Zea mays
  Clone ID: LIB3060-027-Q1-K1-G7
ctgacacgtacttccgggtcctatcgttcctctccgacgccggtcgatctcatggcgggctccatggacgtcgtcatcaccgcccttacgctagcgtacgagactacgcataggccggctgcccagggccgtattctatgcaccgtcgcacccgatcgctcacgatgccgatcgctacgcctccgcccctacggacagcgatcagcccgctcctcggctcggtccaccaaggctgtagcggcagcactagctgatcctctcaaggtcatgatatcaagagctactacgtccggcaagggcacacagtgcgagctgattaagacc

SEQ ID NO: 37471 - DNA, 345 bp, Zea mays
  Clone ID: LIB3060-027-Q1-K1-G8
cggatacaaactggattgatttagatttcagcacttacgctggacgatcgggtcaggtacgctcaagacgtggtcatcgctgctgctacggcagctgatgaatatgcctacggttctgcagccatgatagctactggatgtgtcatcgcacgcattcgtcacacaaatcattgtccagtcggagcggctagtcacagagaacagcttcgtgcaaggttttctggagcacctggtcatcttcataactacttgctccttgcaacctaagaagatcaagctccattagcccaggtgggttctgacaaggcgggctacatcagtggacgaacagatttgcctaaacca

SEQ ID NO: 37472 - DNA, 376 bp, Zea mays
  Clone ID: LIB3060-027-Q1-K1-H1
agtgaggatagcgttacattaggtgatctggttgtgaaggatcaggaatttattgaagctacaaaggagccagggcttaccttcatggttgcaaaatttgatggcattcttgggctaggctttcaagaaatctctgttgggaatgcaacaccagtgtggtataacatggtgaaacaaggtctcatcagcgaccctgttttctctttctggtttaaccgacatgctgatgaaggagaaggtggtgaaattgtgtttggtggaatggattctagccactacaagggcgatcacacgtttgtcccagtcactcggaagggatactggcagttcaacatgggtgatgtcctggttgatggaaagtccactgggttttgtg

SEQ ID NO: 37473 - DNA, 398 bp, Zea mays
  Clone ID: LIB3060-027-Q1-K1-H12
agattgctgtgctcgcccactcactcactcacccatggcgctcgccgcctcccaccaccgcctcctgcccgtcgcccccgcccccgccgccacccgtaccccgtcgcgggggcacctgcgcttccgcgccgcgcgacctctgccccgaccccgctcccggagaatttgttgtcaatctatcaactcaactaatgttttgggagcttcttcgaagacatctgatgaggcaatcccagtcccagttgtccagatagatcaagactcagaccgtgatgcaaccattgtgcagctaagttttggagatcgtttgggggcattacttgacacgatgaaagctctcaaggaccttggccttgatgtctcaaaaggaagtgtggcaactgactcagctgtcacac

SEQ ID NO: 37474 - DNA, 378 bp, Zea mays
  Clone ID: LIB3060-027-Q1-K1-H3
ccttgcccaccggctcccctaatcactatgctccgccaccgccgccgacttcgtacggcgggccctaaacccctttcctcgttcccttccgtctctcagttaggcacaatgatgctagctaataagcttggtggtctgctcaagaatgctacgagttcaaatatgtctgtctaccaagcaatcacatgcatgtcatcatccaagctctttgttggagggctttcttatggaaccgatgatcacagtctcagagacgagtttgccaaatatggacatgtcattgaagctaagattatccttgatcgtgagtctgggaggtccagacggttcggctctataacttacacgtcatttgaggaggcttctgctgccatcact

SEQ ID NO: 37475 - DNA, 421 bp, Zea mays
  unsure at all n locations
  Clone ID: LIB3060-053-Q1-K1-E3
tcatcctctccctcctctactgcacctgcaccacagtagctagctagctatctttgctacggcggctctgtaatctggtccactagcgctccattcgaccccacccacagccatggctgccgtgaccgcggcggccgtctctctgccctcctcctcctcctcccctgccgccgccaaggccaaggcgtccgcgtccgcgtccccgtcgtctccatgcggccacctccagttcccgcggcggcacggcggcccgcgcgcggtgcggctgcgggtgcaggtgtccaccaccgagaccgcggaggcggagccggtcaagaagctggagaaggtgtccaagaagcangaggaggggctcgtcaccaacaagtacaagcccaaggagccgtacgtcgggaggtgcctgctcaacaccaggatcacc

SEQ ID NO: 37476 - DNA, 423 bp, Zea mays
  Clone ID: LIB3060-030-Q1-K1-C12
tgtcgttgtgagaattcttaattcatgagttgtagggagggacttatgtcaccacagacagaaactaaagcaagtgttggatttaaagctggtgttaaggattataaattgacttactacaccccggagtacgaaaccaaggatactgatatcttggcagcattccgagtaactcctcagctcggggttccgcctgaagaagcaggagctgcagtagctgcggaatcttctactggtacatggacaactgtttggactgatggacttaccagtcttgatcgttacaaaggacgatgctatcacatcgagcccgttcctggggacccagatcaatatatcttgtatgtagcttatccattagacctatttgaagagggttctgttactaacatgtttacttccattgtgggtaacgtatttggt

SEQ ID NO: 37477 - DNA, 414 bp, Zea mays
  Clone ID: LIB3060-035-Q1-K1-C5
tcttaattcatgagttgtagggagggacttatgtcaccacaaacagaaactaaggcaagtgttggatttaaagctggtgttaaggattataaattgacttactacaccccggagtacgaaaccaaggatactgatatcttggcagcattccgagtaactcctcagctcggggttccgcctgaagaagcaggagctgcagtagctgcggaatcttctactggtacatggacaactgtttggactgatggacttaccagtcttgatcgttacaaaggacgatgctatcacatcgagcccgttcctggggacccagatcaatatatctgttatgtagcttatccattagacctatttgaagagggttctgttactaacatgtttacttccattgtgggtaacgtatttgggttcaaa

SEQ ID NO: 37478 - DNA, 349 bp, Zea mays
  Clone ID: LIB3060-004-Q1-K1-B12
ttctaataatagcaagccttattcctattttggtattttggatttcaggacttttagccccggttagtgaaggaccagagaagctttctagttatgaatcgggtatagaacccatggggggggcttggttacaattccgaatacgctattacatgtttgcgctagtttttgttgtttttgatgtggaaacagtctttctttacccttgggcaatgagtttttgacgtattgtggtgttttcgttttaattgatacttttatttttgtgcttatcctatttgtatttttagtttatgcttgtctttttgtattttttgtattggttttatttgtatttttgtttattatt

SEQ ID NO: 37479 - DNA, 439 bp, Zea mays
  Clone ID: LIB3060-028-Q1-K1-G2
tgacaatgtcaacttgaattgactaattcagttccgcctattccacattaatgggagtacatttatgttgctgctttacgaatatgatattttttggacatttctaataatagcaagccttattcctattttggtattttggatttcaggacttttagccccggttagtgaaggaccagagaagctttctagttatgaatcgggtatagaacccatggggggggcttggttacaattccgaatacgctattacatgtttgcgctagtttttgttggttttgatgtggaaacagtctttctctacccttgggcaatgagtttcgacgtattgggtgtatccgtttttatcgaagctttcatttttgtgcttatcctagttgttggtttagtttatgcatggcgaaaaggagccttggaatggtcttaactgaatattcag

SEQ ID NO: 37480 - DNA, 264 bp, Zea mays
  Clone ID: LIB3060-042-Q1-K1-D4
tctaagtcttcccatactttcctataatgactgcaacgattttctccattttgcgaattggtaggttatttgaagtatattactatcatatacattatctaaatcgatccactttaaataaaatagaaaaaatcgaaagaaaaaaaaaaagaaagagtaaataataaaacaggatattctgtttcataattctgaaatagagttcttttttttagtattactcctcattaggatgtatatattaatcatcctattttaatatat

SEQ ID NO: 37481 - DNA, 400 bp, Zea mays
  unsure at all n locations
  Clone ID: LIB3060-042-Q1-K1-E10
gtgctgcgagaagaaggagaagaggatgaagaagagcaggtgctgagaagcctgccggcgcgcgttacgacaagcatatatgggggagatcaccaatgtcatggagtaccaggccatcgcgaagcagaagcttccgaagatggcctacgactactacgcgtccggcgccgaggacgagtggacgctgcaggagaacagggaggccttctccaggatcttgttccgtccgcgcatactgatcgacgtgtccaagatcgacatgaccaccaccgtgctggggttcaagatctccatgcccatcatggtcgcccccactgctatgcagaagatggctcacccagatggggagaacgccactgcgcgcgcggcggctgcngcaggcaccataatgacactgtcg

SEQ ID NO: 37482 - DNA, 410 bp, Zea mays
  Clone ID: LIB3060-013-Q1-K1-B7
tctatccagcagccgctctccccagccccactctctccatctagagctccctaactggaccggccgccacaccaccgtaccccgacccctcgacaacaatggccaccgtcctaggcagcccccgcgcgccggccttcttcttctcgccgtcctccctccgtgccgcgccggcgcccaccgccgtggcgctgcctgcggccaaggtgggcatcatgggccgtagcgccagcagcaggggcaggctgcgcgcgcaggccacctacaacgtgaagctgatcacgccggagggggaggtggagctgcaggtgcccgacgacgtgtacatcctggaccaggccgaggaggacggcatcgacctgccctactcctgccgcgcggggtcctgctcctcctgcgccggcaaggtcgtc

SEQ ID NO: 37483 - DNA, 423 bp, Zea mays
  unsure at all n locations
  Clone ID: LIB3060-003-Q1-K1-H11
tctctcgctccgtccatccccgtcgccagcatttcttccacttcggtctcagcgacggtcgccaccaccgctcccctccctctccccctcctcgcccagcggcaattaccacagcctccccagcaagccgggatggctgcactcaaggcatcgttccggggtgagctcagcgccgcttccttcctcgactccagcaggggacctctcgtccagcacaaagtggattttacgtttcaaaggaagggcaaacgagctatttcactgagaaggacatgctgttctatgcaacaggctccaccaccagcatggcctgngcgagctgttgctgagcctggccggaggtcatgggatggcccaaagcctatctcgattgttggttcaactggttccataggaacacagacattggacattgttgcggag

SEQ ID NO: 37484 - DNA, 396 bp, Zea mays
  Clone ID: LIB3060-012-Q1-K1-A4
tctttctaaagagattcgattcggaactcttatatgtccaaggttaatatggaaattggttcagaggttttcccttactttgtccgtgtcaacaaacaattcgaaatacctcgactttttcagaacaggtccgagtcaaatagcaatgattcgaagcacttctttttccattacactatttcggaaacctaaggtctcgatcgtatggatatggaaaatacacgatttccggtcctagcgtgaaaaggatggaaacggatactcaatttaaagtgagttaacagaattccatactctatctcatagatccctatagaattctgttgaaagccgtattcgatgaaagtcctatgtaccgcttggtagggagatctttcctatctttctagatccacc

SEQ ID NO: 37485 - DNA, 418 bp, Zea mays
  Clone ID: LIB3060-052-Q1-K1-B2
tggcttctgtggttctgcacaccagcacacgcacttgtccccaaacaacggcggcggcgatgagtatctcagaagagcttcccggcgaaggatctgacggtgaggaggaggtcttcatcaacgaggaggacatcatccacgagataaccatcgacgaagaagatctccccgaccgcgacgacgaagatgacgacgtcgtcaacgggatggttgattccgaagacatcgatgattctacatacgcatttcaaggccaccaagatgaagtcttcattgtcgcctgcagtcctacagattcatcacttgtggcttctggaggcaaagatgataggggattcctgtggaggattggatcagaagagggtgccctggagctgactggacataaggatactgtcggcacagtggctttcagttc

SEQ ID NO: 37486 - DNA, 412 bp, Zea mays
  Clone ID: LIB3060-012-Q1-K1-B7
ttccacgaacgttggcgcgcaagctcgtggtgtgagcggtcactgtctcccatcccagggctccggcgctgagcgggactctgggcgcgtcgtcggtggcggcgctgcggccctgcgcggggaggagggcgccgtccgccgcgagctcggttgcgccgcgcgggagcggtgtggtgaggtgctccagagggctcaggtgggacgcccacagaagcagggggaggttgctcagggtgaggtgcgatgcggccgtcgcggagaagcccgccgaggaggaggcggctggggagaagttcgagtaccaggcggaggtgagccgcttaatggacttgatcgtccatagtctgtacagtcataaggaggtatttctccgggagcttgttagcaatgcgagtgatgcgctggataagct

SEQ ID NO: 37487 - DNA, 423 bp, Zea mays
  unsure at all n locations
  Clone ID: LIB3060-021-Q1-K1-H8
ttaagatcataagctagtgagatttccaacttcttgcactcgtacgccttcatatgggagtgtggttgttttacttaaattcaataatattaatctaatatgcccattggtgttccaaaagtaccttaccggattcccggagatgaagaagcgacttgggttgacttatacaatgttatgtatcgagaaaggacactttttttaggtcaagagattcgttgcgagatcacaaatgatattacaggtctgatggtatatctcagtatagaagatggaaatagcgatattttactgtttataaacttccctggcggctggctaatctcaggaatggcgatttttgatacgattcaaacggtgacacctgatatatatacaacatgcctcggaatagccgcgtccattgnctccttcattctgctt

SEQ ID NO: 37488 - DNA, 463 bp, Zea mays
  Clone ID: LIB3060-041-Q1-K1-F9
tttagtgaattttccattcacagatccacagcatttgcagctacgtgcacagatattggtttagtggagctcttattcaaggaacaccaccaggagaggcttacatggtggcggcttttggagaacctgtaggtggtggcaaacctacatgggaggctgcttggcgagctgcttttgaaagatttcagtataaaaaatcacctcatatcagtttagagactcccacaagttcacttataggtagttctgtgcctgagaaagctagcaaaggtacagcaattacaactgtgccagctagcaaaaaagttggtaaaactgtggcgccagcacatcctgctgtaaccctacactctccaacttctgattttccttttggtagttctacatttaatctgcaacgaggcactcatctggattttagccaggcagtatcaccatttgcgtataattcacacatgagaca

SEQ ID NO: 37489 - DNA, 432 bp, Zea mays
  Clone ID: LIB3060-017-Q1-K1-C8
tttggtttcattgactactatgaccgcagatatgctgcactagcaattttatctctcaatggcagacaactgtatggtcagccgattaaagtcaattgggcatatacaagtactccgagggaggacacatcaggtcattttaatatttttgttggggatctttgcccggaagtcactgatgctactttgtttgcatttttctctggatactctacttgctcagatgctagggttatgtgggaccagaaaacaggacgatccagagggtttggttttgtttctttcaggaaccagcaggatgctcaaagtgcgataaatgacttgaatgggaagtggcttgggaaccgtcaaattcgttgcaattgggcaacgaaaggtgctaatgctggtgaagagaaacagattctggacactaagggtgacctgtcaaat

SEQ ID NO: 37490 - DNA, 407 bp, Zea mays
  Clone ID: LIB3060-029-Q1-K1-C10
tgaagacgacctgcatgccgatgagaccataaatattttcgtaggaaacaattacaagacctacacttttggtggaaagaagagcatagtcctgtcgactgcgtcctggctaggcggcaagaacgacttccttggacacgcttatattgtcactggttcgttgagcatcatcatatcgattctctttgctctgatccatgtgaagtacccaaggccgcaaggtgaccccaattgcctatcctggaacaggaaaaacagcaatagctaaggggcccgcctgtacctaccatctatgtgggcgcctgtgtaccaacatgaatcagtattacacatctgtatctgaaacatgtcagacactgtgccgcaaggttaatcccagatgatgaaaagaaactgcgtacaccatg

SEQ ID NO: 37491 - DNA, 370 bp, Zea mays
  Clone ID: LIB3060-026-Q1-K1-C7
tgcgtgttttgtgaattctgggaccgaagcgaatgagttggcaatgttgatggcccgggtgtgtagtgggaatctcagtatggttgcgctcagaaatgcatatcatggcggaagtgccggtacgattggattgactggcatgcagacgtggaaatacccaattcctcagggtgaaatacatcatgtcatgaaccctgatccttatcgggggactttcgggtctgatgctgcagcttatgctaaggaagtcgaagaacacataacttatggaagttcaggaagggttgcaggcttcattgcacaaacattccagggtgtgggaagtgctgctaaactaactcctgaatacctaaagttagctaatgacatt

SEQ ID NO: 37492 - DNA, 450 bp, Zea mays
  unsure at all n locations
  Clone ID: LIB3060-011-Q1-K1-C8
tctgcgtacacggtctccctcttcctgtcagtagtagagtgagagtgaggcagcgagtgggagacaaggggaaatggggaagggagcgcaagggagcgatgcggcggcggcgggcggcgaggtggaggagaacatggcggcgtggctggttgccaagaacaccctcaagatcatgcccttcaagctcccgcccgtcggcccttatgatgtccgcgtgcgcatgaaggcagtggggatttgcggcagcgatgtgcactacctcagggagatgcgcatcgcgcacttcgtcgtgaaggagccgatggtgatcgggcacgagtgcgcgggcgtggtcgaggaagtgggcgccggcgtgacgcacctgtccgtgggcgaccgcgtggcgctggagccgggcgtcagctgctggcgctgccgncactgcaagggcgggcggtacaacctgtgcga

SEQ ID NO: 37493 - DNA, 391 bp, Zea mays
  Clone ID: LIB3060-029-Q1-K1-A3
tgaggttcttcggattcacacgaaaatcatgattctggctgaagatgttgacttggagatcattgcgaaggatactcatggttatgttggtgctgatcttgctgccctttgtactgaagctgctcttcaatgcattcgtgagaagatggatattatagatcttgaggatgagacaatagatgctgagatactgaactctatggctgtctcaaatgatcatttcaagactgcacttgggacaagcaacccatctgctctgcgtgaaactgttgttgaagtgccaaatgtctcttgggaagatattggtggcctggaaaatgttaagagggagctacaggagactgttcaatatccagtggagcatccatagaaaaattgaaaagtttgcatg

SEQ ID NO: 37494 - DNA, 405 bp, Zea mays
  Clone ID: LIB3060-029-Q1-K1-F8
tggacccagacgtagttcagctagcctcttctaccttcctctcccaccccgcctgcgcgctgccgcgagagctcgttcctgatggggaactgcgccggcgtggaggggaacgccgagatcaacccttccttcagtgcccccaattcctcagggaccgtcggttctaagagcgtcagcaagaacgcggccgacaccggcaccttcggcaccaagacgtccggctcgtcgtcgtcggtgccgtcaacccctcgtacggaggcggagatcctggagtcgtcgaatgtccgcaagttcagcttcggcgagctcaaaggctccacgaggaacttcaggccggacagcctgctcggggaggggggcttcgggtccgtgttcaaggggtggatggatgagcgcacgctcgcg

SEQ ID NO: 37495 - DNA, 439 bp, Zea mays
  unsure at all n locations
  Clone ID: LIB3060-054-Q1-K1-H9
tttcatgtttggaatggagctggactacagcgacgccctcattggtggcggcttcttgttccagaatccaaacgcaacaaaaacctgtgggtgcggcaaatctttcgcgactggaaaggagaccgaggccgcggcaaccacttgcaacaactagagtagagaaatattgttagctaaacgtgatgtggcatgttgtatagcttgctcatgttgaagccctgtggctacaccacagatacataaagaggcatagttcaaaggaattacaccattaccaatggcctaattcagattttcttgtttggtgatcattccgaagtccttaaacttgtggtatggtctctcaaaatgcattgtattttcaggtatccaaacttgtcttgacgtgtcgtccaggcctacaagtactaaaattttatttntacatttttaaacttgg

SEQ ID NO: 37496 - DNA, 370 bp, Zea mays
  Clone ID: LIB3060-018-Q1-K1-G12
tgaacacttgattgattcagtaggtagctagctagctgaatcacaatggatcctaccgagttccgtccgtccagtagccacgacacgacggtgacgacgacgaacgctggcgctcctgtgtggaacgacaacgaggcgctgactgtggggcctcgcggtcccatcctgctggaggactaccacctgatcgagaaggtggcgcacttcgcgcgggagcgcatcccggagcgcgtggtgcacgcgcgcggtgcctacgccaagggcttcttcgagtgcacccacgacgtgacgtcgctgacgtgcgccgactatctgcgcgcgctctgcgtgcggacgcccgtgatcgtgcgcttctcgacggtgatccacg

SEQ ID NO: 37497 - DNA, 415 bp, Zea mays
  Clone ID: LIB3060-002-Q1-K2-D4
tggtgctcgaggcaacgatgatctgcatagacaattcggaatggatgcggaacggcgactacgctccgtcgcggttccaggcgcaggccgatgccgtcaacctcatctgcggcgccaagacccagtcgaacccggagaacacggtaggcgtgatgacaatggccgggaagggtgttcgcgtgcttgtcactcccaccagcgacctcgggaagattctcgcctgtatgcacgggttagaagttggcgctgaggcaaacttggctgcggcaatccaggttgcccagcttgctctaaagcatcggcagaacaagaggcagcagccagaggattatagctttcaatggaaggtccggtaaagtccaccaggaaggtttggagaccattgggaagaagcctgaaaaggaccatggtgctc

SEQ ID NO: 37498 - DNA, 430 bp, Zea mays
  unsure at all n locations
  Clone ID: LIB3060-052-Q1-K1-E7
tgctaatgttattcgttacttccctactcaggctttgaactttgcatttaaggactacttcaagaggttgttcaacttcaagaaggatagggatggctattggaagtggtttgctggcaacctggcctctggtggtgctgctggtgcttcctctttgttttttgtgtactccctggactacgcgagaacaaggttggctaatgacgcgaaggctgccaagggaggaggtgaaaggcagttcaatgggcttgtcgatgtctaccgcaagacactcaagtctgatggtattgctgggctttaccgtggatttaacatctcctgtgttggaatcatntgttatcgtggtctgtactttgggctctatgattccatcaagccagttgtccttactggcaacctncaggacaatttctttgccagtttcgctctg

SEQ ID NO: 37499 - DNA, 344 bp, Zea mays
  unsure at all n locations
  Clone ID: LIB3060-030-Q1-K1-A2
tggacgagtaccccgtcaccactgagctccatatccgctgcgtaaacatgatagctcacctgttgaacgcgccgatcaaggaggacgagaccgctataggggtcggaacagtgggatcctcggaagcgatcatgctngcaagtctaacggtcaagaaggaaatgccgaaccaggaggaaggaccagggaaaccgggttacaaaaccaacattggtaacggtgccaacggtcaagtctggttggaaaaggttgcaagggattttgaagtggaacttaaagaaggtaagctatcagaagggtactacgttatggaccccgtcaagggtggtgaaaaggtggaccag

SEQ ID NO: 37500 - DNA, 428 bp, Zea mays
  Clone ID: LIB3060-047-Q1-K1-D7
tccgttcgcacaagccagacctcttcgcgccggcaatggacaggctcggcgcgaatggggcgaactcgtgcccgctgacgccgcttggcttcctggagcgctcggccaccgtcttcggcgattgccactccgtcgtgtaccacgacacggtcttcacctggtcccagacacaccggcgatgcctccgcctcgcctccgcgctcgtctctctcggcatcaaccgcggcgacatcgtgtccgtgctgttgcccaacgtgccggccatgtacgagatgcagttcggagtgcccatgagcggcgccgtgctcaacaacatcaacatgcgcctggacgcgcgcacggtcgccgtcctgctccgccactccggctccaagctcgtcttcgtggacccggcgtctctaacgcttatcagagacgtcgctgagcag

SEQ ID NO: 37501 - DNA, 260 bp, Zea mays
  unsure at all n locations
  Clone ID: LIB3060-009-Q1-K1-E1
tctgactgaaggctttttttggataccttctctggctggtcctacaacaattggtgctggacaaaacggccaggggatatcatggctttttccttttactgatggcacatgcacctcttggctggtcagatactttggcatacattgtgttaccagttcttcttgtcattncacagtacatatctactcaagtaaggcaggcaccacagagcaatgatcctaaccaacaaggggctcaggctgtgacaaaggagttacca

SEQ ID NO: 37502 - DNA, 431 bp, Zea mays
  unsure at all n locations
  Clone ID: LIB3060-021-Q1-K1-H11
tccgatcctccacaccagcacccgccgccgccgcctcttcccttgcgcacctgctgctgtgcggatcggtgaggcggaggagtaggatggcgagcgcggccggaggcggagcggcgggggaaggggagtggcttaaggtatcccagctcaggcccatggtggaagcgcaggaccccaacgccaaggcagtggacaacctgacgctgcgtcggttcctgcgcgcgcgcgaccacgacgtggacaaggcctncgccatgttcctcaagttcctcaagtggcggagggaggcggcgcccggcggctccgtgccggaggacaggtaaggaggagctggcgcagggcaagctgtgcatgggcggcgtcgacagggccggccgtcccatcctcgtcgccttcgcggccaggcacttttccgtcggccgtgacatggc

SEQ ID NO: 37503 - DNA, 372 bp, Zea mays
  Clone ID: LIB3060-024-Q1-K1-A11
tggaaaagctggaaacctttaccaaagtggataccagctcaatggaagcgcctatggcatctgaaagcacataagcaatacatggttatgggatcgtgttcgagttagcggtggtgcatatggaggattttgtgattttgacacccattcaggagtgttctcatatttatcatatcgtgatccaaacttactgaaaacactagaggtctatgatgagacagcaagattcctcagagagctagaattggatgatgatgcactcacaaaagctattattggaaccataggcgatgttgacgcctaccagctaccagatgctaaaggttacagcagcctaatgagatatttgctgggcatcacggatgaagaacg

SEQ ID NO: 37504 - DNA, 367 bp, Zea mays
  Clone ID: LIB3060-019-Q1-K1-G3
tggagatgcagagtggtgatgagtggtcccaagttgcatatgtcactttcaaagatgcacaaggggcataagcagcacttcttctttcgggtgccacaatagttgatctttctgtcatcattgcacctgctccagagtatcagccacctcctactgcctctgctccaccaatgagtggaaccagagttccagttggtggtggagacaacaacgttgttcacaaagccgaggacgttgtgagcactatgcttgccaagggtttcgtgctaggcaaagacgcggttggcaaggccaaagcattcgatgagaaccatggcttcacatccacagccggtgctacagtggcctcaattgccaagaaaattgg

SEQ ID NO: 37505 - DNA, 455 bp, Zea mays
  Clone ID: LIB3060-019-Q1-K1-B4
tccgtgcctcctcctcgtctcttcactccaaatccaccgaggccatcgcctgggccggggagagacccctcgcgctcgtggccctgtgagcagccgcagccatggcgcagccgctcgtcgtgaagaaagacgacgatctcgacgaggaagagtactactcgccattcctgggcatagagaagggcgccgtgctgcaggaggcccgagtcttccatgaccctcagctcgacgcgcggcgatgctgccaggttatcaccaagctcctgtacctgctcaaccagggtgatacctttaccaaggttgaggctacagaggtcttctttgcaacgaccaagctgttccagtctaaagatgcgggccttaggaggatggtgtacctcatgatcaaggaactctcaccttcagccgatgaggtcatcatagtaacaagctctttgatgaaggacatgaatagc

SEQ ID NO: 37506 - DNA, 405 bp, Zea mays
  Clone ID: LIB3060-025-Q1-K1-B6
tgggcacgccggagttccccaacctgggaaagcactgcagcgtcggcgactgcaacgcagatcgacttcctccccttcacctgcgaccgctgcgaccatgtcttttgccttgatcaccgaagttatacatcacaccaatgcccaaatgcaaacatgaaagacgtcactgtcctcatctgcccactctgtgctaaaggtgttcgcctcaatccaagtgaagacccaaatatcacctgggatactcatgttaacactgattgtgatccatcaaattaccaaaaagtgatgaagaaaaagaaatgccctgttcctgggtgcagagagacactgacattttccaacaccatcagatgcaaagattgcaccagagaacactgcctaaagcacagatttgggcctgatcat

SEQ ID NO: 37507 - DNA, 235 bp, Zea mays
  Clone ID: LIB3060-005-Q1-K1-E1
tcgacatgaccgtcggcggcgccccggtgggccggatcgtgatggagctgtacgccaacgaggtgcccaagaccgcggagaactttcgcgcgctgtgcacgggcgagaagggcgtgggcaagtccgggaagccgctccactacaagggctccaccttccaccgcgtcatccccgagttcatgtgccaaggcggcgacttcacccgcggcaacggcaccggcggcgagtccatcta

SEQ ID NO: 37508 - DNA, 398 bp, Zea mays
  Clone ID: LIB3060-013-Q1-K1-F7
tgatccctgagaagtacctcgacgagaagaccatcttccacctcaacccgtccgggcgcttcgtcatcggcgggccccacggtgacgccggcctcaccggccgcaagatcatcatcgacacgtacggcggctggggagcccacggcggtggcgccttctccggcaaggaccccaccaaggtggaccgcagcggcgcctacgtggccaggcaggccgccaagagcatcgtggccagcggcctcgcccgccgctgcctcgtgcaggtgtcgtacgccatcggcgtgccggagcccctgtccgtgttcgtcaactcgtacggcaccggcacgatccccgacaaggagatcctcaagatcgtgaaggagaacttcgacttcaggcccgggatgatcagcatc

SEQ ID NO: 37509 - DNA, 346 bp, Zea mays
  Clone ID: LIB3060-021-Q1-K1-H7
tcgacgcttcaagtctcgctacgtagcagtgcaataaaaaaagcagccgcaatggcgagcagcacgatggccctctcctccacggccttcgccggcaaggccgtgaacgtgccgtcgtcgtccgccttcggcgaggcccgcgtgacgatgcgcaagacggcggggaaggccaagccggcggcggcgtccgggagcccgtggtacggccccgaccgcgtgctgtacctgggcccactgtccggcgagccgccgagctacctgacgggcgagttcccgggcgactacggctgggacaccgcggtgctgtcggcggacccggagacgttcgccaagaacccggagcctg

SEQ ID NO: 37510 - DNA, 396 bp, Zea mays
  Clone ID: LIB3060-026-Q1-K1-A12
tcggagcgcacacacacacaaccagatctcccccaaatccacccgtcggcacctccggttcgagatgcagatctttgtgaaaaccctgactggcaagactatcaccctcgaggtggagtcgtctgacaccattgacaacgttaaggccaagatccaggacaaggagggcatccccccagaccagcagcggctcatctttgctggcaaacagcttgaggacgggcgcacgcttgctgactacaacatccagaaggagagcaccctccaccttgtgctccgtctcaggggaggcatgcagatctttgtgaaaaccctgaccggcaagactatcaccctcgaggtggagtcctctgacaccattgacaacgtcaaggccaagatccaggacaaggaggg

SEQ ID NO: 37511 - DNA, 327 bp, Zea mays
  Clone ID: LIB3060-030-Q1-K1-C7
tctatagcaaccggtccaacactttcacgctctggcgctcagctctagcaatggctgcctgcacgatggcgatctcctccacggcgatggccggtacccccatcaaggtgggctccttcggcgagggccgcatcaccatgcgcaagaccgtgggcaagcccaaagtggccgcgtccggcagcccctggtacgggcccgaccgggtcaagtaccttggccccttcttcggcgagcccccgagctaccttaccggcgagttccccggcgactaccgctgggacaccggcgggcttgccggcgaccccgagaccttcggcaagaaccgcg

SEQ ID NO: 37512 - DNA, 286 bp, Zea mays
  Clone ID: LIB3060-034-Q1-K1-G5
tcgatcacgacaagatggcatgcacaaacaatgcgatgagagccttgttcctcctggtgctcttctgcatcgtgcatggtgagaaggaagagtcaaagggcatcgatgcgaaagcgtccgggcctggtgggtccttcgacatcaccaagttgggcgccttcggcaatggcaagacagacaacacgaaggctgtgcaggaggcatgggcatcggcgtgcggcggcactgggaagcagacaatcctcatacccaagggcgacttccttgtcggacaactcaacttcac

SEQ ID NO: 37513 - DNA, 266 bp, Zea mays
  Clone ID: LIB3060-042-Q1-K1-B3
tcgaccgttaagtctcgctacgtagcagtgctataaaaaaagcagccgcaatggcgagcagcaccatggccctctcctccacggccttcgccggcaaggccgtgaacgtgccgtcgtcgtccgccttcggcgaggcccgcgtgacgatgcgcaagacggcggcgaaggccaagccagcggcggcgtccgggagcccgtggtacggccccgaccgcgtgctgtacctgggcccactgtccggcgagccaccgagctacctgacgggc

SEQ ID NO: 37514 - DNA, 387 bp, Zea mays
  Clone ID: LIB3060-048-Q1-K1-A12
tgctcgttgccctcgctctcctggctctcgctgcgagcgccacctccacgcatacaagcggcggctgcggctgccagccaccgccgccggttcatctaccgccgccggtgcatctgccacctccggttcacctgccacctccggtgcatctcccaccgccggtccacctgccgccgccggtccacctgccaccgccggtccatgtgccgccgccggttcatctgccgccgacaccatgccactaccctactcaaccgccccggcctcagcctcatccccagccacacccatgcccgtgccaacagccgcatccaagcccgtgccagctgcagggaacctgctgcgttggcagcaccccgatcctgggccagtgcgtcgagtttctga

SEQ ID NO: 37515 - DNA, 344 bp, Zea mays
  Clone ID: LIB3060-051-Q1-K1-E2
tcacactcgtagagagaaggaaaaatatccccaaaccctagctcccgatctcgatggcgaaccctcgcgtcttcttcgacatgaccgtcggcggcgccccggcgggccggatcgtgatggagctgtacgccaacgaggtgcccaagaccgcggagaacttccgcgcgctgtgcacgggcgagaagggcgtgggcaagtccgggaagccgctccactacaagggctccaccttccaccgcgtcatccccgagttcatgtgccagggcggcgacttcacccgcggcaacggcaccggcggcgagtccatctacggcgagaagttccccgacgagaagttcgtgcgc

SEQ ID NO: 37516 - DNA, 457 bp, Zea mays
  unsure at all n locations
  Clone ID: LIB3060-021-Q1-K1-A4
tctgttgccgcatcggcagcgttctctgcagcggcgatgccgctcctcgaggagatgatggaagcgtcgtgcatccgcacgtacctgcagcagatggcaggtaagtaggtcaacaaattgattcctctcgtggtcgttgtgtgattttgacgcgacatgcgttgcgtgcatgtatctctctgctctctcggtgcctcggtggtagcagcgtcggtctccacggcgagctgcgacccgtctagcggcgccgatgaggtggagtgccgcgacgaggcggcggcgctgaggcttaagatggtgttcgtcgtggccatactcgtcgcaggcgcgaccggcgtcgcgatcccgctcgtcggccgccgctgccacgggcatggagcctnctnctnctnctncaccggtggggcgttcgtgctcgtaaaggcgttcgcggccggngtgatcctggccacgggct

SEQ ID NO: 37517 - DNA, 377 bp, Zea mays
  Clone ID: LIB3060-023-Q1-K1-B10
tgccaatccgatgacaggctaacacctgcaaagccactcttgcccaacgaggtgctcatctcaggcggtggtgtctttgctcttggcttcttctccctgaagaactcttcaaggttctatgtcggcatatggtacaacaacattcccgagcgcacatacgtgtggattgccaaccgcgacaacccaattaccaccaatgtgcctgggaagctagtttttaccaacagttctgaccttgtcttgttagactccacaggccgcaccatctggacgacgacaaacaactataccgcaggaggaggcggtgaaactgcttccatcctgctcgattcggggaacttggttatccggttgccaaatggcactgacataatgga

SEQ ID NO: 37518 - DNA, 399 bp, Zea mays
  Clone ID: LIB3060-025-Q1-K1-E10
tgttgctagggcataataggctatcaggaagcatcccgacaaaaattgtgaaccagagttccctacaaattctgggcttggaagcgaattttctacgtatggcgttgccatctaatattggcaatacccttcctaacctcctcgcactttccttgtacagtaacatgttccacggtccaatcccagcatcgctaggaaacgcttcaatcctcgtggtattagacttcacatctaacagtttcactggaaatgtacctagttccttgggaaatctaacctacctgaacttcctaaaactagaacagaacaaccttgaagcaaaaaacaatgaaggctgggaattcatagatgcattggccaaatgtacgtatctacaatacattttattatctgacaatc

SEQ ID NO: 37519 - DNA, 445 bp, Zea mays
  unsure at all n locations
  Clone ID: LIB3060-030-Q1-K1-H9
tgttcaagtacctcggcagcgcgctggcgtttcggagctggggcagcaaggacctggtgttccgcgtctgcctcgtgtccgccgtggccagcgcgctcttcaccaacgacacctgctgcgtggtgctcaccgagttcatcctcaagctggcgcggcagaacaacctgcccccgcagccgttcctgctggccctcgcctccagctccaacatcggctcctccgccacgcccatcggcaacccgcagaacctcgtcatcgccgtgcagagcggcatcaccttcggccagttcctcgtcggcgtcttcccggccatgatcgtcggcgtcgccgccaacacctgcatcctgctctgctacttctggaggtgcctctccgcgccggagaaggaccaggagggcggcgccgncgncgcggggcccgacgtcgccgtcgtggccgacgagga

SEQ ID NO: 37520 - DNA, 407 bp, Zea mays
  Clone ID: LIB3060-052-Q1-K1-D2
tctggggttcactaatcagtcaatcccattgtacctgtccgaaatggcgccaccccaataccgcggggcaatcaacaacggcttcgagctctgcatcagccttggcatcctcttcgcgaacgtgctcaactatttcgtcataaaaatcacagcaggatggggatggaggatatccctgtccatggccgcactgcccgccgcattcctaaccatcggcgcgatcttcctccccgagacgccaagcttcataatccaacgtgacggcaacaacacggacaaggcaagggtgctgctccagaagctgcgcggaacggcctcggtccagaaagagctcgacgacctggtccgtgctagcgacctctcacgagcaacccggtacccattcaggaacatactcgagaggaagt

SEQ ID NO: 37521 - DNA, 408 bp, Zea mays
  unsure at all n locations
  Clone ID: LIB3060-001-Q1-K2-A4
taacaattgtactaaatatagtaaagaaatcaaaataatctttagatcaatctaagatgtcgattgccagtaaaaaaaaaagaaatataatagaaaaatatgggacaaaaaataaatccactcggtttcagacttggtacaacccaaaatcaccattccttttggttcgcacaaccaaaaaattattctgaaggtctacaggaagataaaaaaatacggaattgtatcaagaactatatacaaaagaataggaaaaaaggctcgaatagaaaaatggaatcagactcaagttctgaagtaattacacatatagaaattcaaaaagaaatcgatacaatccacgtcataatccatatgggattccccaacttattaaaganaaagggagcaatcgaagaatagaggaag

SEQ ID NO: 37522 - DNA, 428 bp, Zea mays
  unsure at all n locations
  Clone ID: LIB3060-001-Q1-K2-A7
gccgtaccggtccggaattcccgggcgagggagcgggaggttggcctctaggcagggtggcgggcgaagatgttggacatacagaagcggcgcgtgcggctgctgctcttcatcacggccgtcctcgcgctcagcatcaccgctgagaagttcagggaacttgttggaaaggaggctgcatcaaagagtggtcaattcacattcatgaactgctttgacatgggctctggcagccttgcgtgcactgcaaaggagggtgtcaagttgtacgtcaacaacatccgaagtgcacacttggaaatggtgcggcaacgagccatggagaaagctttagctgatgctgtgacggaaggcctaacacctagtgaagcagccaaacaagctcagaagattagtgcanaagcgactaaacttgctgctcgtcaagc

SEQ ID NO: 37523 - DNA, 332 bp, Zea mays
  Clone ID: LIB3060-001-Q1-K2-B4
ggcccccacaatatgccatcttatttaccaccaaacggtgtatcccaagtagcaaaataataatgtgttattacatgattaagaatagcaatcttctgcacttggatacaacagattcccctgccttggaacaaaaaatacttcgaattggtgtggtgccataacatcaagtacaattccccccatcttaacaaattattgtgcgtgtttcaaatgctttgacgatggtattcaattcatgtgaataccaccacataagaaagttgggaggcttcatgatcatctatctggctagaaactggcgtcctctggttgtcgccgcctcaagaaat

SEQ ID NO: 37524 - DNA, 380 bp, Zea mays
  Clone ID: LIB3060-001-Q1-K2-B6
aagcggctttggaagttggaatccatggcgtccacctcgtgcttcctccaccagtccagcgcccgcgtggccgcgccgtcgccgcgcctcgccgccccgccgcgcagcgcgcaactgttcgtctgcaaggcccagaagcagcaggccgccgcggcggagagcgacgtgtcgcgccgcgccgcgctcgcgctcctcgccggcgtcgcggccgtcggcgccaaggcgagccccgccgccgccgcctacggggaagcagccaacgtgttcggcaagaccaagaagaacacggacttcatctcctacgtcggcgacggcttcaagctgctgatcccgtccaagtggaaccccagcaaggaacgggagttccccgggcaggtgct

SEQ ID NO: 37525 - DNA, 452 bp, Zea mays
  Clone ID: LIB3060-001-Q1-K2-C1
accggccggaatcccgggtcgcccacgcgtccgttgctctgatagcttgctccagacgtacgtacgtacgtagatcgatccatcgatcgctagctagctgacgaccatggcgtccctctcctctgccgccatcaccgccccttccttcacggccgcgcccgctcgcgcagtggtcagcaggaggtccttcaccgtgcgtgcctctctccgcaaggccactgccaccgccgccgtggccgttgccgccagcgtcctgcttgccggcggcggcgccatggcccaggaggtgctgctgggcgcaggcgacggcgggctcgtcttcgagcccagccagttcaccgtcaaggccggcgacaccatcaccttcaagaacaacgccggcttcccgcacaacgtcgtgttcgacgaagacgaggtgccgagcggcgtcgacgcctccaagatctcgcagg

SEQ ID NO: 37526 - DNA, 477 bp, Zea mays
  Clone ID: LIB3060-001-Q1-K2-C10
cggaattcccgggcttagagttgcatcagagtctgaggtatcccatgcacaggctgatgtggaaagtgcaggcataattgtttctaatgccgatctgactctctgctacgatgaaaggggtgctaagtatgaattgcccaagtatgttttgagtgaaccaaccaacctgatccgagacagctgaacggcagccggccgtatgaagacccaccgatgtaaaaactgtcaatgactgcacatgccgtcaaattggtcccttgcttgtggtaactggagtgcctatagtaaccttcagatttgctttggcaactttcggcaatagggttttccagttctagtgttcagatgaaaaaaaacttttgcgtaccctcatctattgttcttggttctactgtaaacatgagtctgcttagaattctttggagcgagaatgctgctgatattgttctcgtgcactatcatgatacaagctggagc

SEQ ID NO: 37527 - DNA, 464 bp, Zea mays
  Clone ID: LIB3060-001-Q1-K2-C12
tcgacccacgcgtgcgagctcccatatacgctcccctacctctccagcattctcccgtctccgtcgactagacggggctccgtacctctccagccatgggcaagatcaagatcggaatcaacggtttcggaaggatcggcaggctcgtggccagggtcgccctgcagagcgaggatgtcgagctcgtcgccgtcaacgaccccttcatcaccacggattacatgacgtacatgttcaagtacgacaccgtgcacggccaatggaagcacagcgacatcgccctcaaggactgcaagacgcttctcttcggctagaagccggtcaccgtctttggcatcaagaaccccgaagagaatcccatgtgtgaggctggagctgagtatgtcgtggagtccaccggtgtcttcactgacaatgacaatgctgctgcacatctgatgggtggtgccaagaaagtttttatt

SEQ ID NO: 37528 - DNA, 250 bp, Zea mays
  Clone ID: LIB3060-001-Q1-K2-C3
acccacgcatgcggaggccacaaaacatatgtacccaaacttatcgatctgcgcatctccccaccatccatcgtgcaacgatctgattcaaaagcagacatcaatggctatcaactgctgcaacgtcaacggcaacggcaaggctgctccttctgatatggatgtgcctgatatcaagttcaccaatctcttcatcaactgctagttcgttaactcctccttcttcaagacattttataccattgaccca

SEQ ID NO: 37529 - DNA, 409 bp, Zea mays
  Clone ID: LIB3060-001-Q1-K2-D7
cactgccgtaccggtccggaattcccgggctttagaggaactgcacaaattcttgagaaaaagggttacactcagtttactcctcattatatcacatggtattgtccagaagcttttgttgatagcaagcaatgcaaatcacagtgcatcaatcatgggagatattgtgcaccagacccagatcaggattttagccaagggtatgatggaagaaatgttgtggttcaaaacctacatcagatttgtgtattcaagattgctaatgagactggaaagccatggctgtggtgggattatgtgcatgatttcgcacttaggtgtccaatgaaggataagaaatacaataatgactgtgcccatgatgttatcaaatcacttggatgggacatcgagaatttaaacaagtgtg

SEQ ID NO: 37530 - DNA, 479 bp, Zea mays
  unsure at all n locations
  Clone ID: LIB3060-001-Q1-K2-E12
cggaattcccgggatttgagaaggagagggaaaatgatgccctcgtggcttctgggccgccggggcccctccggcttctcctggagtgccagggccgaccaagtcacgcagggcatctccgccgccggcctcaccgccatcgtcactggggcgtccagcggcatcggcgcggagacggcgcgaacgctggcgctgcgcggggcccacgtcatcatggccgtcaggagccttcccgctgcccaggccgtcaaggacgccgtcctcgcccaggcgccgggggccaagctcgacgtcatggagctcgacctctcgtccatggcctctgtccgcgctttcgcgtcccaattcatcgacaggggtctccccctcaacatccttatcaacaatgcaggagtaatggcaataccttttgcgctttcaaaggatggaattgagatgcagtttgcaactaatcatgttgggcatttnctgctcacaca

SEQ ID NO: 37531 - DNA, 411 bp, Zea mays
  unsure at all n locations
  Clone ID: LIB3060-001-Q1-K2-F4
gtctcgtaccggtccggaattcccgggctccactccagcactgaacacttgattgattcagtaggtagctagctagctgaatcacaatggatcctaccaaggtccgtccgtccagtagccacgacacgacggtgacgacgacgaacgctggcgctcctgtgtggaacgacaacgaggcgctgactgtggggcctcgcggtcccatcctgctggaggactaccacctgatcgagaaggtggcgcacttcgcgcgggagcgcatcccggagcgcgtggtgcacgcgcgcggggccttcgccaagggcttcttcgagtgcacccacgacgtgacgtcgctgacgtgcgccgacttcctgcgcgcgcccggcgtgcggacgcncgtgatcgtgcgcttctcgacggtgatccacg

SEQ ID NO: 37532 - DNA, 426 bp, Zea mays
  Clone ID: LIB3060-001-Q1-K2-G10
ggaattcccgggtcgacccacgcgtgcgcctaccccgtgctccggttcatgtcctgctgctccccatgtcgcccccactcgacctcggctacagaggcctctcgccggcggcggctgccgccgctgcccacgacgacctgaagggtaccgagctccgccttggtctgccggggtccggttcgccggaccgccgtgttgtggctgccaccgcaaccaccctggacctgctcccggctaagggcgccaagcgcgggttttctgacgaggcgccgacgccatcgcccggtgcagcttccgggaagggaaagaaggtagcggaagaggaggacgacaagaaggttgcagcgacgccgcagccggtcgcaaaagctcaggtggtgggatggccaccaatccgaagctaccgcaagaacacgatgtctacca

SEQ ID NO: 37533 - DNA, 387 bp, Zea mays
  Clone ID: LIB3060-001-Q1-K2-G2
cggaattcccgggcctaccgatgcttgttttctagtacactgcaagtagcactttcttgcacacgtgaaatttctggtgaatgaacgaccatggaagaagcaactatttagcagtagaattggttcaaatcaagaccccgtatagcagaggattggaattgaaaacacaagcaaacattgaattgaaaccatctctgtgttatcacatgtttagcctcaccacatgcatcttctttctactagcatgcgcacaagcaccggtctatgtttgcctcaccacatataggcctggcaagattcgcttatattacgcatgcctgagctaaaaaaatgcatgacgtgagaagctctccaagcggacatggggatgaacaacatgtcagcaca

SEQ ID NO: 37534 - DNA, 333 bp, Zea mays
  unsure at all n locations
  Clone ID: LIB3060-001-Q1-K2-G6
taccggtccggattcccgggtcgacnacgcgtccgcccacgcgtccggtcgcgtttgcagctaggcagatctgagttagccggcggatccgatccgtgcgcgtgcgcagtgtgtgtgtgtgtgtgtgtgtgtgtttgtgtcggtggagagatggccacagcttacgctcccatggcgagccaggtgatgaagagcagcctcgtcgtgcactcaaggccaaggggcctgtcaggcgctgttgcgctaacaaggcggcccggccggttcaccgtcaaggccatccagcccgagaaggcaacgtaccaggtggtgcagcccatcaacggcgaccct

SEQ ID NO: 37535 - DNA, 390 bp, Zea mays
  Clone ID: LIB3060-001-Q1-K2-G7
gccgtaccggtccggaattcccgggcacacccaaaagtttcccactgccctggtcccccattcaattcttccaactccgccgcttcgcctcggtccgtccgccgcccccatggcgtccgccgccgccacgaccacctccgcccccgcccagaacctcaatccccttagtatcaacatcaagctccccccatggctcagcgggctgcgctgccccttcaccttcgtctgcccgcccccgcccccgcctccgcctctgccgccgcctcctcccccgctgccacctacggaacccgtggtcccacggtcgcggaggttaccaagcctgcgggtgaccacggagtacgatagcgaagagggcgtgtttgtgaacaaggtgtcgtgcaagcttgc

SEQ ID NO: 37536 - DNA, 440 bp, Zea mays
  Clone ID: LIB3060-001-Q1-K2-H10
accggtccggaattgccccacgcgtccggcttcgcgtctcctactccttcctgcttccacctattaatccaccccactctcttcccgccccgtgccacccgcctctaccgccgcgagatccggctccgcttccagaagcttctggaacgcccgttccatgagcgtctgatcggccgccgccatgggctgcgctggatccacccccaaagtcgacgagaacagcaagaaactgaaaaggcctaaggcttggaagcatacccaaccaattacaccggcacggctgaaacagatgcgtgatgagttctgggacacggctccgcactacggaggccaaaaagagatctgggatgctctgagggttgccgcggagtccgatctagcccttgcacagaccatcgtggacagtgctggaatcatcgtgtcgaaccctgacatgacgc

SEQ ID NO: 37537 - DNA, 329 bp, Zea mays
  Clone ID: LIB3060-001-Q1-K2-H3
aattcccggctggacccacgcgtccgcaggaagctgacatggatttattcctttggaacctgcaacatcaatgctaagtttgaggctaaagctattgaacttattgttacaacatatcaggctgcattgctactactgtttaatggatctgacaggcttagttattctgagattgtaacacaattaaacctgtcagatgatgatgtaatgcgtttgctccattctctttcttgtgcgaagtacaatatccttaacaaggaaccggctagtagatccatctctcccaatgatgtttttgagttcaattcaaagtttactgacagaatgag

SEQ ID NO: 37538 - DNA, 335 bp, Zea mays
  Clone ID: LIB3060-002-Q1-K2-A10
agaatggagggagtataatagatatgggtatgttctaattaatacaccccgagcaactttattatatgtattattacaaggcacatacatacagctgcaataacgtatacatgaacaccctttgtctcgctcctgtttatctatgcaactgctggcatgcatgcaaaagacgcctcgggagataagacccctgttattctgctagtacgtatgcatgcatgtgcacgatcgatgggcgcgatggtcatatcatccgttggttcagtagtagggctggatcttccagcgctggttgtcgccctcgcaccacttccagaagcacgacgttggtgccg

SEQ ID NO: 37539 - DNA, 345 bp, Zea mays
  unsure at all n locations
  Clone ID: LIB3060-002-Q1-K2-A2
ccggtccggaattcccgggcgcgccatttccacctnccactgtcctttcgtccagtccccagccctgcagcccaaccgtggaggttctggaaggcggtgtatcccttctagaaccttctcgagatgcagagcgccgcggctttccggccgtgccccactcggctgctgccagcctcgcccgatcgggatggcaagtgccgccagcgacaggtgtcatgcagcgcggccggggatgctgtggcggccccgaaggcggaagaaggaggcgggctcatgaagacgctgtggctcggctcgctcttcggcctctggtacctgttcaacatctacttcaacatctataac

SEQ ID NO: 37540 - DNA, 367 bp, Zea mays
  Clone ID: LIB3060-002-Q1-K2-A8
taccggtccggaattcccgggccaaattaagaagttcatgaacaccctgcggcagtaccagacccctttgcagcggtatatagctatgatgaaccgtcaggaaacggacgagaggcttttctacaagcttttaattgataatgtggtggagctgcttccttttgtttacacaccaactgtaggtgaggcctgccagaagtatgggtccatctttggacgaccacagggtctgtatgtcagcctgaaggacaaggggaaggtcctagaagttctaaggaactggccacataggaacattcaagttatctgtgttactgatggtgagcgaatcttgggacttggaaacctgggttggcaaggaatggga

SEQ ID NO: 37541 - DNA, 434 bp, Zea mays
  Clone ID: LIB3060-002-Q1-K2-B9
accggtccggaattcccggggcaaccggtccaacactttcacgctcaggcgctcagctctagcaatggctgcctccaccatggcgatctcctccacggcgatggccggtacccccatcaaggtgggctccttcggcgagggccgcatcaccatgcgcaagaccgtgggcaagcccaaggtggcggcgtccggcagcccctggtacggccccgaccgcgtcaagtacctcggccccttctccggcgagcccccgagctacctcaccggcgagttccccggcgactacggctgggacaccgccgggctgtccgccgaccccgagaccttcgccaagaaccgcgagctggaggtgatccactcccgctgggccatgctcggcgcgctcggctgcgtcttccccgagctgctctcccgcaacggcgtcaagttcggcg

SEQ ID NO: 37542 - DNA, 384 bp, Zea mays
  Clone ID: LIB3060-002-Q1-K2-C6
gttggggcgaattagtgacccacaatttccattttatctctattggagcagtaggggatacttgttcacttgccagaactcctgatgcaagatagaagcagtatatgtacatcaaatcaaataattcacaacaagtacattagcatttttatttgacatttgagttcaaatggacatagtatcatctgtttgcgccatgacagaggtttgaacttgccaacttggacatgcatatcttttggtcagaataaaactgcagacctttgtttgatggtattgctttcatctaatcacacttttggccactgtgggctgactacctctaatgtgctgaaaactaactgcatgcgactagcaactactgatggtttctctgaacttcct

SEQ ID NO: 37543 - DNA, 441 bp, Zea mays
  Clone ID: LIB3060-002-Q1-K2-D11
tggagcttaagcgggactggtccagagggactaatgcgttcgagttggctttccgtaggaacaaagagatctctgcattcttggatcagagggaaaggaccaaagtgccggctgatacttcagtttctgctccagaagctgaaagctatcaggaggaagctgctccagaagatgagggaagtagtgaagaattgagctctgtgtcagaagtagcaactgatgtttctcctcctgtatctgatgcctcctctcaggtgggaattcaggattctacttctgtggcaaatgctgctgaggaccaaactgtaggatctgaaagttcacctacaattagtgttgaactgtcctccaacgggaccccagatagctctattgtgtcttcagtttcagaaactgcagataaacctactgaacctgaagaatcttcagcggtagaaagag

SEQ ID NO: 37544 - DNA, 392 bp, Zea mays
  Clone ID: LIB3060-002-Q1-K2-E6
aatatgaaagggaattaaattaatgacaggtgaaaacaaattgttggcttaagctcaaggacgactattgacaaaatatggaacattacaacaaacgtctcagagacagacatctatgaaaccatgcataattttctcataaatacatgaccaacaaaccatctctttgtcaatttgggtgactttagctgctctcatgatgtgcccgtaaaactgagaaaactgtacctaagcacctgcttgccatacaccaaccatgtttctgctcatttgtcgcaaggggcagatagttaatctgtgaaggtgataacgatgccagctgacttaactggtgcctgtggtcacatctagtcagatgactccaaaccatagtcaagcatttctttatgttt

SEQ ID NO: 37545 - DNA, 430 bp, Zea mays
  Clone ID: LIB3060-002-Q1-K2-F11
accggtccggaattcccgggttcaagtctcgctacgtagcagtgcaataaaaaaagcagccgcaatggcgagcagcaccatggccctctcctccacggccttcgccggcaaggccgtgaacgtgccgtcgtcgtccgccttcggcgaggcccgcgtgacgatgcgcaagacggcggggaaggccaagccggcggcggcgtccgggagcccgtggtacggccccgaccgcgtgctgtacctgggcccactgtccggcgagccgccgagctacctgacgggcgagttcccgggcgactacggctgggacaccgcggggctgtcggcggacccggagacgttcgccaagaaccgggagctggaagtgatccactcccgctgggccatgctgggcgcgctcggctgcgtcttcccggagctgctcgcccgcaac

SEQ ID NO: 37546 - DNA, 480 bp, Zea mays
  Clone ID: LIB3060-002-Q1-K2-F4
ccggtccggaattcccgggatgagcaagcctgtcgacgccagtgagtgaacaccagccgtcttggcccgcttctcccctgctgcggccatggcgacctgcgcggcgctctcgaccgccgtcaaccccacccagctctgccggtcccgcgctgcgctgggcaagccagtgaaggggcttggcctggggatggggcgggagcgcgcaagccagcggagcatcacgtgccaggcggcgagcagcatcccggccgaccgcgttaccgacatggagaagcggaagctgatgaacctcctgctcctgggcgccatatcgctgcccaccgtcagcatggtcgtcccctacggcgccttcttcgtccccgccggctccgggaacggcggcggcgggacctacgccaaggacaagctgggcaacgacatcacggtggaggagtggctcaacacgcacggtcccaacgaccgtacgctcgcgcaggggct

SEQ ID NO: 37547 - DNA, 420 bp, Zea mays
  Clone ID: LIB3060-002-Q1-K2-G11
gacgggtaaaactttgcttgccaaggcaattgcaggaaaagcttgcctgccatttttctgaatttcaaggtctgaatttggggagaatgttggtggtggtggaacttccaaaattcgggaccctttcaagaaaggccaagggaatggctcttgcatagtggttggtggatgaaattgatgctgttggaaaggcaagaggtacaggtattggtggtggaaatgatgaaagggagcagactctcaatcaactactaactgagatggatggtttcgagggcaacactggaattattgttattgctgccactaaccgggctgacatattggattccgctttacttagaccctggcgttttgatagacaggtgtctggtcacgttcctgatgtacgtggaaggacagagattctaaaagtgcatg

SEQ ID NO: 37548 - DNA, 420 bp, Zea mays
  Clone ID: LIB3060-002-Q1-K2-G12
gacgggtaaaactttgcttgccaaggcaattgcaggagaggctggcgtgccgtttttcgcaatttcaggttctgaatttgtggagatgtttgttggtgttggagcttccagagttcgtgaccttttcaagaaggccaaggagaatgctccttgcatagtgtttgttgatgaaattgatgctgttggaaggcaaagaggtacaggtattggtggtggaaatgatgaaagggagcagactctcaatcaactactaactgagatggatggtttcgagggcaacactggaattattgttattgctgccactaaccgggctgacatattggattccgctttacttagacctgggcgttttgatagacaggtgtctgtcgacgtttctgatgtacgtggaaggacagagattctaaaagtgcatgg

SEQ ID NO: 37549 - DNA, 426 bp, Zea mays
  unsure at all n locations
  Clone ID: LIB3060-002-Q1-K2-G2
taggcagttcaaagctactgccatggaactaatttctgttctagaacagaagcatagggcggttggtaggacaaaggtgcttcttgatacagatcctgttcacaggctagctgatattgctgttgctagctttgagataagttgtgaggagcagctttcgatgctggattcagttcacttgaatgttatactctgaaaggcaactgaacttgtagacagacacctgcagtcgattcttgtagctgataaaataacgcacaaagttgaggggcaactatcaaagtcgcagaaagaatttctactgctccagcagatgatggccataaaagaagaacttggtgatcacgatgacgactatnatgatgttgctgctgttgaaagaaagatgcagaatgcatgaatgcctgctaatatttggaagcatgc

SEQ ID NO: 37550 - DNA, 243 bp, Zea mays
  Clone ID: LIB3060-002-Q1-K2-H3
taggcagattaaagctaccgtcatgcaactaatatctgttctagaacacatgcaaagggcgggtggtaggacaatggtgcttcttgatacagggcctggtcacaggctagctgctattgttgttgatagctttgagataggttgagacgaacagctatcgatgctggattcagttcacttgaatgtgatactctaaagggcatctgaacttgtagaccgacgcctgctgacgattcttgtagc

SEQ ID NO: 37551 - DNA, 474 bp, Zea mays
  Clone ID: LIB3060-002-Q1-K2-H5
gtaccggtccggaattcccgggggaaagggaagctagcggcttcgctctcgcggggagatggcgcaggcggtggaggagtggtaccggcagatgcgcatcatcacgcgctcctacctcaccgccgctgtcgtcaccaccgtcggctgcaccctcgaaatcatttcgccgtatcacctgtaccttaacccgaagctcgtggtgcagcactacgagatttggcgcctcgtcaccaacttcctctacttccgcaagatggatttggattttctattccacatgttctttcttgcacgatactgcaagcttctggaggaaaactcatttagaggaagaactgctgactttttttacatgctcttgtttggtgctactgtcctaactggcattgttctgatcggagggatgataccttacatttctgagacatttgccagaattctgttcttgagcaattcattgacatttatgatggt

SEQ ID NO: 37552 - DNA, 271 bp, Zea mays
  Clone ID: LIB3060-003-Q1-K1-A12
acccacgcgtaacggggagcgacccactttcacacgacattttccaccaccaccaaccagcaaccggaccgggcacccagcgcaaagcgatggcgtcgctcaccatgatggcgtccttcgccgccgtggcggtggccgcgccctcgcgccgcggcaccttaaacgtggtcaggtccgcccaggacgaccgctgccaggagcccgccacgctagcagcaaccgaagccaggcccgtctgcgactgacgccgagccggcatgctcgcggctgc

SEQ ID NO: 37553 - DNA, 444 bp, Zea mays
  Clone ID: LIB3060-003-Q1-K1-B3
ccggttcggaattcccggggagaacaatcatatatatattgttgcttaaagagaagagaagagtaagagaagatcgacaagagattggcggtaatggactcctcggagctgcacatactggccttgcagagggtgaagcaggtggagccggagaacgcgagcaagatcctcggctgcatcctcctggaggaacccgacaaccaggatatgctgcagctcgcctacggcaacgacgccgaggtgcacgccaagatcagccacgccaaggccatgctggacgccatcgtcgcgtgctgctcctcctcgccggccttcggctaccactactggccgtcggtgcccaataaggcgcaggcagaggagtacgcgttgcagccgcagcactacagtggcggaaggtgctactacgcctctgagaacgcgctcatctacaatggcgggggg

SEQ ID NO: 37554 - DNA, 445 bp, Zea mays
  unsure at all n locations
  Clone ID: LIB3060-003-Q1-K1-B6
atgcagtaaggttactcttatgggcattcttgctttcttcctcaactgcagcccaaagttcaagtccctctctctgtccaagtgcatcgagatcaaggacatatgctctgcacctgcacagcttccagaatgcaaatcgcttcagtccctggccatcaaggattgctcaggcttcaccgacaccagcctccctatgttggcatgttctgccctcagctggagaacatcaatatgagtggccttagtgtagtcaccgacaatggcttccttccactaatgaagagctcgaaaagtgggctggtcgacattgatttgaacagctgcgagaatctcacagacatggttgtttctgccttggttaaggccatgacgcttcccttgccacctcagtttcgagggatgcatcangatcactgatgcanacctgttcgccatctgtgagagc

SEQ ID NO: 37555 - DNA, 408 bp, Zea mays
  Clone ID: LIB3060-003-Q1-K1-B8
gccaagttgcaatcgggggaccgggtggaaaccctttcttggggcaacagatgtcaagccagaaggactactctatggcaacagcggatgttgtggacgccgatgtgagggaactcgtggagaaggcctactctagagcaaggcagataatcaccacgcacatcgacatcctccacaagctcgcccagctcctgatcgagaaggagaccgtggacggggaggagttcatgagcttgttcattgacggccaggccgagctgattgtcgcttgagatgtcacaaggcttgcggtgcgtatgcttttcagtgttttgtgtcagagcgagcaatcacaaagcaatggaaagcccagcttgtaggaaccacatcgatgtatagtagttgatacgcatgtactgacttaattga

SEQ ID NO: 37556 - DNA, 360 bp, Zea mays
  Clone ID: LIB3060-003-Q1-K1-C12
ccggctcgaccaacgcgtccgtgccgcggcacccttggccttgggcatattgcaggccagccgtgcccgcttggtgggggcttgctgtgcgcggctaggccccaggtggaggcttcccggctcctggacgtgcccacgggtcgactcgacgatatgggcccggggctggacgcctgcggccgggggagcggcctggcagaggggctacagcgcagaggtgaagactgaggacgagctgcgggtgcggtacctggaggaggagaaccgaggaattgtggtgcttggaataaacagagcctatgccaaaaattcattaagtaaaaatcttataaaaatgctttcaaaagctgtggatgcttt

SEQ ID NO: 37557 - DNA, 424 bp, Zea mays
  unsure at all n locations
  Clone ID: LIB3060-003-Q1-K1-D11
ttctcttttgcttttgtgttgctgttaggtttttgggtagtttgatgaatgatactgagcagcagcagcagcagtaattcatagtgggcggtgtgatagcagcagtgagatcgaggagaggatggaggtgttcatccacgaggactacgtgaacaagcgcaacgagctgaggagggagcagaggcgccgggaactgcagaggctgcaggtggagagcaaccccgacgcgtcccgggaggcgctggcaagccgggagagcccgaggacgccggctcagtgcctgacgccgaccggcgcgtcgccgtccagcttcagatccccgacttcgaggagcacgctgcagtcgccggccgcagcggcggggcaggctgctggttggccgtcggagcatcgccgnctctacgactgcctcaagccgtactag

SEQ ID NO: 37558 - DNA, 455 bp, Zea mays
  unsure at all n locations
  Clone ID: LIB3060-003-Q1-K1-D12
tcccgggtcgacccacgcgttcggtagaatgcatctctgttttgctaacaattgttagcgaaatagctgagaagaagctaataagccaatcagtgataaagcattgcattgatttattttttcagtacccttataataactttttgcatcatcatgttgagaacattattgtttcttgccttgaggttaaaagaaatcaattgattgaccatattcttaatgactgtggtcttgttggtaaagtccttgccgctgaaaaaagttcttctctggcagtggagtctaatgggccaacattaccatcagaagggaaagaacctncaagaattgggaatattgggcacataactcgaatagcgaataagctcattcaatttggaaatagtaacagcatgatccagagtcacttgcangagaacagtgagtgggctgtatggcaaatagatgttctgatc

SEQ ID NO: 37559 - DNA, 53 bp, Zea mays
  Clone ID: LIB3060-003-Q1-K1-D3
ccggttcgtgaattcccgggtcgacccacgcgttcgcgcatcgctagggttag

SEQ ID NO: 37560 - DNA, 472 bp, Zea mays
  Clone ID: LIB3060-003-Q1-K1-D8
taccggttcggaattcccgggcgccgcaccagcgccagcccgcgccgtggtcagaaggaggtccttcaccgtgcgcgcctctctccgcaaggccaccggcaccgccgccgtggcaatggctgccagcgccctgcttgccggcggtgccatggcccaggaggtgctgctgggcgcaggcgacggcgggctcgtcttcgagcccagccagttcaccgtcaaggccggcgacaccatcacattcaagaacaacgccggcttcccgcacaacgtcgtcttcgacgaagacgaggtgccgagcggcgtcgacgccaccaagatctcgcaggaagagtaccttaacgcgccaggcgagacctactccgtcaccctcaccgtgccgggaacctacggcttctactgcgagccgcatcaaggaaccggaatggtcggcaagatcaccgtcaactaattaaagctagctatcgatcgatat

SEQ ID NO: 37561 - DNA, 427 bp, Zea mays
  Clone ID: LIB3060-003-Q1-K1-E11
ccgggtcgacccaagcgtccgctggtctgtcgcacagacttagagcaagatttgcctagctggttacaagccatgatcatgtggagcggtcgagggaaaatatatctggagagggaaacaatgtctggctaggacggtcttaaggtcctcggcctgcaggtgatccctgtcgtgctctgtagtggcttggcgctgaacatgaaaggagtgagttacgagtacgtgaaggacgacatatccaacgagagtgagcttctgctcaagttcaacccggagcacaagatggtgcccgtgctcatacacaacggtaagcccatctgcgagtcactcgacatcatgcagtacgtctacgagctgttcgccggtcggccgatcctagcaactgatcactacgagcgcacaagtggtcgattacgagctgcctacg

SEQ ID NO: 37562 - DNA, 446 bp, Zea mays
  Clone ID: LIB3060-003-Q1-K1-E12
ggaattcccgggctgtcgtgcatgcatgcagttccttgagccacttgagctgtgctacatatcactgtgtgactgcggcgacaaggccatcgcggacgggagcctcctggacctcctgcgccaggtgttcacgttcgggctctccctggtgaagctggacatccggcaggagtcggagcggcacaccgacgtgatcgacgccatcaccacgcacctcggcatcgggtcgtaccgcgagtggcccgaggacaagaggcaggagtggctgctgtcggagctgcgaggcaagcgcccgctgctgcccccggaccttccccagaccgacgagatcgccgacgtcatcggcgcgttccacgtcctcgcggagctcccgcccgacagcttcggcccctacatcatctccatggcgacggccccctcggacgtgctcgccgtggagcttctgc

SEQ ID NO: 37563 - DNA, 296 bp, Zea mays
  Clone ID: LIB3060-003-Q1-K1-E6
aattaatacaccccgagcaactttattatatgtattattacaagggacatacatacaggtgcaataacgtatacatgaacaccctttggctcgctcctgtttatctatgcaactgctggcatgcatgcaaaaaacgccttgggagataaaacccctgttattctgctagtacgtatgcatgcatgtgcacgatcgatgggcgccatggtcatattatccgttggttcaatagtagggctggatcttccagcgctggttgtcgcccttgcaccacttccagagcacgacattggtgc

SEQ ID NO: 37564 - DNA, 456 bp, Zea mays
  Clone ID: LIB3060-003-Q1-K1-G11
ggaattcccgggatcaaatccacggtttaataacgaaccgtgttaacttaccataacaacttctcaattcctatcgaattccttcctatcgaattcctatagtaaaattcctataggatagaacgtacacagggtgtacacattatatatgaatgaaacatattcattaacttaagcatactcctttttttatttaatgagttgatattaattaaatatctttttttttagatttttgcaaaggtttcatttacgcctaatccatatcgagtagaccctgtcgttgtgagaattcttaattcatgagttgtagggagggacttatgtcaccacaaacagaaactaaagcaagtgttggatttaaagctggtgttaaggattataaattgacttactacaccccggagtacgaaaccaaggatactgatatcttggcagcattccgagtaactcctc

SEQ ID NO: 37565 - DNA, 438 bp, Zea mays
  Clone ID: LIB3060-003-Q1-K1-G8
cccgggtcgacccacgcgttcgcggacgcgtgggcagcacagagcattcagcttcccccaacaaaggaatctccctggcgttcctcagcagggtagccatgtttggtcttcgtgcccgcgcagcggcgcagctccagcgcccaaccccgtctccctcctccgcttcctcggcgtcgttctcgctcgcgaggctcgggtgcgccttcccgctcgccgccctcgcgcctctggcttccgcaccgccgtcgccgtcggccagggagacacagccgacctccctctccgccaggtggcctgccgcgcccatgcgtccctggggaacccgtggccactccaggccgaccacgcgcgttctctgcactgctgccggcagcgtccaaagagaggggaaagaactgctagttcagcatttgcttgttggtgaaaaggatttcaggc

SEQ ID NO: 37566 - DNA, 425 bp, Zea mays
  Clone ID: LIB3060-003-Q1-K1-G9
ggatttcccggatcgacccacgcgttcgcaataaggctattagacatgcacattccatctttcgtgatatccacaagtccatatttgaggagcaggtatttgatatggtgatccgggagacgtttaaccagtctcaaggcatcaatgttactgggatgtgcgaagattttctccaattagctattggccaggagtgatcgttgagcctttcactagagctctctggacagaacaataatgcaggaacagtaggacagcttgatcatatggatacaagttattctggataacctgacattcattgcaaacgttaatgatgcctcaaatattgatgccacagggtttcctaaccccaaaagctcacaaatctacctgctgcatatgttccatgaaattcttatgaaactcaaggagaaatctcgtca

SEQ ID NO: 37567 - DNA, 394 bp, Zea mays
  Clone ID: LIB3060-003-Q1-K1-H12
taccggttcggaattaccacctagacctacgcatgccgggtcttgccaatcctcctgcattccgaccgagcgagcaaggagagacacgagggcgactgaggccgtcgcatactccttctgtgcgatccgtacgtagcctgctacctagcaatagcaacccgatcagccaatcattgccgtgttcaccaactccgtttccctattacctagatagaccaggccagatgctgtctgcctcaacggatcgacacgacttgagggatggaggactgagaccgtcgattagagtctgagacagaagccgatgcaacaccggagcgactagctgtatgagatgtacatcatcattgacacggatccctgcatcgatgacagcgtggacatcctgatggca

SEQ ID NO: 37568 - DNA, 415 bp, Zea mays
  Clone ID: LIB3060-003-Q1-K1-H8
tttgatatctccaagaaatgtggatttattcagtgcagtatccagcagctcttcaaatgaccttgaacaaggtgcaaatgtcaggtccaataatgccgagaggttaacattaccagtccaagggccactaaggaaattgttcgctgacatgttatgtcaccagaatatttacttacccgttacatcattgcaagaggcaaatgataacaggaaggaagtcagggttgaatccagtcaagaaactgttagtaatggtttccataggccaaagacaggagagtctgtgatttccattgaaaatggggagtccataaatgatgcccagacacaagaaattactcaagcaataatgccaactggttcttctgtaagtgataaagatgcagaatcacctgttattggagacaatggggca

SEQ ID NO: 37569 - DNA, 351 bp, Zea mays
  Clone ID: LIB3060-004-Q1-K1-A5
taccggttcggaatcccgggtcgaccgacgcgtccggcgtgtaaatcatggcgtcctccgcggtcctcaacgctctcgtcctccgatcgccatgaccgacgctctcgtcctcatctaaccgtcgcatcaccggcgccttcacgagcccgaaccgaccgggctttccatgcctgcgttctgtgcgtcgactcagccttgcgagggcgggtgcagcgcagtcgccgggcgatggccgcgaggacgagtgggggccggagcccgagggcgggtccgctgtcacagcggccgcagcggcggaggcgccgggagcgagagaggtcacggagctcagggctcgagtcaaggacgcgc

SEQ ID NO: 37570 - DNA, 324 bp, Zea mays
  Clone ID: LIB3060-004-Q1-K1-B6
accggtctcggaattccgggtcgacccagcgtccggcgcaatgagtttgctgatgaatctattggtggcaacaggcactcatttgaagatgaacctgggcacacccgaggtccacataggaggcggcattcaccaccacatggctggcttatgagagatacggacattgacgaattctacggaagagagattccagagtataggctggcggcccgttgacaaatagaagatctcccagatagcatgatggacgacaggttttatatgccgtattcccatagacaccgtggccaaggtgatcatgggttgattcacagagacaga

SEQ ID NO: 37571 - DNA, 450 bp, Zea mays
  unsure at all n locations
  Clone ID: LIB3060-004-Q1-K1-B9
taccggttcggaattcccgggggctcattcatcgaaacgcaaatcagagagacaggataagaaaaaagaattttgatcaaatcaatagaaggaaggatcccttacctgatttgaatttcatcctcctttaaataggatatgctctaagtcttcccatactttcctataatgactgcaacgattttctccattttgcgaattcctattttatttgaagtatattactatcatatacattatctaaatcgatccactttaaataaaatagaaaaaatcgaaagaaaaaaaaaaaagaaagagtaaataataaaacaagatattctgtttcataattctgaaatagagttcttntttttagtattactcctcattaggatgtattatattaatcatcctattttaatatatattaatcatcctattttaataggttctaatccaattagtaat

SEQ ID NO: 37572 - DNA, 471 bp, Zea mays
  Clone ID: LIB3060-004-Q1-K1-D11
taccggttcggaattcccgggcatcgaaacgcaaatcagagagacaggaaaagaaaaaagaattttgatcaaatcaatagaaggaaggatcccttacctgatttgaatttcatcctcctttaaataggatatgctctaagtcttcccatactttcctataatgactgcaacgattttctccattttgcgaattcctattttatttgaagtatattactatcatatacattatctaaatcgatccactttaaataaaatagaaaaaatcgaaagaaaaaaaaaaagaaagagtaaataataaaacaggatattctgtttcataattctgaaatagagttcttttttttagtattactcctcattaggatgtatatattaatcatcctattttaatatatattaatcatcctattttaattaggttctaatccaattagtagtaagtattttcttttttatttaataagctct

SEQ ID NO: 37573 - DNA, 315 bp, Zea mays
  Clone ID: LIB3060-004-Q1-K1-D7
ttcccgggacgacccacgcgtgcgcgccacagcttgcgcccgcaatggcactcgtctccgcctactcgtcctccaccaccgacgtcacggggctccccagtaatggacagcgggcgtcgtcctccttcctcagcggcaagacgctgctgagacaggccgaggcggcccggccgtcgttcgccgtgcgcgccgcagcggaccccaacaggccgatctggttccccggcagcacccctacgtcgtggctggacggcagccttccctgctacttcggctttgatccctggggcctggggtctgacccggagagcctgc

SEQ ID NO: 37574 - DNA, 272 bp, Zea mays
  Clone ID: LIB3060-004-Q1-K1-F7
tgtcgttcgcggtttcggttcccgggtcgaccagcgttcggtcctgcgtctgccttgccagtatccatcgtctcgctcgggccgtccctcccgcgtccccgttcgaaggtgcggtggccggcaggcgatcgatttgattcgacatgaattccgagtaccactaccttttcaaactgctgcttattggtgattctgatgttgggaaatcatgcttgcttagcagatttgcagacgatgcttatttggacagctatttcagcgcacttggggtt

SEQ ID NO: 37575 - DNA, 466 bp, Zea mays
  Clone ID: LIB3060-004-Q1-K1-F9
gtaccggttcggaattccgggtcgactcacgcgtccgaaaaaaactgcagcttgctttcacttctctagtgtacccttcactgatcctgggttacatgggccaagctgcttatctgtcccagcaccataaccttgacgcaagctaccagatcgggttctacattgcagttcctgagtgtgtacggtggcctgtgctggtgctggccatcttggcgtccgtggtgggcagccaggccatcatcagcgggaccttctccatcatcaaccagagccagtctctgagctgcttccctagggtgaaagtcgtgcacacgtctgacaaagttcatggccagatatacatccctgaggtcaactggatcctcatgatcctctgcgttgcttgcactggtggtttccgtaacaccaagcacatggggaacgcgtctggcttggccgtgatcacggtgatgctggtgaccacgtg

SEQ ID NO: 37576 - DNA, 200 bp, Zea mays
  Clone ID: LIB3060-004-Q1-K1-G12
ttattttttttttttttgtatttgttttttttttttttaaggatgtttggaaattttgtggattatatggaaaaagaagaagcttaagtatgctgtctttatgaacctaaaagggaaaattgccttgataaatttaaaaatcctggagaaaagttaatttaatcacatattttgagcagaaactatcatttactttaaat

SEQ ID NO: 37577 - DNA, 400 bp, Zea mays
  Clone ID: LIB3060-005-Q1-K1-A8
taccggtccggattcccggcgttttgggttggatgtgtctatgggaataatgatgagagctgatttagcttactctgccattctgatctgcagaggatgatccaaaaaggatcttcttctcatattatacattgctatcactgtgcatgtgctcacactgattaggtatacctggaacaaagacctcttaatgcaaaggaaaatggtatggatagtatctaccatgcacattgtacaagccaggaccgcatcacactaaaagggcaataccacaactgatacatggttacaacacgtctctcaaacatagtacccataagtagatccacacacagctattgcacatgactactatgacttccatggtattcaacaaggaattgaacctaacatttaggat

SEQ ID NO: 37578 - DNA, 452 bp, Zea mays
  Clone ID: LIB3060-005-Q1-K1-B11
cggattcccgggtcgacccacgcgttcgcagctgccccgcagcaacgaacacgaaccttggcagaacgaagctgaagtagttcggtgtgaacccagtatggcaaacgcgccgaggatcctggccctcggcctgctgctagcgctcctgtgcgctgccgccggcccggccgccgcgcagaactgcggctgccagcctaacttctgctgcagcaagttcggctactgcggcacgaccgacgactactgcggcgacgggtgccagtcgggcccgtgccgctcgggcggcggcggcggcggcggcggaggcggaggcagtggcggtgcgaacgtggctaacgtggtcagcgacgcgttcttcaacggcatcaagaaccaggccgggagcgggtgcgagggcaagaacttctacacccggagcgcgttcctgagcgccgtcaacgcgtacccgggct

SEQ ID NO: 37579 - DNA, 169 bp, Zea mays
  Clone ID: LIB3060-005-Q1-K1-B3
acccacgcgttcgcatctcctttccttgtcgtgctcgcctttgtcgttcgcgtccatctcgcctgtcgaacgtccctgagctttttcttcaaccaccgccgaccccatggtgagctcgtacaaactccatctccctgtgcgcccttagttctgcttcatccgttcttca

SEQ ID NO: 37580 - DNA, 234 bp, Zea mays
  Clone ID: LIB3060-005-Q1-K1-C10
ccggttcggattccgggtcgacccacgcgttcgggcacacgctcgccagactagccgatcttcactcaagcggcgcccaacagaagtaatggccactgggacggccctctccctcagcggtggccggggctgtactaccctgctactggggcacgcggtcttggactcagggcagtgctgcgcgttcccatgctcgcggtggaagccgccgcacctgccagactgccgcgcgga

SEQ ID NO: 37581 - DNA, 236 bp, Zea mays
  Clone ID: LIB3060-005-Q1-K1-C3
cggaattcccgggccctcttgccggtcccgaataaagagcagcagcgcaagaggtctgtagagcgagaagaaggcaatggcggccgagagctgccttttcacctcggagtccgtgaacgaggggcaccccgacaagctgtgcgaccaggtgtcggacgccgtgcttggacgcatgcctcgcgcaggaccccgacagcaaggtggcctgcgagacctgcaccaagaccaacatggtg

SEQ ID NO: 37582 - DNA, 449 bp, Zea mays
  Clone ID: LIB3060-005-Q1-K1-C9
ccgggtcgacccacgcgttcgatgccatcacggccagtctcttccaatgttattcgtgatgatcatgcaaaaaggaagcaagtggcaaaaagaagatttgatgaagatgatgaagaccccttatcaatgatcagaaatatgtttgggtatgatcctagtagatatgcaggcagagatgaagatgtcagtgacatggaagccgattttgctactatagaaatggaagagaaaaggagcgcgaggattgctaggcaggaggatgaagaacaacttcgcttgattgaggaagaagagagactcgagcaggagagaaagaggcgaaagatggcacgaggccgatagtcgaatacactcctatttggatgttataatatactaccttcgttctcgaatatttgtcgttcgctggttcatttttgaactaaaccgtgtcaaatataaaagaacgc

SEQ ID NO: 37583 - DNA, 148 bp, Zea mays
  Clone ID: LIB3060-005-Q1-K1-D2
acccacgcgtccgacagcaatctacacaatcacttttacatatcactttcgctatagacagacacaccaagcgttggggccaatagcttactaccaggaggtgggctactgctcagaagacgtgacgtccggagcctcgggcgggttt

SEQ ID NO: 37584 - DNA, 242 bp, Zea mays
  Clone ID: LIB3060-005-Q1-K1-D7
tgctgttgtcgtcatttgagttcatgttcagcaaggtcgacataaaagacctaccaggggctaattaacatgtaagacgaactaaccctttgcacgggcaagctggttacctatcctgtgcaaatgggcagtacaatacgaaatgttcagatttcaccgtggcatcaatgaacttatgttcgaaggcagcgacaccacccaaggtatcgataccgattgtgaaaacgcatattgatagaaga

SEQ ID NO: 37585 - DNA, 288 bp, Zea mays
  Clone ID: LIB3060-005-Q1-K1-E10
ggtcggattcccgggtcgacccagcgtccgcatatgttcgccagagggaagtacatctatcaagactcacggggaggatgtaagggttcccctcgcgtgaatgctgcgcggcgaccgggtcactgccggcgacgtccactcggacgcgagatgttccatccctttacgcttgcttcttgcgcacgcggtctgagttgatagtaattggacactgaatacttggattgtatctctagatagtctataaggtgagtgggcttggaaggagaaatactacaagcgattatc

SEQ ID NO: 37586 - DNA, 387 bp, Zea mays
  Clone ID: LIB3060-005-Q1-K1-E9
cggttcggaattaccgggcggacgcgtgggtttgcacaggccactccaccggatcttctatttttcctagcacaaaggggaggaagtaaaggcttcccctcgccggagatgctgccgtcggcgaccgggttcactgccggcgacgtccactcggcacgcgagatgttccatcccttctacctctgacttcttgcgcacgcggcctctagtagatagtaattggacacttcatacttggattggatctctagatagcctagaaggtgagcgggcgtggaaggagaaattcgggaagcgatgagctttagcgccgcaagagtctcggagcatggcggctagttcgaagaggcaagggggaatgccggcagatgtgagctgggagatgct

SEQ ID NO: 37587 - DNA, 372 bp, Zea mays
  Clone ID: LIB3060-005-Q1-K1-F12
gagaaggagatgaatgagctcaagctctaggagatcaagaacggcaggctcgccatgctcgccatcctcggttacttcatccaggggctcgtcaccggcgttggcccgttccagaacctgctcgaccacctcgccgaccccgtcaacaacaacgtgctcaccagcctcaagttccactagaacgttggtgcatcagcatacctgctgccgtcgccgccagttgtttgctgtggaaagctagatgcatgcgtgttgtaaaggaacctgaagcgttgcatcggtcatgattcatgcatggccagcctgctgcctgtaacaacaaactagtattgatcttattgagaccggaaactgtattgcacatggtaaatc

SEQ ID NO: 37588 - DNA, 233 bp, Zea mays
  Clone ID: LIB3060-005-Q1-K1-F4
cccggctcgacccacgcgtacgaaaaaataaacacgttcgatagcgctttctcattcgatgaccgaagctcaagatagaggaagcgccaattcctgatcactggaggactatactatcttattcaagcacggcaactgatgtaacaccaattgacaataagacgggtgtacctcttctgagatgaaagcttccctttctcgtcaggtccagatataccctttcaacctagcac

SEQ ID NO: 37589 - DNA, 293 bp, Zea mays
  Clone ID: LIB3060-005-Q1-K1-G3
ccggctcgacccacgcgttcgctgagctccaggttttcacacctgacgtttatttatcatacataaggcgcccgcggtgcccatggattcgtgtcaccgcgtgccgagagcgcatatcattccgagcgacgcataaacccttatgcaggcacccgaccctttcatgggaaccaccaccaaccaggcaaggctcctcctctcgaagcaggtaacagaacttgcgaagcaccccgtggatggggtctctgatgcgctggtcctctacagcaatgtcttcgagtggcaggtcacca

SEQ ID NO: 37590 - DNA, 432 bp, Zea mays
  Clone ID: LIB3060-005-Q1-K1-G4
ccgggcgtgaacccgccgccgacgcagcagcaggagacgcgccaaggagagcccgcaaggaggcgactatgagggccaagtggaagaagaagcgcatgaggaggctgaagaggaagcgccgaaagatgaggcagagatccaagtaggctgatggggattgtggatggtggtgtcggcatagttgtgttacgtttcttcgatgcgtgagttcatggagagatgtcacatcctagttcgtcgtcaccgtttgccatgggtccaatggctcgtcttggaaacctgcacttcagtaggccatctatcgtggtttctagctatatccagagttttgtgctaagacaaatcagtcagtcgttttgtgaacctattatgatggagctttatttgctgctaaatatgaacctacctggtaagtaatggcaacgttcgtct

SEQ ID NO: 37591 - DNA, 439 bp, Zea mays
  Clone ID: LIB3060-005-Q1-K1-H12
gggtcgacccacgcgttcgctcggcccttcttcaagggtcattcgttgcattgtacctgaacgctggacatgtgctgtactcgaatcatcgcatcacttacgattcatcctcgaattgacatgtgatctgaaaagacagggtgcattgtacaatccatgacgtgcgtgggtcactatcatagcacgagggcgatcgacgcaagcgctgtgccacctggatcttgagctacctgtgagcacatacctgcccaacttaagcgccaggcagcgcatgttgaactgaagatcacgatagcaccgagtctccgctagtaagacagtgcactatctcgattaccaagtcttgattcacgatactctcaaggtaaaatgtggagacaagaccaacacaatccacattttgctgcgacttcgttgatgcgcaatgctgtattcacta

SEQ ID NO: 37592 - DNA, 151 bp, Zea mays
  Clone ID: LIB3060-005-Q1-K1-H3
aaaaaaaaaaagtggtgctatataaatttcagagatcaacaatagaatactgaaaaaaaggagagacctgaaaaacaaagggcaagcggtctagaggattcaaggttacgtgctcacgactgcgacctgttaactctgtcattgtgctatc

SEQ ID NO: 37593 - DNA, 393 bp, Zea mays
  Clone ID: LIB3060-005-Q1-K1-H7
cgtaccggtcggaattcccgggagcgacagagtatggaaatggataaggtagcggcgagacgagccgattaaataggtgtcaagtggaagtgcagtgatgtatgcatctgaggcatcctaacgaacgaacgatttgaaccttgttcctacacgacctgatcaaatcgatcaggcacttgccatctatcttcattgctcaactctttgatgaaaaaaaaaaatgatatagaaaaaaaaaaaaaaaaaaaaaaaaaaaaaaaaaaaaaaaaaaaataaaaaaaaaaaaaaaaaaaataaaaataataaaaaaaataaaaaaaaaataaaaaaggggcgccctttttaaaggacccaagtttacttcccctgacatgcaactttataccttttttt

SEQ ID NO: 37594 - DNA, 472 bp, Zea mays
  Clone ID: LIB3060-006-Q1-K1-A2
cggaattcccgggtcgacccacgcgttcggaaccatgtaatcagggttgttccgcgtaacgcacagactgcttcagtcccgaaagcccaacctcagccgtcatccggaggccgggaccaaaagaaccatgtaatcagggttgttccgcataacgcgcagactgcttcggagtcagcagcgtggatcttgcggtcaatacaaatggagaggaaccaaaatgattcgtagctggttaccatactttcgtgtcatccgatggcagcttagtgcagcattgcagtttacagggctacccgagctgcagattatggtggctcctgtattctgaccactgattgcgctttacccgatcgtcatagatattggatgatatgatcttgtgttctatgcagagttgtaagccaaagttgtgcccctgaagactgaagtgacagtcctgaagttgggaagtcttcctgaatgtgctatgact

SEQ ID NO: 37595 - DNA, 134 bp, Zea mays
  Clone ID: LIB3060-006-Q1-K1-A4
ccacgcgttcgtcagtagtcgtcgcgtttgcagctaggcagatctgagttagccggcggatccgatccgtgcgcgtgcgcagtgtgtgtgtgtgtgtgtgtgtgtgtgtgtgtcggtggagagatggtcacaga

SEQ ID NO: 37596 - DNA, 349 bp, Zea mays
  Clone ID: LIB3060-006-Q1-K1-A7
tggagcagagctggacagccgactagtgcataaggatgctcgccgtgcccgataggggcacaataagaaagcgtgaaaaaaaaacacacccactccttgtgtttctggttcgccaggcttgtcgaaacattgaagaaccccagtgattggtttgtagtctgtcgtcgtcgttctgcccccatcaagagccccggttgctcatggtggtggctgtcgtaatgtagcggttgttgacctatcttctcatgaattgaaaggatcctgcccatgtacaaaaattatagcgtgggaatggttgtttgacggacaaaaaaaaaaaaaaagggcggtctgtctagaggatccaagc

SEQ ID NO: 37597 - DNA, 437 bp, Zea mays
  Clone ID: LIB3060-006-Q1-K1-B10
aattccgggtcgacccacgcgttcgcgagcgggttgcagcagttcaaggtcaatgtctatgacaagaagcccgagcttttcgggcctgtctagtccggccaggcccgcaagtacatggtgttcgcttgctacgacttccacgtgtgcccatcggtgaccctgggcctgcatgccggtgaggccttcaccgttcgcaacatagccgtcatggtgccaggctacgacaagaccaagtacaccgtcatcgtgtccgtcatcgagtacgctgtgtgcgctatcaaggtggaggtcctcgtggtcattggccatagctgctgccgtggcattagggcgctcctctgcctccaggacggcgcacctgacaccttccacttcgtcgaggactgggttaaaatcggcttcattgccaagatgaaggtgaagaaagagcacgcctt

SEQ ID NO: 37598 - DNA, 447 bp, Zea mays
  Clone ID: LIB3060-006-Q1-K1-B12
cgggtcgacccacgcctcccgttttaaaaaaaacagcacaaggtattagtcccgagtggtctatggcctagaaatgtctattatgagataaagtttgaatgctagaaataatgaagttcgctactttcttcgtaatattctatggcacatactacacaattgatgtttcatgaatatatatacatatctaccaaaaaaagggttacacctgcagagttgctgcagctaattgtacaatttacataaactgaagcgatggaaggacgaatcagctctccaaggtctctagggctgctatctggagttgtcctttgaagcatctggtgtggaggtgctatcagaattccttgcctctgacttttcgtttgagtacgtcgacaatattgtgacccagacaagctccacacagtcgacccatagaagtctttgctcaacaagaaccacacc

SEQ ID NO: 37599 - DNA, 462 bp, Zea mays
  Clone ID: LIB3060-006-Q1-K1-C1
taccggcttcggaattcccgggcttacagagaggggtggcatgacttcccacgctgctgtggtcgcacgtgggtgggggaaatgctgcgtctcgggatgctcaggcattcgcgtaaacgatgcggagaagctcgtgacgatcggaggccatgtgctgcgcgaaggtgagtggctgtcgctgaatgggtcgactggtgaggtgatccttgggaagcagccgctttccccaccagcccttagtggtgatctgggaactttcatggcctgggtggatgatgttagaaagctcaaggtcctggctaacgccgatacccctgatgatgcattgactgcgcgaaacaatggggcacaaggaattggattatgccggacagagcacatgttctttgcttcagacgagaggattaaggctgtcaggcagatgattatggctcccacgcttgagctgaggcagcaagcgct

SEQ ID NO: 37600 - DNA, 443 bp, Zea mays
  Clone ID: LIB3060-006-Q1-K1-D10
tcggaattcgggtcgcccacgcgtccgaaaaaatcccaaatttaagaaacgaggtagaagaaaacaactttcatcgccagtcggcaccggagctcccttcgtcggccttgcttcagtgtcaacccccttctcaaaacttgtatttgcacctcagtccctgccggtctggccggtcgccggctcgccggatgaagcccctcgtctccttgccctgcggcgggttcatggggttctcgctgtaccccatgaagacgttcacgcggatgctctggagcactagcttcttccgtcataagctcagctgctgctactgcttcctctgaggacgccccacccgcctcgatcgcttcggcggcgggccgctgctgctgcgctgtcctagcatccgttcaagtgtgggtttgcgttcttgggtttcaagattggcttttgttgcgttcttg

SEQ ID NO: 37601 - DNA, 445 bp, Zea mays
  unsure at all n locations
  Clone ID: LIB3060-006-Q1-K1-D3
cacgcgttcgaaaatccgaaatggccgctagtggcctctgtctcttcacctncttcctccccggccacgacacccttcttcggcgccggcgccggcggtcggcgggccacgccgccgcgtcgttccggccggtgacggcggagctcggcggcgtcgcgacggagctgggccgccagctggtggaggcggtgggcgtggggctcccctgcaccgtcatgcagtgcggcgacgtcatctaccgcagcacgcttccccggaacgacgggctcaccatcacggcccccggcgtcgcgctcgcgctcgctaccgtgtcgtacctctggttcacgcccggcgtcgcgccggggttcttcgacatgttcgtcctcggcttcgccgaacgcctttttcgtcctttctttcgcaaggatgacttggtatttgggaagaagcttggggagggcgc

SEQ ID NO: 37602 - DNA, 422 bp, Zea mays
  Clone ID: LIB3060-006-Q1-K1-D4
cggaattcccggctcgacccacgcgttcggcaatggctgccagcgccctgcttgcctgcggtgtcatggtccatgatgtgctgctgggcgcaggtgatggcgggctggtcttcgaggccagccagttaaccgtcaaggtcggtgacaccatcacattcaagaacaacgccggcttcccgcacaacggggtgttagacgaagacgacgtgccgagcggcgttgacgtcaccaagatctcacaggaggagtaccttaacgcgccaggcgagacctactaagtgacccttaccgagtccggaacctacggcttctactgcgagccgtatcaaggagccggaatggtccgcaagatcaccgtcaactaattaagctagctatcgatcgatatccattcatgtattaactgttgcttcctgctttgt

SEQ ID NO: 37603 - DNA, 355 bp, Zea mays
  Clone ID: LIB3060-006-Q1-K1-E1
tgctgctccaattcgctctctttactctgccagcggaaggggagaggagggcgagatgactgtggagaaggtggacgcggtgctttccgacttcgacgcccacttcgatcgcctcttcgctttcccggacgccgccttcgacggccaggtgaagctgctgctctttctggccgaccgcaagcctggctcctccctctactggtgccccgactgcaacgtggccgagccggtgatctacgagcggctggaggcactggagggcaaggactcggtgctcctgcgcgcctacgtctgggacaagcccacttggcgcgacccggcgcacccgtggagggtggaccccaggttcgggctc

SEQ ID NO: 37604 - DNA, 444 bp, Zea mays
  Clone ID: LIB3060-006-Q1-K1-E2
accgcttcggaattcccggctcgacccacgcgttcgctgaccaagacattcgctgtcagataatgcctgctgcacgtgcctttcctttaggaaagctaatgaatgccctgcagtcctatcaaaatgagagcaagcagaccatcttcattgagtatattatgcttgatggagttaacgatcaggaggagcatgcacatcagcttggtaaactgcttgaaacgtttaaagcggttgtaaatctaataccattcaatccaattgggtcatcaagcaatttcaagacaagcagtgaccaaaatgtgaagaacttccaaaaggtcttaaaaggcatctaccgcatcagaactactattcgccagcagatgggtcaggacatagctggcgcttgtggccagttggtggttagcctcccagatgaaagatcagctggtggagcaactcttt

SEQ ID NO: 37605 - DNA, 188 bp, Zea mays
  unsure at all n locations
  Clone ID: LIB3060-006-Q1-K1-E4
gacccacgcgtncgcgaagaaacagattataacttgctgactatgatggcagttcgaactacgtgtttgggtgggaacaggggaccttctccaaccttctttaacattcgggctcatattccttactgccattggttggaggaactgccctattaccatatttattggaggagagagttgatgagaca

SEQ ID NO: 37606 - DNA, 450 bp, Zea mays
  Clone ID: LIB3060-006-Q1-K1-F1
cggaatttccgggccgacccacgcgttcgcccacgcgttcgcgtcgagcaaaaggtcgaattctcaactctcaagcaccagcaggaatcgagcgagcgagcgagcagtgtccgtcccccatggccatggtcgcgtccacctccttcgcgtaccacaagccgcgtttcgcggtggtgtgcaggaagaacagggacggccgggacagggagcgggacggcaaggagcacaagcaccccttcaaggtcgtcgagatcacgccgtctccgcggtgcctcggcgtccgctgcttccccaccaacatccactgcggcgagagcgtgacgatcgaggggcaagcgtacacggtgtcggcggtgacgcaccggtaccagctgcgcaaggggcggtacgagccgagcgagaagcgcctcgacgtcctcttcaccggcagatacattctcaacctttacc

SEQ ID NO: 37607 - DNA, 442 bp, Zea mays
  Clone ID: LIB3060-006-Q1-K1-F11
ccgggtcgacccacgcgttcggaagagtgcaatgtatagaaggtgtgaatcaaccaaggttgattctgtaattacacatgcatcatgtcatacaactttaagttaaaccccctgcgtagctattttagtgtatgaatcatctaccttgttcatacatctttagtgaatagagtgtatctgttgcccttctcgatagatgaatcaacaagaagcccctacgggagttggagagtttctacgagattttggtgttccagtggtcctgtggcgactacttcaagaagtcggatataccgaagcacccaagtaccagtggccacgcacggttcttagaggacaaccatggtatgaggtagtagtgcatattccagaacgtgctagaaaccatcttggccacattggatgttccatgctgaaggaatgactccttgggaaggtgctc

SEQ ID NO: 37608 - DNA, 389 bp, Zea mays
  Clone ID: LIB3060-006-Q1-K1-F3
gggtcgacccacgcgttcggtctgcagcaacagctagtcagcgacgtgccgtccgccgtcggcgcgtcagcattccctttccgcctgttctccgcggaggcgcgccggaacactaagagcggtcgaggcaagcggagcgccgccaagcccatcaagtcctcggccccacctcgacctccctactcctctttcgtcatatgcggcggcgtcgcggccaccacgttcacgcggattccacttcgcgatgcgcctgagtgcacccaggtcacgctcgaacgattacccaccggcccgggcaacccgggggcgcccgctctcacgctcgggagtgtgcaacggctggagaacgaggagttcgatgttgggtggaggcccaactctgtcgcgcg

SEQ ID NO: 37609 - DNA, 288 bp, Zea mays
  Clone ID: LIB3060-006-Q1-K1-F6
tcggttcggaattcccggctcgacccacgcgttcgagcagatcaccgactgctggctcaacggtccctactgccgccccgtcatcctccacagctaagctaagcgaggggagggcgattaattttttattgttgccatgttatttatacctgtgtttacgttgccgggaaaaaagtgtcccggcagctgcatgcatgtgttgcctcttgtaacttggtatactggtgggctttatttacaaatcaaatggtatagatttttcatggaaaaaaatattaagtcattttt

SEQ ID NO: 37610 - DNA, 444 bp, Zea mays
  Clone ID: LIB3060-006-Q1-K1-F9
ccgggtcgacccacgcgttcgatttgcttggctgctgctcccttctcctaccgaccaactcgatcccgcgccatggatcgcgccgaccccgcgcggggccgccttgccgtgctctcctcccacctccgtggtgcaggggccgaggaggcggcggggctggagaggtcgccggtatccgcgccggcgcccgggccccgcgccggcgcgcttgccgtggtggacgggaggaccgggaagcggcacgaggtcaaggtctccgaagacggcaccgtgcgcgccaccgacttcaagaagattaccactggaaaggacgacaagggtcttaagatttatgatcctggttaccttaacactgcccctgttcgctcgtccatctgctacatcgatggagatgagggaatccttcgctataggggttatccaatcgaagaattggctgaaagc

SEQ ID NO: 37611 - DNA, 442 bp, Zea mays
  Clone ID: LIB3060-006-Q1-K1-G11
cggtcgacccacgcgttcgggactgtctacattatgagctatcctgagtctgcacgggttgttccgtgtaagagggttcacacaggatgatgcccacatattttgtctggaggaccagataaaagatgaaatcagaggtgttcttgatctaactgagcaaatacttggacaatttggttttcggtattatgagataaacctttcaaccagaccagaaaaatctgttggcactgatgacatatgggaaaaagcaacaattgctttgaagaatgcattagatgataagggttgggaatacaaggttgatgaaggtggaagtgctttttatggtccaaaaatcgatctaaaaattgaggatgctcttggaaggaaatggcaatgttccactgtgcaggtggatttcaatttgcctgaacggtttgacattacctatgtcgattca

SEQ ID NO: 37612 - DNA, 162 bp, Zea mays
  Clone ID: LIB3060-006-Q1-K1-G2
tcgacccacgcgttcgcacgccacccgtacacggtttccagcatagcattccggaaggagggggcgcgatgtggcacgaggcgcggcggtcggagcggaaggtccacgacctcatggacgcggcccgtcgtcgggcgcaacgccgagccgtctaccttgccc

SEQ ID NO: 37613 - DNA, 452 bp, Zea mays
  Clone ID: LIB3060-006-Q1-K1-G9
cggaattccgggtcgacccacgcgttcgaggcccttccctcatcgccccgcggccatgaatctggaggtcatgcccaagcccaaacagcgggtgctggaggcgcagcagagggaggaggccatggagatgagcgacctggacctgtggaagcacgagaagccgccaaggatctgccccttgcccccgtcgctcccgccgccgacgccagcgttcgacgaagcggcgctcgtgccgccgctcaacttcgccgtggtcgacgacggcatcttccgctccggattcccagggaccgccaacttccggttcctcaagtccctcaacctccgctccatcgtgtacctgtgcccggagccgtacctggggacgaacacggagttcctagaaaagaatgggatcaggctgcaccagttcggaatcgatgggcgcaaggaaccatttgtcaacatacccg

SEQ ID NO: 37614 - DNA, 396 bp, Zea mays
  Clone ID: LIB3060-006-Q1-K1-H1
tcggaatttccgggtcgacccacgcgttcgcgcgtgaaccctcacaggaacaggtgacatggtgacgtgctccaaggagaaggacgccgacctcttcgacgccgtgctgggagggctggggcagttcggcatcataacgcgcgcgcggatcccgctggcgccggcgccggcgagggcgcgctggctgcggctcctctacaccggcgccgtcgacctcacgggcgaccaggagcggctcatcgtcgacgacgagcgccgcggcggcgcgctggccgggctcatggactacgtcgagggctccgtcgtcaccgaccttcagcagggcctcatcggcagctggcgctcgcagccgccgacgttcttcttcgtcttgtactcggagtcggtgaccgacgc

SEQ ID NO: 37615 - DNA, 373 bp, Zea mays
  Clone ID: LIB3060-006-Q1-K1-H12
cggctcgacccacgcgttcggtcacttagcttcactcggcatagaaatgaggcaacgacgatggctgctgcggctgcgatgatggtctccggaggacgggcggcgctggtggtggcgggcgtgctctgcgcggtggcggccatggcggcggcgcagcaggcgtcgaacgtgcgggcgacgtaccacctgtacaacccggcgcagaacgggtgggacctgaaccgcgtgagcgcgtactgcgccacgtgggacgccgacaagccgctgtcgtggcggcagaagcacggctggacggacttctgcgggcccgtctggcataagggccaggccgtctgcggcaagtgcataatggtgaagaaccgtgctacgggcg

SEQ ID NO: 37616 - DNA, 53 bp, Zea mays
  Clone ID: LIB3060-006-Q1-K1-H8
tactcttcattacataattttgatgctataaaaaaaaaaaaaaaaaggaaagg

SEQ ID NO: 37617 - DNA, 187 bp, Zea mays
  Clone ID: LIB3060-006-Q1-K1-H9
ccgggtcgacccacgcgttcgcaaattcataaagatgcatatatataatatagctccgcctccgatcctcctctctgcgtgcaaaggtatgccatttcagcagtgacgagcatcgtggatacatgcaattcctctgcacatggatggattgggatgtaacttggaactgttaattttttttactttg

SEQ ID NO: 37618 - DNA, 408 bp, Zea mays
  unsure at all n locations
  Clone ID: LIB3060-007-Q1-K1-A1
accgttcggattcccggtcgacnacgcgtccggaccaacccagtgcaccacacaaggcattgtcagcggtggcggcggcggcgggccggcggagactcccaggccaggagcagtctgccgattggaaggggagatgaaggccacgctcaagggccgctacgagggcgacaaggccacggccgccaccaccctcgccgcccccgccggcgacctccgcctcaaggcctccgccaccgaggccgccttcaccaacggtccttccctgcgaggcctcaccctcaccctcgagaagcccggcgccttcctcgttgacctcaagccccacaaccaggatgtgcgctttcagttcatgaactccgcgctcgtgctcgacaagcgcgtcagccttacctacacttacttcactag

SEQ ID NO: 37619 - DNA, 472 bp, Zea mays
  unsure at all n locations
  Clone ID: LIB3060-007-Q1-K1-A5
accggtccggaattcccggggtcctcctcctgttctttgtttcccgtcccatcgtgtgtgagcgcgtctgctggtctgccaagaggaggaaaggaaggaggagcaagtagagatggcttgccctgcgcagtccatgctctccgccagcggctgcatcttcctgaggagcaagcctcaggcggcatcccaagtgcgagggggcatcatcggcggtggccgcagcagcaggccgttcctgctcacctgcaacgcttcctcttctccgtccccttcctcgccggcgccggcgcaggaagaccccgactgcaacgaggaggagtgcgccccggagaaggaggtcgggagcctgagcgccgagtggctggccgaggagaggacccaggtcgtcggcactttccctcccaagaagaaagggtggaccggcttagtggagaaggacaccgncggccagaccaacatctacttcgtcgag

SEQ ID NO: 37620 - DNA, 353 bp, Zea mays
  Clone ID: LIB3060-007-Q1-K1-A6
taccggttcggaattcccggccgaccacgcgtcggaaactctgcaatttagtgacatttactttctcgacccctctcaacttgggggatgcagtggaagtcaagaggacagcccgagggaagagatgaataccaaagatggccctaagacaagaaagatcttcatcgagtgggctactggatctttactgaaggttgggttggctatcaacaaacaaatgttgaattcatctttttatgatactgagaaggcacaaaattcatatgagatgaaggatcactatccattgtatggcaaggtgcttgaacatcagataatgcttgatcatagcactgggccatatagaaggtttg

SEQ ID NO: 37621 - DNA, 463 bp, Zea mays
  Clone ID: LIB3060-007-Q1-K1-C10
accggtccggattcccgggcacgctcaaacccggcacgacgcggccatggtgtccgtcctgctgaaacactcggaagccaaggtcttcctcgtggagtcgcagttccacgccgtggcccgcgacgcgctcaggctcctcgccgacgccaaagacaggcttcctctcgtcatcacggtctctgaccccagcagcagcagcagcaccggcgacggccgcggcagcaacgacggcagcgtcgcggtcgcggagtacgaagcgcttctgcggagcgcgccgcgcgacttcgaaatccggtggccggcagacgagcgcgacccgatatcgctgaactacacgtcgggcaccacgtcgaggcccaagggcgtcatctacagccaccgcggcgcgttcctcaacacgctggccacggtgctcgtcaacgagatggcgaccatgcccgtgtacctctggaccgtgcctatg

SEQ ID NO: 37622 - DNA, 418 bp, Zea mays
  Clone ID: LIB3060-007-Q1-K1-D1
cccgggtcgacccacgcgttcggaaccaaatacccagcaattacaaaatcattttcccattgagaacacacaacataatggctgattataggtttcttggtcaagaaactctaatagcattgtgccttctcctctcttttccaccgggcatagcctccatccattcatccacactgaacatgagttgcatcttagaggagaaggctgcgcttctatcaatcaaggcaagcctcctggatcctaacaactacttctacttgtcatcatggcaaggtcaagactgttgcagctggaaaggaatcaggtgcagcaaaaaaactggcaacgtcgtcaagctcgatcttaagcgcataaatccaggaaactttgtaagtgagataagctactctttagttaatttacgacggctgagatatct

SEQ ID NO: 37623 - DNA, 418 bp, Zea mays
  Clone ID: LIB3060-007-Q1-K1-E10
tcggtcctctcctctccgcatttcgggcggccacttgtggcggcgtagctagcgtactacagctccctgcatggtgatggaggggcgcacaggctcactctacggccgcctcaacaagagcagcacgcgggggttcctcgcctacaccgccgccggggctgcctgcgcggctgtcctcgcctgcttcgtgctctccgccgcggactcgccggcatctgcggcgcgcaacgatggcgcgcgcctccgcctgtcctcgcgctcaccgcgcgtctggcccgacctcgcgttcaactggcgggtggtggtcgccaccgtcgtcgggttcctcggttccgcgtttggcaccgtcggcggcgtcggcggaagcgggatcttcgtgcccatgctcaacctcgtcgtcggcttcgacaccaaatcc

SEQ ID NO: 37624 - DNA, 343 bp, Zea mays
  Clone ID: LIB3060-007-Q1-K1-E12
gcgctcgtctccggcgtcctccaccgcgctcgcctctactggaagctctagcgagcgaacggtggcatagcatgcttttgtcttttgaactgcacatgatacacacgacacctcaaactcgaaccccaagttagtttgaagaactcaaaaaaaaaaaaaaaaaaggcagacaatctaaaagatacaaagataaaaaacacaagcatgcaaaaaaataacataaaaaaaaaagaaaactaaattcaattaaaaaaaagggggggccgctttaaaggatccaagtttaagtccgcgggcatgcaacttaatagcttttctatagggtcccctaaattcaatttag

SEQ ID NO: 37625 - DNA, 467 bp, Zea mays
  Clone ID: LIB3060-007-Q1-K1-E3
taccggtccggaattcccgggctgaaggagagcagcccggaggagggggagcaagcagcagccgtccgtggaagaagatgtcgtacctgctgccgcatctgcactcggggtgggcggtggaccaggccatcctcgccgaggaggagcgcctcgtcatcatccgcttcggccatgactgggacgagacctgcatgcagatggatgaagtgctggcagcagtagctgagaccataaagaactttgcggtcatctaccttgttgacatcacagaggtccctgatttcaacaccatgtatgagctgtacgacccttcgacagtgatgttcttcttccggaacaagcacatcatgattgatctcgggactggaaacaacaacaagatcaactgggccctgaaggacaagcaagagttcatcgacattgtggagaccgtatacaggggcgcccggaaaggccgtggtctggtg

SEQ ID NO: 37626 - DNA, 483 bp, Zea mays
  unsure at all n locations
  Clone ID: LIB3060-007-Q1-K1-E8
tgccgtaccggtccggaattcccggggttcaagggcacctatgaggctatcacaaaaggcaacccaatgtggaaccagctaactgtcccagaagcgtcactctactcatgggattccaaatccacttacattcatgagcccccttactttaaggacatgaccatgtccccacctggcccctctacagtgaaagatgcctactgcttgctgaacttcggggacagcatcactacagatcacatttcacctgcaggaagcatacacaaagacagtcctgctgctaagtatttgatggagcgtggtgtggaccggaaggacttcaactcatatggtagccgtcgtggtaatgatgaagtaatggcaaggggaacgtttgcaaacattaggatcgtgaacaagtttttgaacggagaagttggacccaagaccattcatgttcctactggggagaagctntctgtttttgatgcggccatgagatac

SEQ ID NO: 37627 - DNA, 468 bp, Zea mays
  unsure at all n locations
  Clone ID: LIB3060-007-Q1-K1-F11
accggttcggaattcccggngtggaggggcgatggcggcggctgatgtggagtaccgttgcttcgtcggcggacttgcctgggccaccagcaacgagtcgctggagaatgccttcgcctcctacggcgagatcctcgactccaaggtcatcaccgaccgggagacggggaggtcccgcggcttcggcttcgttaccttctcctccgagaactccatgctcgacgctatcgagaacatgaacggcaaggagctcgacggccgtaacatcaccgttaaccaggcccagtcccgtggcggcggcggcggcggcggcggcggtggctacggcggcggtcgcggcggcggcggctatggtggcgggcgccgtgacggcggttatggcggcggtggcggctacggcggtcggcgcgagggtggtggcggcggctacggaggcggtggcggctacggcggtcggcgcgagggtgg

SEQ ID NO: 37628 - DNA, 422 bp, Zea mays
  Clone ID: LIB3060-007-Q1-K1-F4
taacctccttgcagaccaacgtaagagtatcctgaattttaatcaacgtatagtgattgcccttgatgttgctattgcattgacttatctccatttgtgttctggggacgctttaatctgttacaacttgaggacgtcaaacatcctactgacagagagctaccgagccaaagtgtgctgttctgaactgtcaaaaagtggtaatatcgtgctattaaagggaacagggggctacattgatccagagtacttggagacctcagagctcactgccaaatctgatgtctactcttttggaataatacttctagaaatcatatctttttaatggccacaagacttggatgtattgatgaaaccaccggaaaacagtgtgtacaatgggctcttgaaaattctatgacgacctcatgaatgagata

SEQ ID NO: 37629 - DNA, 376 bp, Zea mays
  Clone ID: LIB3060-007-Q1-K1-F6
ggaatacccggctcgacccacgcgttcgagtctcgtcatcatattccgaacactagttctctcgattccattccaggatgctgctgggcccggcgtcagagacgtcggtgctagacaccatccggcagcacctcctcgaggagccagcggcggcggaggcgcggccggccgacgagagcttcgggagcctggtggcggaccagtggagcggctcgctcccgttccgcaccgacgacgccgacgacatggtggtgttcggggtgctgcaggacgccttcgcctactgctggctgcccgacggctcattcttgcacgtgaagcccgatccagtgcggtcccccgactcgtcctactaccacccctgctcctacgacgg

SEQ ID NO: 37630 - DNA, 470 bp, Zea mays
  Clone ID: LIB3060-007-Q1-K1-F7
taccggttcggaattcccggggctcggtggatggacgactgaggctgtggcggtggcgctagccagcctcgcatgcgttgttccgggccggtgatggcagtgcccgcacgcgcctgctcccagacgacgacggcagccaccccgcgcgcctgctttggggccgcggcatggccagagcgcgtgctcgcctacccatggcgatgacgcagcccgattccgcagcgtggccagatcccgtgctcgcctgcttgcgcggcgggggcggcccgcgcttgaccgcatctgctcgaccagcgctcacatgcctgctcacggcggtggcggggacggcctgcgcgcctgctcgcatgctgggcggcaggggcgctcgcccgcgcgctcgcggccatggcggtgctcgcacgtgtgcttgtctgcgacagcacacgcctgcgcgcttggttgtggcgacgcccgcttgcgtttcgtgc

SEQ ID NO: 37631 - DNA, 289 bp, Zea mays
  Clone ID: LIB3060-007-Q1-K1-G10
cggttcggaattcccggctcgacccacgcgttcggccgtgcactccattgtgctttgcgcattgtatgcgtccgtggcggggcaccacagacggggggagcgtctagtgttcctgctgaccggtgctgccaagggcgctaagagactcacacggttcgcgttcctccggtgggccacgagggacgccgttgtgcagatgctatgcctctgggtctttggcgatgtgcacgaccaggcccagctgttcaagctctatgtggtctccaaactcatgccattctccgcgtat

SEQ ID NO: 37632 - DNA, 465 bp, Zea mays
  Clone ID: LIB3060-007-Q1-K1-G2
cccgggctttagaactcgatcttaattctcatcaactcacttcccagctgtcggaaaatttgtggacaaactcccaggactcgccgtttattgttgctcccaaccaccagaaaaggaagcacgtcacccatccttttttcacgttactatcggcaccgcccatccaacatgtcgggcaccgcgcacgactccagactactgtacaaggtgaataatattcgagccttccatatccaagatggcgaggagcaagagttgacgccttcgggccctcaaattctctcgctgttgatggttcccaccgctgcgccggcaaacgcctccgctggtggcacgcagaccccagaggaggatttctacttgcatctctctattcctcccgagctggaccttgccatcccagctaccacccagatcttccaccaaccacccgatagctacctcattcctcgctgggacgtgggt

SEQ ID NO: 37633 - DNA, 182 bp, Zea mays
  Clone ID: LIB3060-007-Q1-K1-G3
gggccgacccacgcgttcgcaatcttaaaaccactttattcaagcttttatttcacaccggggatggatctcagtggggggggatatattacatgcttgtgcgtccaaccgaggagaatgtagttatatacgagattcatccatactcgtagaaacatacactatataatcatggcacacac

SEQ ID NO: 37634 - DNA, 78 bp, Zea mays
  Clone ID: LIB3060-007-Q1-K1-G8
tcggttcggaattcccggctcgacccacgcgttcggctgaacccttagcttaaagactttcatcgccatcaccaccag

SEQ ID NO: 37635 - DNA, 413 bp, Zea mays
  Clone ID: LIB3060-007-Q1-K1-H10
tgcacacatccttgagccaaaatagaaaaaaaatcatagaagagttctttggctgtcacgtgattcaagagtattaatgatatacaaaagtttgctttatggcaagtcaggtaaccacaaattttgggcaatgacagggatgtgcagtggtggtctcttaaaagaattttgtgttccagcgtagctatttccactgcaaactatcaaatcattacaaactgctgggaacatgctccatcttattatcgaagcctgtatctcgagaaagttgatcgatacatctgcttatttatggcctggttatgttgtaccatctgggactttaaaagatacagctttgccccaagaatccccttggttaaactttatgaaagggtctcgactttcaggaccccttattgatgctctggtcg

SEQ ID NO: 37636 - DNA, 465 bp, Zea mays
  Clone ID: LIB3060-007-Q1-K1-H11
taccggtccggaattcccgggattcctccctgtctccgccctcttctcactcccgtaggccgtggtgccgccgccgactgctgggactgccctacaccaagtgcccaggtcatcttcggtccattcgccggcgacgagcaccaccaggtgtgccaggttgaccgagctatggacagcctgtggcatcttggggacgagctccgcgggcagcccaaggtggtggaggaccgccagtggtctctcatgacgtccaagctggcggagatcaccaggtccaagggcgagaggatgaacaccgtccctgacgccaagcagtgggacaagacgtcctaccagcttcacgacgacagcaggatgggccacatcaatctcggcctcatgaaccttgatctcaagatgaacgaggctgccgccatgaagctccccttccgtggcatgccctataacatgaaccagatgtacctc

SEQ ID NO: 37637 - DNA, 384 bp, Zea mays
  Clone ID: LIB3060-007-Q1-K1-H2
tgacaagcttgtgggggaagttagcagacttgtggtagcagaagcttgtatccaagctttagatattgaatccactgaaggacaaatatatgagattaactcagttaagggtgaagggcccggaactgacccagagaaatgggaggagctattcagatctgctcggtcagactagtggcattctgcaaagcgtagtaacgtaatgtaggaatatgcatcgtaatacaatgtaatccatagagtgcagccctaattcaatagtcactgaacagtagcgatcatgtagagaatatttggtttgtgtacatagtatgagcattcatatatgacgattatacctcctaaaagtgatagtttttgttggaaagtaaaatgttcaatgtt

SEQ ID NO: 37638 - DNA, 444 bp, Zea mays
  Clone ID: LIB3060-008-Q1-K1-A3
ccgtaccggtctcggaattcccgggtgaacaaggggctgtctgacttcaacttggcgctggacctggggttcctgaccaaggctaggaagtacaccttcttcaagcccaagttcatcttctacgccacctacctgtccgagaagatcgggtactggaggtacatcaccatcttcaggcacctcaaggcgaacccggagtaccaggtgtaccccatcttcaagtacttcgagaactggtgccaggacgagaacaggcacggcgactttttctttgacctgctcaaggctcaaccgcagttcctcaatgactggaaaggccagcttttggcaacggtccttttgcctcttgggggatgtgacccatgtaccctgaatgactgccaaacgcactgcatttctatgaagggaattgggtctgggacaccaaaagaatttgacatgcat

SEQ ID NO: 37639 - DNA, 350 bp, Zea mays
  Clone ID: LIB3060-008-Q1-K1-B10
aaacaagtccatccaatgggctgggatattaattaattattacaaaacagcatgcagattgtacgatgtttattattacaatatgtataatatgccaagattttccacttggacttgacaacaagagtgaatataaagaggcaggaaattacatatgcatagggaaaacagacgctgccagttcggcatttccatccaaaactgacaaaacgccaccatccggaagctgattattgcggtgcactctgcaggtgagtgaagagaagccgcctagccagtgttctgcatgccggcggcgatgcccttcatggtgaggatgagcgtgtctttcaggccgggcgggtactcgc

SEQ ID NO: 37640 - DNA, 429 bp, Zea mays
  unsure at all n locations
  Clone ID: LIB3060-008-Q1-K1-B2
taccggttcggaatcccgggtcgactcacgcgtccgcagaagaggacaaaccagattcgattcctcctcctgtcctccatctccccaattcgcacggccatcggaccatggattccggcgtgcctgcctctgcgcctgcccctcccaaacacaagacatgccggaagtgcaaggcgagctatgacccctcggccaacacgcgcctctcctgcaggttccacccttccttcttcgtctgccgccgccacgacgaccagaagaggtactacgagctccgcgacggcgatcctccctacgccgccaagttctacgactgctgcggcgccgaggaccccgacgctccgggctgcaccactgacttgcaccgttcctacgacgacgcccaagactagcanaaccttgctggcttcacaggcctcatcttaatct

SEQ ID NO: 37641 - DNA, 368 bp, Zea mays
  Clone ID: LIB3060-008-Q1-K1-B7
tgcaactacttcagttaataacaggtcgtacagtggagcagcacaagatctgatgatgtcacagtagatagtactatttctgggaagaaaaccataaggttttctctgaataacagaggtgctgatagaaacacagctgacagctcgaggacattgctatcattcaaacgcaagttgagtgagaggggaccacgagctggtaagcaacttccgcagaggccaactattgctgcagagaaattagaagatgaagacaagaagacaactgataagaagataactatgcaacagagagaaatgtttcaaaaggagctcattatgacatctgatcaagcttttacacagaacctacgccttcctaaaggata

SEQ ID NO: 37642 - DNA, 306 bp, Zea mays
  Clone ID: LIB3060-008-Q1-K1-C5
ttgatgacaaagcacaagcatcaacattgctattccaatagataatgttatacatatgatccataaaacaaagacgaacttgtgtaggctcactgcaacaaaaaggaatgaaacgatactgaaccacgcatgagttcaccataaggtacgcagagacaaaacacagtaatacttcttgatattggtttatgcagttcacattccatttcatcttctactgggaaggaatgggctgcatctatggtgctgcagcaacgtcagtcacggtgtacctgaacacgcgggcgagccgttcagtgggcacca

SEQ ID NO: 37643 - DNA, 465 bp, Zea mays
  Clone ID: LIB3060-008-Q1-K1-D10
taccggttcggaattcccgggcggagaagctcgtgacgatcggaggccatgtgctgcgcgaaggtgagtggctgtcgctgaatgggtcgactggtgaggtgatccttggaaagcagccgctttccccaccagcccttagtggcgatctgggaactttcatggcctgggtggatgatgttagaaagctcaaggtcctggctaacgccgatacccctgatgatgcattgactgcgcgaaacaatggggcacaaggaattggattatgccggacagagcacatgttctttgcttcagacgagaggattaaagctggcatgcagatgattatggctcccacgcttgagctgaggcagcaggcgctcgaccggctcttgccgtatcagaagtctgacttcgaaggcattttacgcgctatggatggactcccggtgaccatctcactcctggacccttcccttcacgagt

SEQ ID NO: 37644 - DNA, 215 bp, Zea mays
  Clone ID: LIB3060-008-Q1-K1-D6
tcccggtcgaccacgcgtccggtgccgcgtcgttcgccttcggcgatgcccgttgacgatgcgcagaggcggcggagcgatgcagcggggggccgggagcccgtggtacggaccggaccgcttgctgacctggggccagtgtgcggaaagcgatcgagctacctgacgggcgagttactggtcgactactgctgggacaccggggggttgtgttt

SEQ ID NO: 37645 - DNA, 370 bp, Zea mays
  Clone ID: LIB3060-008-Q1-K1-D8
tcccactcccaccttcttggagacaccttcaggcgccatcttccggccgctgcccgcctgcccgccccgggaggtcgaactgccttctagagccctctcctgttttcaggcgaatgtgcaggtagcttgacgtctgatgaacgctcagccatgctgctgatgctacacgaaactcttcctttcgtgaggccgacgagttcttgccgggacccaaaactctccgagaagagtgcctctgcttttcacggtaaattgggatgcagtgcggtctgcagttcatcggaaggccatcgtgtacagaagccacacattgttcacagcttcaaagtaagctttactaggaccagtcattcatttgtgtaaaagctta

SEQ ID NO: 37646 - DNA, 427 bp, Zea mays
  Clone ID: LIB3060-008-Q1-K1-E1
tagcgatccgaggagcgcgcagcgattgcggcggcggccgtggcgactgtggcctccgcatccctcacctccaggcggctgttcccctccgccggcccgtctcttctccggctcccaaggtcgaccgcgcggctcaggcgcgccctgcggttcgccgctgcgggggatgaagcggacgtgctgcctggcccgggggccgagggggaggccgtggtgcccgggaggctggaggagcagcgggacgagcagctgggcggaagccagctcgacatcggagggctcgccttccagggcgacgtgggcgggggcttcaccggcggcggtgcgggctccggggccttcggcggtggcggcggcaacaagatgctggaccggggcatcaacacggtcatcgtgttcggggccagcacctacgctcttacccagc

SEQ ID NO: 37647 - DNA, 486 bp, Zea mays
  Clone ID: LIB3060-008-Q1-K1-E10
taccggttcggaattcccggggaagaaacctcatggaaccttctgataataatacttccaatgatgctgctgcttccagtagtgcaactgcttctcggacaatcacagtggacgattctttgccatcaacctccctccaaatcaggttcgcagatggcagtcgcttggttgcccgtttcaacacaagccacaggattagtgacgtgcgggcatttatcgacgcgacaaggccaggagccagtgattacacgctgcaggccgggttccccccaaagccgcttgaagacacggccaagaccatcgaggaagccggcgtggccaactcggtaatcattcagtcagtctagcttggcagaacaggtgccgcaaccctattccatggaacacgctaggcatctgaagctaccaccttccttgatcttccttcattttgtttctcaaacctggcttttaaccttttatcttcatccagtagctacttttggg

SEQ ID NO: 37648 - DNA, 445 bp, Zea mays
  Clone ID: LIB3060-008-Q1-K1-E4
ccgtaccgtctcggaattcccgggtcgactcaccgtccgcattgagaatgccaatgtcatcatggcaacatatgaagataagctccttggtgatgtccaagtatacccagagaaggggacagttgctttttctgctggtctgcacggatgggccttcaccctcactaacttcgcaaagatgtatgcatctaagtttggagttgatgaaactaagatgatggagaggctatggggtgagaacttctttgaccctgccacaaagaagtggaccaccaagaacacaggttctcctacctgcaagagaggatttgttcagttctgctatgagccaatcaagcaaatcatcaagacctgcatgaatgaccagaaggagaaattgtggcccatgctgcaaaagctcaatgttaccatgaaggctgatgagaaggagttgattggcaaaact

SEQ ID NO: 37649 - DNA, 215 bp, Zea mays
  Clone ID: LIB3060-008-Q1-K1-F3
cccgggtcgagccacgcgtccgatcttggcctcgtcaatccatcaccacttggcgtctctgagctcctcctccggcttcggggcggtgtcttgccttctgctcggtcgaagaagaagatgaagaaaacatgtgttcgtgatccgtggagtcgtcgtctgcggcgtcggcgggcaagagcgtgtgcgtgatggactgccgcggggccgctgggcca

SEQ ID NO: 37650 - DNA, 386 bp, Zea mays
  Clone ID: LIB3060-008-Q1-K1-F8
ttttgcttggtgctgtccatggcatggtggaggctcttttcaggagatacacagaacaaggaatggacgaggactcagcatataagaatactgtagagagcatcactggaattatatcgaaaactatttcaaagaagggtatgcttgaagtgtataactccttgactgaagaaggaaagaagcagtttattgaggcctatagtgcagcatattacccatgcatggacatattgtatgagtgctatgaagacgtctcttctggaagttagattagaagtgtggtgttggctgggaggagattttatgagaaggaagggctccctgctttccctatgggaaaaattgatcaaacacgtatgtggaaggtgggtgaaagggttccgtta

SEQ ID NO: 37651 - DNA, 437 bp, Zea mays
  Clone ID: LIB3060-008-Q1-K1-H7
ggaatcccgggtcgactcacgcgtccggaattttctgcagattggggagaagattgcatctggatcttccggggacttgcatcgaggaacttatcaaggtatggatgttgcagtaaagttcctcagaaccgaacatgttaatgactcgtcaaaggtggagtttttacaagaaataattattctaaagagtgttaatcatgataatgttgttcgattctacggggcatgcacaaagcagagaaaatatgtcatcgtgacagagtatatgcctggaggcaatctgtatgattttcttcacacgctaaaaaatactttggatctcccaacggttctcaggattgctatcggcatctccaaggggatggattatttgcaccaaaataacatcatccatcgggacttgaagactgccaatttgcttatgggctctgattatg

SEQ ID NO: 37652 - DNA, 85 bp, Zea mays
  Clone ID: LIB3060-009-Q1-K1-A4
taccgcttcggaattatcgggtcgacccatgcgtcctgtgcagggaaggtcttccaagtcaactaaggttggcgtcatcatgtct

SEQ ID NO: 37653 - DNA, 233 bp, Zea mays
  Clone ID: LIB3060-009-Q1-K1-B9
aattaccggctcgacccacgcgttcgcatacagatacagatagttttttcgtttttaatcatactgcttcaaaaagcagattcgggcttcgttgtgtacgaaaagaacggagggtgtttttcaccttcggctcaaaaaatacaagtttcgtccacatcaaagcatttcatacatcgatggaaaggtaaaaattattttacatggtgtgcacaaagttacaatattctctatta

SEQ ID NO: 37654 - DNA, 285 bp, Zea mays
  unsure at all n locations
  Clone ID: LIB3060-009-Q1-K1-C1
taccggttctcngaattcccgggtacgacccacgcgtnccgagcagcttccgctggttcgatcagcttctcggcgtgacccactcattcgccagtggagtgtcctgcgcgagccaggtctcgcctgccgccagcggtgagatgtggaagggagagggtagaaataaactaggcccaagatcgatgaggtacagcgacgaaaaatgagagtgcaagagagataggggactcggaggtcgtgtgggccggggctccaagacctgaggggcttcgttgcgcatgaagc

SEQ ID NO: 37655 - DNA, 326 bp, Zea mays
  Clone ID: LIB3060-009-Q1-K1-E2
accgcttcggaattcccgggtttttaaccggcaaatggcccatgccgcaggaattaattaatatacaacaccagcaagtacggttaaatgataagtgaaaaagaacggtctaatgaagccaagcatgaaagatcgatcgagcacctcgctacgagttacttactgcaactaacctactccggccgacacggcacgaaggcgccggagccgaatgctaacaaagaggatgctaggtgtcctacccgtacccggaggagaggctggtcacgggcaccgtcgatcgatctgcgactgcgatcaaccgctgtaggtgtgagggtgatgca

SEQ ID NO: 37656 - DNA, 241 bp, Zea mays
  Clone ID: LIB3060-009-Q1-K1-G10
ccgggtcgacccacacttacgctgaacatctttgacaaagctttgggccataagggtgtcagggcattcagggggcttctgaaatcgcaagaaaccctggaagaactttatgtgatgaatgatggcatattataggaagctgcaaaagctctatctgagcttattcctgcaactgaaaagcttaaagttcttcactttcacaacaatattactggagatgaaggtgctatatatattgctg

SEQ ID NO: 37657 - DNA, 205 bp, Zea mays
  Clone ID: LIB3060-009-Q1-K1-G2
taccgcgtccggaattcccggatgtcacacagacgtgcgtgcagttacgagctacattgaaggtctaacacacattggcagcgaggtatactgcattcacatgtgggcgccatgagagagctgtgcagacacgcgcattccacgatgacgcttcacacctgcatacacatcacgttgaagagcgcatttctccaggacgacgcca

SEQ ID NO: 37658 - DNA, 450 bp, Zea mays
  unsure at all n locations
  Clone ID: LIB3060-009-Q1-K1-H10
tgccgtaccggtccggattcccgggtcgcccacgcgtccgacggcacggaagagaatcgctacccagccaatcgaagtcttctcttgccctgctgtatctcatatcctgttgcgcgagattcttggcgattctgctactggtttttatttttattttgctagttcttgaaatttctttcacgagtgtcagtagccaactgctgataacaacatcctatcgttcctgtagcccctttccgtgaccttgccaaagaatttgctcttctctgtgcgtgtgcaatttcttccgctacagctcaaggatccgctactctgctgttttgggagattcgccatgggcggcggngccgttaacgaccacttcccggnggccagcgacccgctgctccccacgaagcgggatggggacggggacgaggacgacgcaggtgccttcgcgttccacgagtt

SEQ ID NO: 37659 - DNA, 429 bp, Zea mays
  Clone ID: LIB3060-009-Q1-K1-H9
gtaccggttcggaattcccgggctctcgtccgcgcttgtttgttcgcgtcttctccctgtagggaactccgttacccggccccggctgtgcgtggcgtcagcacgccccgcgggcaggagggtgaggctgctgagcgtgaggtgcgagcagggagccaagggcggtggcgggctggacgtgtggctgagccgcggggcgatgctgggcttcgtcggagcggtggccgtggagctgaccaccgggaaaggcgtgcttcagaatgtgggattgaccgcgccggtgccgacgctggcgctggcgctcaccggcgcggtcggcgttctcacggcctttctcatcttccagtccgggacgcgggactgatgggtgaattgtcaaagcttccaaaaggacatgcataaagtctggcagagtcttgtgctgggtat

SEQ ID NO: 37660 - DNA, 190 bp, Zea mays
  Clone ID: LIB3060-010-Q1-K1-A3
cacgcgtacgatctcgcgaagaggattcagcaagaagcatgcttacgctgctgctgcccgcactcggatccaagcggccacgcccgcacgcccagtccaaccccaacccgcgaagctggcgcgcgaggcggccgacgcgagcgcccgcaagcgcaaggcgggggactgcggccaggtccccgacgccacc

SEQ ID NO: 37661 - DNA, 119 bp, Zea mays
  Clone ID: LIB3060-010-Q1-K1-A9
gaattcccggctcgacccacgcgtacgcattcagagctacccttaaaaacattcttttccaatccggtatgcacttactatgggggggagcacaatcaacacaagatctgattctctat

SEQ ID NO: 37662 - DNA, 449 bp, Zea mays
  Clone ID: LIB3060-010-Q1-K1-B6
gggtcgacccacgcgtacggtcggaggtggaggacgaggcggcgacgcttcttctcgccaacggtgcagccgacgtccgggggaggagggaccaggcgaaggcaattctgtccacgcaggccgtcaggatcgccaccaaggccgagcagcatgagcgcttcatctttaaggtcacacacttgctgggtgttcttggatttgggggattttgctatctcttgggtgccagaccacaggatgtgccatatgtgtactgcctgttctatgtcatatttgatccgctccgctggatttactaccgcttcaagaaatggcattactaccttctggacttctgctactatgccaacacctttctccttgtaatgattctcttctacccagaggatgaaaaactttttatggtttgcttgtcgtttgcagagggtacgtttgcttgggcattaatt

SEQ ID NO: 37663 - DNA, 467 bp, Zea mays
  Clone ID: LIB3060-010-Q1-K1-B7
taccggattcggaattccggggtacgacccacgcgtccagctcacggcgtcgcgtatcgacctggcttactgctcctcgaggtaccgccgcgcaggagcgggactactacgccgtttatgtctgcgccttccgagaggtccgacccctgataccacactgagggcggaggcattaggcgattcgcgatggcgaggtggcggacgtcggcgatgctggtagtggctgtggcgggggctctataggcggactggcgggcggatgcgctatcggttacggtcgaccgacaccgagtgcctacacgagtccatgccctatgagggcgacaccgtgtccgggaacttcgtcgtcgtagaccacgacattttctggagctccgaccacacaggaatccacctcacggtaacgttaccaggcggcaacactgtgtacacattgaaggtaaaatctggtgagaaatttgagttta

SEQ ID NO: 37664 - DNA, 465 bp, Zea mays
  Clone ID: LIB3060-010-Q1-K1-F12
tgccgtactcggtctcggaattcccgggccggtccagcactttcacgctcagctccagcaatggctgcctcctccatggcgatctcctccacggcgatggccggcacccccatcaaggtgggctccttcggcgagggccgcatcaccatgcgcaagaccgtgggcaagcccaaggtggcggcgtccggcagcccctggtacggccccgaccgcgtcaagtacctcggccccttctccggcgagcccccgagctacctcaccggcgagttccccggcgactacggctgggacaccgtcgggctgtccgccgaccccgagaccttcgtcaagaaccgcgagctggaagtgatccactcccgctgggccatgctcggcgcgctcggctgcgtcttccccgagctgctctcccgcaacggcgtcaagttcggcgaggccgtctggttcaaggccggctcccagatcttc

SEQ ID NO: 37665 - DNA, 135 bp, Zea mays
  Clone ID: LIB3060-010-Q1-K1-F5
gcccgtactcggtatcggaattcccgggtcgacctacgcgtacgggttggcttataactttcctccgtttcttgttcggattcgtgaggttctcctatggacggattattggttaagctgatagagatgtcggta

SEQ ID NO: 37666 - DNA, 427 bp, Zea mays
  Clone ID: LIB3060-010-Q1-K1-G10
tatgatacagtagcaaaggagatggccttttttgatccttcacgcagtcaagattttctgttcatctctggaaccaagatgcgcacttatgccaaaactggagagaatcctccagacggtttcatgtgcccgggtgggtggaaggttcttgttgactactacaacagcctgcaagctgaagaagcgactccagtccctgtatgaggcaagctactatttgactaagagattattcaatggcggggaaacatacaagcaagtgatcagatcatttgagcttttttccttattgattctttaggttagtagttgattgatatatgatcagatcttttcgattgtttgtttgtcttaaatatgagactctgaagcatggaaaaactaaagatctgcacaagttgagccaaaacagcatggccattgttct

SEQ ID NO: 37667 - DNA, 469 bp, Zea mays
  Clone ID: LIB3060-010-Q1-K1-G11
gccgtaccggtctcggaattcccgggcgctcgtacgcgttcagctcactactccaatttcgcaacaagttgcaagcaataaccgaccaaggacgacgaacgggtcgatggccacgctctactcctgcagccgcctgagtagcggcaccggcgccgcggccatccaccggcagccggcccgtgctggagccgtcctcgtcgtcacctgcaggcggagctcctccgcgaccgtccgcgccgcagccgctgccactgcggcggcgccggctgccgtagagctgcagaacaagggggtgtcgctgccgacgtgggcggagttcgagctcgggcgggcgccggtctactggaagaccaacaggtgcctgccgccctcgccgggcgaggggctgaccctgttctacaacccggcggcgacgaagatggccccgaacgaggtgttcggcgtggcgttcaacggcggcttcaaccag

SEQ ID NO: 37668 - DNA, 291 bp, Zea mays
  Clone ID: LIB3060-010-Q1-K1-G12
gtactcggtctcggaattcccgggcggacgcacgcgttcagctcatctactccaattacacagcaagttgcaagcaataaccgaccaaggacgacgaacgggtcgatggccacgctctactcctgcagccgcctgagtagcggcaccggcgccgtggccatccaccggcagccggcccgtgctggagccgtcctcgtagtcacctgcaggcggagctcctacgcgaccgtccgcgccgcagcctctgccacggcggcgtcgccggctgccgtagagctgtagatcaagggg

SEQ ID NO: 37669 - DNA, 101 bp, Zea mays
  Clone ID: LIB3060-010-Q1-K1-G8
tcaagcgcgtatcatttcctacttttattgccgcagcggctactgcaagtacggggcgggagactactacgacagcggttacaacagcaagaccatcactg

SEQ ID NO: 37670 - DNA, 402 bp, Zea mays
  Clone ID: LIB3060-011-Q1-K1-A5
accggtccggaattcccgggcgaagagttccttgagccacttgagctgtgctacaaatcactgtgtgactgcggcgacaaggccatcgcggacgggagcctcctggacctcctgcgccaggtgttcacgttcgggctctccctggtgaagctggacatccggcaggagtcggagcggcacaccgacgtgatcgacgccatcaccacgcacctcggcatcgggtcgtaccgcgagtggcccgaggacaagaggcaggagtggctgctgtcggagctgcgaagcaagcgcccgctgctgcccccggaccttccccagaccgacgagatcgccgacgtcatcggcgcgttccacgtactcgcggagctccctgccgacagcttcggcccctacatcatctgcatg

SEQ ID NO: 37671 - DNA, 453 bp, Zea mays
  unsure at all n locations
  Clone ID: LIB3060-011-Q1-K1-B3
ccggattcccgggtcgacnacgcgtccggctactccatttcctcccccggtacagcctgacccaacaaacgcacccccaagctaccaacgcacgcaaagcacggacgggcgcatacagctttccctttcgcgagtgcgtgccccttctcttctctagttctcttctccgtcgcgtcagagatcagggagagaccagagcaaacaacaaccaccgcttgtttcatcaagaatcgtggaggagaaccgaaaggtgtagtagccttttccggtagggcatctgctagagccggccggttgaagcaggggagcgagaggaggaaggcagccgagcaggagcatcgcagtggtggttaagcagcagcaacgacgacgacgacgacgctgagaggtttccccgttcccgacggcacgtccaccgaggcggcgccatcgcgatgggtcctctggcgccgc

SEQ ID NO: 37672 - DNA, 321 bp, Zea mays
  Clone ID: LIB3060-011-Q1-K1-C11
ggaattcccgggtctacccacgcgtccgcggacgcgtgggaaaaaaaaaaaaaattaaaacattaaaaaaaaaataaaatataaatgaaactagaaaaaaaaaaaaaaccaaattaacaaatacaagcaacacataagcctgcttcctactatttcatcatattttacttctgcctcaaatcctattaattcttcgaactgtataaaccattgatcttcactaatcctctttatataaccatcttaatcccctctatataccccctttactaacttaatatgcctattttcccatcattcccttaactacatctgtttcta

SEQ ID NO: 37673 - DNA, 456 bp, Zea mays
  Clone ID: LIB3060-011-Q1-K1-C3
ccggaattcccgggcttgccaactttctgcgacacggtggaggcgtggagctaactacccccgcgctggctcgccaccgccgccgcagcaggcgtgggaatctgggcagcgccccgcggagaagaggaggcagcgcgctctccgtccgccatggcgggctcttccgaccccgacaagctcatgagcaaagccgacaaactaacaaaattgagttttacaagatggaatgctgattggaaaagcgctacctccttgtatgagcaagctgcaattgcgtataggttcagaaaggacaatgagaaagcaaaagatgcttttgagaaggcctcaaaaggacaggaaatgatctcctcaccatgggacgctgctaagcatatggaatctgctgctgctttagcaaaggagcttgggcgctggaatgaagtatctgatttctatcacagagcttcagaatta

SEQ ID NO: 37674 - DNA, 459 bp, Zea mays
  Clone ID: LIB3060-011-Q1-K1-C5
taccggtccggaattcccgggcaatctttgcggcgccctcacacaccaccgccgccggctagagcctagggccgtaatcgtaacagccacccctgagactgagatggatacagcggaggaggctgggcaggaagtagtcagcgctgttggggaggatagtatcccggaagctgccgcctgcagcagggaggagaggaaggaggaagaggaggaagaagtggaggtgagcttcgatgaacttggcctggacgagcagctgaagagggcgttgaggaagaagggcatcctcaaggccaccccgatacagcgggaagccatcccgctcatcctggaagggaaggatgtggttgcaaaggccaagactggctctgggaagacctttgcctatcttctcccacttctgcacgagctactgaagttgtcctcagaaagacgtatacgaaaacctgcaccaaatgc

SEQ ID NO: 37675 - DNA, 458 bp, Zea mays
  Clone ID: LIB3060-011-Q1-K1-C6
accggttcggaattcccgggcaatctttgcggcgccctgacacaccaccgccgccggctagatcctagggccgtaatcgtaacagccgccccggagactgagatggatacagcggaggaggctgggcaggaagtagtcagcgctgttggggaggatagtatcccggaagctgccgcctgcagcagggaggagaggaaggaggaagaggaggaagaagtggaggtgagcttcgatgaacttggcctggacgagcagctgaagagggcgttgaggaagaagggcatcctcaaggccaccccgatacagcgggaagccatcccgctcatcctggaagggaaggatgtggttgcaaaggccaagactggctctgggaagacctttgcctatcttcttccacttctgcacgagctactgaagttgtcctcagaaggacgtatacgaatacctgcaccaaatgc

SEQ ID NO: 37676 - DNA, 379 bp, Zea mays
  Clone ID: LIB3060-011-Q1-K1-D7
taccggttcggaattcgagccacgagtcacacgtaacacgcacgcacgcacacaccaatccgctgcagcggcgacagacaccgaatcggcggggtacggcagcaactccatgacgtccgaaagccccgacgggcagaagcggtacgtgtgctacttctacaacccggatgtgggcaactactactacgggcagggccatccgatgaagccgcaccggattcggatgacgcactcgatgctggcgcgctacggcctgctcaaccagatgcaggtgtaccgccccaacccggcccgcgaccgcgacctttgccgcttccacgccgacgactacatcaacttcctgcgctccgtcacgccggaaacgcagcacgaccagatc

SEQ ID NO: 37677 - DNA, 457 bp, Zea mays
  Clone ID: LIB3060-011-Q1-K1-G2
ccggaattcccgggcaagaatttacttttacaatcaaaaggggagttgggactgatacgtgtgttagcgttaactatgacgactttgttaatgatgttgaagtgggcgacatgctccttgtagatggaggaatgatgtcattcttggtcaaatcaaaaactgaagattctgtgaaatgtgaagttattgacggtggtgaattgaaatctaggcgccatctgaatgttcgtggaaagagtgcaaccttgccatcaataactgacaaggactgggacgacattaagtttggtgtggataatcaagttgattactatgctgtttcctttgtgaaagatgctcaagttgtccacgaactcaaggattatctaaaaagttgcaatgctgacatacatggtatcgtaaaaatagaaagtgcagactccatccccaacttacatttcatcatcacagcatctga

SEQ ID NO: 37678 - DNA, 465 bp, Zea mays
  Clone ID: LIB3060-011-Q1-K1-H1
ggaattcccgggcttgccaactttctgcgacacggtggaggcgtggagctaactacccccgcgctggctcgccaccgccgccgcagcaggcgtgggaatctgggcagcgccccgcggagaagaggaggcagcgcgctctccgtccgccatggcgggctcttccgaccccgacaagctcatgagcaaagccgacaaactaacaaaattgagttttacaagatggaatgctgattggaaaagcgctacctccttgtatgagcaagctgcaattgcgtataggttcagaaaggacaatgagaaagcaaaagatgcttttgagaaggcctcaaaaggacaggaaatgatctcctcaccatgggacgctgctaagcatatggaatctgctgctgctttagcaaaggagcttgggcgctggaatgaagtatctgatttctatcacagagcttcagaattataccgtgaatg

SEQ ID NO: 37679 - DNA, 480 bp, Zea mays
  Clone ID: LIB3060-011-Q1-K1-H2
cggaattccgggtcgaccaacgcgttcgcgacttgtttcattgattcttgaagagatcgagcttcttttgcaccacaaggtcgaggatgtcttgcaactgcggatcaagctgcggctgcggctcaagctgcaagtgcggcaagaagtaccctgacctggaggagacgagcaccgccgcgcaggccaccgtcgtcctcggcgtggccccggagaagaaggccgcgcccgagttcgtcgaggccgcggcggagtccggcgaggccgcccacggctgcagctgcggtggcaactgcaagtgcgacccctgcaactgctgatcacatcgatcgacgaccatggatatgattattatctatctagcttgtggtggtggttgaacaataataagcgaggccgagctggctgccatacataggtattgtgtggtgtgtgtgagagagagagaaacagagttcttcagtttgctatctctctctgcat

SEQ ID NO: 37680 - DNA, 451 bp, Zea mays
  Clone ID: LIB3060-012-Q1-K1-A11
taccggtccggaattcccgggcaggcatgccgaacggtggcggcaagaggtggctgctgctgctgccgctgtcgcggtgggttctgctcctcggcgagcctccagctcccggcggccggcggccacgtcgtcacgcgcatgcgcgggttcgacgggccacttccgttctacctcgaaaccgggtacgtggaggtggacgagcagcaaggtgtgcagctcttctactacttcgtgcgctcggagcgcgacccctacgaggacccgctgctgctgtggctgtccggcggcccaggctgctccggcatctccggccttgcctacgagataggacccttaaaatttgatgcccgagggcaaggtgaatttcccactcttctctaccgaccggagacatggaccaaggtgagcaacatcatatttgtggactcgccggtggggactgggttctcgt

SEQ ID NO: 37681 - DNA, 450 bp, Zea mays
  Clone ID: LIB3060-012-Q1-K1-A7
gtaccggttccggattcccgggtcgcccacgcgtccggctgatacgggagccaaccaggagatgccctcgcgcgaattgaaaagctttcagagagtaaacccgatgcttggcttccgtgggtgcaggcttggtatatcgtaccctgaattgacagagatgcaagcccgggccatttttgaagctgctatagcaatgaccaaccagggtgttcaagtgttcccagagataatggttcctcttgttggaacaccacaggaactggggcatcaagtgactcttatccgccaagttgctgagaaagtgttcgccaatgtggtcaagactatcgggtacaaagttggaacaatgattgatatccccagggcagctctggtggctgatgagatagcggatcaggctgaattcttctccttcggaacgaacgacctgacccagatgacctttgggtt

SEQ ID NO: 37682 - DNA, 478 bp, Zea mays
  unsure at all n locations
  Clone ID: LIB3060-012-Q1-K1-B9
taccgtccggattcccgggtcgactcacgcgtccgcggatagcacgggatcctcctccgactcaggctccacctcatcgggaatcgaccgccgccgccgccgccaccgccatcggagcagccgccgcaaggagggcacgtcctcgtccgcgctgaaggcgcgcaaggaccggaggtcccgccacaagcgccgccgccacgagcgggagcggcggcggtccgcgtccgacgacgacagctacagcacaagctcttatgacagtgaccgtgaggtgtctggcagatctcggaaacataagaagagcagcagatcaagaaagtttagggagagggagcggagcaaagatagacatcatagacgagacaagagtaaacacatagaggtaaatttcctatttattcagaaactactaaactnttatgatggcttaacttaacatgtcagtggtagaagtacattntatctatacttncacaca

SEQ ID NO: 37683 - DNA, 266 bp, Zea mays
  Clone ID: LIB3060-012-Q1-K1-C7
ccggttctcggaattcccgggtctgacccacgcgtctcgcacctcttaagctcaaagccaagtctgctagtggtcctcttgaaccagtcaactgtaagcgtattctgggtgctcatcatctgacgactcagtaagtcaacagtgtgcggcttaatgctcaagctgggctccatgtgtctagcgcactcgtctgtctgtcgtttgcttgtccatggcttggcactcacttagctgtccggcatacgattcgcaagtagtacctggtg

SEQ ID NO: 37684 - DNA, 436 bp, Zea mays
  unsure at all n locations
  Clone ID: LIB3060-012-Q1-K1-C9
tcgtaccgtccggattcccgggtcgaccacgcgtcggtcgactcgcagaattattcagtcaggaaaagatcttagcaattgactaccgggaaaagaagaccctggtgacgtaaccggaacccatagtcggcttgcgactatcgcgtaaattagacagggtaagcaaatttattattcggcgagtggattaatgaatgatctaactaggtctataatgaattgggtcacaataaatgtagtaatttactaatttagcatgcctatattgtgataatcgatttaggtaaatcggtaaatcaagtaattaagatacatagttaaagagttaataaaaagctaggattaaaatagatctagtgtaatatgtcaattnggtaatggatgtagtcgatgccctgctgtgaatccatgnatgcttaattttggtttaaggttc

SEQ ID NO: 37685 - DNA, 458 bp, Zea mays
  unsure at all n locations
  Clone ID: LIB3060-012-Q1-K1-D9
taccggtccggaattcccgggagacaagcaaggaatcccccgatggctcatcgcgttctcctcctcctctctctcgcgtcggccgccgcggttgcggccgccgtcgacgcggaggacccgctgatccggcaggtggttcccggtggagatgacaacgatctggagctgaacgcggagtcccacttcctgagcttcgtgcagcggttcggcaagtcctacaaggacgccgacgagcacgcgtaccggctgtccgttttcaaggccaacctgcgccgcgcgcgccggcaccagctgctggacccgtcggcggagcacggcgtcactaagttctccgacctcacgccggcagagttccgccggacctacctcggcctccgcaagtcccggcgcgctctcctcagagaactcggngagtcggcgcacgaggcgcccgtgctccccaccgatggtctccccga

SEQ ID NO: 37686 - DNA, 334 bp, Zea mays
  Clone ID: LIB3060-012-Q1-K1-E1
ggaatttccgggtcgacccccgcgtccgacttcctatgttagtccctagtccacatcgtcgttcagctcagtagccgtataccagggacagaggagagaaatcactggattgcgtgacaaagaagcgtagtccaatatgacacctgccagccaagcactcgacaaattccctgaatcggagaaccattaccgatctcgtgtattcgagtcagctattggaatggtcgcaagcgctcaatgtggaagaatggaattagatgaagaagaaagagaggttcagcgcgatgctcactaggtgctcaataaattgcgagtcacgggactctcgtcgact

SEQ ID NO: 37687 - DNA, 432 bp, Zea mays
  Clone ID: LIB3060-012-Q1-K1-E5
ccggttcggaatacccggcctggcgggccactactccgtcaagggcgcgcgcgccgtggcgcagctggccgtgcagtgcaccgcgcagcaggggcgggacaggccgcgcatggtggctgtcgtcgacgcgctcgacaagctgcaggggctcaaggacatggccgtcaccgtcggcctctggcccgccaccgcgcccgtcgccgggcggaacgccatctccgccaagatccgcgcggaggtcaagggcgccgccggcgcagggtcgcgccggaggagcgcgtcctccaagctgccttagtaatcttgacggctggaccacctgcgtgccacgtcgtacatgtctcctagctagctcgtgtgtaccccgggtgtaggaatcgtcttgtgtgttttgtgccacgtcgtcggtgtgtgtatatagtacatactact

SEQ ID NO: 37688 - DNA, 181 bp, Zea mays
  Clone ID: LIB3060-012-Q1-K1-E8
cggaattcccgcgtcgacccactcgtccggccagaagtatgggtccatctttggactaccacagggtctgtatgtcaggcgtgaaggacaaggtgaaggtcctagaagttctaaggaactggccacataggaacattcaagttatctgtgttactgatggtgagcgaatcttgttacttgt

SEQ ID NO: 37689 - DNA, 354 bp, Zea mays
  Clone ID: LIB3060-012-Q1-K1-G1
cgccccggaattcccgggctcgtgtggtgctcatcaagctggcagatcgcttgcacaatatgcggacaatttatgctcttcctgtacctaaagctgaagctgttgctcaagagacattggctgtctggtgctcacttgcttctcgattgggagtctgggctttgaaagctgagctggaagatttatgctttgctgtcctccagcctcaaatcttcaagaaaatacaatctgaacttactttaatgtggaatcataccggaaaatctaaaaatatgagaagatcatcaattcgaaacgaattacttgctttcaatgaagaatgggaattgggggccatcaatggattggttaagt

SEQ ID NO: 37690 - DNA, 354 bp, Zea mays
  Clone ID: LIB3060-012-Q1-K1-G10
actcggttcggaattcccgggtcgacccaagcgttcgctggcctgtaatattacttttcgttattaccgtggcaaccctgtttgtgtggtctcgagttttccgcgcctatagaagcagccagcaaaccttactccttaagaccttaacaaagcaagcaatctaacgggcacggctggtttccgaccagttctgtcgtgccatggatccgcgacacgcattcttggagagctcgaccgaagacctgaccaggccgcttctgcccgtgcacgactacaggcctgcgggacgctgctcttgcttcgggctcgggttcctgcttaccaccaacaagtacctggcccgttcgtttggcc

SEQ ID NO: 37691 - DNA, 455 bp, Zea mays
  Clone ID: LIB3060-012-Q1-K1-H9
tcgtaccggtctcggaattcccgggaacgcctccaactccaccgcggggaacctgtgcatgcccggcaccctcgtgccggagaaggtggccggcaagagcgtcgtgtgcgaccgcggcgtcagcgcgcgcgtccagaagggcctcgtcgtgcgcgacgcgggcggcgccggcatggtgctgtccaacacggccgccaacggccaggagctcgtcgccgacgcgcaccttctgcccgtcgccggcgtcggcgagagggaaggcacggcaatcaagtcgtacgtgacctccgctccgaaccccacggcgacggtcgtggtcgccgggacggaggtgggcgtgcgccccttggccgtggttggcgcggttctcgtcgcggcggcccaaacatggtgacgccggagatccttgagccggacatgatcgcgccgggggtgaacattctggcgtcgtggac

SEQ ID NO: 37692 - DNA, 437 bp, Zea mays
  Clone ID: LIB3060-013-Q1-K1-A10
cccacgcgtacggggtgctgaaatgagacaagcggtcctttaagtacgcgtgggtgctcgacaagctcaaggctgagcgtgagagaggtatcaccattgatatcgctctgtggaagtttgagaccaccaagtactactgcacggtcattgatgcccctggacaccgtgacttcatcaagaacatgatcactggtacctcccaggctgactgtgctgtccttatcattgactccaccactggtggttttgaggctggtatctccaaggatggccagacccgtgaacatgctctccttgcgttcacccttggagtgaagcagatgatttgctgctgcaacaagatggatgcaaccactcccaaatactccaaggcacgttatgaagagattgtgaaggaagtctcatcctacctcaagaaagttgggtacaaccctgat

SEQ ID NO: 37693 - DNA, 457 bp, Zea mays
  Clone ID: LIB3060-013-Q1-K1-A3
gtaccggtctcggaattcccgcgccaagcgtccggtcgtgtcgaggcttccggtcgtcgacagcggtctcagatccgtcggcgtgatcgtggggagcgaccgggcaagagcctctcatgggtccaagacgaagatatcggaagtgatgacatctccagctatcacactatcgtctgacaaaaccgtgatggatgctgctgttctcatgctcaagaagaagatccacagattaccagttgtaaaccaggacgaaaaagtaataggtatagttacccgcgctgatgttcttcgcgtgttggaaggcatgttgaagatttaggagcgcagatacccatgctcggaagccacagcctcttgtaaatatgtagatgtgcccgggcatggtgtttctgagtagcagcaaagagatctaccatgtataggagtttttccttgtaaataaaagtagcacgccagg

SEQ ID NO: 37694 - DNA, 382 bp, Zea mays
  unsure at all n locations
  Clone ID: LIB3060-013-Q1-K1-A5
tgatcaccaacagctagtgctagtcccccttccttccatccatccatggcatgcgtgagcaccttccagagctgccccattgccagaagagcaaagatcaacaccaggtccaggggcagcagcagtagcgtggcgaaggggtcaccaccaccagccttccagttccagtgcagggcgtcgactttcgcggcggacaccagcctccggctcgagctggacgagaaccccgaggcgatcatctcgggggcgtggcccgggaactgctccctcctcagctacgacgacctccgcgcctacctcgagtcgcaggagacggcggcccaggcagacgatcagcgcggcgtggcgctcctgagcgagaccatgtncacacccgtgctgg

SEQ ID NO: 37695 - DNA, 448 bp, Zea mays
  Clone ID: LIB3060-013-Q1-K1-B12
ggaattcccgggcggtcgtagccatggagaccacttcccctgcctcttcacctgggcacatctccctcccagctgctgcaggtaggactaagtagtaaatagccatatacataggttgagtggatcgttaagagagggtagccatatacataggagtactggatagtatacaagaacggtagatacagggcaggggacatgatgctgggaaagagatctgggcgcccgtcgccggcgtcgcggcagcacatgcggcggaccacgagcatgacggagttcgcggcaccgcacgtgctggtagacgtcgcggaggaggaggaggacgaggagctgcagcttctgccggcgcacgccgaggccgcaggggaggcggccgagcaggaggacccctacgggtgggccatcggcggcgccgcggcggccgggcgcgcggactggctggcggcgt

SEQ ID NO: 37696 - DNA, 409 bp, Zea mays
  unsure at all n locations
  Clone ID: LIB3060-013-Q1-K1-B3
tcccgggtcgaccacgcgtccgcggggcgttgagggccggcttgggcccgggttaacggtgttaaaggccgcattccgggccgggaaggcaccgtcccaggtggtgcagccaatcaacggggaccggttaatcggcagcctggagacgcccgtcaccttcagcccgctcatcgcgtggtacctctccaacctgccggcctaccgcaccgncgtgagcccgctgctgcggggcgtcgaggtcggcctcgcccacggctacctcctcgtcgggcccttcgcgctcaccggcccgctccgcaacacgcccgtgcacggccaggcgggcgcgctcggcgccgncggcctcgtcgccatcctcagcgtctgcctcaccatgtacggcgtcgccttcttcaacgagggcgacccg

SEQ ID NO: 37697 - DNA, 426 bp, Zea mays
  Clone ID: LIB3060-013-Q1-K1-C10
tccctctccctacacctccgctccctctcgccgctttcccccacccaatccgaccgctgggccgcctactctccgccggggccggcgattccccggagattccgcgcgattctgctcagattctgggctcctcttgtggtttctcggcgaatcggcgtggatcgggactcccggctggagaatcttccgtctgtttcgctaactgtttggatcattctacgtggcgattgcatgccatcaccttccttgaagtgaaaaatatatgggctgatcttggcatttcatgggaggttttgaagatgatgaacctccctcaaaacgcgcatgagcatcctcagtagaatctgcaagtttaccagactggttcttggtttcaaaatctgccaatcctttgggaagtacaatggctagacctttgccttccca

SEQ ID NO: 37698 - DNA, 350 bp, Zea mays
  Clone ID: LIB3060-013-Q1-K1-C7
ctgtactgtactgtacctatacacctatatactacgacgtgcacatgtacgagtctgcgacgtgctgctgtaccatactaatactagtgcgctgctgctcccttgccttcttgcttgcaagttgcaccagccactccgcttttttttgctcgaacgatcgactgctcgtcgcgtcgggccacggccggtcgtcagtttgggtgtgtccactccactgtaaagctcctcctcttgtttttttgggtactccctgcatgccaaagttagcggacgtgtactaggtgtggttcggagcagcaggttgtattacttaccaccccctctgtgatgtaagaacgcgtgctgaaatt

SEQ ID NO: 37699 - DNA, 275 bp, Zea mays
  Clone ID: LIB3060-013-Q1-K1-D1
ggctaaaaaaaggttatttccacacgggacaagggggaaatccaataaaaataaaagcgacatttatttcttgggcataaaatcacaaggcatttccccgcaggaaaaacaattaccggattattccctgcccacttgacaaaaaccccaaccgaaaccaccggaccggggataaaatgtccatggggacccccggcaacttgaaaaggtcggcctcccggttaaaccgctggtttagcatccacttttttaaaggggggaaaaagaatcccctt

SEQ ID NO: 37700 - DNA, 474 bp, Zea mays
  unsure at all n locations
  Clone ID: LIB3060-013-Q1-K1-D3
tccggaattcccgggtcgaccaaggcgtccgaaccgctgttggcaactgatttcttcgagataaaggctgtggatgaaataaagcctggtctgaagaaacagctcataatttccacaattgtgatgaccattggcattgcactaatcagttggcttggtcttccatacactttcactattttcaactttggagtccagaagacagtgcaaagctggcaattgttcttgtgtgtggcggttggtctctgggctggcctagtcattggttttgttactgagtactacacaagcaatgcctacagccctgtacaagatgttgctgattcctgcagaactggagcagctactaatgtcatttttgggcttgctttgggttacaaatcagtcattatcccaattnttgctattgcgtttagtatcttcctcagcttcagccttgctgccatgtatgngtgtgctgtggctgctcttgga

SEQ ID NO: 37701 - DNA, 380 bp, Zea mays
  Clone ID: LIB3060-013-Q1-K1-D6
cgacccacgcgtacgagctcgatctactactactactagctggtacacatactagccagcctgccagccagcttgccgtggcgcccaccgtgatgatggcctcgtcggcaaccgccgtcgccccgttccagggtctcaagtccgccgccagcctccccgtcgcccgccgcagcaccaggagcctcggcaacgtcagcaacggcggaaggatccggtgcatgcaagtgtggccggcctacggcaacaagaagttcgagacgctgtcgtacctgccgacggtgtcgacggacgacctgctgaagcaggtggactacctgctgcgcaacggctggataccctgcctcgagttcagcaagctcgggttcgtgtaccgcgagaac

SEQ ID NO: 37702 - DNA, 157 bp, Zea mays
  Clone ID: LIB3060-013-Q1-K1-E10
tccggaattcccgggcaagcttccggttttgtctgcagaacatggttagtgtcatgtagcagggcaatgaccgttcactttcgtcatcgtatttgtttccggtccacttgcctaaacttttgtaatctttgttggcttggccttttcgaatatatcc

SEQ ID NO: 37703 - DNA, 425 bp, Zea mays
  Clone ID: LIB3060-013-Q1-K1-F12
ccggttcggaatccccggctcgacccacgcggtctatactttgcagatcaaccaattttgcttcaatggataacactgcatcacctgacatggtttatcttcacaaatgtcctgtccacttccgaatcgacttcttatcgcaactgttgccttcatcatactctcgatcataaaccatatataccatcatggttagaacgatggcctcaacgctactcatatttcttataaggcatgcttctcttgtcaagccactctcacaagcaggcaatttcataattgcacggcacattcatgatctacagcttgatcacggtcacaatctgtttccagatcaataactcaggtccccatacacgtcactacaggcataccgtcctgtcttgttcctgaaaacatctcaccttgacaagattccgctcctt

SEQ ID NO: 37704 - DNA, 268 bp, Zea mays
  unsure at all n locations
  Clone ID: LIB3060-013-Q1-K1-G4
ggcccaagtcactggtcaccatctccacggaggtggacaccaaggccatcgagaagagctctaaggttgggctctccctggtcctcaagccctgaggtcaccagcttctgcttttgggatgttaggtttatttttatttttatcagcagctgaagttcagtaaacaagcttggactaaacttgtcaactttggtgcccatcccacaaactcaattcgttgcctgttaccctatcctaaactacctgagaggtttatgttacaattaan

SEQ ID NO: 37705 - DNA, 332 bp, Zea mays
  Clone ID: LIB3060-013-Q1-K1-H1
ccggattcccggtcgaccacgcgtccgcgcacgcccgcgcctccccgctgtggcgctgtcccctccctggcacccaccctcacagggcatcagcctctccaatcagacgcgagccacccaccgcgcgacctcagggtgcctgtgcctgctctcgctgttccttcctcatggccaccgcctgccacctcgccgcgccgctcggcctcgccccgttgccccgcggctgcgcctctgctggcgtcgtggccgtcgtccggtgcgctcggtcgtcaagctccaagatcccgagaggcgttgctgtcagggcgacgtccggcggcgagggcgccacg

SEQ ID NO: 37706 - DNA, 356 bp, Zea mays
  unsure at all n locations
  Clone ID: LIB3060-013-Q1-K1-H10
cggtccggaactcccggctcgacccacgcgtacgtctaccgaaatccaaattgtttcagntttaggcgattctcagctcgcctttgtttcgggtgacagattcctgtgcctgcggacgggatgtcaagccctctcgaccgatttgctaggccatgctttgaagggtttgtacataacgatgaaaggaaagagagcagatctgatgcagacaactcagaaggatataagaacactaagattgggtctttcaatataaaagcaattaatgcggagaacaaattcaggcattccttgataaggagaagcactactaagaccgaaaggctggattccatcaatgacataagggacgttaa

SEQ ID NO: 37707 - DNA, 455 bp, Zea mays
  unsure at all n locations
  Clone ID: LIB3060-014-Q1-K1-A1
accggccggattcccggtcgaccacgcgncgcggcgcgtggtcgctacatgacggacatgacacctacgccgacaccgacgcgcgatcggggcgccggctcgcggggctgcctgcgcgtacgagctctccaaggaccccgccgtgagcatcgccatcgtggagcagtcggtgtcgccgggcggcggcgcgtggctgggcgggcagctgttctcggccatggtggtgcgcaagccggcgcacctgttcctggacgagctgggcgtggcgtacgacgaggccgaggactacgtggtcatcaagcacgccgcgctcttcacgtccacggtcatgagcctgctcctggcgcgccccaacgtgaagctgttcaacgccgtggccgtggaggacctcatcgtcaggggagggcgcgtcggcggcgtcgtcaccaactgggcgctcgtgtccatgaaccacg

SEQ ID NO: 37708 - DNA, 459 bp, Zea mays
  Clone ID: LIB3060-014-Q1-K1-A10
accggtccggaattcccgggggccaccattccgaccaccgattctggcctcgtcctcagttcctccgctctcctccggaggactaggagggccgcctcatccgtcaccgccaggctgccagccgtcgcccgccgtcgcccgcagctcctcgtgcgtgcctccgccaaggagatcgcctttgaccagggctccagagccgcccttcaggccggcgtcgagaagctcgccgccgcggtcggcgtcaccctcggacccagaggaaggaatgttgtcttggatgagtttggaacccccaaagtggtcaatgatggagttaccattgcccgcgctattgagcttgctgatcccatggagaatgctggtgcttccttgattcgtgaagttgctagcaagacgaatgactcggctggtgatggaaccacaactgcctctgttctcgctagggagatcatcaaattg

SEQ ID NO: 37709 - DNA, 458 bp, Zea mays
  Clone ID: LIB3060-014-Q1-K1-A11
taccggtctcggaattcccggcaaacagtagttcttcagttaagcaggagggcacaggatgaggaagatggcgtctaagaggatccagggggagctcaaggatcttcagaaggaccctgccacctggtgcagtgcaggtcctgttggtgaagatatattccactggcaggcaacaataatgggtccatctgatagcccatattctggaggagttttcctagatacaatccattgtcctcccgattatcctttcaaaccaccaaaggtggcattccgcaccaaggtgttccatccaaacatcaacagctgcgggagcatctgccttgacatcctgaaggaccagtggagccacgcgctaaccatctgcaaggtgctgctgtccatctgctccctgctgaccgatccgaaccccgacgatcctctggtccgcgagatagcgcacatgtacaagacggacc

SEQ ID NO: 37710 - DNA, 64 bp, Zea mays
  Clone ID: LIB3060-014-Q1-K1-B10
ggaattccgctcgacccacgcgtgcttgacacatatatatagattaatttacatgcaacgcacc

SEQ ID NO: 37711 - DNA, 432 bp, Zea mays
  Clone ID: LIB3060-014-Q1-K1-B2
cggctcgagccacgcgtgcggcgccatattgcagaacctcgtcgccttcacccgcaccacaccaccggcgatgtccaggtcggcttcgcagggcggcagccacaagccggcgctccggaggcccgtcttcaccaaggtcgaccagctcaggccgggcaccaacgggcacaccctcaccgtcaaggtcgtcagcgccacccccgtgcctgggcgcgcgcgcccatgcgcacccgccgccgccccatcccgcgcgccgcgcatcgccgagtgcctcatctgggacgagaccggcgccatcgtcttcaccgcccgcaacgaccaagttgacttgctgaagcccaatgcgacagtgatcttgcgcaatgccaaaatagacatgtttaaaggatcaatgaagcttgcagtggacaagtggggtcggattgaagctgt

SEQ ID NO: 37712 - DNA, 384 bp, Zea mays
  Clone ID: LIB3060-014-Q1-K1-B6
ccgggtcgaaccaagccttccgaggaaaaaggccaaggaaaaaaggcattgggccaaaggaaggttaggtaggctaaacgggccggccaaagctaacgtcctggtgctgccgatgccatgccagggccatgtgacgccgctgatggagctctcccacctcctggtcgaccaaggcttcgaggtcaccttcgtcaacaccgacgtggaccgcgcggccgtggtagccgcgctggaggcctccggcggcggcggcggcgtggcggcgctgggcggcggcatccacctggcgtccatcccggacgggctggccgacgacgaggaccgcaaggacatcagcaagctcgtcgacgcctacacgcgccacatgcctggctacctggaacg

SEQ ID NO: 37713 - DNA, 421 bp, Zea mays
  Clone ID: LIB3060-014-Q1-K1-C10
cggaattcccggctcgacccacgcgtgcgcagaggattcagcacgccgcccgttggtaagggagcttcgaggcggcccgcgggggcgcgtcatccgggcggactgagccaatggcacgggcccttggcgcgcgaacgctctaacagttgtcgtcgcgggcggctagcaaactcgccgtatgctagcttgtattctgacttataggcattcagtcataatccggcacactgtagcttcgcgccactggcttttcaaccaagctcgatgaccaattgcgtgaatcaacgattcctctcgtactatgttgaattactatctcggagcagtcattactaccttaaaactaacctgtctgacgacagtatagacccatgtcacgttccctattggagggcgaacaatccaacactggacgaattct

SEQ ID NO: 37714 - DNA, 454 bp, Zea mays
  Clone ID: LIB3060-014-Q1-K1-C2
cggtccggaattcccggccgccgccgagctcaaggtgaaggagctcaagaacggccgccttgccatgttctccatgtacggctttgggcaggaggccatttgcaacgtacaaggctcgatggatatcctaatcgactacatatcacattctgtgagccacaacgccttgtacatactctaagaactttgtccgcggtaactaattcactgaccaaatccactcatgtgtactactatcacatccatcaattgtgtcctacctctgtaacatgaacattgacttatattctgtactttacttaatcatatcgatctatcctattaatatcaccatccagactttactcattaccaatctgctcttaacaattactggaatcctctaccttgtttaagaggtatatatgccataagctcatacgaatgtctcctgatcaacggataaatctactta

SEQ ID NO: 37715 - DNA, 440 bp, Zea mays
  unsure at all n locations
  Clone ID: LIB3060-014-Q1-K1-C3
tccggaattcccgggtcgacccacgcgtacgctgaccttttcgctgtactcactcgccacacacaccccctctccagctccgttggagcgtccggacagcagcaggcgcggggcggtcacgtagtaagcagctctcggctccctctccccttgctccatatgatcgtgcaacccatcgagctacgcgcgtggactgccttccctgggtcggcgcaggaggggatcggaaggatggcggcgtcggtttccagggccatctgcgttcagaagccgggctcaaaatgcaccagggacagggaagcgacctccttcgcccgccgatcggtcgcagcgccgaggcccccgcacgccaaagccgccggcgtcatccgctccgactccggcgcgggacggggccagcattgctcgccgctganggccgtcgttgacgccgcgccgat

SEQ ID NO: 37716 - DNA, 464 bp, Zea mays
  Clone ID: LIB3060-014-Q1-K1-C4
accggtccggaattcccgggctgctccggctccggttcgcacacagtaagaaaagatggcgctgccatccatgagtcttgtggcaaagggtgtgcttcccttctcagcacgtacctcgagtggtgtcacacaaaggccggtgtcagtgactgcttccttggagcacaaaaccagcgatgccagaaggaagttcctaaaacttgcgcttgggaaccttggagttggactgcccaccttgttgggcgctaagaaagctctcgctgatgagcaaggcgtctcgtcctcgaggatgtcttattcgaggttccttgagtatcttgacaaggatagagtgaagaaggttgatttgtttgagaatgggacaattgctattgtggaggccatttctcctgagcttggtaaccgcgtgcaaagagtccgtgtgcagcttcctggtctaagccaggagcttcttcaaaagttga

SEQ ID NO: 37717 - DNA, 346 bp, Zea mays
  Clone ID: LIB3060-014-Q1-K1-C6
attcccggaccgacccacgcgtacgctcgccttttcactggactcactcgccatacacaccctctctccagctccgttcgagcgcctagcagcatcatgcgcggggcggtcacgtagtaagcaactctcggctccctctccccttgctccatatgatcgcgcaacccatcaagctacacgcgtggactgccttccctgcgtcggaacattacgggatcgcaaggatgcctgcgtcggtctacaaagccatctgcttacaaaaaccgcgctcaaaacgcaccaatgacagagaagcgacctccttcgcccgccgatcggactcaacgccgaggcccccacacgccaa

SEQ ID NO: 37718 - DNA, 454 bp, Zea mays
  Clone ID: LIB3060-014-Q1-K1-D11
cggttcggaattcccggctcgacccacgcgtgcgccggctcctcgcccaccaatctgtacacactccgacgccgacgcgaaatcgagaggagcaccaagctcaaaaaagcgccgcccggcgccgatgttgctgcggcggatgcgatggatgtcggagggggacggccggtgggagctggatgcggagaccccggtgacgatggagggcacggcgcgccccgtcccgggggaccccctgccgctggggctctcacggggctaccgcatcacccgtcccaagcagctagacttcttccaccggttcatggcgtcccctctggtacccaccttctccgccatgcgcgacggcctctccgtcaaccacgcccacattttctacatgacagacaactggtcttctaccatcttggagaaaatcaatgttaagaagcttgtgtctgtcgtgaaagagaaa

SEQ ID NO: 37719 - DNA, 451 bp, Zea mays
  Clone ID: LIB3060-014-Q1-K1-D3
ccggaattcccgggccaggatataactttgtgctgctgtgatggtgttaagtgccggtgggctcggccttcttataagtctaatggggtatccgatgtccttggggcaatcggacagatccggttaagttatctggtgcacatgcatagccgtccgaggtctttgagacaaggacaggtgcatgtgggcccaataacttgggaggttctgccacagcagggagcaggcgcaaggatcctctttactgcacatggaggcgagcacctcagatatgccctacagttgttatttccagcctttaacaatgcaacagaatatgaagctctgattcatggactgaacattgctatatcactgggcatcaagagactgatggtatatggagattctttggtagtcataagtcagataaacaaagaatgggattgttcaagcgattccatgggaaaat

SEQ ID NO: 37720 - DNA, 372 bp, Zea mays
  Clone ID: LIB3060-014-Q1-K1-E8
caagcgttccaggttattccttggcaaaagggacccttgaaagggcctaaacggatttttcgaaaaaaggaaaggaggagggaaaggattccatgggaacatttatgagttggatggagtttccgttactggaccaaccaggttccaattccgttatttcaactacacttaaacgaacttttaaaatgggtcaagactctcaagtttatgggcccttctatatgggaccaagttgtggttcattggatttggttcattaatagggtcacgattcgactttgatcggtatggattggtaccaagatcaagtcctagacaagcggaccttattttaaccacttgtacggtaacaatgaaaatggctccatcttt

SEQ ID NO: 37721 - DNA, 313 bp, Zea mays
  Clone ID: LIB3060-014-Q1-K1-F11
cggttcggaattcccggctcgacccacgcgtgcgtccacgcgtacgagcgcgagcttctactagcatctatactgcactccggtgaggaggcggaaggtgcccggtggagtctaagtgcattgtaagcctgactctttgacaagtcaacggcaccggttgctcattcagtatgtgcgctctacagctgctatacacacatcacgttcctcaccgtacataccaaacttgtgccttccaacgacactgggcgccagaactgacgacctgctagagtggagttctgccactgatcgattgaagacgactgttatc

SEQ ID NO: 37722 - DNA, 455 bp, Zea mays
  unsure at all n locations
  Clone ID: LIB3060-014-Q1-K1-F3
ggaattcccggctcgcncaacgcgtccgaaccctgggaatcacccacgccacccatctaaccactgcaccactgcgcgcttcgtactgctggccgggctgctccagcaccaggaacgctcgctcctgctcgtcgacgttagattttcccagacgcgcgagctccccagcaactccaacacgttgctcgcctcgctcagtcttcaagccatcgtgtcgctggttctagccaaagtcgggcgcgttctttccttcgccaggcagcgcctccagtcgtcgtttcttttccacggctgcacgctcaccgactcaagcgctnggccatggagctcagtttcgtgtgtgcctgtgctgngtcgccgggtcacgtgctcatccgttttgatgccgtgcacgctccggcttgtggaactcgccggcgtcgtcatctactactagacctcacagtggtactgtg

SEQ ID NO: 37723 - DNA, 433 bp, Zea mays
  Clone ID: LIB3060-014-Q1-K1-H1
ggaattcccgggcccagtccaaggtcatccccatggtaccgggaaacaccatggttcggagcagggaaagagcttcggctgggcaccatggggtttcccagtcccaggtcatccccatggtaccggtcgagtttttccctcctctctggccggcgttctgcctcaggcttgcccaggctatccctcctatcgacggatctgtggtcgccgtacccctgctccttccaacgccgcgccttgcttggttccatggccggagttccacccatccgcgcgattctccctgcccctgcgtcggtcgcccatctccctggagtttctgcccgtgccgtgcctctttactgtgctcacccaagttgtcgtcgcagctccagctcggctctgtccatactccagcttgccccctctgtttgttctcgctgatgggtcgggt

SEQ ID NO: 37724 - DNA, 446 bp, Zea mays
  unsure at all n locations
  Clone ID: LIB3060-014-Q1-K1-H3
ccgggctggacccacgcgtccgaagacacataacaacgagcagcacagttcacgctcggctacgactacgatccgcgcgcatcgagggcgatgagtgacaccggctcgagcttcgcgcagtgggccgcgctctaccaccaccacgaccccgccggcggcccggtcctgcccgacgacgacgcggcggacgctggcaacggcatcggcagcggcaccgtcaccgtcgcgagcccgacgtcgggagggtccagcggcgggagccccaccaccaaggcagcgtgggggcagcagcatctgcttcacggggtggaggggccccgggtcgccgggaagccggcggcggcgcggcggcggtcccgcgcgtcgcggcgggcgcccgtgacgctgctcaacacggacgccgncaactttcgcgccatggtgcagcaattcacgggcgtccccgc

SEQ ID NO: 37725 - DNA, 220 bp, Zea mays
  Clone ID: LIB3060-015-Q1-K1-A12
tcacctcatcactacctcacccacccaggcccccaagaactacccatcaaccatggcgcgcggcgtcggtgtccgcctcccacctactaatcaccgactcgctcccaaagcccaagccttactccctgcgcccgccgaggatccctctcgccaagccccttcccgcatcggcggcgctcctggagctcgcgggctcacccgcgctcgccgacgacgcgcc

SEQ ID NO: 37726 - DNA, 411 bp, Zea mays
  Clone ID: LIB3060-015-Q1-K1-A3
atctatagcaaccggtccaacactttcacgctcaggcgctcagctctagcaatggctgcctccaccatggcgatctcctccacggcgatggccggtacccccatcaaggtgggctccttcggcgagggccgcatcaccatgcgcaagaccgtgggcaagcccaaggtggcggcgtccggcagcccctggtacggccccgaccgcgtcaagtacctcggccccttctccggcgagcccccgagctacctcaccggcgagttccccggcgactacggctgggacaccgtcgggctgtccgccgaccccgagaccttcgccaagaaccgcgagctggaggtgatccactcccgctgggccatgctcggcgcgctcggctgcgtcttccccgagctgctctcccgcaacggcgtc

SEQ ID NO: 37727 - DNA, 446 bp, Zea mays
  unsure at all n locations
  Clone ID: LIB3060-015-Q1-K1-A8
ggattcccgggtcgacnacgcgtccgcgcgggcgcggagctgctgcggcggctggaggagcgcgggcccggcgggcgcagcatgatcgacatcacgcacgcggtcgtgccggacctgccggcgttcgccacgggggcggtcgcggggcccatgctgcgcctcagggagtccatggcggacgggtccgagtacaacctgtcggagctgcggatggagtgccacaccggcacgcacgtcgacgcgcctggccacatcaaccaggcccacttcgccgccggcctcgacgtcgacacgctcgacctccacgtcctcaacggacctgcattgctagttgatgtgccaagaaacacaaatataacagctgaagcgatggaattcctaaacatcccgagaggggttcgccgagttctgttcagaacactgaacactgacaggaagttgatgtg

SEQ ID NO: 37728 - DNA, 412 bp, Zea mays
  Clone ID: LIB3060-015-Q1-K1-B1
accggtccggaattgccggatccacccacgcgtccggagaagcggcgcatgtttgaaagaggtgctgcctgtgcccaaagtgcgcacgcaactactgaatattgcacgccgcatggaggaggaaagcgctgatgctgccgctctgcaccaacagtgctcgcggccgcactgactgctagctgaagcacggcggccgcaagctgtgcaaggctgagaactgcggctagagcgcccagaggagcacggacttctgcaaagcccatggcggaggacagcggtgcacatggggcacaggctgcgaaaaactgtcccgtggcaagagcggcttctgtgcagcacatggcaccttgatggccaggcatgcgagaacatgcagcggacaagaatgtaggaagcatgattggaccaggtc

SEQ ID NO: 37729 - DNA, 313 bp, Zea mays
  Clone ID: LIB3060-015-Q1-K1-B12
gacccactcattcgtgactccgcccactagaccatccattctttcgacaacaaccatgtcacctcatttcatgagtgttatgacaccatcaatcaactcactggcctttgcattacaatgatctcaatgataaatcactgcccctaccctacttacttagcttgcatcacatatccctatcctcatctggcttaatacctaagaggtccacacctatcccacttcctatcacttgcgcagcctcaattactaatatcactctccctgtatcacagcattaatcgcagactgtgtcatatttacacacaacatc

SEQ ID NO: 37730 - DNA, 416 bp, Zea mays
  unsure at all n locations
  Clone ID: LIB3060-015-Q1-K1-C12
cggtccggaattcccggggaaaaacaaaaacgagtgggaggtggccgtgggccatgttgctgctgctgacgaggcggcgcgacccatagtaaaggcgtacaacagctcacctncctcgtccagctccagccgccgtcaggcttccgacgcaacttctaactccgttcgcctccaggcgacaccatcgcccgctggcacgccgccacagcagcaggttaacacaatttggcccggagcttagttgaatcctgcttccgccactgcggacaaccatggcgtcgtcgaagctgcagctgcctgctgacgacagcgtcctcctgctcatcacccactccaatctcaccaccttcgcagcggacatccgcgtctcgcaacagaccaccgtggaggcgctcaaggacaagctctggcgcaag

SEQ ID NO: 37731 - DNA, 436 bp, Zea mays
  Clone ID: LIB3060-015-Q1-K1-C3
taccggtccggaattcccggggttgctctagatccgttcatcctggtggttttgtgaggtcgaaagcggcgagcgaattagaagatgctggacaagctgtgggacgacgtggtggccgggcctcgcccggagacgggcctcgagaagctccgcaaggccaccaccgcccgtccgctcgtcatcaacaaagacgcggacggcggcagctacaagcgggcgcagtcgatgccgtcgaccccgacgacgccggtgacgccgtcgtcgtcgtcgtcgtcgacgacgccgcgcggcgccggcaacgtgtggcgcagcgtcttccacccggggagcaacctggccaccaagggcatgggcgccaacctcttcgaccggccgcagcccaactcccccaccgtctacgactggctctacagcgacgagaccaggagcaaccacc

SEQ ID NO: 37732 - DNA, 467 bp, Zea mays
  unsure at all n locations
  Clone ID: LIB3060-015-Q1-K1-D4
taccggtccggaattcccgggcttcttggtagctgagatgctccttctgtccgtcaatgcattgcattgcatggctagaagcgttatatctaggaggcaaaagcaggaggagactggtgggaggggagtagaccatcgcctattcgattctcactacttgtccatgctgcttaaaagaatccctctggtcctgattaattagaagctgtagttgtccttgacttgcaaccatgtatccacagatggtatatcatgcagatgttcgggcgagggagaaggagttggcggcggcggagacggagacggagaccatgggctgctgctcctgcgctcccttgngcaggatgatatccagatgtatcatcaaacgcaacgtangaagagaacggcgcatgaggtacgacgagaggacgggaatggactatgccatggcgtacgctcccccgcagacatgctacgtgcgccca

SEQ ID NO: 37733 - DNA, 368 bp, Zea mays
  Clone ID: LIB3060-015-Q1-K1-E11
tcgttctgaaaagatagtctcaatgaggagacctgctaatggcaagcgcatacgaggaatgctgccgaatgatgctacaaaacggtgctcaatctgatagctagattagccattcattatagttctatagccctgtgattcacaatatcacgtacatgcgttgtcaggacagagcctgggaacgacacatcgtacttatagatctacactagagatacttgcagacacgattgagatgagcgaaaacatggacaagaagagctgtctggactgatgcaggctaggaccttcaatgcctatgctcgatgcagatcgcgtactaaggtgacaatgtgtgcaggggaatacactatcgtggcagcatttcg

SEQ ID NO: 37734 - DNA, 461 bp, Zea mays
  Clone ID: LIB3060-015-Q1-K1-E8
ccgctccggaattcccgggcttttgctaactctgatgataacaatgaaacatttgtgagaaagaaagctcgtattgggaactacagttccagtactccaaagtgtactccagaaataaacaagagatgttttgctgctcttgttcgccataacattgatttaatctacttgaagaaatctttggttgtggatctactaagggagccggatacatttggcagcaaagttattggctgttttgtgagaataaagattgatctcaacgattatagtttctacatgcataaaaaggtgcaccaacatagaaagttgtatcagcttggactagtaacaggcaccagtaaatcccctgaagaatacaagataaatgatgtatcaacagatattcttttatgtatttccagcatacctgacatcaaaatttcaagtttgtcagatgaagaatacgaagaggaagaatg

SEQ ID NO: 37735 - DNA, 460 bp, Zea mays
  Clone ID: LIB3060-015-Q1-K1-E9
gtccggattcccggtcgaccacgcgtccgcaaactgtaagagcagagagattttagaaagagagagagagagagaaggatctaggtcacaatatagacgaaaaccaatcggagacgaatggtcgtcgcactcgcacgagggctgattcctttccagctcgcaccgcggttgaacagcgtttcgttgtttcctccccaacttccaacacgcctcgatctagatccactcttcccccttctccttccggtcctccccccgagactattcatataggcgggtaggcgtccgaggcctcgtttgttctcggcttcttgtctccaagggtgctactccgtccgcgcttggtctgctctcgtccttccggaggccgcggcgcaacatggcgaagatcaagccgaaggccttgctcgcgcaaagcaaggtgaagaaggtccccggccaaatcagcgtggccacgatc

SEQ ID NO: 37736 - DNA, 263 bp, Zea mays
  Clone ID: LIB3060-015-Q1-K1-F3
gcaatcgaactatgggttctattggtcaaaataagttactagcacaatctttttggacagagaacatgtaaagtaaaaaggaatattgggttggggcaatataaaactcaatattatgtaaagaaatttaaagatgtctgtgttacatgtttatcatattcactcaaagtgggcaaattgatgtgaacttgtgaagcatgcagagtgaatatggggccgtcaagtgtagctgcattcttcactagacaatttacattttcccc

SEQ ID NO: 37737 - DNA, 337 bp, Zea mays
  Clone ID: LIB3060-015-Q1-K1-F6
ctgtcgaagtcacttgattatggcacacgtgacatatttcaataattggttgtttactattgagcatagctcagtacaataacaccacatatttcagaagccacacacattatttagataggtttccactcatactacacaagggacttgatctgagaacctggcgatatgcaacatatcatatgtgtctatatatagatcggataccatcatatgatgagtggaaggctatatatgtatgcatgaactttagggaatgcaaccaggagctaagtatgagggttgcttgagagggttgctcgaccaaccaggagctaagtatgagggttgcttgagc

SEQ ID NO: 37738 - DNA, 68 bp, Zea mays
  Clone ID: LIB3060-015-Q1-K1-G2
ctgctcgtactcggtccggaattcgccgggatcgactccaacgcgtaccgcgtgtccctctctcgcat

SEQ ID NO: 37739 - DNA, 387 bp, Zea mays
  unsure at all n locations
  Clone ID: LIB3060-015-Q1-K1-G9
aacctgaagtccagaacctctgttggagtgcaatgaagccgcgcacccaaaaagtctgtgacgaccagcaacgagatctcaaaatgcgcactgttactgatcagacacaactggagcacgacaacaagaatgcttggagcttctgcctgatgggctatagtctacgttcaagtggaagcagcatcctgcgtgtcccctggttttcctggagctgcctcgcggatgatcctgagggactcggcgaagtcgtccaggagctgacggccatccggaaactgcgcttcgtctaccgacaggactagcttcacggagtttatgtagctctggtagtgcacagtcagggcatgtgggtggccgtaggtgctgngcgcgatgtagacgatgggg

SEQ ID NO: 37740 - DNA, 438 bp, Zea mays
  Clone ID: LIB3060-015-Q1-K1-H4
accgcttcggaattcccgggctccgttagccgaacactgatattgagcgcaagttactgatgggtggatttgctgaagtgcaatcttctgctgggaactcgcaggatagcgtgcaatctgttacagttaaggcaaagaaggctagctggagcatgggctcttcttttccccttaagaaaacaacgaaagcccttaccaagattcaaattgacgacgactctgatctgattgatgaagacagtctcttgactgaggaggacctgaagaaaccacaacttccagttgttggggactgtgaagtgggggcagcaaagaaagcatgcaagaactgtacttgtggcagggctgaagcccgagagaaggttgggaagctggagctcactgcggagcagatcaataaccctcaatcagcttgtggcagttgtgggttgggtgatg

SEQ ID NO: 37741 - DNA, 414 bp, Zea mays
  unsure at all n locations
  Clone ID: LIB3060-015-Q1-K1-H6
accgctccggaattcccgggctccgttagccgaacactgatattgagcgcaagttactgatgggtggatttgctgaagtgcaatcttctgctgcaaactcgcaggatagcgtgcaatctgttacagttaaggcaaagaaggctagctggagcatgggctcttcttttccccttaagaaaacaacgaaagcccttcccaagattcaaattgacgacgactctgatctgattgatgaagacagtctcttgactgaggaggacctgaagaaaccacaacttccagttgttggggactgtgaggtgggggcagcaaagaaagcatgcaagaactgtacttgtggcaaggctgangccgaggagaaagttgggaagctggagctcactgcggagcagatcaataaccctcagtcagctt

SEQ ID NO: 37742 - DNA, 53 bp, Zea mays
  Clone ID: LIB3060-015-Q1-K1-H8
caaaatgggggagtttttttgcatgcgtctgatccgatgcagccgtaccccga

SEQ ID NO: 37743 - DNA, 465 bp, Zea mays
  Clone ID: LIB3060-016-Q1-K1-A6
accgcttcggaattcccgggcggacgggagcctcctggacctcctgcgccaggtgttcacgttcgggctctccctggtgaagctggacatccggcaggagtcggagcggcacaccgacgtgatcgacgccatcaccacgcacctcggcatcgggtcgtaccgcgagtggcccgaggacaagaggcaggagtggctgctgtcggagctgcgaggcaagcgcccgctgctgcccccggaccttccccagaccgacgagatcgccgacgtcatcggcgcgttccacgtcctcgcggagctcccgcccgacagcttcggcccctacatcatctccatggcgacggccccctcggacgtgctcgccgtggagctcctgcagcgcgagtgcggcgtgcgccagccgctgcccgtggtgccgctgttcgagaggctggccgacctgcagtcggcgcccgcgtccgtggagcg

SEQ ID NO: 37744 - DNA, 430 bp, Zea mays
  Clone ID: LIB3060-016-Q1-K1-B1
aactgcttagctcactcgtacatcgccacatcggtgaagtggtgtcgcggggaccatgacgcctggcctactcgccggcgccgccgtcgtcgtgctggtcgcggtggcggcgtcgctcgcggcccacgtcacgctcaactgccccgtgcagccggcgccgtcgcatctgccgccgtccactccgacgcccaacaacctactccagaggctggagaagcttgtagaaggggcgctggacgcgccggaggacgtgtacgtggacgcggcggctggcggcgcgctgtacacggcaaccagggacggatggctgcagcggatgatgaacaacggctcctgggagcggtggcgcttcgtcggcggcacgggcctgctcagggtcgcgccgtccgacgactgcaccatgctcgtctgcgacgccgacaaggggctt

SEQ ID NO: 37745 - DNA, 460 bp, Zea mays
  Clone ID: LIB3060-016-Q1-K1-B8
ccgctccggaattcccgggcttcattgctaagccttatccttcagctagcacatagccaccgtttggttgatcatcgcactgatcaggcagccatggctaccaaagccaaatcaagctcctcgtcatgtctctccttcctgaaggacgccctgctccttccaaccaagaacgccaagctcttcgtccctgtcttcctcctggtaaccgctcccctcattcttctccagatcaccaatgtcttctgcatccagccgcgcacagccgacatgctgcaccacatcaacgagatcaagaacatggacccctcaagcgccgattacgccaagctcatggtggagatcatgaaggaagccaaggagcttgccatgatctccatcgcgctcctagtcatcacctttgcaggaagctttgctaaacagatcatagccttcttcgccacctccactacctacgccggtg

SEQ ID NO: 37746 - DNA, 439 bp, Zea mays
  Clone ID: LIB3060-016-Q1-K1-C3
cggtccggaattgccggatgcacccacgcgtccgagcagattcatccaagtctatacacatcgatctacaacaagttgcacaatggacagaacactgatcacttctaacctctccatgagtgcacatgcttcaagatcgtcccggagggttcactacatctctcctgcagcctctgctgctgcacacaactccagctacaggaagaagaagaagaactccccgtctacgccgacgtcggccgacgcaactgacaccgttgtcatctcccatcctgccactgacaatgttcagtgcactgctccgaatcaggccggccgacatgagcttgaagagctcgtggccgccaagactaacacgttcagaattgctactgcaagaacaagtgcctcgagccagtctcgggctaagcttgaacgccggcctgccccgggaatcacg

SEQ ID NO: 37747 - DNA, 448 bp, Zea mays
  Clone ID: LIB3060-016-Q1-K1-C4
ccggtccggaattgacggatccatccacgcgttacggaacgctatcccatcttgttacacaaaaatatccgcgcgaccccgaccttcgcctcggactccgggcagcaagcagcagccagcaggcatggggatacctgtggtggttcccgtcgaggcggactactcgtgctactactccctcgacgcgccaccgagggccgccgccgacgcggcgagggcgccgagccgcgcgcacgtcgcggcggccgggatgtcctccacggcgtcctacttcgccgggatgcagctgaagcgacctcgcggaggtggccgcctaagcagccgatcggcccaagagagcggcctccgagtgaggcggcgcgctcttgtgcaagagcctcttacggctcggcgtgccggagctcagagtcatcgccggcgtcgcacgactcgtgttcaggcccaagca

SEQ ID NO: 37748 - DNA, 437 bp, Zea mays
  Clone ID: LIB3060-016-Q1-K1-C9
cacggcggcgacgagaagtggcgagccccgagagcgggtttagttagaggctacgggcggtcgggcgcggcggcggcggcggccatgagcagcgggagcgagagcactaccgccagcaggtggcccgagctggccacgctgcgcgccctggcgcgcgacgccgcggagcagctgcggctgccgcgggccggcacgtcggcgtcggcgtcggcgtcgtcgtcgccgtggcgcgggcgcgaggaccacctccacggccacggcaagacggccaaggtgatgcacctgctgctctggggacccaagtgaagcggcgagaggccaccgtaccgccggcgttgctcgttttgctctgcctgcaatccgccccgcacggactgtactgtactgtacctatacacctatatactacgacgtgcacatgtacgagtctacgacgt

SEQ ID NO: 37749 - DNA, 440 bp, Zea mays
  Clone ID: LIB3060-016-Q1-K1-D12
taccggtccggaattcccgggcgcgctttccactcccaacgagatccatcacccccgacctctgtaagcttcccttgacgtcgtcgtcgtcatccatggagagcaaggacggcacccacgatcccgccacgacggccgcgccaccggccggcgcgccgcagcccgcgatgccttccgcggagacggcgcggtggggcacgcggcagatgggcccgacggcggcccccggggcgcacccggagaaccaggaggcggcgcggtggacggccgcgcgcggggaccaggagctgccgccgtacgtcatcatcggtgagcccgtggcggcgccgccgccacagcataggggcaagggggacagccccatggagcacatcctcgacttcttcaacacctggagccgcaaggccgaggagctggcctacagcatctggttcaatctg

SEQ ID NO: 37750 - DNA, 460 bp, Zea mays
  Clone ID: LIB3060-016-Q1-K1-D3
taccggtccggaattgccggatcgacccacgcgtacgcgcccagctgctccacatctcaattctcaccacacacacgcacacacactatcgtccagcaagctcgctgttgcttgccacccaccgtctcagctcgatcgcaacgcgctcggcatggcgtccgaggtgtggctatcgccggcgtctcgcctaccatccctgtccaacgcaccacctcgcttacgctccaagcctgccaccacaaccgcctctgtgctctctccctgtccccgacctgcccgcgccctgcctgtgctgcgtgtccgtcgccgccgacgacttcgcgccaccgagcagcaaggccaggttcaggagcaagatgacgaggtggtggacaggaacatgctgccctactgcagcatcgacaggaagcagaagaagacgctgggagagatggagcaggagttcctgcaagcccttcag

SEQ ID NO: 37751 - DNA, 451 bp, Zea mays
  Clone ID: LIB3060-016-Q1-K1-E1
taccggtccggaattgccggatcgacccacgcgtgcgatagtgttgcttggatggaagacagtgatttccacaatctgcgaactgaatgtctcaagcagcaatacaacttggtcaaggataggacagcggttcaggatacattcagctatggctcccatgtgatgcaatatggttcattggagttgaatgttaagcatctgctttcgtacattggcacaaaccctgctaacgatgacaacacgttcatagaagacaactcggtgccatcattctcaaaggctgttaatcagcgcgacgctgaccttgtctacttctggcagaagtaccggaaattggcagacagctcacctgagaaaaatgaagctcggagggagttgcttgaagtgatggcccacaggtctcatgttgacagcagcgttgagctcattggaagccttctctttggctctg

SEQ ID NO: 37752 - DNA, 474 bp, Zea mays
  unsure at all n locations
  Clone ID: LIB3060-016-Q1-K1-E10
taccggtccggaattcccggggctatgtgctgtggtctctggtcgagggacatcaatactctatgtcccttgctcacctccctggtcgtgctcgccgggacactattctctagccaactaccgtcggtggaagccctgccatcgatatcgcatgatattggttgtcttcttcgaccacgtcattgcctcacaggatttggacaccttgtcgacactcgaccacgtgttcgctcgttaccacgccatcttcagcatcatggttctataagactccgcgcactcatcggcacccggctgtcaatctccaccacgcagcgctgcatcggacttaccctgtatgatgttcgacgacaagcccaaaccagaatttatcaatattctcacaagtattgagtcacgtttgaatgctggtaagcaatttatttgcttagtaattntagggctttgccggtaggcgctatcggcattntatgc

SEQ ID NO: 37753 - DNA, 395 bp, Zea mays
  unsure at all n locations
  Clone ID: LIB3060-016-Q1-K1-E11
accggtccggaattcccggggctatgcgctcgggcgtccgactcaaggacatcaatactatatgtctcttgctgagctcagtggatgcgtgggcgtgcacactatactgtagacaactacctgctgcatgaatctctgtcattgttgtccgatgataccggtggtcgtgtacaaccacatggttacctaacacgattagaacagcatggggcaccagaaccgcgggggccacgcggagtaggcgttcgcgcggacggcgaacgatggcgcgctggccgctcatgnggacacgatgagcatccgggcagcgcgcttcaatatcagcgacagactgtactcgcgcgaccacgagaccgtgctgccgctggcgcacggtagacccctcggtgttcccg

SEQ ID NO: 37754 - DNA, 410 bp, Zea mays
  Clone ID: LIB3060-016-Q1-K1-E7
tgcaaactctggtttcatcagtaactccaatgggaggcaaatgggttcatacttcaatggaagttcgaatagattgagtagttctattgggtatcttggttatgactcaggatcgatgttgagttccatgtctaggaattttaatgcaggtgtaaactacccgatcaatcctacaaacatgagtgcttttgctgcccttggaaatgggggtggcgtcaattatatgggtctcccttctattgcccctgagttggcccagttgggcaacatttcaagccttgggtcagggaactttagccgtggagctggagttaataacttaagtttaccttctggctcctatgggaggagcaattcaactggtacaattggtgagcctttttctgcatcaggcaatgcatatgaagtga

SEQ ID NO: 37755 - DNA, 430 bp, Zea mays
  Clone ID: LIB3060-016-Q1-K1-F1
accggttcggaattgccggatcgacccacgcgtgcggtctgcgtgcagggcgcgagcgcggatggcacgcccaagaggctgacctacgacgagagccagagcaaaacgtacatggaggtgaagggcacgggcacagcgaaccagtgcccgaccatcgacggcggcgtggagtcgttcccgttcaaggccggcaagtaccagatgaagaagctgtgcctggagccgacgtgcttcaccgtcaaggcggagggcatcggcaagaacgccccgctcgagttccagaagaccaagctcatgacccgcctcacgtacacgctggacgagatcgagggcccgctcgaggtcggctccgacggcacgctcaagttcgaggaaaaggacggcatcgactacgccgccgttaccgtgcaacttccgggaggcgagcgcg

SEQ ID NO: 37756 - DNA, 437 bp, Zea mays
  Clone ID: LIB3060-016-Q1-K1-F10
tattaatgcgagcacgcaaagccagcaactggaccgcgtcgggcatcggttcctgctctgtgctatactgctaatctgctatcccctcccccaagccgtcaccaccagcagcagcggaacccaccgccctcgttcctcccccgccggcgagagatctacgagatggtgctgtcacacggcgtcggtggctccgatgagtccgtccactcgacgttcgcgtcccgctacgtccgcacctcccttcctaggtaccggatgccggagcagtcgatccccaaggaggcggcgtaccagatcatcaacgacgagctgatgctggacgggaacccgcggctgaacctggcgtccttcgtcaccacgtggatggagcccgagtgcgacaagctcatccaggcctccgtcaacaagaactacgtcgacatggacgagtaccccgt

SEQ ID NO: 37757 - DNA, 312 bp, Zea mays
  Clone ID: LIB3060-016-Q1-K1-F4
accggtccggaattcccgggtgattctacttgtgaagatgttcgagaagagcaagatggtgacgatagccacggggctggacctcctcagctgctcgatctgcatcttcttgtcgtcagcttctctctacatcctgcacaatcttcacaagggcgaccatgaggagtgacgagagtgaaatgccgaatttgtagcctattcgagagagagttgacggtcttgtccaataatcaatactggatttttaagactctcttcaacggtgttctcttcataaaatatataatgagaaatgtatgatacaatttatct

SEQ ID NO: 37758 - DNA, 445 bp, Zea mays
  Clone ID: LIB3060-016-Q1-K1-G3
acggatgcacccacgcgtacggtcggcgtcagcaggcggaggcgcggtgcgcgcgctgtcccagaaggagcaggacatggagatgatgctcgcggccgacgtgcacctcggcaccaagaactgcgatttccagatggagcggtatgtctttaagcgtcgcaccgacggcatctacatcatcaacctgggcaagacatgggataagctccagctcgcggcgagggttattgttgccattgagaacccgcaagacatcatcgtccagtcggcccgcccctacggccagcgtgctgtcctcaagttcgcgcagtacactggcgcccatgccatcgctgggaggcacacccctggtaccttcaccaatcagctccagacctctttcagcgagcctcgcctgctcatccttactgacccaaggactgaccatcagccaatcaaggagtct

SEQ ID NO: 37759 - DNA, 358 bp, Zea mays
  Clone ID: LIB3060-016-Q1-K1-H5
cccacgcgtccggtctaatactgtatcctgcatcagtatgtaataccatgtgaatcgcactgttagttaatgcttggtgctgtcagtcttgttgggagtctgactcgtaaagctcattatcatcggaagtgtttgtcggaggagtgctggcactaactatttatcttcagttggttgtcgtgttgccaacttgcgatgtcaaggtgcatatttcagtttttttagagtaaaaatgcactttacatcctgccgccaaacttaactatgggcctgtttatgcccctgtttggtttagcttttttttaccagcttttctaaaaatctggttgcggaaagaatttgagtattgtgaagatta

SEQ ID NO: 37760 - DNA, 432 bp, Zea mays
  Clone ID: LIB3060-016-Q1-K1-H8
gtccggaattgacggatgcatccacgcgttcgatgccttgacgttcgttttcaactcgattactatactaccgtcttggacaggaggagcgtcaagacgaatccactaaacggtgcagcatacgatgttggtagtggatgggccgaagggattggttaaaagggtcccgaacttgaccaacggactgctgcacaacaagctgtagaagggattgcaagacacgcacaaccggatggtcaaagaacaggcccttcattgctaaacgtagctttcatggaaggtttaacaagttaaggactggttgcggcactaacgcttgtatttgcaaacccttttgtttaatcctaaaaacgaaaatgagtccgttagattagatactaccaagtttgtttagcacattggcattggcttaagcaattctaagtatatcaa

SEQ ID NO: 37761 - DNA, 441 bp, Zea mays
  unsure at all n locations
  Clone ID: LIB3060-016-Q1-K1-H9
tctctgttaggcatctaactgaataaatgatctcctaaagaattgacagattccaggactgagcagcccttcgccccggtggctgcggtgtcgcactggctgacacctgctcgcagttgcattacaagttttactgactatgtattttcaggtttattcaatttcggttctaatgcttctgacagcagttgtatcagtcctcttgttcagcttacatgtatccctcgcatccttccttggatccacataagtgttaataataattttgttgcatctcctctgctgatcagagctttcaaactcatgacagaataatgtactaaacttcagtttggtgtctatctcagtgtacctacactcagttggaaaacttcaaccacactgcnaacaggtttataaaaggaaaaacanatttatgggctcaaacaaagtgtgatagtg

SEQ ID NO: 37762 - DNA, 450 bp, Zea mays
  Clone ID: LIB3060-017-Q1-K1-A11
accggttcggaattcccgggaaaaaactatttagtatagcaccgatatttggagtatatttatttatttgctaattaattggtaacagagctgcacatttgattactgatgtgctgaatggactattcctccataattcgttttttttgtggcgctgcagagacttcatttcattttagaattccattatcttgcttgcttgtatgagtgccatcatttgtacccaaatctctcattattgacctctactatattatcgtcaggattcaaccaccactacagcaacactgtttccatatatatctagcttatcaaggtcgttctgcatggacctgcttcagttctttggtgtaaagtggtttggctgaaatattttggttaactgcagtctagtatttagtgccagttgcattgattgcaaatttcaagatggcgaattgatgatgtttg

SEQ ID NO: 37763 - DNA, 457 bp, Zea mays
  Clone ID: LIB3060-017-Q1-K1-A3
ggaattcccgggtagacctacgcgtaggaacctccgtccaagagggggaaattggaaattatggaaaaggctgccaaataggttggaaaaaccagggcaggggaaattccggttgaggcaccaaatgagaaaccggaatttaagccagatgctggcccacaagttggtgagaccaaagaatgtgaaattacagtagaggcaccagatgagaaaatagcatacaaaggtattgttgaaccaataatcagggagataactgaagatcaaactgcagctggagaaccagatgaagaagctacaacaactgaggaaacggtagaggatgttaaagtgctagatgataagtctacagcagatgggaaacctgtagagaatgccacagtcgcgacaaatgaggattcaacaacagttgagaatactctgaagggatgcatggttgcgccaccaggtacaaata

SEQ ID NO: 37764 - DNA, 472 bp, Zea mays
  Clone ID: LIB3060-017-Q1-K1-A8
taccggtccggaattcccgggctctcaccttttcgctgtactcactcgccacacacaccccctctccagctccgttggagctccggacagcagcaggcgcggggcggtcacgtagtaagcagctctcggctccctctccccttgctccatatgatcgtgcaacccatcgagctacgcgcgtggactgccttccctgggtcggcgcaggaggggatcggaaggatgacggcatcggtttccagggccatctgcgtacagaagccgggctcaaaatgcaccagggacagggaagcgacctccttcgcccgccgatcggtcgcagcgccgaggcccccgcacgccaaagccgccggcgtcatccgctccgactccggcgcgggacggggccagcattgctcgccgctgagggccgtcgttgacgccgcgccgatacagacgaccaataagagggtgttccacttcgggcagggca

SEQ ID NO: 37765 - DNA, 336 bp, Zea mays
  Clone ID: LIB3060-017-Q1-K1-B1
tcccgggtcgacccacgcgttccgtgcgactccctcaatggtcgagagtccttggcgccaaccttggccaatcccaggccccgctcctgctttccgttcgctccggcgccgccgtgtccatgcccggcatgatggacactgtgctcaacctgcggctcaacgacgaagtggccgccgggctggcggtcaagagcggcgagcgcttcgcctacgactgcttccgccgcttcctcgacatgttcggcaacctcgtcatggacatcccccgctcactgttcgaagagaagcttgagcacatgaaggaatccaaggggctgaagaacgacaccgacctta

SEQ ID NO: 37766 - DNA, 458 bp, Zea mays
  Clone ID: LIB3060-017-Q1-K1-B11
accggtccggaattcccgggtcaagcgatgcatacatggctattaaggcagcggtaagacgggcgttaccacgcaaggcttcctatcgccttggcgaagaagcaaggcgacggaacatggcgctgcctgagctctcacatggagccgtgccaacgcgcatgcatctgtcacgaccttctgcagaatcacacgaatagttatacgaccaccgagacctgtgcagagtaaaatagctggtggacgtactagccctggcaagttcccgagcccttcaccgtagtatgacacttgcttgggagacctgcatagtgttgcttggatggaagacagtgatttccacaatctgcgaactgaatctctcaagcagcaatacaacttggtcaaggataggacagcggttcaggatacattcagctatggctcccatgtgatgcaatatggctcattggagctgaatg

SEQ ID NO: 37767 - DNA, 458 bp, Zea mays
  Clone ID: LIB3060-017-Q1-K1-B3
ccggaattcccgggtcgacccaagcgttcggttggccaacatcgacttccggagcttggacctggttgtcaaaagggaaagaaacaactttgtttaaccgggttaccgaccaattaaaaccaaattggtattcctggtgataccggggaacctaaactgctgccgttgcaaagccaaaataaccaaggcctggactggcttaaaagaggagttctgcatcgagaaagtgaagttcgatgccaagaaagagaagaaaggtgtgtgggtgcgtggaagttcgacgccgagaagctctgcaagaagtgtggtccaaggccgggaaaatcgtgaaggggattgtcatcgctgaggtgtggccaataccagccccgcccaaggagtgcaagcctgaggcaccgaaatgttgcgactgtgagaagtgcaagccgaagcctaagccggagccaccgaaatgttgc

SEQ ID NO: 37768 - DNA, 474 bp, Zea mays
  Clone ID: LIB3060-017-Q1-K1-B4
cggaattcccgggtcgacccacgcgttcgcttgcacaccatcgactcccgtagctggtactcgctcgtcaaaaggaaatgaaacactgcgcttcaactggttgacagacgactcatagcataatgggtatactggtgattacggtggacctagactgctgtcgatgtaaagccaagatcaccaaggtcctggactgtctcaaagaggagttctgcatcgagaaagtggagttcgatgacaagaaggagaagaaggtggtggtggtgcgtgggaagttcgacgccgagaagctctgcaagaaggtgtggtccaaggccgggaaaatcgtgaaggggattgtcatcgctgaggtgtggccaataccagccccgcccaaggagtgcaagcctgaggcaccgaaatgttgcgactgtgagaagtgcaagccgtagcctaagccggagccaccgaaatgttgcgactgtgagaagtgca

SEQ ID NO: 37769 - DNA, 76 bp, Zea mays
  Clone ID: LIB3060-017-Q1-K1-B5
tttttaaaggtcccaagcttacttacccttccttgcgacgtcttagctcttctatagggccccctaaattaaatta

SEQ ID NO: 37770 - DNA, 537 bp, Zea mays
  Clone ID: LIB3060-017-Q1-K1-B7
cggttccggaattctccgggttcgactccacgtcgtctcggtcgcatcgacaccgatcgtcgagcgtcaagcacgtcacgttgtcgtgaagcctcaagttgagaaggaagcacacagtgctctgactcgatggtcgtgcccatgcctctcctcgtccggcctgtgcagctgcgtgtggccgtccccgctgcagtacggctcgtctcgtagcgtcggtcggccgagggaagggcgccacttgcgtacgtcagtggcacatgctccagctccttccagcacaatgcaagggtgcccgacatggcacgctgtcggttctgcgtgccatagcagtcgccttcacctacactcgatgtgcacgctgcctcggacgactcatggcattcgacccgtctgggctctctcggactccggagggcatccgggggccttgatcgagtcccaagtgcgctggtctatggcgaggtgatcaacggccgctacgccatgctgggcgcggtgggcgccatcgccccggagatcttcggcaagatgggcatc

SEQ ID NO: 37771 - DNA, 463 bp, Zea mays
  Clone ID: LIB3060-017-Q1-K1-D3
tccggattcccggtcgacccacgccttcgtgttcttggccgaatttcacaacccatttcaacccgcccattggttgccccaacccttggcgggggacctttggttcaactgcccccggttcccccgcccggttccggttggtcaaccctacccctaggaagttaggttttgatgctataaaacctccagcgaccggacaggaaaagagaatagagctcaaatcttggatgcgcccgaaccgattgcgacacctgccgcagagaagcctggagatgtacagatccgtgatgctcaggcggacatcctcgagacagagttcgccgtgatccgcgacatcgtcgacgactatccgtatgtggctatggacactgagtttccgggcgttgtgagtcgtccgctcggcacttacaagtcggcggtcgagttcaactacgccactcttaaagctaacgtggacatgctg

SEQ ID NO: 37772 - DNA, 445 bp, Zea mays
  Clone ID: LIB3060-017-Q1-K1-D4
cccgggtcgaccgacgcgtacgtgtgcttgcccgatctccacaccccattccacctcacccattgatgaccccaacaatggacgggtgcctgttcgtacactggcacccgctacccctacccgctaacgctcgtccacgcaaaccctaatcagctcggctatgatactataacagctgcagcaaccgacgaggagaggagaataaagctcaaatcttgtatgcacacgaaccgatggcgacacctgccgtagagaagcctgaagacgtacagatccgtgatgctcggacagacaacctagagacagagatcgccgtgatccgcgacatcgtctacgactatccgtatgtggctatgcacactgagtttccgatcgttgtgagtcgtccgctcggcactcacaagtcagtgatcgactttaactacgccactcttaaagctaacgt

SEQ ID NO: 37773 - DNA, 252 bp, Zea mays
  Clone ID: LIB3060-017-Q1-K1-E1
cccggctcgacccacgcgttcggcgtcctgcccctgcccctgccccggctacttccgtggaccaatttctacaacttgggttccgtaacaagctagcaactgaacgaggtcaactcttacgcccgccgacagagacggaggcagctgctaagacaccggagggtatccgcgcacctgccatcatccaccacccgatacccacgtcttgtaccgcgcagatctgctgctgcccttgagatctaaatcaaagct

SEQ ID NO: 37774 - DNA, 435 bp, Zea mays
  unsure at all n locations
  Clone ID: LIB3060-017-Q1-K1-E3
cgacccacgcgttcgtggggggccaagttccgggattttcttggcccggacacattggttcgggctcttcttatgtgggatacccggagggcggtcttttccttcccgggcgagttttttttaaataccttagcttccgaacctggcaattgtcactgatgccattgcatgtgtacctggtttaagtgaaggtttccgttcaaaagaaacctgacaggcaaagaaggaggaggataagaagggtgaagacaaaatgcttgnatggggtggcatgacgataagaagctgatgattcctgctacagtaattttaaagcacatgttcactcctgctgagctgagagctgatgaagagcttcttcctgagcttgaggctgatgttagagaggaatgcatcaagtttggtccggtggataatgtcaaggtttgtgaaaat

SEQ ID NO: 37775 - DNA, 467 bp, Zea mays
  Clone ID: LIB3060-017-Q1-K1-E9
aaagcttctaccggtccggaattcccgggggacaggatcgagtctttctccgacgtctacttccagcgcctagcttctccaccgcgttggctgctcctccatcgccagtctgctcgccgggatgcccctgccctactcctcggtctccctattctgccacggccgctgctcatcgcgcccagctgaagctcgccggacttccctgtttctctctctccgctgctcgctcggtgtccggtcgtggtactgcctgcgcaccacgagtttctccctgacgcccagcgacagccgcagctcggatatcccaggccgcgtgctcgccagtctcgagcgcccctcccttgctcctctagctcgtggagcttctcctcgacagcgcccctgtttctttttggccggagcgccctctgctcggcgtccctcgctgctcgccggggaaactctttccctgctcgccggcagcaaca

SEQ ID NO: 37776 - DNA, 463 bp, Zea mays
  unsure at all n locations
  Clone ID: LIB3060-017-Q1-K1-F1
tccggaattcccgggtcgacccacgcgttcgcgcacgcatacacagcacagagtgaggtaagcattcgaaaaaagctgtgatctgatcgacatggccgtcgtcaccatggctctcaccttccgcgcgctcgtcggcaagccggcgaccagcaccagggacgtcttcggcgaggggcgcatcaccatgcgcaagactgctggcaagcccaagccagcggcgtccggcagcccctggtacggggccgaccgcgtcctgtacctgggcccgctgtccggccagcccccaagctacctgaccggcgagttccccggcgactacggctgggacaccgcggggctgtccgncgacccggagactttcgccaagaaccgcgagctggaggtgatccactgccgctgggccatgctgggcgcgctcgggtgcgtgttcccggagctgctcgcccgcaacggcgtcaagttc

SEQ ID NO: 37777 - DNA, 415 bp, Zea mays
  Clone ID: LIB3060-017-Q1-K1-F10
aattccagcctcgacccacgcgttcgcggacgcgtggttagggggggtagcgcttgtgcctgaagtaagcctaatcctgaccgggggcgtcatgacggcgcccaagctcaagctcctagctcttactactatgctggtcctcatcctactcctactcctctccgccgcccggcggcgcgtccttatggagacgctcctccttcgcgccccggtcctcccggacgacctcctcccgctcctgccctggcccgttgcgcatgcgctgctccgccgtctcgcgcttgggggccctatcgacctgctcccggatttcgctcaagccgtgcgcgcgaccaagtccgacgactcctacccgttcgccgagtgtaagggcgcctgcttctacgagaacatggcgtgggtggagttacgcaac

SEQ ID NO: 37778 - DNA, 333 bp, Zea mays
  Clone ID: LIB3060-017-Q1-K1-F4
cggattcccggtcgacctacgcgtccgcgagtgtcaagtgaacctgaaacttgcggagtcactggctggtatagcctgagtgtgagtgagtgatcgagctagctgagctccgatcctcgctagctagctaggataccgccataccacaagtcttcttcacaagtttaggagtgacagcaacaagagatctcgatggcctatgccaccgtgctcaagtcctccttccttcccaagaagtccgaatggggcgccaccaggcaggccgtcgcgcccaggccgtccaccgtctccatggtcgtccgcgcctccgcctacgccgatgagctcgtgaag

SEQ ID NO: 37779 - DNA, 420 bp, Zea mays
  Clone ID: LIB3060-017-Q1-K1-G1
ccggattcccgggtcgacccacgcgttcgccacgcgttcgcaggatacgcgtgccgcagcacgccacaagctagatcttctgcttgaccaacggcgccgagtgggacgggccgtacaccctcaaggtcagggtcccgaagccatggcagaagaagccgctgagcttcttcaacgagggcctggcggacgagctgaacagggagggcgcgtgcgacctgggcatatacccggacgagaacatcgtcatgaccagctgcgccatggacggttacctcgacgaggggggggatcggcgcaagctggatatcgcgagcgggtgcacggaccccagctgctacatgttcgacccgctgggcaccgtcgacgacggctgctgaccactcgagtctgattccgaggaatgaagcttcagttcgatcc

SEQ ID NO: 37780 - DNA, 471 bp, Zea mays
  Clone ID: LIB3060-017-Q1-K1-G2
cggtccggaattcccgggttcggatcaccttgcagcagcacgtggttcaagaaagtgaaacaggaagcaatgaacatgtccagatgctggagagagctcaagtatttgatggacacaatagctgggaattccaaaaactgcatctcgtcacagcctcgcagattggatgcgtgattcacacggctggtttggcattgtttgaacacatgagaaggaagggttgttccatacggttggaagacgagatgttgcgttgtgtactatgtatttagacgaagactgttcttttttacgctgaaaaataaattgcatcttccgtctttctttgtgttgtgctccttttctctatcctttttcttttctagaaaaaaaaagagtgagacactatacgtgtttgttacctgcaagttttatgtttcttttctgtacaagtatatggaggatttttttgggggcaattgtaaagctttg

SEQ ID NO: 37781 - DNA, 451 bp, Zea mays
  Clone ID: LIB3060-017-Q1-K1-H10
taccggtccggaattcccgggccatgatacagcagatgcagcagccttgcaatgagtgcaaggggactggagagagcatcaatgagaaggaccgctgtccagggtgcaagggtgagaaggtcattcaagagaagaaggttcttgaggttcatgttgagaaggggatgcaacacaaccagaagatcaccttccctggtgaagctgatgaagcgcctgatactgtcactggagacattgtattcgtcctccagcagaaggatcactccaaattcaaaagaaagggtgaagatctcttctatgagcacaccttgtctctgaccgaagcactatgtgggttccaatttgttcttacacatctggacaacaggcagcttctcatcaaatcagaccctggtgaagttgttaaacctgaccaattcaaggcgattaatgatgaggggatgccaattta

SEQ ID NO: 37782 - DNA, 409 bp, Zea mays
  Clone ID: LIB3060-017-Q1-K1-H12
cgggtcgagccacgcgtacggcccgacacgtaccatatgaataagctgtgcctggagccgacgtacttcacggtccaggctgcaggcatcgtcgataacgccgcgaccgagttccagaagaccaatctcatgacccgtctcacgtacacgctggacgagatcgaggtcccgttcgatgtcggatccgacggcacgctcaagtccgaggataaagacagcatctactacgccgacgtcaccgtgcagttcccagtgggcgaacgcgtgccgttcctcttcaacgatcagcagctgcgtgtcaccggcaagctctagagcttccgatgtgcctttctcgtgcccagctaccgtggctccttcttcctatgacacaatggccgaggcggctacaccggctacgacaacgcca

SEQ ID NO: 37783 - DNA, 411 bp, Zea mays
  Clone ID: LIB3060-017-Q1-K1-H7
cggttctcggaattcccgggtcgacccatcgtgcgtccacgcgttcggtttcttgtgttcgcagatgaggagatggtgcggtcaaagagggctgctacatcgcttcatcaaatataaaatgtcaagatcgcacgcggccggcgacaagcagatcccatagagaagggaaccctagacgaaggtagctagatacggttgaggtctgagcacgagaccgtctcatcaagctgttcgagaagaccatgcccgtgccggagacggccgtcatccgcgaggctgccaaggacatccaacagagcgccagaagcctcttcggcaccactgactcaaaatgacaggagaacaacgttcaagactccacaagctcgcctacgtaacacgaggtccattacaccgaatactcgtcggaag

SEQ ID NO: 37784 - DNA, 445 bp, Zea mays
  Clone ID: LIB3060-018-Q1-K1-A11
gtaccggttcggaattcccggggtaccacaccactcctcgctagctgtggaactgtacaggagggactaatgtcaccacaaacagaaactaaagcaagtgttggatttaaagctggtgttaaggattataaattgacttactacaccccggagtacgaaaccaaggatactgatatcttggcagcattccgagtaactcctcagctcggggttccgcctgaagaagcaggagctgcagtagctgcggaatcttctactggtacatggacaactgtttggactgatggacttaccagtcttgatcgttacaaaggacgatgctatcacatcgagcccgttcctggggacccagatcaatatatctgttatgtagcttatccattagacctatttgaagagggttctgctactaacatgtttacttccattgtgggtaacgtatttg

SEQ ID NO: 37785 - DNA, 444 bp, Zea mays
  Clone ID: LIB3060-018-Q1-K1-A3
cgtctcggaattcccggctcaacccacgcgttcgcgctccatcagctacatggagccagtttactaatgggcatctacttgtaatcagggagtgctgacactatggtatcggcaacagttatctaagatgagggagacatttgtaaggtctgatgaaaccaatcttgatttgactgatcttggaatgcacttttctttattcataacactgcttcatatggtgagaaacttgagagcatactcagatcgaatgcatgctttggcatgtatttgtcggactgctctttgtgttcatctttttgcaaaggagagtgtccgaagaggtcacaagcctgttcctggaacagatgtgatatcgctctttgaagatgtcaggctgaaggaagatctaaacagcgtaacaagcaaaaacttgttcagagaagagctagtggctgccctagt

SEQ ID NO: 37786 - DNA, 461 bp, Zea mays
  Clone ID: LIB3060-018-Q1-K1-A6
gctctaccggtccggaattcccgggccaagtcccacgcctgcgtctcgtgatgccgccgaaatcgaaggcgtccgccgccgcggagccggtggccgtcgaggacctcttcgcctcgctccaccgccacatcgaggcaggtgctttcaaacaggccgccaaggtcgccgaccaagttctcaaggcagcgccgggagatgaggacgcggtgcgatgcaaggtggtggcatacatcaaggccgacgagatcgacaaggcgctcgccgcgatccgcgccgtcgagcgccttccgatcgatctcagctactacagggcctactgctgctacaggcaaaacaaactgcatgaggctcttgagcttttaagaggccaagaagaaacttcagctgttctccagctggaatcccagatcttttaccgactaggaagaatgaatgattgcatgagtagctatgagaagctt

SEQ ID NO: 37787 - DNA, 287 bp, Zea mays
  Clone ID: LIB3060-018-Q1-K1-C10
cccgggtcgacaccactccttccgacccaaacgcgccaaggcggcaggctttccttcgtctcgtggttcttcacccactggttctgggaatttttgggcgcccattggcgagcaacttgcttaaaacttagggttccacgaatggggaccttgatggactaaaattttgcgtggagagccaagacatttggaaagacaattacatgttgcaattggataaccgctccggcgctcgacgggcggcgttggcgtttcggcaatgggatatatactcatgtgccatcgcg

SEQ ID NO: 37788 - DNA, 465 bp, Zea mays
  Clone ID: LIB3060-018-Q1-K1-D12
taccgcgtccggaattcccggggcagggacggccatggcatgcagtgggtgcagctgcgaggcggcggtgggggcgatggcgtcggaggcgtacctggagggggcgccggtgcgggaggcgcgggagctggtggcggagctctgtcggcacttctacgcgcagggatgggtcacgggcaccggcggcagcatcaccgtcaaggtcaacgaccccaccgtgccgctcgccgatcgcctcatcgttatgtcaccctccggtgtgcagaaggagaggatggtagcagaggacatgtatgtgatggctgcagatgggaaagtgctttctgcgcctgtagcaaagccatggccaaacaagcctcctaagtgcacggactgtgctcctctgttcatgaaggcgtatctgatgagaggagctggggctgtcattcacagccatggaatagagacttgcatcgcaacaatgct

SEQ ID NO: 37789 - DNA, 136 bp, Zea mays
  Clone ID: LIB3060-018-Q1-K1-D3
cccggtcgacccacgcgttcgaaggtattagctgaacactctggataggatctttatttaatgccgggtattattggaattggacccttcttaatctggaaaggtggttttcctttggaccaatccttatggtttc

SEQ ID NO: 37790 - DNA, 472 bp, Zea mays
  Clone ID: LIB3060-018-Q1-K1-D7
gctcgtaccggtccggaattcccgggccggtccagcactttcacgctcagctccagcaatggctgcctccaccatggcgatctcctccacggcgatggccggcacccccatcaaggtgggctccttcggcgagggccgcatcaccatgcgcaagaccgtgggcaagcccaaggtggcggcgtccggcagcccctggtacggccccgaccgcgtcaagtacctcggccccttctccggcgagcccccgagctacctcaccggcgagttccccggcgactacggctgggacaccgccgggctgtccgccgaccccgagaccttcgccaagaaccgcgagctggacgtgatccactcccgctgggccatgctcggcgcgctcggctgcgtcttactcgagctgctctcccgcaacggcgtcaagttcggcgaggccgtctggttcaaggccggctcccagatcttcagcgagggc

SEQ ID NO: 37791 - DNA, 457 bp, Zea mays
  unsure at all n locations
  Clone ID: LIB3060-018-Q1-K1-E10
ccggaattcccgggctcacttccctcagtcctcgtccgtctgctccctcctctctctacctagctctagctagccttcctgtagcgcggcagagatggctgcccctgcctccaccacggcggcggcggcggcagcgctgctgctgctgctcctcctgtcgctcgccgcggcggcggacatgtcgatcgtgtcctacggggagcgcagcgacgaggaggcgcggcggatgtacgcggagtggatggcggcgcacggccggacctacaacgccgtcggcgaggaggagcggcggtaccaggtgttccgggacaacctccgctacatcgacgcgcacaacgccgtcgtcgacgcgggcgtncactccttccgcctcggcctcaaccgcttcgccgacctcaccaacgacgagtaccgngccacctacctcggcgccagtaccaggccgcagagggagaga

SEQ ID NO: 37792 - DNA, 372 bp, Zea mays
  Clone ID: LIB3060-018-Q1-K1-E7
ggaattccgaggctcgacccacgcgtacgaggagcagcaccctggtacttttactattttctcctgcgaccaccataagcgccgctgggtaatacatcaatcatcacttgatcagcaccagatcatagatctcagcgtatgacgtggatatcgcgaatagcggcggctgcagacaaacgatcaccatgctactgtcgctgatcatcgttcagaacatggagccgtactaccaagatctgtggtaactgttcttcatgcagtcgagcgacagctactacacgcgcgccatcaaccggttggtggagacactgtactatatgaacttcctcaacaagacgtgcatcaacgtcctgctcgactacatcgaggtca

SEQ ID NO: 37793 - DNA, 428 bp, Zea mays
  Clone ID: LIB3060-018-Q1-K1-F12
cacagctgtgaaggtggttgatattgttgacacattccgtctacaggagcaacctccttttgacaagaaatcatttgtgtcttacatcaaaaaatacatcaagaatctcactgctgtgttggagccagagaaagcggatgagttcaaaaagggtgtcgagggtgcaaccaagtttctccttagcaagctgaaggacctccaattttttgttggtgagtccatgaaggatgatgcgtctgtggtattcgcctattacaaggatggtgccactaatccgacattcctctatttctctcatggtcttaaggagatcaagtgctaggcgtgcggcgaaattagttacccatgttgggtactatctatgtactattattatatccaaaactatagttgtcctggctgaattgaactcaaaagggtttgtttga

SEQ ID NO: 37794 - DNA, 398 bp, Zea mays
  Clone ID: LIB3060-018-Q1-K1-G5
ggaattcccggctcgacccacgcgtgcgtgatcacttcattgattcagtttttatttagctagctgaatcacaatggatcctgccgggttccgtccgtccagtagccacgacacgacggtgacgacgacgaacgctggcgctcctgtgtggaacgacaacgaggcgctgactgtggggcctcgcggtcccatcctgctggaggactaccacctgatcgagaaggtggcgcacttcgcgcgggagcgcatcccggagcgcgtggtgcacgcgcgcggggcctacgccaagggcttcttcgagtgcacccacgacgtgacgtcgctgacgtgcgccgacttcctgcgcgcgcacggcgtgcggacgcccgtgatcgtgcgcttctcgacggtgatccacg

SEQ ID NO: 37795 - DNA, 468 bp, Zea mays
  Clone ID: LIB3060-018-Q1-K1-G7
accggtccggattcccgggcgcgtgcgaaccaagcagaccacagcaagaagcgtagtcgtcgccggaaggaaaggcgcggagcaagatgtcgtggcaggcgtacgtcgatgagcacctgatgtgcgagatcgatggacaacatctcagcgccgacgccatcgtcggtcacgacggctgcgcttgggcgcattccgagagcttccccgagttaaagcctgaggaggttgctggtatcataaaggactttgatgaacctggtactcttgcaccaactggtcttttcgttggacgtacaaagtacatggtgatccaaggtgaacctggagttgtcatccgatgaaagaagggcactgggggcattactatcaagaaaaccggcatgtccttgattattggtgtctacgactagccaatgactccagggcattgcaccatggtggtggagaggctcggcgattacctgatcg

SEQ ID NO: 37796 - DNA, 437 bp, Zea mays
  Clone ID: LIB3060-018-Q1-K1-G8
cggttcggaattcccggccgcgtgcgaacgaagcagaccacaacaagaagcgtagtctacttcggaaggaaaggcgcggagcaagatgtcggggcaagcgtacgtatgatgagcacctgatgtgcgagatcgatggacaacatctcagcgccgacggcatagtttgtcacgacagcagcgcttgggcgcattccgagagcttactcgagttaaagcctgaagaggttgctggtatcataaaggactttgatgaacctggtactcttgcaccaactggtctttgcgttggacgtacacagtacatggtgatccaaagagaacctggagttctcatccgatgaaagatgggcactggaggcattactatcaggaaaaccgttatgtcctagattattggtgtctacgactagccaatgactgcatggcaatgcaccatg

SEQ ID NO: 37797 - DNA, 396 bp, Zea mays
  unsure at all n locations
  Clone ID: LIB3060-018-Q1-K1-H11
taagaatcctaactacaaaggaaaatggaagaccccagggtttgtcaatccaaaattggaggttgacccagacctatatgttctgaaacctttgcagtatgtggngattgaagtatggcaggtcaaagctggttcagttnttgacaacattttgatttgcgatgacccagactatgcaagacatgttgtagatgaaacttttgctgcaaataaggaggctgaaaaggaggcctttgaaggagctgaaagaaagaggaaggctagagaagaagaggttaattaacatggaatcttactctctttctgctctggtcgctgttgcctgttaacaattctgaaactgtgaatgtgagccttggaggagttaacaggacgttgcttttccacaggaagcac

SEQ ID NO: 37798 - DNA, 486 bp, Zea mays
  Clone ID: LIB3060-018-Q1-K1-H2
taccggttccggaattcccgggtacgacgtacgcgatcgattctaaaccaatcccattttaatatatcacttaccgacatgcgcaacggtctaaacaagcttatgtagaaatgcactgacaggccaatacgcaaatgcatagaaaatctggccgcgcttaagggatgtcctcagcgtcgaggaacatgtgctagggtgtatactatcaaccccaaaaaacccaactctgccttacgtaaagttgccagagtacgattaacctctggatttgaaatcactgcttatatacctggtattggccataatttacaagaacattctgtagtattagtaagaggaggaagggttaaggatttacccggtgtgagatatcgcattattcgaggaaccctagatgctgtcgcagtaaagaatcgtcaacaagggcgttctaaatatggggccaaaaagcccaaaaaataagtgattcgtttttagcccttataa

SEQ ID NO: 37799 - DNA, 464 bp, Zea mays
  unsure at all n locations
  Clone ID: LIB3060-018-Q1-K1-H3
cccggtcgaccacgcgtccggatcgatctaaaccaatccattttatatatacatacgacatgccaacggttaaacaacggatgagaaatgcaagacagccaatacgaaatgctagaaaatcggccgcgcttaagggatgtcctcagcgtcgaggaacatgtgctagggtgtatactatcaaccccaaaaaacccaactctgccttacgtaaagttgccagagtacgattaacctctggatttgaaatcactgcttatatacctggtattggccataatttacaagaacattctgtagtattagtaagaggaggaagggttaaggatttacccggtgtgagatatcgcattattcgaggaaccctagatgctgtcgcagtaaagaatcgtcaacaagggcgttctaaatatggngccaaaaagccaaaanaataagtgattcgtttttagcccttataaaaagaa

SEQ ID NO: 37800 - DNA, 477 bp, Zea mays
  Clone ID: LIB3060-018-Q1-K1-H4
cggttcggaattcccgggtcgacccacgcgtgcgcctgctttcccttcagcctcccttcctttccggtgtacgtctccgccgagatggccgccccgctccggcggagcctcccctcccttggtcgcgcgcttctcacgccggcgccggcgcggatgctctccgcggaggcctctgatgccctcgttgagatcaagcccggggagatcgggatggtctccggcatccctgaggagcatctccgccgtaaggttctaatttattcaccagctaggactgcatcccagcaaggttcaggcaaagtcgggaggtggaaaattaattttttgtcaacccaaaagtgggagaacccgttgatgggatggacatctactggggatccatatgctaatgtcggtgaagcaggacttacgtttgacagtgcagagtcagcaaaggcgtttgccgaaaaacatggatggaattatgtggttcggaaa

SEQ ID NO: 37801 - DNA, 373 bp, Zea mays
  Clone ID: LIB3060-018-Q1-K1-H6
cttcaacgagggcgacccgtccacggcgcccacgctcacgctcaccggccggaagaaggaggccgacaagctgcagaccgccgacggctgggccaagttcaccggagggttcttcttcggtggtatctccggcgtgctctgggcatacttcctcctctacgtgctcgacctcccctactacttcaagtagaatacaaattcataaagatgcatatatataatatagctccgcctccgatcctcctctctgcgtgcaaaggtatgccatttcagcagtgacgagcatcgtggatacatgcaattcctctgcacatggatggatggggatgtaacttggaactgttaattttttttacttggatttggatgccat

SEQ ID NO: 37802 - DNA, 354 bp, Zea mays
  Clone ID: LIB3060-019-Q1-K1-A12
ggctggtgccttcatgatctgccacaactgttgcggccgtggccacatggcttatgagtgtccgtctgccggtctcatggaccggttcccccctcgccgtttctgaaggaaggacatccaagggctgttcagatggctgttgttttcagcccattttgtcaggagcacctgttttgctttgctttatgtatttctaaacccgaatggattctagatatttcagattcataactcgtcagcgctatttgtaattctggatatgttacccgactccgatgttcttgatgataatgtttgaagacggggatacttgcccttacgaactcaaaaaaaaaaaaaaaagacaaaaaacag

SEQ ID NO: 37803 - DNA, 429 bp, Zea mays
  Clone ID: LIB3060-019-Q1-K1-B1
tctgtgtcttgtagccgccagccgcccccaccgctcactccatgccacggccgcccctgccgcgcccggccacccccggccccggccgcccttgccgcggacgcccctgtgtgagccgtcgtcgcgcactcgccgctccgcccctacatgcagtcaccacgggagctcgtatcgctcgatttcctctccagcggcagcaccctccacccctcatcaacccaacccgcaagaaaaacccgcagcagagaagaggagtcgccgtgaccgagagctccagagcatgcccccgccacagcctccgacgatggatccaaagatgacagaggtgacccagatgttcgcccgcttcaagacggcctacgcccgcaacgacctcaacacctgcgtcaccctcctctcgcagctcaaggtgcggtacccgacttcact

SEQ ID NO: 37804 - DNA, 375 bp, Zea mays
  Clone ID: LIB3060-019-Q1-K1-B12
aatttcgggtcgaccacgcgtccggtcatggctgatcccaccggctgatagagttttcggtcgtgggagtgagtcgtcagggatgtgatcgggtcctgtgtcgcggtcggtggctgaagatgtgggccgctggggcagcatgaagcagacgggggtgaccctgcggtacatgatggagttcggctcccggcccacccagcgcaacctgctcctctccgcgcagttcctgcacaaggagctccccatacgcttcgcgcgccgcgcgctcgatctcgactcgctgcccttcggcctctccaacatgcccgccatcctcaaggtccggtactgttacatggactcattccgggacattagatacttccctgaagtgag

SEQ ID NO: 37805 - DNA, 413 bp, Zea mays
  Clone ID: LIB3060-019-Q1-K1-B2
attagcgggtcgacccacgcgtgcgcagcgggcagcggcggccggcatgcaatgctttgaagaaatgctcggcgttggcctgcgcgtcggactgatggtagctgttgcccctgcgcctccagttccagccccaccaggcaaaccgccccttcctctctgctcctctctccgccaccgctcctccggctggtggttctccaacggcgacgcccatggaagagacagcaccaccgtcaccacgagcagcagggcgacgaggcggaagtggtggtccgaccccgacggcagccaagaagactacggttcctcttctctagaggaggacgagtacggttacggttacgactacgattacaaggatgaggctgcgttccccggatttgaagggcctggggagatgttcgacaagccct

SEQ ID NO: 37806 - DNA, 204 bp, Zea mays
  Clone ID: LIB3060-019-Q1-K1-B3
aattcccgggtcgagccacgcgtccggcttcggggaggagcacctgtgcttccagactctgcagcgcttcacggccgccacgctggagcgcggcatgcacccgccggtctctcccaagcccgagtggcgcaagctcatggacgagatggcggtcgtggccacggaggagtaccgctcggtcgtcgtcaaggagccgcgcttcgt

SEQ ID NO: 37807 - DNA, 147 bp, Zea mays
  Clone ID: LIB3060-019-Q1-K1-B7
cgacccactcgtccgacagcgatcatattggagtcgtactcgtacataagccacatccctctgctagctagctagctccggctagagtggaaagtgcatgatgggaagctccgactacgcttccgtctccgacgaccacattgcaag

SEQ ID NO: 37808 - DNA, 418 bp, Zea mays
  Clone ID: LIB3060-019-Q1-K1-B8
gaattcccgggggaaaaatccgaaatggccgctagtggcctcggtctctccacctccttcctccccggccacgacaccctcctccggcgcgggcgccggcggccggcgggccacgccgccgcgtcgttccggccggtgacggcggagctcggcggcgtcgcgacggagctgggccgccagctggtggaggcggtgggcgtggggctcccctgcaccgtcatgcagtgcggcgacgtcatctaccgcagcacgctcccccggaacgacgggctcaccatcacggcccccggcgtaacgctcgcgctcgctaccgtgtcgaacctctggtccacgcccggcgtcgcgccggggttcttcgacatgtccgtcctcgccttcgccgaacgccttttccgccttaccttccgaagggatgact

SEQ ID NO: 37809 - DNA, 256 bp, Zea mays
  Clone ID: LIB3060-019-Q1-K1-B9
ggaattcccgggccaagaacaaccagagaggcaagcaggggagaatcgcggaggtctgggaaacaccatcctgcagagatgacagtgctgcgctccccgagctcctccctgttcctcgccaaaccttctgccgtcgccaagggcagggcggcggctgtgacgtgcttcagcgggccctccctgtcagtggggcgtgaagatcaggagggtgtagcagtggtggtggggaggcgtgcgttggctttcgcagcagctg

SEQ ID NO: 37810 - DNA, 425 bp, Zea mays
  Clone ID: LIB3060-019-Q1-K1-C3
ccggtcctgaattcccgggtcgagccacgcgtgcgggagatcggtcgtgttcgcgcttctagattctattttttatgcatgttttattcaggagatttgaggaacgggactgctaggcaagatgagtatacctgaaatttaggtctagaaattcactgctatcagtctcagaataggctaggttgaacttatacatgagatatccacaggtccaggtgcattgtttgaatttgattagaaatgtgtaaaggtaagtcttataaaaaaaccacctaaaaagggccaaaatttggatgtaccttctgggttattgaccccaatatctttattactatatgtgcctggtttgcttaaaaaaaaaaaaaaattaaaaaaaaaaagggccgcccgtttaaaagatccaagcttaccttccccttccttcc

SEQ ID NO: 37811 - DNA, 356 bp, Zea mays
  Clone ID: LIB3060-019-Q1-K1-C7
aattcccgggtcgacccacgcgtgcggttggctgcttctatattaagggcagagacatttggaatacccatacctggttgggcgaaaaaggcaaagaggctagctgaagctgtggacaaggtcattgttccggatttccatccaaaagagggtgttaagatagagacagatgagaaggctactagcctatcctctgcgtctgttgatgatgctgccgtcattgaagagcttattgcaaagctgcaagcaatttctaaaacattgtcaccaggattccgtatgaaccctatacagtttgaaaaggatgatgatacccaatttcatatggacttgattgctggttttgctaacatgcg

SEQ ID NO: 37812 - DNA, 455 bp, Zea mays
  Clone ID: LIB3060-019-Q1-K1-E4
ggtccggaattaccgggtcgagccacgcgtccgtctccgctccgaatctccgatgggtccccggtggcgacacgtacgccgatccgggggagtgcggggacgaacctgcaccggcggggaagctcaatacaggcacgatgcatccaggcacaaatcgatcgatttagaaacaagaatcaaaggtgtgcgagccgagagacgaacacgagagcaaatccttccttaatattcatggacagcgcaacgctgacctgcaacaaccgaagccgaccacaggcatccgcaagacagcaagtgaagctcatatcggcgaactgcggccttctgcgcttcgcctaggagcctacggagtactgagaacagagcagcggaggatcatggcacaccttcaattcttgcggcgccagaagcagcggagcttgagccggtgcgctaggacattggcgatcgcgacg

SEQ ID NO: 37813 - DNA, 264 bp, Zea mays
  Clone ID: LIB3060-019-Q1-K1-E7
ggtcttgaattcccgggtcgagccacgcgtccgctcagagcaggttccaccttcccgtgtggctttgagtcggcgccgcctttaagttggccatctgcaacgacgtcaggaacttccaggtcctcaaagagatgtacaacgagtggccattcttcagggtcaccctggacctgctggagatggttttcgccaagggagaccccggcattgccggcttgtatgacgagctgcttgtggcggaagaactcaagccctttgggaagc

SEQ ID NO: 37814 - DNA, 304 bp, Zea mays
  Clone ID: LIB3060-019-Q1-K1-E8
aattcccgggtcgagccacgcgtccggctcagtccacccagcgcaggggatggcgtcgtcgttcgccgtggcaacggtcccgtcgctgggggccccggcggccaagaagcggtccggcggcgtcacgtacgtggagggcatgaacgcctacagcggcctcaaggggctcaacaaggtgaacatgctcggggtgcgcaagaccgccgactactccttcgccaaggtcgtggcgtcgctcagccccgcgggcaggaagcggcgcggcggcgcgttcggcgcccaaatgaacgccgccgccgaaatc

SEQ ID NO: 37815 - DNA, 388 bp, Zea mays
  Clone ID: LIB3060-019-Q1-K1-F2
ggtcgacccacgcgtgcggccgaggaagaggagaagcgaatcaagcaggcttcgacaacaaggccgacgctgactgccaatgcaaacgtggaactagagcaagatgggcggctaactgctgcttgcgctcctcctcgtctctgctgctgccgtccctcaggtactcggagttggcaatggagacaatcacatgagaatcatccacgaggacatcattgagacagtcaacaaccataccaatgctgggtggacagcctcacgtaatccttacttttcaaactataccattgcgcaattaaagcacatacttggagggaaaccaccaccacagaatgcactaagcattgttcctgtcaaaacttattcaggatcactgggaacttccaaa

SEQ ID NO: 37816 - DNA, 320 bp, Zea mays
  Clone ID: LIB3060-019-Q1-K1-F3
tataacttgaaacagaaggctatgaccagatagactctgtcactactggagcatctgtactaggggagggagttgttgcaagcagccaaggcggtaagcaaaaagtggagttgaaggtttcaaagatcactgtgattggtaagagtgaccccacatcttttcctatacagaagaaacgggcatcaagagagttccttagaactgtagcccatctccgtcctcggacaaacacttttggtgcagtggcaagagtgagaaatgctctggcatacgcaactcataaattctttcaagacaatggaattgtttggttttaaagc

SEQ ID NO: 37817 - DNA, 350 bp, Zea mays
  Clone ID: LIB3060-019-Q1-K1-F6
gaattcccgggtcgagccacgcgtccggtcgttgtgagaattcttaattcatgagttgtagggagggacttatgtcaccacaaacagaaagtaaagcgggtgttggatttaaagctggtgttaaggattataaattgacttactacaccccggagtacgaaaccaaggatactgatatcttggcagcattccgagtaactcctcagctcggggttccgcctgaagaagcaggagctgcagtagctgcggaatcttctactggtacatggacaactgtttggactgatggacttaccagtcttgatcgttacaaaggacaatgctttaacatcaacccggttcttgggaac

SEQ ID NO: 37818 - DNA, 348 bp, Zea mays
  Clone ID: LIB3060-019-Q1-K1-F9
ccggaattcccgggcacggcttcctcgcaccggctccggtcctcctcccatcaccatcaccaccgtcgttcctctcacgagtcccgacacacgcgaaccgcacgaaccctggctggcggcgggatgacgcggcggtgctcgcactgcagccacaacgggcacaactcgcggacgtgccccaaccgcggggtcaagatcttcggggtgcgcctcaccgatggctcggccatccgcaagagcgcaagcatggggaacctctccctcctctccgcggggtcaaccagcggcggcgcgtcgcccgccgacgggcccgacctcgccgacggcgggcgggggctacgcctccga

SEQ ID NO: 37819 - DNA, 306 bp, Zea mays
  Clone ID: LIB3060-019-Q1-K1-G9
ccgctcctgaattcccgggagaaaagcagttcttcagctaggcaggagggcacaggaaggaggagatggcgtcaaagaggattcagaaggagctcaaggatctgcagaaggaccctcccacctcgtgcagtgcaggtcctgttggtgaagacatgttccactggcaggcaacaataatgggtccatctgatagcccatattctggtggagttttcctagtcacaatccattttcctcctgattatcctttcaaaccaccaaaggtggcatttcgtactaaggtgttccatccaaacatcaacagca

SEQ ID NO: 37820 - DNA, 413 bp, Zea mays
  Clone ID: LIB3060-019-Q1-K1-H10
cgagccacgcgtccgcatcgagccgcgattgctcaccgcacaagttcacgcttacctcacacactcagctaagtagctgactcggtatgctataacaagaaaaggctcgacatggccgaggagaagaagcagggcctgcagctgctggacttctgggtgagcccattcgggcagcgctgccgcatcgcgctggacgagaagggcctggcctacgagtacctggagcaggacctggggaaaaagagcgagctgctcctccgcgccaaccctgtgcacaagaagatccccgtgctgctgcacgacggccgtcccgtctgcgagtccctcgtcatcgtgcaatacctcgacgaggcgttcccggcggcggcgccggcgctgctccccgccgacccctacgctcgcgcgcatgcccg

SEQ ID NO: 37821 - DNA, 245 bp, Zea mays
  Clone ID: LIB3060-019-Q1-K1-H8
tggggaggcagattttctggagtgcccctcatcgagtgtctgccttgggaagcccccgaaggtggggactgggatctttgggctactgcagaatcttgaattggagcagcccaagaatatctaaaatctgcatttggtgcacgtctggccaagctgccttctgaaggtttacaagttttggtcctgtcagcctttgcacggcagaatgtgctttagtttgttactgtgtggcacgctgcatctgt

SEQ ID NO: 37822 - DNA, 349 bp, Zea mays
  unsure at all n locations
  Clone ID: LIB3060-020-Q1-K1-A4
ccccgggtcggcccacgcgtccgctcgcgtaccactgcntgggcgttggcgttcttgtgtccctgctcgtgttgcccgtctccccggccaccatacatgcgctgtccagagaatcaagtgccagtggtgaccatgctcacaattctttacccaccatagccagaacattctaaggagttgctggcctatatgaagcttgttccataatcatctcatatcacgaagaagaagtggaagtccctgaagagaagactacaccacctttggagtctcaagcagggtctcggttctactttagcatctgcgggcctgagactaactcaactatagaccaaggttaggaagcgac

SEQ ID NO: 37823 - DNA, 198 bp, Zea mays
  Clone ID: LIB3060-020-Q1-K1-B10
aattctcgggtcgacccacccgtgcgcgattcgctcgctcgatcctagcttcccttcttcgaatcgcaacacaccatggccattgacacgcgagcctgcgccgtcacgcgccatctgctggccaccgcctgggcgccatcggccaaactccgttcacatatctctcagctcgcgctaccgtaatcctgctaaatgctt

SEQ ID NO: 37824 - DNA, 436 bp, Zea mays
  Clone ID: LIB3060-020-Q1-K1-C5
aattcccgggcaccagaccagcagcagaacgaaagggatctccggtccccaggccccggctcctccccttccgattccaatctggtctcgccgggcctggcggcgagggagagatggggaagaaccaggcgtacaaggcgatgcagcgggcgcggttggggtcctcgtccggcgcgccgggcgccgccgacgcccccgaagacggcatggtcggtccccttcctctctcctaggagatctctgtttcccatctgcacttccgagttccaggctcgcaatccatcctgatctgattatttccgcagccatattactatgctaattatatacgatagagtaggcttccagccgctgaggaattttggctaccattccactttcgctttgggtgaaagataaagaaaaagaactttggctaacgagggccgtcgcagac

SEQ ID NO: 37825 - DNA, 289 bp, Zea mays
  Clone ID: LIB3060-020-Q1-K1-D9
gaattcccgggtctgaagacagcatctatggtattgcatggagctcccatgatccatcattattcgcttctttgtcatatgatggaaggggggtcttggaatcagtcaagccctacttgcagagaaaatgaaccttgtctggttttctaaattctgagtagctttgccttgccattctgtagcctcttaacaagcatctatgtgatgattcggtttactgttgtagcaatggcagaaaaatggataacaagattgttacagaaatcaatttttacgatgttgtacaaaa

SEQ ID NO: 37826 - DNA, 274 bp, Zea mays
  Clone ID: LIB3060-020-Q1-K1-G1
ttctggaggatatgagtcaggcacatggcccatacatgaccttggggcaagcatggatagccggggagccagccttcataatcttcttggttttcgacgctctggctctcttcatctcgctcgcggtcgtcgtggtccagacgtctctgatcgtcgtcgaacagaaggccaagaagaagatggtcttcgtgataaacaagctgatgtggctcgcgtgcctctgcatctcggcggcctttatagcgctgacctacgtcgtcgtgggccgagacga

SEQ ID NO: 37827 - DNA, 365 bp, Zea mays
  unsure at all n locations
  Clone ID: LIB3060-020-Q1-K1-G10
aagcaagcagcgagtacatacatactaggcagccaggcagccatggcgcccaccgtgatgatggcctcgtgggccaccgccgtcgctccgttccaggggctcaagtccaccgtcagcctccccgtcgcccgccgctcctccagaagcctcggcaacgtcagcaacggcggaaggatccggtgcatgcaggtgtggccggcctacggcaacaagaagttcgagacgctgtcgtacctgccgncgctgtcgacggacgacctgctgaagcaggtggactacctgctgcgcaacggctggataccctgcctcgagttcagcaaggtcngcttcgtgtaccgcgagaactccaccctcccgtgctacta

SEQ ID NO: 37828 - DNA, 267 bp, Zea mays
  Clone ID: LIB3060-020-Q1-K1-G11
tataggtgtctcgtgggctcagaagcacatcatctgactgttcttaccaggggatcagatcttggtcctaggcgaaaacatggtgtcggtgattggcctggtgctgacgttcaagccatttttctccctaccgaatccaacgaggcattcataaatctgtgtagatgaagcccgttcctgtgaattgtatcgatgcactgcctgattacagttgggtttcaaactgcaagaattcatgacttcatgtattggtgtgtggtccatact

SEQ ID NO: 37829 - DNA, 241 bp, Zea mays
  Clone ID: LIB3060-020-Q1-K1-H11
ccctgaattcccgggtctcgctaccgaataaaaacataaataaaagatccactgtcgtctgcatcattgttttatatatatacatatatatatatgtatatggatctatctaaaaaaacgacaagaaccaaaccaacaaaaccaacacaacaaaccaaaacaacagcaacaacaaccaaaaagggccgcccctcctaaaggatccaagctaactaccgctaccatgcgacgacaaacccct

SEQ ID NO: 37830 - DNA, 104 bp, Zea mays
  Clone ID: LIB3060-021-Q1-K1-A1
tcgacccactcgtccgaggtgagagaagcatgccatcccacacctattcctgcactgcacacacaatccctccccatgtgctctgctgcaactactactatata

SEQ ID NO: 37831 - DNA, 467 bp, Zea mays
  Clone ID: LIB3060-021-Q1-K1-C10
attcccgggtcgagccacgcgtacgctttcgtcaactacacttatcttcttcgcgttacctcctcttcgccgcctccaactctggacagagcaaccagccatggatgaggagtactacttgatcgtactatgcacggggctcaagtagtgcatcctcagctgtctcctctctgtagacggcctcaaggtattgcatatggacagaaatgactactatggatgagattccacctcactcaaccttaatcagctctggaagaggttcagaggggaagacaagccctcatcacatataggtgcatgcagagactacaatgtggacatggtgccaaagtttatgatcgcaaatgggacattggttcgaaccctcattcacaccgacgtgacaaagtacttgtcattcaaagctgtcgatgggatctatgctttcagcaaatgtaacatttacaaagtccctgacactgata

SEQ ID NO: 37832 - DNA, 386 bp, Zea mays
  Clone ID: LIB3060-021-Q1-K1-C2
ctcctgaattcccgggtcgacccacgcgttcgctttgcaatctttcgctatataggaaatccaatagttaccccggaggtgacaagagatgtatgcgtgctggccagaatgatggctgcaaacttgtacatcgatcagattgaagagctgatgtttgagctctatatgtggcgctgcaacgatgagcttcgtgttcgtgccgaagagctccacagttcgtctggttccaaagttaccaagtattacatagaattctggaagcaaattccttcaaacgagccctaccgggtgatactaggccatgtaagggacaagctgtacaacacacgctagcgtgctcgccatctgctggcttctggagtttctgaaatttcagcggaatcgtc

SEQ ID NO: 37833 - DNA, 457 bp, Zea mays
  Clone ID: LIB3060-021-Q1-K1-C6
tcctgaattccggggtcgacccactcgtcgggtctgcgtcgcgtagggttttggctacttgcacgtacgagagcgtccatggacgactgcatcggcgaacaaggtggttgaggacgtcgcggaggaggaccccggccgccgcggcggtccatggaggacggatgaggccgacgccaacgagaaggcgcctcgcccgagcaggcgggtcgcttccctcgacgtcttccgcggcctcaccgtcgcgctgatgatactggtggacggcgccggcggcgagtggccggtcatcgggcacgcgccgtggaacggctgcaacctcgcggacttcgtgatgcccttcttcctcttcatcgtcggcatggccgttcccctggccctcaagaggatcccggaccgtggccgatccgtgaagagagtggtcgtaaggactctgaatctgctcttctggggcattctg

SEQ ID NO: 37834 - DNA, 432 bp, Zea mays
  Clone ID: LIB3060-021-Q1-K1-C8
acctcataaaattgctctggctttctataagatttgagcgcaccaaaggtgccagtgatgtacaatgtgctaggctagtacactatccagatggccctttctcctagagaatcctaccattctagtcgtcgatctcctttacagcgtcctttgcgagcctcgttacataagcggcagcaatggctgtaaacaataatccaacgcccagtgtccatagctgttcgtttcctcccaaaccaatttccgactcatcttggattaaagctcgcccgaatgcaccggcactgacgtaagcccatgaacctggaagcattcccaaccaactgcccaagacatacggcaagaacttcactgaagtaaggccatatagatagttcccaagggagaaaggtaacaggggactcaagcgtagcaaagtaacaaccttaaacc

SEQ ID NO: 37835 - DNA, 470 bp, Zea mays
  Clone ID: LIB3060-021-Q1-K1-D1
ggtcgacccactcgtccgccatgcgtggaaagtacatggcatgctgatttatgtactgtggctacgttgttccaaatgacggggatggggctgtccattcaatctagaccaatatatcagagcacatagttgattggtgctctactggtttcaagtgtgggataaactaccaaccaccaactgtagtccctgaagggtacctggccaacgtgcaacgagcaatctgcatgatcagcaacatcacagtcgtggctgaggtcttctctcgtattgaccgcaagtttgatctcatgtatgccaaacgtgcattccttcattggaatgtcacgtaaaggattgaaaaaagggagttctcagaagccatggaagatcttgcaacacttgagaacgattattacgaagtccgaacttaaattgaagattaagacgacgaaactgaatattgaatcatcgatctggatgcatggtta

SEQ ID NO: 37836 - DNA, 404 bp, Zea mays
  Clone ID: LIB3060-021-Q1-K1-D5
tttggaagaaaagaacaggctactgtcttctctatctcaacagggcgacgcatttcaataacaccctacactgtttatgttgtacacacctatctagaaaagacagaaaaaaactgaagagaaagctgattagttacacggagggaccgatctaatcagttgccatcaaccataccgagaaggagctaggcaatgatctacaaaaatgctaccagggtgaaaacttcaaatcaagtgacaagcagaaggttgttttcatgcccattgttgtgcacagtgggtcgcagcggatcattcttccaaacaccatcaacaataaacttaatctcatatctaccagggtacagtctcagatttaaggaaaacatgccgttttctgatctttccaactttctttgacttgt

SEQ ID NO: 37837 - DNA, 365 bp, Zea mays
  Clone ID: LIB3060-021-Q1-K1-D8
aattcccggatcgacccactcttccggttggctactcctacccctccggttcggattctgattcatgaggatctccgttactgggttaggtgggtcttcaaatcgagatagcaccgtccgatgttgagtaccgatgcttcgtcatctgcctcgcctgttccacggactaccactccatccacaactccttcagcacctactgcgaggtcctcgaatccaagatcatcctcgatcgggagactcataagtcccacggcttcggcttcgacaccttctccacggacgatgcgattctcaacgccatcgaaggcatgaaccgcaaggatcttgactgcctcaacatcaccgtcaacgaagcccaatcc

SEQ ID NO: 37838 - DNA, 427 bp, Zea mays
  Clone ID: LIB3060-021-Q1-K1-E4
gaatttccgggtcgagccacgcgttcggtactggtccaatctgtcaccacactttgatcacacacaggaagttgagatcagaaaaatgcaggctgcggctactgccgccgggttctcggccgtgctgcccgccaagggcaggccggcggcgaggagcatggtggtggcccgtgtccccgccacaaggaggagcgtccgtgtagctgccgtcgtcgcgaccgaggccgcgcagatcgactacagctcaagcgtctcggtgttcccgatggacgcctgcgacctgcttggtggctactcgtgcaacgggcccatgttcccggaggccaagcccgcctcggcggctgcggcggcgagcaggagtgtggtcggggtggacagggactacctgtcctacgacgagccaaagacggtgttgccggacgaggcg

SEQ ID NO: 37839 - DNA, 265 bp, Zea mays
  Clone ID: LIB3060-021-Q1-K1-F2
ggtcgacccacccgtcctaaacgctctatcgcttaacacgacctcctcttaaacctatacaacctcctttaccatctgtacggatccagttcccatcgacccttactccatatccacaaccaccttctaacattactaccgatacttctacaccaacctctcatcgctagtttgactgtaccaagagacctccatgctcaccttccagggccagaactttccacggcccctccgccattgccgtcaatctcggatctatcccttt

SEQ ID NO: 37840 - DNA, 249 bp, Zea mays
  Clone ID: LIB3060-021-Q1-K1-F6
aattaccgggtcgacccactcttccgttaaggccatcttcacgataatgctcgtgcttcaagctcgaatacatgcaactaatgggaaaagtgacatcttacattgatagaatgtgaaactttaaacaataatcccacatcatatccagttaatactgtaataacaacattctagcattatgtattcaaactgcctactgatcatatgatcttaccatatgctcacccctttataaactctccaagatca

SEQ ID NO: 37841 - DNA, 483 bp, Zea mays
  unsure at all n locations
  Clone ID: LIB3060-021-Q1-K1-F8
gaattaccgggtcgacccactcgtccgaaaacgccgcaggccagtctgcgagttggattgcctccttcttggccctcgtgtgcgtcctcgggttgctagccatcgcctcctacgtccagtacactcgctggcaaaaggggaaaggccgcttcggcggccatgggaggtctgctcccttgaagctgcctcctggctccatgggctggccttaccttggcgagaccctccagctttactcccaggaccccagcttcttcttcgcttccaaacagaagaggtacggcgagatcttcaagacgcaccttctgggttgcccgtgcgtgatgctggcgagcccggatgctgcgcggttcgtgctggtgacgcatgctcacctgttcaagccgacctacccgcggagcaaggagcgcatgatcgggccgtcggctctcttcttccaccagggcgactaccacctncgncttcgcaagctcgtccagggcg

SEQ ID NO: 37842 - DNA, 335 bp, Zea mays
  Clone ID: LIB3060-021-Q1-K1-G2
cgctccggaattcccgggtcgacccacgcgttcgctcgccttcacccaggtccaaaaactgccgcatgagatggtggccctcatctagtaagggactaggtttcatctgccatccaagtgttctgtatgcacgccaatattattaatgttcttagatttgctcttataccttaatgcatacatcgtttgcaggctcgacaaccaaaaaaatataacgccccgtttggatcattgaaattgaatttcattctaataatagtaatttaggcatatatcaatcaagataattcagttttatacgaaagatatttgtatactattattagcaagatgtc

SEQ ID NO: 37843 - DNA, 493 bp, Zea mays
  Clone ID: LIB3060-021-Q1-K1-G3
gctcctgaattcccgggtggaaggagaatattgttggagcctaagagaggtcttctgaagcagattattcgacaatttgattcaacaaatcaacttagaaagaaaggggttgctggtacaattcgtaactgttgctttgaggctgatactcagcttctgagtttgctttctttagcagaatatctttggccagctctacttttgcctgtagccggaaagaagatatatagtgaagaagacagatcaaaaatgccacttgagctatcgagtgcactctctcatgaacgggaagttgttgaggattctgaaattcggcagcaggcattagaagctatttatatgatcgtattgcaagatggtggtcgaaggtccttttggtcagttaatggcccacgaattctgcaagttggttatgaagatgaaaaggacccgaaagtgatggaagcatatgaactcattggttccctgcttgttgggaagggtgaagatgtac

SEQ ID NO: 37844 - DNA, 471 bp, Zea mays
  Clone ID: LIB3060-021-Q1-K1-H10
gaattcccgggtcgacccactcgtccgcttcatctctggcacaaagatgaagaggaattcctagatccttgagagaccaccagaggatgagatgctctcgatcggctgcacagtgctcctcacatactataacaacttagtgccatctgaagacagcagcaagctccctgaaccaattgcagcactaaaatctgtaatatgactcatataaggcatgctactatatcttatcaagcggttctctgcgacatagatccgatgctatatgatcgtatactggctgtaacactgttaaacactaggcttgattcggatgtcaatgtgtgcttcgtacccgatgtaccttctctgctggcactgttgcacattcactgtagcacatcagacgtttggtgctaataaggacaggctatgtatcctctgccagattgtacatatatacattgcggtgatatataatgataaagctgt

SEQ ID NO: 37845 - DNA, 475 bp, Zea mays
  Clone ID: LIB3060-021-Q1-K1-H3
cgctcctgaattcctgggccaatctcggcgtcaccgccccaaatctagcaaacggaaatcccatctcgccgtcgtcgcgatgtctcgccgctatgacagtctcacgacgatcttctcgccggaggggcgtctctaccaggtggagtacgcgatggaggcgatcggcaacgccgggtcagccctcgggatcctggcggccgacggcgtagtcctggtcggcgagaagaaggtgacctccaagctcctccagaccttccgctccgccgagaagatgtacaagatcgactcccacctggcgtgcgctgtggcagggatcatgtccgacgccaacatcctcatcaacaccgtccgccttcacgcccagcgctacgcgctctcctaccaggagcccatccccgtcgagcagctcgtccagtccctctgcgacaccaagcatggttacacccagttcggtggccttcgtccctttggggtc

SEQ ID NO: 37846 - DNA, 286 bp, Zea mays
  unsure at all n locations
  Clone ID: LIB3060-021-Q1-K1-H4
gattcccgtgtcgacccactcgtccgttaagatcataagctactgagatttccaacttctagtgctagtcccccttccttccgtgcatcgactacatgcntcagcaccttgcacagctgccccattgccagaagagcaaagatcaacaccaggtccaacggcagcaaccgtagcgtggcgaaggggtcaccaccaccagccttccagttccagtgcagggcgtctactttcgcggcggacaccagcctncggctcgagcatgacgagaaccccgaggcgatcatct

SEQ ID NO: 37847 - DNA, 471 bp, Zea mays
  Clone ID: LIB3060-022-Q1-K1-A6
cggtcttgaattcccgggtcgagccacgcgtccgccgctgctcatctcacatccctcgtgaagactcctgctcctcgccgatcgatacgatggccgtgttctccgacctccacaccgccgacggcctcaagtccctcgaggctcacctcgccggcaaaacctatgtgtctggtgactccattactaaggatgacattaaggtcttcgccgcggtgccgtcgaagcctggcgctgagtttcctaatgccgcccgctggtacgagaccggctctgcggctgtagcctcaaaaattcctggtaaaggttgttgtgtaaaattggcttgcggatcaagttctgccggaacttcttctgccgatgaagcttaagattaatattaccttgatccttttggtgatgaaactgaagaagaccagaaagcaacttattaaccgtccgtcgctgccaagggcttttctaaaaagaaagaaa

SEQ ID NO: 37848 - DNA, 207 bp, Zea mays
  unsure at all n locations
  Clone ID: LIB3060-022-Q1-K1-A8
tccggtcttgaattcacggatcgagccacgcatgcgcgcaaagagcacgctctcctactcatgcagcgtgccgtgctgncactgacggcgatggttacggagcgtgcagtttgcgcgtgcacgtgtgcgtctcagggctgctacctgctactgtgtgcctctgagtgtcttagctgtggagtaagatatcggctgcgcctgacagtt

SEQ ID NO: 37849 - DNA, 363 bp, Zea mays
  unsure at all n locations
  Clone ID: LIB3060-022-Q1-K1-A9
cgggtcgacccacgccttccagaaggccaatgtcaaaggaacccggaaacttccggggcaactgcctggaatagcctaattgggggtgattgatcaagctacttgagctccgatcctcgctagctagttagtttaccgttttaccacaagtcttcttcacaagttaaggattgacagcaacaaaaaatctcaatggcctctgccaccgcgctcaagtcctccttccttcccaagaagtccgaatggggcgccaccaggcaggccgccgcgcccaggccgtccaccgtctccatggtcgtncgcgccttcggctacgccgatgagctcgtgaaaaccgcgaaaacgatcgcgttgccggggcgg

SEQ ID NO: 37850 - DNA, 190 bp, Zea mays
  unsure at all n locations
  Clone ID: LIB3060-022-Q1-K1-B12
ctcggtcctggaattcccgggatcggtccgacgcgtcacgcttcccgtgctcggctcgtggtcttctctcgtggtatatagccacagctcatgnggactgggtctcgggaggggcggatgcgccgattgcgagctcgtcctagaggacctaacgactgcggcttgccggagctcgtctggatggactcgg

SEQ ID NO: 37851 - DNA, 274 bp, Zea mays
  Clone ID: LIB3060-022-Q1-K1-B4
ggaattcccgggcgctgaatcatcacaaggtggagctgagcggcctggacgcttggggcggcccgctgtacatcggcacgggatgcttccagaggagggagaccctgtgcggcaggaggttcaccgaggactacaaggaagactgggacagaggaaccaaggagcagcagcagcaccgccaccgcgtcgacggcgagaccgaagcgaaggccaagtcgctagcgacctgcgcctacgagcacgacgacgacacgcgggtgggagacgaggtggg

SEQ ID NO: 37852 - DNA, 161 bp, Zea mays
  Clone ID: LIB3060-022-Q1-K1-C10
tcggtctggaattcccgggtcgagccacgcgtccgctagctagctaggataccgccataccacaagtcttcttcacaagtttaggagtgacagcaacaggagatcttgatggcctctgtcagcgtgctcaagtcctccttccttcccaagaagtccgaatg

SEQ ID NO: 37853 - DNA, 445 bp, Zea mays
  Clone ID: LIB3060-022-Q1-K1-C7
ttcacttcgttctagtggggagcgccgccgcggcagcggctgctgctctgcgcgtcaggcggggatgcgctcgcgcttgcgcttgggccccctcgcagcgaccgcagcaaggggcactcgtcagcctcaagccttgcgcctcactggcaccacaagctcctctgtggcgcgcggagtcggatgccgcggggggtggtgccggcgccggcgatgtcatgggcctcctcctccgggagcgcatagtcttcctcggcaacgagatcgagggacttctcgcggacccccgcgtcagccaagctcctcttcctgaagccatcgaacccgacttttaccttcggcttttcggcaacttaacaaggggatcccttaacgcaaccatggccatctattaagtaatgcaacttgggaaggccaacctgttcactattggaatgggcctaactgg

SEQ ID NO: 37854 - DNA, 454 bp, Zea mays
  unsure at all n locations
  Clone ID: LIB3060-022-Q1-K1-E9
tgcccgcctctgccgccgtcgcaggcgccttctccctccgctgccatctgtgctccgaatgcaggcctttggcgctcctccctccccgaaaacctcgccctcctcacgcttctctcttccccatccgacgctctcgccaccacccccggcaccgtaccgcctcgccgtccccgccagctcccgctccacgtcatccgatccacttatgcttcctttctcgcttccagtcttccaccatgtcatcctcactgagtccgcctncccgctccactccgagccaggcccaagccccgtccacctcgcgttcggatccctcgattccgacctcggcgcgccacagttgtacgtgtgggggccgtctcgtgagccgtgagcccttcttacgatccgaggccaaccccatcccactgcgaagcataaagctgagttctaccggcccaccacgcggcatggt

SEQ ID NO: 37855 - DNA, 365 bp, Zea mays
  Clone ID: LIB3060-022-Q1-K1-F9
taccggtccggaattcccgggatggatgatgcggattggatcggatcctgcttcttctagctagcgctgatacgtgcgtgcgtgggatggttggcagggcgaggggctgaccctgttctacaacccggcggcgacgaagatggccccgaacgaggtgttcggcgtggcgttcaacggcggcttcaaccagcccatcatgtgcggcggggagccgaggcagatgacgctgcaggagcggggcaaagccgacccgcccatctacaccatcaggatacgcgtgccgcagcacggtggagagcccgccgtctctttcatttcatctcatctcactagttacctctcgctgatttctctcgctgcgtgcg

SEQ ID NO: 37856 - DNA, 308 bp, Zea mays
  unsure at all n locations
  Clone ID: LIB3060-022-Q1-K1-G9
tgcactctactcggtccggaanttcccgggtcggacccacgccgtccgcccccggactcttccccagactcgactgagatcgctcgaccgtcatcggcgccgttccacgtcgctcgcggagcctcccgcccgacagtcttcggcctcctacatcatnnctccatggcgactggccccctcggaccgtgctcgccgtggagcctcctggcagcgcgagtgccggcgtgcgccatgccgctgctccgtggtgccccgctgttcgagaaggctggccgaccatgcagtcggcagcccgcgtncgtggaagc

SEQ ID NO: 37857 - DNA, 134 bp, Zea mays
  Clone ID: LIB3060-022-Q1-K1-H7
aagctacaggtcaaggcccattttcacattaaacagacagagaacagagctcaacataatgttatgtacatattattcaaatgttgtcgattaaaaagcgtatacagcttttgataacattgctacattcaaat

SEQ ID NO: 37858 - DNA, 399 bp, Zea mays
  unsure at all n locations
  Clone ID: LIB3060-023-Q1-K1-A10
gtccgtggcctgaacaggaagtgttgctccttagcaccggctagccgccctagaggatcgacaggatggtgccaattccagtgactccctgaaattgggatgttggatcagatcgatccagtatggcaacacagggacaacatatatcctggattcaagtgcaagtactgcaaaaaacagtggaaggatgtggtgctatacgtttcaagcaacaccttgcatcgtgtggggggaatgtgcaaggttgtcgcatcgttccaccggacactgtcgattactttcagcaggagcttgacaaggtccatgatgctagtggtggtggtgcttgtggtagcggtgttggtgctagtggtgcttgtgcttgcngtaaccgttgttgtggcagtggtggtgcttggg

SEQ ID NO: 37859 - DNA, 424 bp, Zea mays
  Clone ID: LIB3060-023-Q1-K1-A2
tcatgcgactgtttttggagcgttttaagagagaaccttgtaccatgttaagatactgttgagcttgtgacgatgcgcacggtagaagaggaacctttttttttttgcggttggattgtgcaaactgcgagcagtagtgagtgtggtatatttgtgccttcagtttcctgttgggtggagtgttcttgtcgtttggcacggcacactagtattatcagcgctctgttgaaagatggatcggaatggatgcccagatagtctgggacttgtggtgatgcaaatccagccagtaactagtatgaatttctttagtggggttgttgggctgctaaaaaccgccggactgagcaaaggaaccttgcgtctttgtgtaaagcaacaatcgaatctgtgtgtgtttgtgattaaagtcgtcattcggtcc

SEQ ID NO: 37860 - DNA, 210 bp, Zea mays
  Clone ID: LIB3060-023-Q1-K1-A5
tcccgggtcgagccacgcgtccgcacgcctgaaggccagatctaagccttctcgtcctcgcccaaggacaacgataaacatctaagagccaagcaaaacagagcacgaccatcggtctctaagcaaaacgcgcagcacgccgggcgctccacgcacgtaggctagcagagcgcgcatggggcttctggaccagctgtgggacgacacggt

SEQ ID NO: 37861 - DNA, 497 bp, Zea mays
  Clone ID: LIB3060-023-Q1-K1-A8
accggtccggaattcccggggctcctctcggcactcgtctcagcacttcttcctcaggccgcaacccttctctgccatttgtgcttggctcccagaagcggccgagctagactcctcgtcgtgcgctgttgtgctgctccatgtccgaccgttcgtctctagctcgccatggctgctccagatcctgctcgcgagtttcccagcgccgtcagcttgccggcatccagctcgcctgtatcatggccgtcgcgccgtctttactcgttggccgtgcgttgccgcgcacacgcgcccgacaccccggttcctctgtacgccttggttgcgcgcgccgaactgcgtccttcgcagctcgctggctttagctgcaggacaccaccagccgtgccttcgtatcctgtgtcctcgactcgtccacagtgtcactcgcgaggtgctcgaggtaatggcagaattgaaaatcgtagctgtgctcatggccttcaagacatattaag

SEQ ID NO: 37862 - DNA, 350 bp, Zea mays
  Clone ID: LIB3060-023-Q1-K1-B11
aattcccgggtcgagccacgcgtccgcatcgtccttacagacgagacacgagaggcatcgagccagcgaccggcaacagttttctcggaagtcagcctcttcctcgtcgccgccgacgtcacccgccgcggctgtcggggatgccggtcagggtggtcgataccgccacgccttcctcgcagccctccccaggttcccctaccctcctcgcatccgctgtctccaataaatacgctatgcgcgcatcaggtccgctttgtacaatcaggtctagatcttatcggattacaactctcttgtgcctcggcgtgatgcgatttcgttgaatttcagttggaaagctgttttct

SEQ ID NO: 37863 - DNA, 488 bp, Zea mays
  Clone ID: LIB3060-023-Q1-K1-B6
accggtccggaattcccgggaaaggcttatcttttcaatgattactgggaagatattggaactattaagtccttctttgaggcaaaccttgctcttgctgaacagcctccaaggttcagtttctacgatgctgacaaaccaatgtatacatcacggagaaacctaccaccatctatggtcaacaatagtaagatcactgattcaatcatttcccacggatgtttcttggataactgcaggatagaacatagtgttgttggagttcgttctcggataggctccaatgtgcacctcaaggatactgtaatgcttggcgctgattattatgaaactgccgtggaaagaggagagctgcttgcagaaggaaaagttcctattgggattggagagaatacaacgattcaaaagtgtatcatagacaagaatgcgaggatagggaagaaagtggtaatctccaactcttgaggtgtagatgaagctgaaagaac

SEQ ID NO: 37864 - DNA, 353 bp, Zea mays
  Clone ID: LIB3060-023-Q1-K1-C9
tttttggttttttttttcaaccaaaacagagcagcagtggcttatcttattgaacagttttttgctctctgtctctctgcggcggcttttcttataagaaaaaaaatatttggtaaaactgtgtgtttagaagaagaaaaaaatgatatcttcagaatcagaaccagacaacgcctcaaggactgactaaacccttggcaatctccaccaggagaacgatctccatccagcatccaacgcggtgctttgaagagaaggcagtggacactggtgagtttgtgacttgttgttggtgcacgtgaagagaactttttttttcacccttcggtggacatcggccccgatccactttt

SEQ ID NO: 37865 - DNA, 365 bp, Zea mays
  unsure at all n locations
  Clone ID: LIB3060-023-Q1-K1-E1
gccggctgcaggcacggcagcggagccgcacgtcgtggaggactgcctcggcttcgtgcagctgctgagcgacggcacagtgaggcggtccacggactactccatgctccgtcccatcggccgcgtgccgtcggacacggacctgcccgtgcagtggaaggacgtggtgtacgaggacacgcgcggcctccggctccgcatgtaccggcccactggcgccgcagccggggagacgaagctcccggtgctggtgtacttccacggcggcggcttctgcctgctcagcttcgaggtggccagcttccatgccggcgcgctccggctcgccgncgagctcccggcgctcgtgctgtccgcggactacc

SEQ ID NO: 37866 - DNA, 376 bp, Zea mays
  Clone ID: LIB3060-023-Q1-K1-E11
gtccacccacgcgtccgagcaacgggtccaggactttcacgctcagcttctagcattttctgcctccaccatggcgatctcggccacggggatatcttgcacccccatcaaggtgggctccttcggcgagggccgcatcaccatgcgcaagaccgtgggcaagcccaaggtggcggcgtccggcagcccctggtacggccccgaccgcgtcaagtacctcggccccttctccggcgagcccccgagctacctcaccggcgagttccccggcgactacggctgggacaccgtcgggctgtccgtcgaccccgagaccttctccaagaacctctagctggaagtgatccactccctctgggccatgcttggttcgctc

SEQ ID NO: 37867 - DNA, 358 bp, Zea mays
  unsure at all n locations
  Clone ID: LIB3060-023-Q1-K1-G4
gtccgaccaacccttccgcaaagatttggccggaaccagcccaccccataaagtgttagatgctgtcattgccaaactgggtgaacgacaaaccgtgtgtttaataaaatttttttcctcatggactaggtaactagtcgactaggtaactagtccttactaaatgtttgttcttcgtataagtttagactttagaccaccattttgttcggcaaattcttgtacaatctttaagtatcttggttctggcctggtttgggtgtgttgtgtaactgagcanactcgtattaattttacgcattttttgtgaccttaatcttaactggaattagaagaaaattttggaacagttctcctt

SEQ ID NO: 37868 - DNA, 306 bp, Zea mays
  Clone ID: LIB3060-023-Q1-K1-H5
gtcctgaattcccgggtcgacccacgcgttcgctccgcgctagcttaagaccgtacatctgcacagaagtgcgacctacgactaccacagggcaaggtccacacatggcattccaactctacttcatcgtgccccggtttcactgtcttctgggctactcctcgcccagatcctcggtggcagagctgttcgtcctgatggtgggcataaataaggtttcgtatcagggcattctctgcgactacatcggctctgacaccaacacgttcattgtgactacgacgactctcatactgttctcggggc

SEQ ID NO: 37869 - DNA, 136 bp, Zea mays
  Clone ID: LIB3060-024-Q1-K1-A10
ggattcccgggtcgacccacctcgaatctcaagtctagcatgtgccctttatcactctttacctactcagggagtaatcatatgatcggcatagttatttgatgggcccatagtcaccctattgtcacctaatacc

SEQ ID NO: 37870 - DNA, 372 bp, Zea mays
  Clone ID: LIB3060-024-Q1-K1-A3
tatgattcttcgtttggggagttcctgaaatcttctcccccgatatttccgtagatgcttgcgcaaaaaagccgatatttcggtagatcgatttgttcttcaattgtaactgtaggtttcaaggtggctaatgaacggtaggtttcaagatggccagtaatgatatacacggagttagtcgtcatattgtactgtgttgagttttacgacttcatcgccttggtgtggttgtcctgatggagttgtgatcgaacggtgtggcttttcgctgccctttccttcacccactaaaaagcatagaatgtggagaattttaccttgagccattatagaagtttataatactttatgtgccacgaaaaaaaaaagaaa

SEQ ID NO: 37871 - DNA, 446 bp, Zea mays
  Clone ID: LIB3060-024-Q1-K1-A6
taacctccttgcagaccaacgtaagagaatcctgaattttaatcaacgtatagtgagtgcccttgatgttgctattgcattgacttatctccatttgtgttctggggacgctttaatctgttacaacttgaggacgtcaaacatcctactgacagagagctaccgagccaaagtgtgctgttctgaactgtcaaaaagtggtaatatcgtgctattaaagggaacagggggctacattgatccagagtacttggagacctcagagctcactgccaaatctgatgtctactcttttggaataatactcttagaaatcatatcttctcatgggccacaagactgggatgtattgatgaaccaccggcaaagcagtgttgtacaatgggctcttgagaaattctatgacgacctcatgaatgagatattggattaccgtatggaggatc

SEQ ID NO: 37872 - DNA, 415 bp, Zea mays
  Clone ID: LIB3060-024-Q1-K1-B5
ttccctctccaccacagccccatcccccttcccctcctgctccgccgccaccactcgtcgccccacccgcgccttctccccttggcggcgtccctcccgcccccacctcccgaggagctgctccacagtcaggccacgggtctcgtcgctgcctcacaggccaacttcatgcgcgtcatcgtggacgccacggccccggggctggaccaccaccgcggctccgacctgctctgcgtcgtccgcgcgctgctcaagaagatccgccgccgcgtgctcgtcggtgaccgcgtcctcgtcggggcggtcgactggaccgatcgccgcgggatgatcgaggatgtcttcgagcggagatccgaggttgtcgacccgcctgtcgccaacgtcgaccgccttgtcgtgctcttctcgctcg

SEQ ID NO: 37873 - DNA, 333 bp, Zea mays
  Clone ID: LIB3060-024-Q1-K1-C1
ttcccgggtcgacgcacgcgttcgcggacgcgtgggttctcctggtcgatgggctgcctgtgatcggcttatcccctcctgatggcattctcaccgagcttgtgtcaatctgcgttcgcggcggcgtttcttttggcctcgcaagccgcggacgatgaaagaattcccgggttttatcgcaaggacaacacctatttgatgctttctggaactagaccatacaacctgatggtaaaatgatacttaattatgacacggaaaatggtacaagacaagagttcatcacaagacacggtacagaaaagtgggcatgctgtacctgggaatggttct

SEQ ID NO: 37874 - DNA, 458 bp, Zea mays
  unsure at all n locations
  Clone ID: LIB3060-024-Q1-K1-C2
cggaattccgggtcgacccagcgtccgacggccagcacatcgacacacactagcacagaagagaaacgggcacacgcacgtgagaggcaaccaatattcaccgtcggcaatgggcgacctgatccctgggctgccggatgaagtggccagggagtgcctcgtccgggtgggcttcgaccagctgccggtggtgcgccgcatctcgcgccagtggaagtcggaggtggagtcgccggactaccaccgccagcgccgggcggaggggctggcgcgcccggtgctcgcgctggtccaggcgcagccgacagcgccgccggatgacgacgacgacgccggccccgcgcacaagcgctcgacggcggccaactcgtaccggctggtgctgctggaaccggccgagggacggtggacgccgctgccgtccncgtctgggccaagccagagcctgcctctgttct

SEQ ID NO: 37875 - DNA, 452 bp, Zea mays
  Clone ID: LIB3060-024-Q1-K1-C3
tccggattccgggtcgacccacgcgttcggggtcctggcgtccttggaatgcctacgtatccatatctctatggtgatgacctggtaggggtcctgaagaagaagcatgctgccgggacctacaaaagcctggtcttttaccttgaagcatgcgaatctgggagcatctttgagggcctcctgccgaatgacataaatgtgtatgcgaccaccgcgtcaaatgcagaggagagtagctgggggacgtactgccctggcgagttcccgagccctccaccggagtatgacacttgcttgggagacctgtatagtgttgcttggatggaagacagtgatttccacaatctgcgaactgaatctctcaagcagcaatacaacttggtcaaggataggacagcggttcaggatacattcagctatggctcccatgtgatgcaatatggttcattgga

SEQ ID NO: 37876 - DNA, 170 bp, Zea mays
  Clone ID: LIB3060-024-Q1-K1-C4
tttattttatttattttgtttggttttatttattgtttggtgtttaaaaattattttttatttttttatttttgaaaaaaaaataattttttatttttttttttattagtttaaaacagataacaaaaaaaagtaacaatcaagatgctattattttatataattttata

SEQ ID NO: 37877 - DNA, 473 bp, Zea mays
  Clone ID: LIB3060-024-Q1-K1-D3
gtccggaattcccgggtcgaccgacgcgtccgcatcgaaacgcaaatcagagagacaggaaaagaaaaaagaattttgatcaaatcaagagagggaaggatcccttacctgatttgaatttcatcctcctttaaataggatatgctctaagtcttcccatactttcctataatgactgcaacgattttctccattttgcgaattcctattttatttgaagtatattactatcatatacattatctaaatcgatccactttaaataaaatagaaaaaatcgaaagaaaaaaaaaaagaaagagtaaataataaaacaggatattctgtttcataattctgaaatagagttcttttttttagtattactcctcattaggatgtatatattaatcatcctattttaatatatattaatcatcctattttaattaggttctaatccaattagtagtaagtattttcttttttattta

SEQ ID NO: 37878 - DNA, 448 bp, Zea mays
  Clone ID: LIB3060-024-Q1-K1-E1
cggtacggaattcccgcggcgagccacgcgtacaagatctttcatcaaacaaatatagttgtgaaattcctggaactttacgacagcttggacaaatacacaccattcaaatggaccaaaacattcttactggaaacattccgcccatatttagtcgactatatagcttgaacttgctcaatctttcccataacaatttatctggccccatgccaacttttctaagtggtctaaatcttagtaaactagatctatcctacaacaattttcaaggacaaataccaagaactggtgtattcaataatcccacaattgtttcactagatggcaatccagaattgtgtggaggagccatggatttgcatatgccttcgtgccatgatacttcaaaaagagtaggtagatcaaacttattgatcaaaatattgatcccaatttttgggttcat

SEQ ID NO: 37879 - DNA, 481 bp, Zea mays
  unsure at all n locations
  Clone ID: LIB3060-024-Q1-K1-E3
ggtccggaattcccggggagcttcctcttgagccgtctctttcaaggactttgattgaagcaaatgaattgggatgcctatctcaggcggtaagtgttgcatcgattttgtcagcagaaataacattgcgatcagttagcaaggacgtggtggatggaaagaggaaaaggcaggagctccctgatgggtctggctggggtgaccatatacaattgcttcagatatttgaaagctgggaccaaactggctatgacacaaaatggtgctctcatcatgatttgcaggtgcggggtatgaaattgagcaaagatgtgaggaaccaactatgtcagattattcaaaaaattgcaaaaggttcaactgatgtggatgcaaggaaaagccggaagaatgaccctgattatagaaagctgangagagctctctgcgtangatatggtaaccagctagctgagaggatgctgcatcacaatggctacca

SEQ ID NO: 37880 - DNA, 369 bp, Zea mays
  Clone ID: LIB3060-024-Q1-K1-E6
cgacgccaacgggagaaagggcaagggcaagggcgtgtaccagttcgtcggcgggtgcggcgcgaacgtcgacggatacagcccaatctacaacgaggatgactggtctcccaccggcgacgtctacgtcggtggaaccactgggcttctgatctgggccgtcaccctcgctgggatcctcggcggcggcgccctactcgtctacaacaccagcgccctctacggctaaggatatccaatgcatgcgcttcttgcgattcgtcatgtaaaatcagggtgtctgtctataatctagcctccatggatgctcaaccttcgtcatgtaacaattatcagtgctactctgcatacataattttgatgctatat

SEQ ID NO: 37881 - DNA, 275 bp, Zea mays
  Clone ID: LIB3060-024-Q1-K1-E7
cataagtgcacacaggtggaatagggcgaggatggtctggtgcaaaggtgaagtaatggcacagattgtgtatgtgtgtgtcctgtttttcagaagttttaccttgcgtaggccagatttgtcgattcttagtcgtctgtatttggctgtattcaattgaattgtgaaatgtatcagttgaagttatgcgtagacattcacttcaaaaaactatgacacaaaatggtgctctcatcatgattttgcaagtgccaagtatgaaattgaacaaagat

SEQ ID NO: 37882 - DNA, 452 bp, Zea mays
  Clone ID: LIB3060-024-Q1-K1-F1
ccggaattcccgggtcgacgcacgcgtccggtttagttagggtggccatttggtgcattggtgaatatggagaaatgctggtcaacgatgggagtatgttagacatggaggaaccgatcacggtaactgaatctgatgctgtggatgccgtagagattgctcttcagcgttactcggcggatgttactaccagggctatgtgtcttgtctctcttttgaagctttcttcccggtttccaccaacatcagagagaataaaagaaatagttgcgcaaaataaagggaatactgtgcttgaattgcagcaaagatctattgaattcagttccattatacaaagacatcagtcgataaaatcatctttgcttgaacgtatgcctgcattggatgaagcaaattatttggtgaagagagctgcttctacacaggctgcaggttcatctgtaaattct

SEQ ID NO: 37883 - DNA, 402 bp, Zea mays
  Clone ID: LIB3060-024-Q1-K1-F12
ccggaattccggtcgacccacgcgttcggcggagcagacgcgcgggcgtgctgcgcctgctgcccattggcggcgagccggcgtctgcgtggtgtacgcgcagatatgacgctgttcaacaagcaggggcgcaccctggaccgccacatcggggacggccttgagctgcctccggcggcgctgcagacgctgggccccgcgagcatcctgctgttcgtgcctgtttacgaccgcgcggtggtgccggcgctgcggtgggcgacgggcaacccgtcggggctgagcatgctgcagcgcgtgggcgcgggcatggcggtgtcgctggcgggcgtggcggtggccgcgctggtggaggcgcggcggctggcgatggcgcgggagcacgggttggtggacgacccg

SEQ ID NO: 37884 - DNA, 461 bp, Zea mays
  Clone ID: LIB3060-024-Q1-K1-F2
ggtccggattcccggggcgacgccacgcgtccggccggacaaagctacgcaaggagggagaaagcgtgtaaaccatggcgtcctccgcgtgccgcaacgctctcgtcctgcgatcgccatcaccgtcgctctcgtcctcgtctaaccgccgcagcaccggcgccttcgcgttcccgaacccaccgcgcttcccatgcctgcgttctgcgcgtcgactcgtccttgcgagggcggcggcagcgccggcgccgggcgatggccccgaggacgagtgggggccggagcccgagggcggttccgctgtcacgggggccgcggtggcggaggcgccggaggcgagagaggtcgcggagctcaaggcgcagctaaaggacgcgctgtacggcacggagcggggcctgcgggcgttcagcgagtcacgagccaaagtgctggagctcatcacgcagctcgagacgcgc

SEQ ID NO: 37885 - DNA, 472 bp, Zea mays
  unsure at all n locations
  Clone ID: LIB3060-024-Q1-K1-F4
ggtccggaattcccgggagaaggccgacgcgctgcagaaggtcatagtcgacgcagggtacaggccggttcctaacgcgagaggcgaggaggtgctggcgaagaagtacaggatcaggctgagggggatcgatgcgcccgagagcgcgatgccgtatggcaaggaagccaaggaggcgctgctcaaacttgtccaggggaagagcttgaaggtctacgtgtacgacgaggaccggtacggtagatgcgtcggagacatctactgcgacggggtatttgtgcaggagcaaatgctgaagaagggtttcgcgtggcactacaccgnctacgatcaacgcccggagctggccaagtgggagaaacaagcgcagaccggccggaagggcctgtgggcggcgtcgaagccacagaaaccatgggagtggaggaaggacaagcgcaacgggacagcatgaacaaacccncccgtgcat

SEQ ID NO: 37886 - DNA, 249 bp, Zea mays
  Clone ID: LIB3060-024-Q1-K1-G1
tatcgaggtagcgtctgctactcgtatgttattacacttcttgcaaatatgctcaggcgggtacgcactgaagccgagtaccaagcaaatgacataaactaacatgcagactagacaacccaactgaatacatgtatctcaatgcatcattctgcaatcatctttactgaaaaatattaaaccgctcgatacacgaaccttttcttttcgtaagattcataatatagatagtcactgacatgttctatt

SEQ ID NO: 37887 - DNA, 480 bp, Zea mays
  Clone ID: LIB3060-024-Q1-K1-G3
gtccggattcccgggtcgacgacgcgtccgtggtcaaaggtgtcacatatcctcttcgtcgattcaccggttggagctggattttgcttggcgagagatcccaaaggctacgatgtcggagacatctcggcctcactgcagctacaggaattcctcatcaagtggttcagtgatcatcccgagtacctcgcgaatcctttctacattggcggggactcctatgtcggaaaaatcgtgccgttcctcgggcagatgatttcagaaggtattgaacttggaagaagacccttccctaacctcaaaggctatctggtgggtaacccaatcacgggcgaaagtatagatttcacttccagagtgccctacgctcatggagtcggtatcatatcagatcaattgtatgagacgatattggggcattgccaaggagaggactacactagtcctgcaaacgctctgtgtgctcaggctctggacact

SEQ ID NO: 37888 - DNA, 445 bp, Zea mays
  Clone ID: LIB3060-024-Q1-K1-H1
ccggtattgccgggtcgacgcacgcgttcggcccttgcgagtccaaaccctaaacctaaacctctcacccggcgccgtcgccgtcaccggggtcgtcccgaggccccatcccagcgcaaccgacttccgcctcggattgaagcaatgtcgtcggacgacgaggtcagggaggagaatgagctcgacctcttctccaacgatgtcgtcaccaagtacaagactgccgaccaaatcctgaacaacgctctgaagctggttgtgtctgagtgcaagcccaaagccaagattgttgacctttgtgagaaaggtgactctttcataagagagcaaactgggaatgtctacaagaatgcaaagaggaagattgaaaggggcattgctttcccaacctgtgtttctgtgaacaacacagtctggcacttctccccgcttaccacagatgatg

SEQ ID NO: 37889 - DNA, 314 bp, Zea mays
  Clone ID: LIB3060-025-Q1-K1-A12
accggttcggaattcccggctcgacccacgcgttcgtggcttctcctccccctccggttcgggttcgggttcgtgaggttctccgggggtcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggttccgcggattcggcttcggcaccttctgcacggaggaggcgatgcggaacgccatcg

SEQ ID NO: 37890 - DNA, 380 bp, Zea mays
  unsure at all n locations
  Clone ID: LIB3060-025-Q1-K1-A5
cggttccggaattcccgggtgcgacccacgcgtgccgggncacccacgcaccactcttctcccccacgagtcccggtaccccgtgaggagccggagccggtgggcgtccacctcctgctgccgtcctccaccagtcaactcgcccgcctcggacgcgtcgccgcgcctggccgccgccccgccgcgcagcgcccagctgctcgtctgcaaggcccggaagcaggaagccgccgcggaccagagcgacgtctcgcgccgcgccgcgctcgcgctcctcgccggcgtcacggccgccgccggcgccaaagtgggtcctgccgccgcggcatacggagaagcagccaacgtgttcggcaagcccaaggcgagcacggagtaca

SEQ ID NO: 37891 - DNA, 367 bp, Zea mays
  Clone ID: LIB3060-025-Q1-K1-A8
caaaaatgaatggcgcaggccatcgatagattgattcatccactgatgacgatacatgcgtctgtgcttagtttacatcgaccgcttacagcaggcagccattgacattgattgatgagcacacatcgatcatgagcatacgccggctggtgcaactactacacgcctacgatctgaacaagtagagtacagagaagaccacactgttcactcgacggacggacgaacgaatggatggatctgatggtagtacacatgtacggcgttgctcagtcagttagttgccggggacgaagttcgtggcgtatgcccaggcgttgttggcgacggggtctgcgacgtggtcgaagaggttctcgatggggcc

SEQ ID NO: 37892 - DNA, 441 bp, Zea mays
  Clone ID: LIB3060-025-Q1-K1-B10
ccggttcggaattcccggctcgacccacgcgtgcgcaggcattcgcgtaaacgatgcggagttagctcgtgacgatcggaggccatgtgctgggcgaaggtgagtggctgtcgctgaatgggtccactggcgaggtgatccttggaaagcagtcgatttccccaccagcccttagtggcgatctgggaactttcatggcctgcgtggatgatgttagaaagctcaaggtcctggctaacgccgatacccctgatgatgcattgactgcgcgaaacaatggggcacaaggaattggattatgccggacagagcacatgttctttgcttcagacgagaggattaaggctgtcaggcagatgattatggctcccacgcttgagctgaggcagcaagcgctcgaccgtctcttgccgtatcagaggtctgacttcgaaggcattt

SEQ ID NO: 37893 - DNA, 412 bp, Zea mays
  Clone ID: LIB3060-025-Q1-K1-B9
ccggttcggaatccggctcgaccacgcgtccgctccggggttcggtttcgtgggtgggcggatcgagatggcggcgtcggatgttgaggaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggcggctacggtggtggccgtggaggcggcggctacggcggtggcgggcgccgtgatggcggc

SEQ ID NO: 37894 - DNA, 234 bp, Zea mays
  Clone ID: LIB3060-025-Q1-K1-D12
tcagaactggcgtgggcgccaataactcagaagagagacttggctatatagatatagctggtgctaataaataggagtataatcgtcatatcgatcggttgcgtgtggaatgccaatcatgtgtgtaatctgttggcaaataacaaacctctgttcctccctgctgctgttgtccgtgcgatcatgattcagaactggcgtgggcgccaataactcagaagagagacttgctgt

SEQ ID NO: 37895 - DNA, 447 bp, Zea mays
  Clone ID: LIB3060-025-Q1-K1-D2
gtccggaattcccgggctcgcgcttccgctttcgttctcctggtcctggccatggccttcgaacgggagccgctcctgcagcaacgacggaccggcgtcggcaatgcctgcggtgccaaggactcgtcctcggcgccggcgccgtcggctgccgcgctgccgtcgctggctaggaccgtgctcaagttcctgatgtgggcggtgttcctcacctgggccgcggggatcttcctctacccgaccaagcccgtgcaggccgtgttcaggaagtgggtcgggctcaccagggactccatgttcggcatcgccgggggtattttcctgaccttcagcgcgccaattctgatcattgcgcttctcgcatatgtgtacatctccttcttcccgagtgagcatgtggtggagaaaaggaagctgcgctcactgagtttcaggctctgggacttt

SEQ ID NO: 37896 - DNA, 380 bp, Zea mays
  Clone ID: LIB3060-025-Q1-K1-D6
tgctttgactgtttgggaaaaaaaagggtcagtacatgtatgtgtaaaaaatctttcttgaacggctaacagcaattttacactctactagggctacatcgatccgagcgtcattcctactcgacgactcaacaaaatcctgggcgtggtaaagagtgctctacgacctcggcagtatcttgccgttatacatcttgtcgagcagctgcttggcttctgggcgtcgcaggagccccttgttgtttggcaggccagttccgagacagacagggcacaccaactttccccggccgtaacaaattcggcactcggtgaattcataaacatctttcgccctcttccgattgagggccttccatttccctgtgccaccacacatg

SEQ ID NO: 37897 - DNA, 412 bp, Zea mays
  Clone ID: LIB3060-025-Q1-K1-E2
cggtcgaccacgcgtccgcggcagtgacagagaaccagagaattcataagcccatagcaagctaaagcacaggagcgcgagagcccagcaggcgccaagaaaagcaccgcccggctggtccgcgccagcgcagtatggtgacggcgatcgcggtggcgtcggcggggctcgggatgctggcgggcgtcgcgatggccaacaggtcttcgccgccgtccgcgggcgccgcgctgtggaggcccggcgggggccccgcgctgcgctggggcggaggcggaggcgccccgcgctgcgaggcgtgcggtgggtcgggcaaggaggactgccgcctctgcgcgcgctggtccgacgccggcgcccgcgggaagaagattagccgctccgggtgcggcgcgtgcgccggcacgcgccg

SEQ ID NO: 37898 - DNA, 254 bp, Zea mays
  Clone ID: LIB3060-025-Q1-K1-E7
tagcagtgcaacaagcaagatttacctgcccatcgatcatatcgtcaactgggccgggagttcgcgacaccatgagctccacggagtgcggcggccgaggctgcggcgccaagacgtcgtggcctgatgtggtctggctgagcgtggaggacgccaagaaggtgatcctcatggacaagccggacgccgacatcgtggtgctgaccgtctgcttcgaggtgaccgcggattatcgccctaaccgtgtacgcatc

SEQ ID NO: 37899 - DNA, 393 bp, Zea mays
  Clone ID: LIB3060-025-Q1-K1-F11
accggtctcggaattcccggtcgacccacgcgttcgcccgcgtctcgccgcgtagcggctatgcgccacagaaactcgcacgccgggccccgccgtccggcccgagtcgccgtcgctgccgaatccaatccatggctccgcccgccgaacccaccgcgctgcaccaccgcacgcccctcctgctcccccgccgcaccgtagtcttgggtgccaccgccaccgcgcgcgccgtcagggccgcttctctcgacgtcagggcccagccggacaccaccgacgcagccgtctccacctccgcgcctgagccggcgcccgagttcaagcctgcgccggggttcaaggcgcccgagcccaagaggtacgatgtcaagtccggccaggtgggcagcgttc

SEQ ID NO: 37900 - DNA, 425 bp, Zea mays
  Clone ID: LIB3060-025-Q1-K1-G8
gtaccggttcggaattcccgggcctttttttttttttttatatggtttcaatgtgtgtctgtatgtactgaactgtacaagcttatcgagaaagatcactgcgagtctacaacaatccacacccaacacaggcggtggacacaacccatccaataatctttcatgagtacagtgtcggagtcatcggccaatttcttcaaaattatcattaatttatgatgttcatgtaactatagtcgtaggataaggcagggccggtttggtttcatcacgcggatgggagcaccttcttgacgatctcatcactgagcgaggcgatctgggcgtcgagcgccttaacagcctcctccttctgcgcctcgaggttggcgagcgcctctacgagctcggcctccacacggctgcgcccctcgtccagcttggcc

SEQ ID NO: 37901 - DNA, 455 bp, Zea mays
  Clone ID: LIB3060-025-Q1-K1-H10
acgcgtccggaatctcgggacgagattctgtttaaggggggaaggtagggccgaaccggggcagcgcctgcaggaagagggttggacttacgggattcaactgccggtgtgggaacttgtactgcgcactccaccgctactccgacaagcacgactgcaagttcgactaccggactgctgccagggacgccattgccaaggctaatccggtggtgaaggcagacaagctcgacaagatctagggggggttccctacggttgggtatcaggaagattgtaaaccgcggtaactcgtcatgcggaactgctgccttgccccccgcgcctttctcttccatgtttgctgctacaatcttgttgttgggcattgcagtgcacggtgcacacttgtgtagcccggctcgagaatttcttgcttttgcatctggtcagttctaaaatgatttgcatgttgg

SEQ ID NO: 37902 - DNA, 411 bp, Zea mays
  Clone ID: LIB3060-025-Q1-K1-H5
accggtctcggaattcccggggtctcaatcttccaccgtgatgtcaagtcctcgaatatacttttggatggaaactacactgcaaaagtttcagattttggtgcgtcaaggttggttcctattgaccaaacccatgttgttacgaatattcaaggcacttttggctacttagatcctgagtactatcacactgggcaactaaatgagaaaagtgatgtgtatagctttggagtggtacttgtggagctactccttcgaaagaagccggtttttacaaatgagactgggacaaaagcaaaatctgtccaactatttcctttgggaaaagaagatgaaacctgttacagagatagtggctgctcaagttcttgaggaagcaacataagaagaaattaacattattgccttcct

SEQ ID NO: 37903 - DNA, 448 bp, Zea mays
  Clone ID: LIB3060-026-Q1-K1-A1
attcccgggtcgagccacgcgtacgcactcggcatcttatcccccgcctactccggtcctcttgccgctgttgctcacttctgagtccgtacgcgcgagctcccaagagctagccatggcgtccaccaccctctcctccgacttcaccctcctatcccgcccctccacctccccgtgccccggcgcctagctcccgaggtcctaccacgccgcgccccacattcgccggggccgtcgcgccgtctccgtcacgtgcaccgccaccgagtcccccaagatcctgaacctcgagaaccccatccccggcctaaccctcaaggaggcccgcaacctcctcgaccacctccagaaccggttcggagtcaccgccgtggacttcggcccggccgcccttgaaggggcccccgggtcgaacgcctggcccgcgtccaagaaggagccccccttc

SEQ ID NO: 37904 - DNA, 275 bp, Zea mays
  unsure at all n locations
  Clone ID: LIB3060-026-Q1-K1-A2
gaattcccgggtcgagccacgcgtccgcgggtgacgagaggggtccctacgcccgcctttccaaatcctcgctcgctcgcgacgaccgccggcggcgccgccgaggctgacccgcctctgtccgatgcccccacgcgcgccgncgcgccggcggcctgctcccgccgcgggaggccccggcttcggcgactccgcgcgtgtgctgctcgcgctggccgcgctctacgccgccatgtcgctcctcgcctaccgcgtcatccacatgcgccacgtcg

SEQ ID NO: 37905 - DNA, 499 bp, Zea mays
  Clone ID: LIB3060-026-Q1-K1-B8
accggtcctgaattcccgggtcggcccacgcgtccgagcgaaccaaaagggagaaataacataaaaagaatagagacacacacacacagctctgggcttgttattccaatcctctctcatcttgctggttcatccttgggatcggctctgtcgtcccctagctagttcgttcggtgctgtggtttctgccgctatatccaagaactcttgctcttgctgagtctggactctgggacttcagttccttgcagagccaggctttacatatcttgggtgccgcacacagtatctatgcacctttgacaacaccaatctgattctgatgacaacaacagccactatctcccgtcatccttgcatcgatctgtcagctggcgtcgcctcgtgcttctgaagacgatggccacattcttctccacttccacgaaccagagggacctcgccggaggcggcggcgacatgtcgtcgttccaccactacgcctactcggacccaccag

SEQ ID NO: 37906 - DNA, 291 bp, Zea mays
  Clone ID: LIB3060-026-Q1-K1-C1
aatttccgggtcgacccacgcgtacgagcacagacactcaagcactgagcaaagcactctattcctagcagtagcgacggcgctggcgggtgcggctcatatcccgccgacggtggtggcggctgctgctcatctacggccattcgtcggcctcgtcgtcagcctcaatcccgtctggagcttgtctgtctacccgaccagagtacccggtgctgctgccgatccagcgcccttactgaactaaaggaaaaaggcgcactagattaataacaccatggttccaagaaacat

SEQ ID NO: 37907 - DNA, 390 bp, Zea mays
  Clone ID: LIB3060-026-Q1-K1-C11
cgggtcgacgcaagccttccggccagggcaaggcaatcaagtccggtttcgtgaaggaacacctgtgcttccaaacggtggggggcttcacggccgccacgctgaaccacggcatgcacccgccggtctttcccaagcccaactggcgcaagctcatggacgagatggcggtcgtggccacggaggagtcccgctcggtcatcgtcaaggagccgcgcttcgtcgagtacttcagatcggctacaccggagaccgagtacgggaggatgaacatcagcagccggacagccaagaggaggcccggcggcggcatcacgaccctgcgcgccatcccctggatcatctcgtggactcagaccaggttccaccttcccgtgtggctgggagtcg

SEQ ID NO: 37908 - DNA, 446 bp, Zea mays
  unsure at all n locations
  Clone ID: LIB3060-026-Q1-K1-C12
ggtccggaattcccggggccaagaacaccagtgataaatcaagctcatattcaagttcagctgatgaagtgggcctaactggaatcagcagcagctatccaactgagggaaatgagagttcacaacctgatattgaggtagcagcgtcagtatcttgcaacttggttccagatttggctccacaagctgcttctgatgatttccacatatcagatcctcactctttacgtcctgaaaacaagggtgcatccaacagtcggagctccaataacttgtgcacagatccttttgctgcagaagcaaaggaagctcgatgtgtgaagctactaacagagaataattcccaagaaccctgtaagtggtattctgctgctggacacttgtcacagaagttgggttcctgttggaaagaaagagacttgcaatgggatctgnttagatgtctc

SEQ ID NO: 37909 - DNA, 368 bp, Zea mays
  Clone ID: LIB3060-026-Q1-K1-C2
gaatttccgggtcgacccacgcgtacgctgctgggcgctctcctctcccgacgacagctacacctcacaaccgtgagctcgccaaggaacggtgtgcgcaattccggcgccggcaccatgagtaagctgcatactgattctctgagggacaccattgcctcaattaccaatgattcccgtgagaagcagctcaaatttgttgaaaccattgagctacaaattggactgaagaactatgaccctcaacaggacatgcgcttaagcggttctgtcaagctgcctcacatgcctcgccctacgatgaacgtttgcatgcttggtgatgctcagcatgttcaggaggcacagataatggttatagacaatat

SEQ ID NO: 37910 - DNA, 371 bp, Zea mays
  Clone ID: LIB3060-026-Q1-K1-D7
aattaccggtcgactcacgcgtccgggttggcggaataagaaccccaaagtacctttacgccatgaagaacctcatgccacaggcctgggacgagcttgttgagaactgcaacatcctgcagagccactacaaggaaatgcatgatatcgagttcactgtccaggaaaacaagctgtggatgttgcagtgcacgacagggaaacgtactggcaaaaatgccgcgaagatcgccgtggacatggttaacgagtgccttgtagagccccgctcagcgatcaagatgctagagccaggccacctcgaccagcttctccatgctcagattgagaacccttcagcgtacaaggttcaagtcattgccactggactg

SEQ ID NO: 37911 - DNA, 331 bp, Zea mays
  Clone ID: LIB3060-026-Q1-K1-E1
cctgaatttccgggtcgacccacgcgtacgcgacttgatgccttcagctcagacttctagctctcattcagagatgggctcgtggaccgcgcctgcctgcagcacaggaaggcccagccaatctatcaagccttgccgccttaagtcgtatgtcatgtcgtttgattccgatacgctccagaggtatgcgacagtcaggtcaaaggaggccttcggcatcattgagaagcacacggaagcgctatttgggaagccagagattgtgatcacacctgaaggcacccttgattcttccaaggatgagcatattacgataagctttgctgggctg

SEQ ID NO: 37912 - DNA, 442 bp, Zea mays
  unsure at all n locations
  Clone ID: LIB3060-026-Q1-K1-E3
gaattcccgggtcgacccacgcgtacgctcgcactcatcagttgcaagaggttctggtggtcccattctgcctgtgactagcagtgaacagggcagatggcaaatgtggagcacgccattggttcaggaaagtttaggtttgcaaggtcctcagagtcagtggtttcaacaaaacacaaatcaatttaaccatagtgctaaccttttcagtagtgaaggcagggcaagaagtcccctgggtactggtttgaatgacagtgatccatggcttcagaaagcaccttttcaacaattgccacctgatacatcaagcctggtnctttcacatgaaatgccagaaaattggcccaatgcttggcttttgggtcttcaaaccaaataacccgggaacaacccttttggccaacttggtaattggtggcttaaggaggacctgggcttg

SEQ ID NO: 37913 - DNA, 299 bp, Zea mays
  Clone ID: LIB3060-026-Q1-K1-E4
gaattcccggggcgaaaaccgctgactctgtaagcagattgcgtcaagctttcactgcggtaccgatatacgctagagctcaagacctgtggcatgtgctagatcttaagaaagcaggcgcaacagacgttgtcctggaaaatgccgagaccagcttgcagctaggttcaatacttttgaaaggactgggcgtcatgtctgatgatgtatccttcttgagtaagcttgtgagggactcaatggagctacaagctcaagaagcactgaaagacattgcggaccaagaagttgatattatg

SEQ ID NO: 37914 - DNA, 455 bp, Zea mays
  unsure at all n locations
  Clone ID: LIB3060-026-Q1-K1-E5
tcctggcgtgcgacgccttcggcgtgctcccgccggtgagcaagctgaacctggcgcagaccgtgtaccacttcatcagcggctacaccgctctggtcgccggcacggaggacggcatcaaggagccgcaggccaccttctccgcctgcttcggcgcggccttcatcatgctccacccgaccaagtacgccgccatgctcgccgagaagatgcagaagtacggcgccaccgggtggctcgtcaacaccggctggtcgggtggcaggtacagcgtgggcaagaggatcaggcttccctacaccagaaagatcatcgacgccatccactccggcgagctcctcaccgncaactaccagaagaccgaggtgtttggcctggagatccccactgagatcaacggcgtgccgtcggaaatcctcgacccgatcaacacctggacggacaaggccgcgtac

SEQ ID NO: 37915 - DNA, 450 bp, Zea mays
  Clone ID: LIB3060-026-Q1-K1-F1
gaatttccgggtcgacccacgcgtgcggctgaaaattcgatggagggaaacgccttggctctcgggatgcccgcggatgctacttgtgcgggcatgcgttgcaactctggcaccgattccgttccttccttgcggcggcggcggaaaaacaggagcttctccatccttcccttcgttcgtgctcttcttcttgttattccgtttatcggtctggcgcagaaagaaacaagagatgcgatctagtctgctaccggagtccccgtacgtacccagtgctccgcggcttcggcaggggtgctgctggctgcagacgctgatctgtatccacccggcaaccgccgtccgggttcttcattgtaaccggggaagaatttggggctggtggcttgtggtttcaatgggcttcaccagaaaccagaacctttttggcaatttccttggggttcaaaa

SEQ ID NO: 37916 - DNA, 231 bp, Zea mays
  Clone ID: LIB3060-026-Q1-K1-F4
agcattgcatatgcttctaggttttgttttgtatgcaatgttgtgatatcagagagatatctgggttggtatattttatatgatgacgatgagaactaagtacaagtgcttttattttttattattcctaaagacaacttttgtatatgtaacatcatgaatgtttgaggtgtctcatgtgtaactttaattaatatcaatttatgcatgaaatattatggatggttcaaa

SEQ ID NO: 37917 - DNA, 323 bp, Zea mays
  unsure at all n locations
  Clone ID: LIB3060-026-Q1-K1-G3
tatctggatcccctttccctctaccgtcctcgttcccggccgtccgtgccgaaggaagcatcgggtgagccagcccatccacctcgctccctcgaccgacccacccagcccagcgcgagctcgcatggcgatgctgctccgcaaggtgtggggctccgtgctggctcgcgccgcagcgtcgggggccgacccgcgggcccgccgcgcgcatgcgcatcgtgcggagcagtaccagtaccacggctcgctatcgctgggcgcgctcgacgccgatcncaccgacgtgctcgaccagatcctgcgcctgctggtccccgctcgac

SEQ ID NO: 37918 - DNA, 258 bp, Zea mays
  Clone ID: LIB3060-026-Q1-K1-H3
aattcccgggtcgagccacgcgtccggcaagggaacactgtagctaactattcacctttcgcccacacgactattctatctagagtacaggcgacttcaaaacagacacacagtcccgcgctgcctgatctctgaccttgttgacaactaccgaaactccaaccacctgatcgcggacaccgtatcttcctgactgagccttgaacccaccgttcaccaccagtcccgcactttcctctagtgtgacactgacgaaca

SEQ ID NO: 37919 - DNA, 57 bp, Zea mays
  Clone ID: LIB3060-026-Q1-K1-H4
gacgccccctgtagcttcacattaaccactgcccgtgtgatctgctactcgcatacc

SEQ ID NO: 37920 - DNA, 209 bp, Zea mays
  Clone ID: LIB3060-027-Q1-K1-A1
ataacatacgtctctttgggcgaataatctgtatattattctctatggaaagaaccctcgcgcccgtgctgtacgtttcgtcgtggaaagaaccctggggtgtgtatttgtttcatcaatcatgccagccgatttgaatctcgtttcaccagcatgatctgatttgggtatacaagtataaaccgcaacgagcgatcttgtaaaaagag

SEQ ID NO: 37921 - DNA, 265 bp, Zea mays
  Clone ID: LIB3060-027-Q1-K1-A2
ggaattcccgggcccggagcgcgtggtgcacgcgcgcggggcctccgccaagggcttcttctagtgcacccactacgtgacgtcggtgaggtgcgcctacttgctgcgcgcgcccgacatgcgtacgcccgtgatcgtgcgcttctagactgtgatccacgagcggtggtgcttgaagacgatgcgcgacccgcgcggtttcggcgtgaagttctacacgcgatagggcaactggaacctgctgggcaacaactgtcgggtgttc

SEQ ID NO: 37922 - DNA, 427 bp, Zea mays
  Clone ID: LIB3060-027-Q1-K1-A3
taccggtccggattccagctcgcgccctcagacaagcgcccttcacgatacgcactcaccataggaaaagggcaaaagccaaaaggcatgagcgccgcgacgacgatggcagcctcgctccaagccgcggccaccctgatgcagccggccaagatcggcggccgggcgccctttgcctcgctgccgtcccgcccgtcgtcgcaactcgcctgcagggcgttcggcgtcgacgccggcgccgacaggatcacgtgctccctgcacgacgtcgccagcaggtgcgtcgacgccgcgaagctagccggcttcgcgctcgccacctcggcgctcctagtctcgggcgcgagcgcggagggcacgcccaagaggctgacctacgacgagatccagagcataacgtacatggaggtgaaaggcacgggcacgg

SEQ ID NO: 37923 - DNA, 446 bp, Zea mays
  Clone ID: LIB3060-027-Q1-K1-B5
ggaattcccgggtcgagccacgcgtccgtggcccctccgaatctccgtatgggttttcgggggcgacacgtacgccgatgcggtcgagtgcggaaacgaaccttcaccggcggggaagctcaatacaggcacgatgcatccaggcacaaatcgatcgatttagaaacaagaatcaaaggtgtgcgagccgagagacgaacacgagagcaaatccttccttaatattcatggacagcgcaacgctgacctgcaacaaccgaagccgaccacaggcatccgcaagacagcaagtgaagctcagatcggcgaactgcggccttatgcgcttcgcctaggagcctacggagtactgagaacagagcagcggaggatcatggcacaccttcaattcttgcggcgccagaagcagcggagcttgagccggcgcgctaggacattggcgatcg

SEQ ID NO: 37924 - DNA, 426 bp, Zea mays
  Clone ID: LIB3060-027-Q1-K1-C3
ggaattcccgggctctcccccgtctggccgtgcagccccggaggcgtcactggccaaggaggctggggtggggacctaaaacgccatggatgtgcagccctaggcaccagatattaggatggatggagtcacacaagctgttgaaaatcttaagaaagaatggggccaagcagtttcacagcttgacgagaacattactgcaatcaaatcatgtggaaaaacagggaaagggacagaggaagcaaattctcttccaaggttgaatggttctgcacaggatgctctgcagttgctgaagtcactgcagttccagctggatcttctagcacagcagcttcccacttttgatgaggtgcagtctggtcaagcaaccttgaagtcatgggatgaacaatacaagaagcttcgtattagcttgaggaatgc

SEQ ID NO: 37925 - DNA, 405 bp, Zea mays
  Clone ID: LIB3060-027-Q1-K1-C7
cggattcccgggtcgcccacgcgtccggggcaaaagccaaaggcattaccgcgcgcgacgatggcagcctcgctccaagccgcggccaccctgatgcagccggccaagatcggcggccgggcgccctttgcctcgctgccgtcccgcccgtcgtcgcaactcgcctgcagggcgttcggcgtcgacgccggcgccgccaggatcacgtgctccctgcaggacgtagccagcaggtgcgtcgacgccgcgaagctcgccggcttcgcgctcgccacctcggcgctcctcgtctcgggcgcgagcgcggagggcacgcccaagaggctgacctacgacgagatccagagcaaaacgtacatggaggtgaatggcacgggcacggcgaaccagtgcccgaccatcgac

SEQ ID NO: 37926 - DNA, 385 bp, Zea mays
  Clone ID: LIB3060-027-Q1-K1-D12
ccggttaggaatcaccggctcgacccacgcgtgcggtgcgtcccaccacgctcgatttatatttactgcaacacaagccttttagctgtgtcgaccgctgactattggatcacaagcactgcccattcttatttacacgacttggcaaaaccactttaacacaccacatgggctactccatctactgcctatgagcgcccaactaagtgtctactctatactacgcttgcttcccttaactgagcctgctcaaggccaccactatgttcccttagctcacgattccctggatcgaacctttctactacatctcggtctccaagaacgcctacaacacgtgataagctctttggcacgtagacacgctgaaagcttattggaacaa

SEQ ID NO: 37927 - DNA, 198 bp, Zea mays
  Clone ID: LIB3060-027-Q1-K1-D9
cggattcccgggtcgaccccgcgtccggtgccgctgcttcgtccctctatctatctagccttcccggtcctgcatcccagctgaggttggcacgctcaacacgccggtcgcgtcggcggcggctactcttctgctgctggtcgcgccgctcgccgacgctgccgacagcatggtcatcgtctactacagggatccgag

SEQ ID NO: 37928 - DNA, 417 bp, Zea mays
  unsure at all n locations
  Clone ID: LIB3060-027-Q1-K1-F2
ccggaattcccgggcctctctcccctcccgctttcttgcgtccccggcgaccggcgcattggaacctaatcctcccaatccccaacgagtcagccaccctctccccgcctccggctgcgaccaccgcacccgcgaacttgccgggccgctcggcgctgcacaccaagcccggggatggccgccgcgcttgcgagctcgccgcttgttcacctaactacctcccgtctccgcctccccaggccccaagcctccgcttccagttcgggtccagtctgctcgatcggcgtgtgcttgggatggaggctcaaggtcgggtggagagccctgaggcggcgcgaccggcttcgatgcttctccaccgacggtggcggccggngaggagggggaaaagcgtggcgaggaggaagcatcggcaac

SEQ ID NO: 37929 - DNA, 426 bp, Zea mays
  Clone ID: LIB3060-027-Q1-K1-F9
cggaattcccgggtcgacccactcgtccggcctccgccgccgacagcagcgtactgttttgtatctcccgagaagggttgtgagaaggagtagtatcctcaatgtccacgggaggaagctgttgatgctgaggtcctcattgaccgacgtgccagcagaggtcccggcggtccaggtggccgatgcgcccaaagcgaaaaatgcgcccacagagaagaaggcgcctaaggagaagaagctttccgcggcgaaaaagccggcggcgcaccctacctacgctgagatgattgtagaggcgatcgctgccctcaaggagaggaaggtgtcgagctcggtggccatcatcaagtacgtctagggtgagcatggcggcaaagctcacaccaacttgcgcaagcagctcactgtgcagctgaagaagctcgc

SEQ ID NO: 37930 - DNA, 392 bp, Zea mays
  Clone ID: LIB3060-027-Q1-K1-G10
tgcgccatggccaccaaagcaggctcctcactgtcgccatgcatcaggctcgtggaggaatccctgctcctcccgacgcaagacgccggcctcttcgcaaaggccttcgtgctcatcttcgcccacaccttcctcttcatcgcggtcgccgtccacttcgctcacccactcgccacggacatcctcgccgacatcaaagcacaaaggagcagcagcaggaccactaccactaccggcgccgcgagctcaaaccactccaaggagcttgcgttgctagcgatctacctctgctacctcgcgagcaaactcgccacccagctcgtcaccgccctcgccaccgccacgacctactccggcgagcgcctcacgcgtaaagtggtcatggagaggat

SEQ ID NO: 37931 - DNA, 424 bp, Zea mays
  Clone ID: LIB3060-027-Q1-K1-H11
cccggcccgacccacgcgtacgggcgacgaccgccagcagcggccggatcaccatgggcaacgacctgtggtacggcccggaccgcgtcaagtacctgggccccttctccgcccagacgccctcgtacctgaccggcgagttccccggcgactacggctgggacaccgccgggctgtccgcggacccggaggcgttcgcgcggaacagggcgctggaggtgatccacgggcggtgggcgatgctgggtgcgctgggctgcatcaccccggaggtgctggagaagtgcgtgcgcgtggacttcaaggagcccgtgtggttcaaggccggcgcgcagatcttctcggagggcgggctggactacctgggcaaccccaacctggtgcacgcgcagagcatcctggccgtgctcggctttcaagtcat

SEQ ID NO: 37932 - DNA, 166 bp, Zea mays
  Clone ID: LIB3060-027-Q1-K1-H2
gtaccggttcggaattcctgcatacaagcacttggacgtgacacgggcccttcacacagtacacttcaagcgttggcaccaatggcttactaacaagaaggtgactaacggtccgaagaaggtaaggccgttggccccggccggtttcggcggcaacggcggcggc

SEQ ID NO: 37933 - DNA, 389 bp, Zea mays
  Clone ID: LIB3060-028-Q1-K1-B4
tgaccgtccatcgtcctgttcagggttccgatttccgcccaacaatccgccgccgccaacaatgcttcgtcgttccatccttcgaagcccttgcactacgtactatcgtagccctcttttctttatagctggtgttgtctattttgatttggtaattcaggccccgtagaatgttttcttttgttttatgcatgcaaaggtcgatttggtgataggagcggtgatgattttgtggactagagtttccgatactaccacggtagtatttgacgaccaaacccttggctgtctgagctcctaaatcacagtcttcgaccacttcgctgtttatatatatacatgcgagatctgcggtctttattttcttctgcaatgcaatggtatgatga

SEQ ID NO: 37934 - DNA, 378 bp, Zea mays
  Clone ID: LIB3060-028-Q1-K1-B6
gaatacccggatcggcccacgcgtacgctcacgcatccggcctatcctgggtgtagttttaacagcgccgcaccacctcgtgcggtgagggatcgatctcatcgatgcgacgctcctcggagagcagcgcctcctcctgcgcggtcttctttggcgcgagggcgggcgggacggatggcgccgaggatgatgcggcggcttaggatctagggttagggttcgccgccgccgtctgagctgctgcgtcgaggttgctggggtcggaaccggtagcagctgctgcggaattcgcggagaccgccgacgtgccggccttggcgaggacctggctgtgctcttcgcggcgcttctggagctgcttctgctccagctccgacc

SEQ ID NO: 37935 - DNA, 428 bp, Zea mays
  Clone ID: LIB3060-028-Q1-K1-B7
ccggtcttgaattcccgggtcgacccacgcgtgcggaagacaaacgccggcacgcgcacgcagacacgatggcgatctgcagcgcgcacacgaccacgggcctgcgctccccatgcacgaccgtctcgaacgcaggtctgaggcagaagcaagtcatcttcgtcaccagcaacaggaggagcggcggcggcaggaggcacggaggggcaaggagcttccaggtctcgtgctccgtcgacaagccggtggtgattggcctggcggcagactcagggtgcggcaagagcaccttcatgcgccggctcaccagcgtcttcggtggcgccgcggagccgcccaagggcgggaacccggactccaacacgctcatcagtgacaccacgacagtgatatgcctcgacgactaccattccctggacaggaacggc

SEQ ID NO: 37936 - DNA, 282 bp, Zea mays
  Clone ID: LIB3060-028-Q1-K1-B8
aaaaagaaaaaaaaaaaaaaaaaataaaaaataaaaaaaaaaaaaaaaaaaaaaaaagggcaacggtttctatctgttccatgcttacgtacctttccttccaatatcttacttcttctatcttttcacctaatttcaattcactggccttacttttacaacttctacaattgggaaaaccctaaatgccacccactttacttcgccttccaccccttccccttttccccattctccttattacccataatccccaatcctatctcctttcccatcatttcc

SEQ ID NO: 37937 - DNA, 376 bp, Zea mays
  Clone ID: LIB3060-028-Q1-K1-C3
cgctccggaattcccgggctctattcccattccaagtccgcgctcttggattcccgacgacgagctcggagcttcttcttccctgctcggtgctcgtggcaacgagctgccgccatgtctgccgggaaccagctcgccgctctggtcagcaacatgtacgccacgggtttgcttgacgatcagttccagcagctccagctgctccaggaccccagcgcccctgacttcgtctccgaggtcgtcacgctcttctgtcaggacggcgagcggatcatcgaagagctggccaaactgctggagaagcccaacgtggattttgacagggttgacgcctttgtgcatcagctcaagggaagcaatgcaaatattggtgctc

SEQ ID NO: 37938 - DNA, 403 bp, Zea mays
  Clone ID: LIB3060-028-Q1-K1-D11
tgcttatcccctcctcctcccagtcccagccatcgcctcccgatggcgtccctcgtgacgctccccgccatcggcttctctaaccccgccacagcctccggcgctgtccgcctacgcgccgcggccttccgctgctgggcgctccggcggcgcgggtgggcggtggcggctgccgtggcctcgcccaactccgtgctcagcgagcacgccttcaagcggctccagctcgggagtgacgacgaggacgaagaagggccgtacgggagcgacgccgacgaggggttccagggggacgaggaggagctcgccattgccaggctcggcctgcccgacgagctcgtcgccacgctcgagaagcgcgggattacgcacctgttccccatacagagggctgtgttgattc

SEQ ID NO: 37939 - DNA, 348 bp, Zea mays
  Clone ID: LIB3060-028-Q1-K1-E11
aaccaaaccagggcgaagcatctagtacagcatgcaaagcactgtcgtccattgatgcatggacattcagcagtcggcgcctccgcaatcaggcgttcgcaccaactaatccagccttttgagctgttgactgtccaatatggccccctgtacatgattacccaatcaacactctggggatgcggacaaggtgctaaaatcagctgatcatggtttttttctttatttctattgtgtacacgtacaatcccaaccaacgttttccccttgttcccatctgattataggcttgtgtatactgtggggttaaatgattaataaattctggtgttagctaatcaaacatac

SEQ ID NO: 37940 - DNA, 412 bp, Zea mays
  Clone ID: LIB3060-028-Q1-K1-E7
actaaaacctatcgtctgagtatcaggctaatgacattttgtctttacaatactgtgatgcaataaaactgggcaaaccattgataccaccgtatacagtaactcaataccatccaattctatgaggattaaaaatgtattggaatggattggtatgtattttgacttgctataaatttaaaccaactcaataccatccaattcacttagattaacggtgaaacgaacaaggcctaaggggagtggtaacagtctaacatcattgtacaacagcctttccgaagcccatagacattgtgagacaagatccgtaaaccatgaatcgttcttcacttaggatgaccatcttagctggtcacgaaatggtaccgggaatccacaaatctctcaacgtcccagaggaacgatcctg

SEQ ID NO: 37941 - DNA, 246 bp, Zea mays
  Clone ID: LIB3060-028-Q1-K1-F7
ctcgagtccaaccccaattctgccgtggccgcggcgctctgaatccccaattttttcacttcccccaagggccgcggggatgaaccggatcccgtccgtctcgctgcggggcggcggggcgaacgaggacgccgcggcggcgtcgccgcccccccgatcccgcggcgctgtcgcggtgggtgcgggccttctgtgtcatccggttcgacctgaagcgcggccagctgttgaaggcctgtttccttc

SEQ ID NO: 37942 - DNA, 414 bp, Zea mays
  Clone ID: LIB3060-028-Q1-K1-F8
tgaatccacagaatgataaatagagactggggccatatccaccagaagtaaacaagacatgcaaatacgttccacacattacagcaagcggattaggacaattcgggctacattaagcaaataaaagctacagatttacagtactagcacatgtgttgttgaagtcggctgatttcatctttccaccagaccaccactgacccctatgtacagcacacagacaaccatcgcatccacacccacactaccaacctaggtatccagtttctggcagtacgtacaccagatccttcctatatatgcatgaaccaacataaggcatcaagctatcatcaccaaatcaacagagtatcatggaagaatcccaaaaagctgccccatctctctctccatgaagcacacacttggaactta

SEQ ID NO: 37943 - DNA, 405 bp, Zea mays
  unsure at all n locations
  Clone ID: LIB3060-028-Q1-K1-G5
tagttctctgatcctcagcacttagcatcaagcttagcacaccggcgagatggcctgcacctggaccttcctgtccaccctcgccagcaggtccgcggcagccgatagcctgcgcagcgccgtgccgtccttcgccaagatcgtcaggttcttgcccgcgcaggcgcagatcagccgcaggcggcgcgcggcggtgctgcccacgccgagggcggcgctgtcgggcaccgagaaggcgccgtcgagcaagcacgagcgcgtggtcagggtgcacagcacccaggagttcgacgacgcgctcaaggccgncaagaaccggctggtggtggtggagttcgcggcgagcgacagcgaggacagcagccagatctacccgaccatggtgcaactcagccgaacctgcgg

SEQ ID NO: 37944 - DNA, 330 bp, Zea mays
  Clone ID: LIB3060-028-Q1-K1-H4
gacgcctgggagggtgagagccccgtccggtccggaccctgtcgcaccacgaggcgccgtcggggaagcgggagtttgggatgatcgaagacagcaaggcccgtacactggacgagaggatcaagaagcagaggcgtgcactgatgaacctacatcttcgtcgccacgacctgaccaaggaagtgaccaggacgctcatggacctggctgagtgatgcagtggactgagctgagtatcatctaagaattctattttatggtatttaagtgcactgatgatcgattaccagcaaatgttgtatgacctactcaagcatggtaggtgaatct

SEQ ID NO: 37945 - DNA, 358 bp, Zea mays
  Clone ID: LIB3060-028-Q1-K1-H5
taacgagagagagggagagagagaaagagagaaaaaaaaacactcggaaacgatccgcgaacgagtccaccggcgatttgttgttttgttcttcagtgcgtcagccaaccttaactgctacgatcggtcgatcaagggggaggaagtttctggagctctgcccatggcgtcggcgatgaagctgctggggagatctttcttggcgagccctgctgccgcggcgcccggacgggagcggcgaggcgggccctgcttcgccgcggtcggaagggaggggagcgcgcacaggaggaagtcgtcgctgaggtcgaccgcgccggtgggcgcgctggccgaacgggtcgtggtgacgccggcg

SEQ ID NO: 37946 - DNA, 345 bp, Zea mays
  Clone ID: LIB3060-029-Q1-K1-A10
cccggctcgacccactcgtccgatcgcacagggccttgtgctactcgctttctcctctaccatactttccctacagcccgggcgggttcacctaccctaccgtcactcgcccccaagcactatgccaatggcgcgccccgtataactgttcgcgagataggactagaccttgaagcctctaccccttgaagagagcgagagatgtatcaacaggagacagccattagagccactcagctggaccgcaagcggatcaaacacgcgcatgatacacacctactagaaggcagtctagttgccgtccacgtctagctcttcaaccagccagcatactcgaccacacac

SEQ ID NO: 37947 - DNA, 429 bp, Zea mays
  Clone ID: LIB3060-029-Q1-K1-A8
cggtctcggaattcccggctcgacccactcgttcgtgcatggctactgccccctattcgttctcgccgtatagctcctgcatcgcgagtgcggcttgcgccatccgctgcccgtggtgccgctgttctagaggctggccgacctgcagtcgacgccctcgttcatggagcgcctcttctcggcggactgatacatggaccggatcaagggcaagcagcaggtcatggtcggctactgctactccgacaaggactcctgccgactgtccacggcgtggcagctgtacagggcgcatgacgagatggcgcaagtggccaagcgctacggcgtcaagctcaccttgttccacggcctgggaggcaccgtggacaagggtggcggtcccacgcaccttgccatcctgttccagccgccggacaccatcaacgg

SEQ ID NO: 37948 - DNA, 414 bp, Zea mays
  Clone ID: LIB3060-029-Q1-K1-B12
tctgccctgcgaatctccgagggtcctcggggcgacacgtacgccgttccgtccagggcggaaacgaaccttcaccggcggggaagctcaatacaggcacgatgcatccaggcacaaatcgatcgatttagaaacaagaatcaaaggtgtgcgagccgagagacgaacacgagagcaaatccttccttaatattcatggacagcgcaacgctgacctgcaacaaccgaagccgaccacaggcatccgcaagacagcaagtgaagctcagatcggcgaactgcggccttctgcgcttcgcctaggagcctacggagtactgagaacagagcagcggaggatcatggcacaccttcaattcttgcggcgccagaagcagcggagcttgagccggcgcgctaggacattggcgatcg

SEQ ID NO: 37949 - DNA, 442 bp, Zea mays
  Clone ID: LIB3060-029-Q1-K1-C3
tccggaattcccgggcttagtcagcagatattcaatgagctggtggaatgtggatgcctcacggaggcatcgcttggggctttccgtgattgcgatttgcaggatatttgtctgggagactaccctggagttactgaagtctcttaatcttgacaatcgccaaatcacagatactggtttatcgtctcttacaggtctcactggattgacacacctcgacctatttggagctcgcataactgattctggcatgagctgcttcagatttttcaagaatattcagtccctggaggtctgcggcgggttgattacggatgctggcgtgaagaacatcaaggacctgaaagctctgacgttactcaacctgtctcaaaacggcaagctcacagacaaaaccctggagctgatctccggcctgactgcactggtgtcgttgaacgtg

SEQ ID NO: 37950 - DNA, 428 bp, Zea mays
  unsure at all n locations
  Clone ID: LIB3060-029-Q1-K1-C4
tgctgatcctaccaaatcccctgcctttattttggctgggggtcccggtcctaacgttttcgttttaacaggcacaagggccacccttgctgttcctattggaggatgtaacaggctaatggatatccccatgagcaactgtctcaacagtggcatatacaagatattgntatgactcagttcaactcagcttctcttaaccgtcacattcatcgtacctatcttggtggcgggatcaacttcactgatggatctgctgacgtgctggctgcaacacatatgcctgcggaagctgctgactggttccagggcacagcagacgccgttagaaaatttatctgggtactcgaggattattacaagcataaagctatagaacacattttgattttgtcaggagatcaactctatcgtatggattacatgga

SEQ ID NO: 37951 - DNA, 459 bp, Zea mays
  unsure at all n locations
  Clone ID: LIB3060-029-Q1-K1-C7
accggttcggaattcccgggcggagctatgtcggttggatcaagggcagctgcttgtgcgatatctcctgaatgtgttgaactctgggagcgacatgccatcccaggagcagctcatgagagctgaggtgtctcttaaggaatggatagagcgagcaagtgaaaggtcttccaggcttgatagttgcttggcagcgctacaggagctttctggaaaccttagcctgatgaaggttaggcattctgctaaggggaaagtgctcatgcgagcattgtatggaatcgaggctgttaccgtcttaatctgcagcgtacttgtagctgtactgtcgggtaccttcaagccactggtggactntgatgtccctgagaaatttggttggtctacggccttcattgatcttcagaaagccataagcggtgaacttagcaggcaactgtccataggtagtgttgcagc

SEQ ID NO: 37952 - DNA, 362 bp, Zea mays
  Clone ID: LIB3060-029-Q1-K1-D12
cggctcgacccactcgtccgatgcaaacgagacatgcaaggaatccttttacttctcatcgcgttctcctcctcctcgctctggcgtcggccgccgcgggtgccgtcgccgtcgactcggatgaccctctgattcggcaggtggttcccggtggagatgacaacgatctggatctgaacgcggagtcccacttcctgagcttcgtgcagcggttcggcaagtcctacaaggacgccgacgagcacgcgtaccggctgtccgttttcaaggccaacctgctccgcgcgcgccggcaccagctgctggacccgtcggcggagcacggcgtcactaagttctccgacctcacgccggcagagttc

SEQ ID NO: 37953 - DNA, 393 bp, Zea mays
  Clone ID: LIB3060-029-Q1-K1-D2
tgcaatcctcgctcgcccacgctcggtagccatggcgtcgtcgcgcaaccgtacccggagccgggaccggcggccgtgtggtggtcttcccgttcccgttccagggccacttcaacccggtgatgcggctggcccgcgcgctgcacgcccgaggcctcgcgattaccgtcttccacagcggcgccctggacccggccgactaccccgccgactaccgcttcgtgcccgtgaccgtggaggcagacccgaagctgctggcgtccgaggacatcgccgccatcgtcaccacgctgaacgccagctgcgacgcccccttcagggcccgcctctcggcgctgctggccgccgaggggagggacagcgtccggtgcgtcttcaccgacgtcagctgga

SEQ ID NO: 37954 - DNA, 401 bp, Zea mays
  Clone ID: LIB3060-029-Q1-K1-D3
tgcgatcgtcgctcgcccacgctcggtttccatggcgtcgtcgcgcaccggatccggagccggatccggcggccgtgtggtggtcttcccgttcccgttccagggccacttcaacccggtgatgcggctggcccgcgcgctgcacgcccgaggcctcgcgattaccgtcttccacagcggctccctggacccggccgactaccccgccgactaccgcttcgtgcccgtgaccgtggaggcagacccgaagctgctggcgtccgaggacatcgccgccatcgtcaccacgctgaacgccagctgcgacgcccccttcagggcccgcctctcggcgctgctggccgtcgaggggagggacagcgtccggtgcgtcttcaccgacgtcagctggaacgccgtgc

SEQ ID NO: 37955 - DNA, 429 bp, Zea mays
  Clone ID: LIB3060-029-Q1-K1-E4
gattcccgggtcgacccacgcgttcggcagctaagagagtggatcactcagctagtgctagtcccccttccttcattgatcgatggcatgcgtaagaaccttccagagctgccccattgccagaagagcaaagatcaacaccaggtccaggggcagcagcagtagcgtggcgaaggggtcaccaccaccagccttccagttccagtgcagggcgtcgactttcgcggcggacaccagcctccggctcgagctggacgagaaccccgaggcgatcatctcgggggcgtggcccgggaactgctccctcctcagctacgacgacctccgcgcctacctcgagtcgcaggagacggcggcccaggcagacggtcagcgcggcgtggcgctcctgagcgagaccatgtccacacccgtgctggtggccacagc

SEQ ID NO: 37956 - DNA, 434 bp, Zea mays
  unsure at all n locations
  Clone ID: LIB3060-029-Q1-K1-F11
ggctcgacccactcgtccggcgagatgaagatcaagacgatccatattaacgacatgatcctgactctgagggggagttggatgaccacaaggctgtggaagagtcatcgaggaggagcattctaggtataaaaatcacgagagaatttggtgaaaatgcgaccagagtacaggatggtggcaggattgcatctgaacatacaggactggaacccatggcagatgacattggttcctccaagcaagctcctgcagatgccagtgcaatggccatcgatgaaccatgctatgtccataatgaacctgagagctcaactaaattgcaaggccaagcatctgcgtaccacaagccatagctgcgaccatcaagagttgctgggtatctgctatgcaacttnctgcttgatttggacagtccaaaaaacagaagtgaa

SEQ ID NO: 37957 - DNA, 275 bp, Zea mays
  Clone ID: LIB3060-029-Q1-K1-F2
gcttttcataaaaaaaatatatagaaacgaaaataagtgttctttcagttcatttgcatccgattttatccctaattgcaagcacaatgcttactgatgaaaatcatgtactacttcgattgaagaataaataatcacttgatcaggattgctgttgtaccgtatgacgtggagtaacgcgacccaactaaatacatgttaaacagctaaatacatgactactaccagaacaatccgttcccaactaaacagggcttcatgtccactttgccgac

SEQ ID NO: 37958 - DNA, 461 bp, Zea mays
  Clone ID: LIB3060-029-Q1-K1-F4
cggaattcccgggtcgacccacgcgttcgaacattggccaaggaaggagggcccctttttagtatctccttggcaattgaatgatgaaatggagtaccaatacttctttttaaagaaatcttttgatgatggtggctcatgccttggcccttttgaaccttcacccgtaataggggtggtaatggatcgcgatccaaatgttccttcacaaattcttaggtccttaaataaattttagttcaaaaatgaatagaaatagagcccgaacctaatccgagccttaaattttatagtgtaaaatttagagtccattgtcacccctccgtacacagctattactaatttgttgctgtattgatcatagcatgttttgacctcatgctatgcatgaataattgttctgaatcttgtgcatgttttgacctccagcagaggtttgtaccactttaatttagcagttt

SEQ ID NO: 37959 - DNA, 348 bp, Zea mays
  Clone ID: LIB3060-029-Q1-K1-F9
tagacccagacctcgttcagctagccttttctaccttcctctcccaacccgggggcgggcttcctcgagagctcgttactcatggggaactgcgccgccgtggatgggaacgcctagatcaacccttccttcagtgcccccaattcctcagggaccgccggttctaagagcgtcatcaagaactccgtcgactccgtcaccttctgcaccaacacttccggctcgtcgtcgtctgtgccgtctacccctcgtacggaggctgagatcctggagtcatcgaatgttcgcaagttcagcttctgcgagctcaaaggctccacgaggaacttcaggcctgacagcctgctc

SEQ ID NO: 37960 - DNA, 433 bp, Zea mays
  Clone ID: LIB3060-029-Q1-K1-G2
cggaattcccgggtcgacccactcgtccgcaacttgctccagagaaaatatcttctcaaggatgatttcagctagaaggttcgagctttgcagactttgggatacatacttattgcgaagcctgaatttatgctacaaaaggatatgttgaatctcatagagacagcactctcttctgaggttgattatagattcaagattcaaggacttcaaaacctctacgagtatcttagagatgctgaaagccaacttactgctgagagtactgcgaaacctcctgggcagtgtgaaataaatggcagaagtgaagtgtctgttgctgctggtgctggagacaccaacatatgtggtggtattatccaattgtattggagttctattcttgaaaggtgcttggatacaaatgatcaagttcgccagagtgcacttaaga

SEQ ID NO: 37961 - DNA, 432 bp, Zea mays
  unsure at all n locations
  Clone ID: LIB3060-029-Q1-K1-G3
tctctttcctctcttgccttcgtcgccctggcttaaccgcctccttcccctgctctggttgctccctttgctaacgcccgcctgtttgcgtctggaccgcccagggcgcgggggcaaggatttgtgaacaatgcccggggctggagtacggcctgccgccgttcgtcgccgttctccgggcaagctgccccgtctcgacggaagggtactcgccccccgaagaggttgttaatggggaagaacttctcaggttgttggatggcaaggaagagcacacagctgtccttttctatgcatcatggtgccctttctcagaaagaatcagaccagtncttgatgatctgagctcaatgtttccacgggttaagcacttggctatcgaagagtccaatgtcacgaaagccatttagtcgagatatcatgtccgtgcac

SEQ ID NO: 37962 - DNA, 435 bp, Zea mays
  Clone ID: LIB3060-029-Q1-K1-H4
cggatttcggagttcccgggtcgacccgcccggtcgagtgaattcattaaccggatttagctcttttccagcacccttggcaccaaaggtccgggttgagtccatccatatcccaaaatggtaactgatgaaatcatagagcccattaacatgtatcataagttcgtatcaattgatggaacatggataaacgaagttcatagctcctataatgaacagatacacgcatagtacatagacatcataggatccatatagtacaccttaagcacaaccactgaaagtaggcacatgagctatataacagcacaggagccatgctctttcttatcagagttcagcttcttatgacattctgctagaagatatttgagaaagcattccaaacctgcagaagcagagcatatacctcagcgccccctttcaaagttgatg

SEQ ID NO: 37963 - DNA, 442 bp, Zea mays
  Clone ID: LIB3060-030-Q1-K1-A11
ccggctgaattccggtcgacccacgcgttcggtgttcttgtgaggagagaaaccctcgggtccgatgatgaagaagtgaggcccgtgcgacgtgtgctaaatgttcagtagaaggttcgaaccaaaattcatagtcgatctcgtgatttcaagtttggtttagttatggttcgttacacgtgatgcgtaagacaagagccgagttgatctcaatatgatgctggtgaacgagaccagctaatggatgatctgatcaagtgctaggacggacgatgctcaccaagtggtcgtcatctaactacactaacctaatgttatcccaggttataagtatgttccgctgcggatggtgctaaatgccggtgggctcggacttcttatataagtatatccgatctttagcttatttattgaagattggcacttaagctagcatgtattt

SEQ ID NO: 37964 - DNA, 488 bp, Zea mays
  unsure at all n locations
  Clone ID: LIB3060-030-Q1-K1-B12
accggtcctgaattcccgggtccgcttccgcttcctgcgcctccaggctccacttctccgctcggcagtcggcactggaaggacagcatgtcggtctcggcgtcgtcaccggcggcggcggcgggcgatgagaagcaggaggcggcgcccgtcaggcgctgcaagggcgtcaacgacctcgacaaggtcgttctccgcgaggtccggggcagctccgcagaggtgtacttgtatggtgggcatgtgacatcatggaaagatgagcatggagatgaattactttttgttagcaataaggctattttcaagcctccaaaagctatacgtggaggaataccaatatgctttccgcagttctccaactttgggaatctggaaccacatggatttgcaaggaataggacatggagtgttgatgatgatcctncaccatttccagtgccaacctccaatagcgcttatattgacttgatcctcaaacctactga

SEQ ID NO: 37965 - DNA, 327 bp, Zea mays
  Clone ID: LIB3060-030-Q1-K1-B5
tatgcgaccaccgcgtcaaatgcagaggagagtagctgggggacgtactgccctggcgagttcgggagccctccaccggagtatgacacttgcttgggagacctgtatagtgttgcttggatggaagacagtgatttccacaatctgcgaactgaatctctcaagcagcaatacaacttggtcaaggataggacagcggttcaagatacattcagctatggctcccatgtgatgcaatatggttcattggagttgaatgttaagcatctggtttcgtacattggcacaaaccctgctaacgatgacaacacgttcattgaagacaac
